United States Patent 11,001,841 (CCCTC-BINDING FACTOR (CTCF) RNA INTERACTOME) - sequence listing, part 13

SEQ ID NO: 31877 - DNA, 1209 bp, Homo sapiens
atggagataagtatattaagaaggtacagatagagcagttgaagctgtttgggtaggtagagtattcctcctggcgggtcagaaaaggaccatggtattcatgctgggtgtaggaggaccagcaagatttaagccttggggggagaaggaggtataggaacagaggagcaagtcaacacaactagctagaagttagcattatgaaagggaaaacaggctagaaggacacagaggccaaatccaaagcgcttaatgccattggacttggctttgtggctaaggggcatctgctgaagctttttgcacaggagtctgtcaggctcagagctgtggtttagagaaacttgtccctcagcaaatgttattcatttgttcagcaagtattcattccatgcctgccatataccaggccctgctacaggcactgaggatacagcaatgaacaacacagtgcctgccattgtgaagctggtggggagggagagaggcagtcaacaagtaaacaaatcaaaatataatgtgtcagatgactctcagtgccatggaggaagacaaaacagggcaagggcatggggagcgagggcagggatgccttctacaataggatatgaggagacctctgtgataaggtgacatttgagaggaagtaggtaaggtagatgtctgggggaaggacattcctggagaggtaacagcaagtgcagataccccaaggtggttatgagcctggtatcagtgggaatggagacatgggggcagattttaggacatttatggaaaataaacaagatttatgattaattggatgataggtagatgatgtggcttgaggttggtttaaggcagggatgcttaccactggctacactttaaaatcgtgaggggagcatttaataattccagtgtctgtgctctattatttcatttatgtgaagttcaaacagacaaagtatcaagaatgtacaagaaactgatcattcagtaacagtgagtgattgtattgtgactgtaaattgtattgtctaatacaatttaaaaatgggcaaaaaatgtgaatagacacatcacaaaagaagatatacacatggtcaacaagcacatgaaaagatgctcaacataactagtcaacagagaaatacaaattaaaaacacattgagataccattttatttttattttattttaattaattaatttatttatatttta

SEQ ID NO: 31878 - DNA, 1035 bp, Homo sapiens
ctggttgtaatattatactaaagttctgcaaaatatcattgtggagaactggaaaagtatacaggggatctctattattttttacaactgcatgtgattctataaaaatctcaatataatttcaaattaaaaagcaaaaaacaaagggcagtgtcctacagatacttctggctagagaaacaaagtgggctggaattaacaaacatctgtatactgtacatgaggaaatactggtgacccagattggattcgccagcttcttggatgataaaatgtcaagcttataaactaaagaaaattctcaaaagaattttgggcagaaaaaaaaaatggcatgagagccttagtggtgaccgtggaaaagtaacaaacctagaggaaaatcatccctgctttttaaaaaatgggttactgcaaaaatgatatcctcgtcaaaaataatccttggattgctggagcaaatgttacccctttcccaaactttctaatacatacattctagaatgtcggttctgaaattctcttgcatccttaattttctcacagcatgttcttattttaatgaaaacctggctttctgctaggatccatgctttccagaagccctctaagtagacctggctattccttttcctatgccacatagtcccatcgtggtcatgaggcaaacgaatgatactccccactacacacaccatttaaaaaaaaccctaatcctttgaggctcacatctacctgaatcctactctttatcctgtctctctttgctgccacctgtatattatacgtctcccaccctcagctcaccaggcagcaattggagaccaacgggaaagatccatttttcctttatcaggaaacttcgggtttatacctgcagtgctgatggcagtctagtgccgtatcttatgtatgcatgtctatgggatgggtattcattcaccttatgaggaaaaaaaatagaaaaacaactgccaaggttttcaaattatgaagtcctggataaatatttgggcaggagctgtggctcacgcc

SEQ ID NO: 31879 - DNA, 1048 bp, Homo sapiens
ctagccccaagagatactcatggtataataactaaattggatttggggcctgcaaagctgaggtctagaatgagagctgtgaaatggagagagccaaatgaggccttggttttaagctgtagcagaacttacttccattaccaggcaaaacagctaaatctgtagtaattaatatatgtgactactaaaataataaagataactgaagagaatttcacattttacaaagcactttcatgacctatttgattatcatgataataaaggtactattaccgttttaagaagaaagttgaggtttgtgacttgactaatgaggtcaaaactcaggtattcccacttctgactttgttcaattcatttttgtttctcatagtaagagtagggccactgtttatgttatgtttacttattggtgggagagagaatttcagtgatgggaaatatatttggtgactattatcattaagataaataagcatgggtaaaagtcccactttaaagttggaactacatggaactgtggggagaacctaatttagggattaggaaaaaaagccattacacccacacaagtatgcacagctgatttttaaaacctttattgtggtaaatatacatataaaaattaccattttaaccatttttaagtgtacaatacagtggaactaagtatattcaaaatgctatgtaaccatcaccaccatccacctctaaagtcttttcatcagcccaaacagaaactccatgccctttaagaataacttctggttggatgtggtggctcacacctataatcctagcactttgggaggtcaaggcagatcgcttgagcccaggagttcgagatcaacctgggcaacatggcgaaacaccatctctacaaaaaatacaaaaattagctcggtgtggtggtgcgagcctgtggtcccaactacttgggatgctaaggtgggaagataacctgagcccaggtggttgaggctgtagtgagctgtcattgcacgactgcattccagcctgggcgatagagcgagaccctgtctca

SEQ ID NO: 31880 - DNA, 1077 bp, Homo sapiens
ccccacctgcccagctgttactggggtctgcagttgcaacagcatttttgacattatcctctgatgctcggaacagctgggatcctagaaaggaggattcactaagtctggggatctgataacatttaactgctcttgggagcttagtaaagtggtttgggggagtgaattggtagcttcctcctgtctgcctcagtttctaaagggattttctaggcatgtttttaatctcttgttgatttcttttttctctttcttttgaaaaaatttttgttttatcatgctttgtcctggctgagccactaagccctttgttccccactccagttggtctctaaatttggtgcccaatatagaggaggcagaggcagataaacatggtggtgttgaagtaccctggtctgtgtggccctggaatgccaagaaggtgaggtccaaatggtgcctgggctattaacataagacagtgcttagaatccatgttcagatcctgcctccattctgtacatgctgagggacttggacacatttacttagcttctcccagcctctgtgtcccaatctataaaatggagtaatagaaatagtgttagcctcttaatgttggtttgaagattgaatgagaaaatatacctacagtgttcagtatactgcctggaacataaagtgttagaggctggtgattttgagtgtgtttttcaaggtaagagtgggttcatatttaatagttgttggtaatctgggaatcagtttcaggtgccgattggatccttggtagcaggatgggatgggaggtacagcacgggaatcagctgctggtcccagagcagtggaggggccaaaactccgcttagggcacgagtaagaggagtgataggaagaggcagcttttcctagtttgattacctccgcttttctaaaggaaagcaaacaaataaggatcaaggttgttgggtcccctttgaatcccttttgtctccttcaagagtttcaccactgagcactgtgatcacatccacccagcattcactcatcttcccttctccctgccccatagcctgatgactttcagctggt

SEQ ID NO: 31881 - DNA, 1032 bp, Homo sapiens
gaggttctaggacgccttcgggatccaggagagtttgcagaactgaggggtgacgtgtgaagcgagctgagggaggcgcgggaggtgggcggggcgggggtggaccctcagggtcgggggccggggattgggggtcgggggccgggggccggggacctgggcaacgccctggggcttgccagttcgagccctcagctcgtggcaggcactggcgtcgggtcctcaggcccttttgctttgggaggtgatgggtggtgcacatttggcgggggtggtggggagccacgcgaggtgcgcggagcgggcctgggcctccccaactgcctttgaaggcagaaccccggcaggcctgcagctgattcctgggcgctttgggggccagtagggcacctaccatgtgtgtccggtggtaagagcttgccacggcctgcttggcagtgccagagtagcctctgaagaaggaacccagtgaactcctgactccatgtgtgtgtttaggaacccgtctccagctcactgatgggaactctctgctaaagtatgtgaccgtcaggccagagtcttgcaccaggtgcagggcgaccagtgtctgcctactttattgccagccaacacttagagcgtactcttgggagaagcaaggctccgcgtggaaaaggatgacttcagggttatggggcgagcttgataggacttagtagctaagagcatagacagaggaggtttcattcaccaaatgtttactacaatatgtgccccgccttcaaatcttggttctcggctactagcggtgtgcgtttaagcaagtcacttatcctctcttagcctctgtttctttctctgtgaagtggagatgaaagtacagtgcctttatcacggggttgcagtggggatgaaatagtgccaggcaagtcctcagcccagtatgtctaacagtaagtgtgtggcaaatatcagcagtcgtggtgactaacgacagaaagtgttagaggtgcttggagtccaggttcatctttaatggtactagctgcc

SEQ ID NO: 31882 - DNA, 1026 bp, Homo sapiens
tttatgtcatctaagttttttaacttacaggtataaagttgttcacattattttcttgttatggttttaatttctatagaacatttaatgatatctccttttttattcctgatattggtaatttatgtctttcttcttttattcttaattagtttagctagaggtttagtttactgatctttttaaaaaacgtttgttcttattgattttcttctatcgattgatttctattttactgatttttacacttttaatattttcttcattttttcctgttttttttttctagccccttcttagttctattatatgaaagattcttagattagattcctcagcttttctattgaagttttcattttgacaatcatatggtaatttccaagaactctttctggctttcaattgttccttttctgtgagtgtctgctcttgttgtatgaatacaggattttcttagttctccctgaggctgctgtcctttttttaaaaaaaaccctctctcctgttctcagaattatctgtttcatctggattcattttcttcttttttgccatggggtatatgtgcatagctgtgtgtctgtctgattttcttcatgaagacttttctcaagtgtttggtgagtcttggctatctgttcatattgagaattagccagtagcatggctggctcaggccttcatgatatgggtgaggttttccaagaggcaaagactttgctttatgatagaagacaaaggggagagggggagggtgcagaatacactgcccatcccccaatgccagaatgtggaaggtgttttgagctcccttagtcctcctaccttccaccccaagaaagttcacttaatttgtttagtaaagatctattttgtgtgtgcatgtgtggcacatgtatgtatgcatctgagagttacttagctgcagccatttgcacataggattatagggagagatgaacttccatatcactcttcctaccattatgagggcattgtccaggtacaaagcctttccaaggc

SEQ ID NO: 31883 - DNA, 1988 bp, Homo sapiens
gttcgagcttcccagctgctttgtttacctactcaagcctcggcaatggcaggcacccctcccctagcctcgctgctgccttgcagtttgatctcagactgccgtgctagcaatcagcgaggctccgtgggcgtaggaccctccgagccatgcacgggatataatctcctggtgtgccgtttgctaagaccattggaaaagtgcagtattagggtgggagtgacccgatttttcaggtgccatctgtcacccctttctttgactaggaaagggaattccctgaccccttgcgcttcccaggtgaggcgatgcctcgccctgcttcggctcacacttggtgcactgcacccactgtcctgcacccactgtccgacactccccagtgcgataaacccggtacctcagttggaaatgcagaaatcacccgtcttctgcgtcactcatgctgggagctgtagactgcagctgttcctattcagccatcttggctccaccctcccacagtatcaaaaaaatctttagaaagcataacttactaaaactggcaagatgaaatagaaaatctgaatagcttaatatctccttttttaattgaatgtgtaatttttaaaatattttccataaagaaaagtattttacaaatacagtccccaacttataatggctcaaattacaattttatgactttactgtaggagtatgagccagagacaaaactcctcagacatggagttaaagaaggaaggggtttattcggccaggggcattcgaagattcctgtctcaagagccgagctccccaagtgagcagttctgtcccttttaaaggctcacaactctaaaggggttcatgtgagatggtcctgatcgattgagcaagcagggggtatgtgactgcgggctgcatgcaccggtaatcagaatggaacaggacaggatgggttttcacagtgctttcccatacaatgtctggaatctatagataacataacctgttaggtcaggggtcgatctttaactaccaggcccagggtgtggcgctgggctgtctgcctgtggatttcatttctgccttttagtttttacttctttctttggaggcagaaagtggggataagacaatatgaggggtggtctcttcccttattgcaatgatatgaaagcaatacacattcagtagaaaccgttcgaatgcccatacagccattctgttttttactcttactgcattattcaatagatggcatgaaatatttaagactttattataaaatagaccttgtattagatggttttgcataacagtaggctaatgtaagagtgctcaggacatttaaggtaggctaagctatgatgttaggtaggttaggtgtattaaatgcacttggaatttaacagtattttcaacttacagtgggtttatcaggaaataaccccatggtaggtcaaggcacatctgtagttaattaattggcccctcagggcccctcatgttgattagtgtttgtttttccttcccttgagtctgaacttgtgacttgttttgaccaaaagcatgtggcagaagtgatgctgtgtcatttccaatgctgaaacttaagaatctgttgctccagagttcaccaattcatctattccctctcctaagtcaaatactatggcaaaagtctgactaccctgagaccaccatgctgtaaggaagccttgctagccatgtggagagagaaaccatgtgcagagcaccaaggcaccagacttatgagtgaaggctttgaattcccagcccgcccaccacctgaatgcagctgagtgaatggccccaaccagtattgtgtggattaatgtctgcccagattagcttgaattactgacccacagaattgtgagaaaataaaatggtgatggttttaagccactatattttgaagtagtttgttaggtagcaatagatcatcaaatcaccttcacacgatgcattgataactcctt

SEQ ID NO: 31884 - DNA, 1091 bp, Homo sapiens
aggagaatcacttgaacccaggaggtggaagttgcagtgagccgagatcgcacaactgcactccagcctgggcgacagagtgaaactttgtctcaattaaaaaaaaaaaaaagtgaagtgcaaaatgtgactgaggagatacagtactctccaaattgcataattttgccaatttttatagaaacctggggaatctgtagagatagcgtcagaagcattggaacgagagcaactccatgttgaataggggctgggtaaaagtgtcagaggtatttgaaccagagcgactccattttgagtgagggctgggaaaatgaggctgagacttactggcctgcattctcagaaagttaggcattcctaccctctaggattgaattgggacccctttcctgtaacatatttctggtgaccacagaagggactatagtgcagaaacgttgacccaacggctacctttgcgtaagtgttggggtcctgtaacatatttctggcaaaccacagaaaggatgatactgaagaaatccccccaaccccaaagaaatagactgcagcactgattggacgactttgggtaagtgatggggtacccgagtaacaaatgggattgggttagaggcccaacttaggggagttggagtttctcctaagacagagtgagttagaggcccctcttaataaaaggcaaggacacttgactgacctcaggttagaggttactccatcctactctatggagtagctgtcctttcaccactttactttcttaataaacttgtttttgctttgcactgcggacttgccctgaatcctttcttgcacgagatccaagaactctcttaagagtctggatcgggacccctttcctgtaacaaaatgaggctgagacctactgggctgcattcccagacggttaaggcattctaagtcacgggatgagataggagattggcacaagatccaggccacaaagaccttgctgataaagcaggttgcagtaaagaagccagctaaaacccaccaaaaccaagacggtgatgagaatgacctctggtcatcctcactgctaccctcccaccagtgccatgaca

SEQ ID NO: 31885 - DNA, 1028 bp, Homo sapiens
gctgggcatggtggcacgtgcctgtaatcccagctacttgagaggctgaggcaggagaatctctagatcccgggagttggaggttgcagtgagccaagatggtgccactgcactccagcctgggtgacagagcaagactctgtctcaaaaaaaaaaaaaaaaaatgccatggcaacatcaggaagtaacactatatggtctaaaaaggagaggaaccctcagttctggtaattgctcacacctttcccgggaaacttatgaataatctaccccttgtttagcatataatcaataaataaccataaaaataggcaaccagcagcccttggggctactcttcctatggagtagccattctgtatttctttactttcttaatattaactactttcactttgtggactcgcccgaattcttttcttgagcaaggtccaagaactctctcttggggactggatcacgaccgctttctggtaacaggagcaatacaaatggctattagtaaacgaacgcttaagtaactctagtacatctatgatgaaataccaggccacagtttttttaaaaatgaggatgttctctatatactgacgcacagtcaccaagacatgcactttataggaaattataagctcctccttgcctaaatctccttaattttgcttaataaataacaagtgaagccagaagctgtaaactcataattttaatgaagaaatgggatccagaagatggagatgtttttcattctactttattagatgaggaaaaggagagtaaatacttgtatgccagctaccacaccttttaaagttaatgttaaccctgctaagaacagcaaggagattttatatcagccaggttttagttgccagaaaccacaccagttattttagcaaagaccttataaagaagtgtactatatttaagtagctaaaaaggcaagaagaaaatgccaaggtgtcttggaggtagcaactgctaagcagctgccaccccaggactgggggagctagaatagagtctcc

SEQ ID NO: 31886 - DNA, 1041 bp, Homo sapiens
cttatggctaatgttagtcctacaaaggcaatctagtccccaggcaagaaggagatctgctttgggaaagggttgttaatctctatgtttaaactattagtttctcccaaagttagttccatccgtacccaggaatgaacaaagacagcttggaggctagaagcaagatggagtcagttaagttagatctctttcgctgtctaagtcataattttgcaaaggcggtttcacttttctttaggcctattgttgggcaagtaggttgttttcaatgttatgttacagagtgctctagtgtacactcatgtaaatgtctatataccgtgcatctatttttccagggtagattcttactttatttcatttttcaatagaaacggagtcttgctgtgttgcccaagctggtcttgaattcctgggctcaagtgatcctcccatattggcctcctaaagtgctagaattacaggtgtgagccaccacacctagctctcacagtagattcttagaaggaaagttcctggggcatgaagaatgtgcctttttattgtaaatctttaactagaattcatttttttagtgtgtggttttatttgttatttaaatttggctagccagttgtcccaatgcaattcattgaatagtctaatctttcccactgatttctaatgctgcctctatcatagaccaaatatatatgtatgcataagcccatgtcaggattctgtatgtactgtttcttccatctactatttgcgtattccttcagtaatactcagtgttttcattaatgtagctttatagtaagccttaatatcaggtagaacaaatattttcaccgctaaaaagttatcttggctattcttggccttttagtcatttgcttgaattttagaatatgcttatcaagccctaagaagagatggtggaatttggttgggattttattaaccacacattaccttaggaagaattgtcatcatgaaaagatttgtctttccatacttaagatttattcaggtctattatgtcttatgtttatc

SEQ ID NO: 31887 - DNA, 1019 bp, Homo sapiens
acataggcaatattcttaatttgcccaacaggctgcatggggaaccgaattaacattttctatcccagcaaaacacacataacaaaacaaacattagtcaccttgttcagcacccaaagtcaacctgacgaagctcaaactttttcccattggtccctgttgtctttgatccataccaggtgggaaaggacaacctatgaatgttaattcacaatggggtctctgggcaaggggaagagcagatagtcaccccaagagacagacctgttgagcgttgagtcttctttagagctcatcgaatgtcaccagacaaataaggaaggttctttgagttaggcctgctggacttccatcagcaacccctctgagatcccttccacataaacacatgcaaagatgagacagacagccttctaaatcagatccctaaccaagctatcctcctattctcggtctgagaaacctcctcgaaatcttcctgattgagtagaagtcttccaaaccaggactcttcctcctggttagaaggagcacttcaggagccaaacagacacccagcagtggtgctacagacacagacaccccatggtagagctacaaacagacaccccgtaatggggctacagacaccacaccatagggctacagaagctgctgggagaaggaaggaggcattggcagcgcctaggatactcaccaatgcagacactctgcagtggggctacagacagacaccctgtggtagggctacagttaagggatgtccccccaggactatttctccattgctattaaatctgtgcacatggggtcagcagtgccccgccagtagagagagtaccagaatcagcccccagttccaaaagaactaggtggctgcttgggctggcttctggatccatcgctggaggggggccactgaaccatgggcaggtagctacaagggcagtcctggacaagcccccaaatttgtaaccgcccaaggagtaaactttgcctgctgcttagacagagctgat

SEQ ID NO: 31888 - DNA, 1449 bp, Homo sapiens
cctgcctgttggaagctgcagttttaccttctggttcttgcctgctcatcccctaccatactaagcctccagagtgtgggaatgtgcaccatttcctaactatattaactcactgccaccagtctggtgtgggtgctcagtacaagtgaatcctgaaaaagcctcaggctcttggatggaggaaaactggctgcatttgaaagccatacttcaatttctattggtcactgctagtataaactttaattattgatttaaacaaattttatctggatccaattatgttgataaattatttttaggtttaataatttgttagattcatttcctagcttttctaggtttagaataaataatgatttatttgtcttttgatgtcacttatgttgtgcattagcaagaacttcagaaaacatggaacagtagatgtctttctcttaacgcttgggggaatgtttttagtattctgcagtttcatatcgtgttcattgttggattctgatgttctgttagatttaggaagtttccttctaatcttatttctagaagaagcagtgtagtttagtggttaagagcacagattttgttcccagtgccctaggttcaaatcctgagtccaccactttgttaggtgtgtgatcctgggcaaatcacttaccttccttgtatcttattcctccatctataaaatggagctacctcatagggttgtgaagaatacattattgtaacaatactgggcacacagtgcacagtttcccaattattattatacttacagttttgttttctgtttttttttttgacaaggtctccctctgttgctcaggctggagtgtagtgatgtgaccataggtcacctcagccttgaactcctgggctcaagagatgctcctgcctcaacctcccctatagttaggaatacaggcatgtgccaccatgcccgactaagtttttatttttattttttgtaaacatggggtttcactattttgctcaggctggtcttgcggtcctggcctcaagcgatcatcctgcctcagcttctctaagtgctgggaatacaggtgtgagccaccatgcctggcctatacttaaaaagtttttattaggattggttgctatattatatcaagtttaaaaactccatcattgtaattttatgagttatggttttttctttttgtaattcattttcttgacaagtttgcaaatatttgcaatttccttgtacttttcaagtaaaatctatttgttcatagtgaatttttattaagtacagaagtagattcaatttggtaatgctttgctagctttgcaaaagaatttggaaaaaattttgtttatcttattgctatggagagtttgtataacatgggaattgttccttgaaggcttgctaaaagtaactgggcctggttctttgggtgaggggattgggagggatat

SEQ ID NO: 31889 - DNA, 1050 bp, Homo sapiens
cttagagtctgcatgctgccattctcttttttatattccttttctttttaaactttttactacgaaaatttccaaacggagataagctagagtgaataagagtcagtgtgtatggagctgcctgggtcctcttgaataggaccttctctgcattcagcttgaacaatgatcagcattctcttcacctcattattgattgacataaggtggtttaggtagagtttttttagttgtaaggaatagagagccactcaagttattgtaagtaaggagctgtgagtcataggcttaaaggaatgagaacccagaagaaactgatcgctagaccagactgtgggaagtagggccttgactcagggcagcctgggagcctgaacagcaaaagcaaatgcatgttgatgcctgtgttctggtgtgaatgtaatgcagctgctcgcagtgtatctgttttctctctgcttgtactcctcctgctgcccattttcttcactgtgaatcttttgtccttttcgtagctctttcctaattgtacttcctgttcccttatatttgttgcttgctgtgtctcctaatggcttggcttctctccatgtatcacttcagattccattaccactcgtaattttgccctacttccagttccgaatttccttagagacagattcccattgctatagccattactcatcatctcggttgggcagagctttggcccaggccatggcagaggctgaagactaacctacagataagctgcccttgggtctggtacctggtactggtccaatcacttgcagtccatcatgggatgatgttcaggatcacttgccacagagcatggttgcctaagtgttgctctctgcaaagactggggcagtgcagtttcctggaagggcttcttggcagtgcaggtgctatgattgatgcatatagggcagtagccaactctggaaagggtgggcttaggaatctttcacccagacatcttaaactttccataggctaactgacatgatggctgtagccccaattcagatgtgattgaaagga

SEQ ID NO: 31890 - DNA, 1113 bp, Homo sapiens
tttgaaattgagaagtttgagtccttcaactttattcctctttttcaagaagaattgtgactgtatggttctcttgagtttccacataaattttaggatcaactttcgacttctaaaaagatgccccctgggaatctgatagggattgtgttgaacctgtagataagttttgggagtatccatgggacttgtgtttgaagaaaagagaggaattaaaatgttttggccagtgtgtgaattcattgacataacttgggaaatccagagaggaaggtagtaagaacatgcattttagacactgaacttgaggtgttgcaggacacccaagtgcaatgtcccataggcaacaggaggcatgtggtaggggtctaggagagaagtaagaactgtgagagcagtattaaagcaatgagagttggtcagattgctgacggaaaaaacaaggaagcactggggcctgagttgcaaggagtgtccataatgagagggcaggagcagacatgaggaaccacaactgtgtggggaaaatcagggctggctggtgctagggaagccatgggagagagagtggccagaatagcttccttgaaaaaggttgaagagagtgagggcttggaggaacacccagttctcagcttgatccgggaccttgtactgtaccctccagggaaaattcacaccactcttgggataatgccttatggaagaggttaagagtcagtgtgtgtggaggtgcctgggttctcttgaatccacttattgggaatatagatcttatgggagccagaagcagggcttgtcccactcatagctttctttcctccctcagctcaatgtacttctccagttcctacccttcctcaagtggggaactcaggagaccaagcaggggcaactgtacttcggatggtcaggccccaggtgagcttggttctttgtgtttttaccaagtccccatgagtctggtccaagaatggctagaggtctcacccccaggactctgccccatctaagactattcctgtggctctcctgcctcattgcttcccctggaggtaatggactctatcttgcactggactttcgaggtgttatctcagctcctctctccca

SEQ ID NO: 31891 - DNA, 1040 bp, Homo sapiens
ccaaaatgcaaaacatcatacagttggccccctgtattcttgggttccgcatccacatattctgaggatatggagggctgactgactgtaaaggagcatctgagggctttgatatctgagataggggcatcctggaaccaattccctgtggatatgactatatatggaaaaagaggtcaattacatatacagaacagaggaaaagaatcttacagaatactaggtgtaactttatgccaacgtttgacagaatagtaaatacgatttccagatacatattagaaaaatttacacagaagtagaaaacctgaagaacaaaaccactgaaaaaaactgcaaggatgctactgccacatccaaacaccaggggaaaaaaattatatatatatcagaatgcgtcatttctagctagcctttaaggaataactgctatattatgcatactgttccagagtaataaaagaaaaaaaacttccaaattcattttgcacagccagcaaaatattggcaaattgaatctacttctgaactttaaaaaataataataataataaggccaggcgcagtggctcatgcctgtaatcccagcactttgggaggccgaggcgggcggatcacctgaggtcgggaattcgagaccagcctgaccagcatggagaaaccctgtctctactaaaaatacaaaaattagcctggcatggtggcacatgcctgtaatcccagctactcaggaggctgaggcaagagaattgcttgaacctgggaggcggaggttgcagtgagccgagatcgtgccattgcactccagcctgggcaacaagagtgaaactctgtctctaaataaataaataaaatagatttatcccaggaatacaagaaaatttcaattatttgggaacttttagattttttataacttgataaaacttagcaactattcctaataaaacttttattatagtgtatactatgtgtcaatcactgttttaagtaccttacacatactgactaatttaatcctcacaaccctatgaagtagc

SEQ ID NO: 31892 - DNA, 1059 bp, Homo sapiens
tggtcatatctttcttactaatttgtaagttatgtaatttatcaatttttttttgttgttctgtttcccaacctctatgtcagataaagaatcacccaggccagacacaatggctcatgcttgtaatcccaacactttgggaagccaaggtgggagaattgcttgaagccaggaatctgagcccagcctgggcgacaaagcaatacccctatctctacaaaaaataaaaaatagccaggtgtagcgacacacacctgtagtcccagctgctcaggaggctaagcaggaggatggcttgggcccaggagttcaacgctgcagtgagctatgattgcaccactgcactccagcctgggcaacagagtaagaactgtctcaaaaaaaataaaaaatagaaataaattttaaaaaaagaattacccatattctctttgtttttgtttattcacattaacctttattctatctggaatttattagagtatacttttttctcaaataatcaattgtcctagaaccatgtgtttctcatttatttgaaaggccatctagtgagagatttctccaaatgttggggtagggaagggaggggaagcactttaaagtctgagcctttagaggtgattcctcaagaccctgcttaatcctaacaattttcctcattagtaaaagtcagcccaaactgggggcttgttaagatccttaccagccacatccatctgaaattatgaatttcaaagtatcttacaaatttggtgccacattatcttttttaagtttgttttgttttgtttttttgagacagagtctcgctctgtcacccaggctggagtgcagtggcgcgatctcagctcactgcaagctccgcctcctgggttcacaccattctcttgcctcagcctcccaagtatctgggactacagtcgcccgccaccacgcccggctaatttttttgtatttttaatagagacggggtttcactttgttagccaggatggtctcaatctcctgacctcatgatccacctgcctcggcctcccaaagtgctgggattacagg

SEQ ID NO: 31893 - DNA, 1023 bp, Homo sapiens
agtttggtatgatatgtagtatatttttcattatttctgaacatttactacattgctttaggggaaaatgctgtagttccaaacagtcacttttcaaactacttaaaaatacaacctgattgtaattgggaactgacaatattatagaatactttagcatgtgagtttttattaagtaactgcatgccttgagggcaatatagctagaaacaatggagaagaccagactgaatcagattcagggatatccttaaatacaatatgagattttcttattatttgcttctaaggtaaaggcaaaataatgaggagaagaaagttcttaaaaattctgtttttgctcagatgaagaaccaactccagccgatggaagaatcatatatcgaaaaccagtcaagcatccctcagatgaaaaatattcaggtttaacagcaagctcaaaaaagaagaagccaaatgaagatgaagtaaatcaggactcggtcaaaaagaactcacaaaaacaaattaaaaatagtagcctcctttcttttgacaacgaagatgaaaatgagtaagtgtaaatattttgaatttagtctactttgaaagtatatggagtgttcattaaaatcacattttttcctattataaagatactacaagttctttatagaaagtttaggaaatagagaaaaaaatttaataaactacatctattcatcaatacccctctgacttaaaatgccaactctatagaaattagctagtattaacattttgttatttcccttgtgtggttgtatatatatgtaaattatatttttaagcaaaatacattttttgtgtgtaaacaaaattttataaatacaactgtattgcaaatgttctttgtcctgcttctcacttgacattgcattacgagtattcttccaggtcagtaaatttcaaaaacctgacattaatagctacagataatttcataaacatctcattgtatctttttcattagcaatagctccactttgggtgggggagatgata

SEQ ID NO: 31894 - DNA, 1096 bp, Homo sapiens
tatctggcttaggatcacctcatagaagagaaagaattcacagtgaagcagaaacaagccactgaccagcgtactcccaacctgaaccttctttttctcaccctctccctcaagtaaacatcttgctgacttgagcagtgtgattgccgtagcaaagcagagtggcccccagggatcccgctctgttgggcccacaggaggagccgatgaagctgatccaaggagtgaggacaagcgctgcagagggacgttcgctaaaagccttctaggggccgcacatgctctaacacggacataaggatgccctgaatttctgcagctgaggccatatagtctggtgaccaagtatttgggtcctggcttcagtctttggttgaaatgtctgcttggctacttattaccgcacctactaccaaaatatgaccttgagcagtaacttctttaagcctcagttttttcatctgaaaacgggaatgataatctaaatcacaaagttaatggaaggattaaatgagggtgatgaataggaatgtatagcgtctggccctggtatggctttataaatgttagctgtgttggagctgtgcttttcaaaccattggtcacagccattcatggtttgcaaccagcatgtttttcaagaaaaatgtttaatgcattacatattgcaggataagtattgttttatgaagcttagggagttgtgtgtatatgtgttctggaatgcaacagaaaaatgtttcctcttgtgggttacaatatagaggtatgaaatctctgatgaggagagacagtgttatctggcccgctatgaagagacacatttgcataggctgctccctgaggctctggctttctacatctgatgatacagggagcagggaacagcctgttctcgttctgtggggctcagctgagtctgttctgcacagactcttccttcctcgggagccttagtcctaatacattcattttggagtgttggtgagtttgttcacagatcacagctcatgtgtcacccagactgacctgggccaaaaggcccatcacacaccctgcaagagcttctggtgtcgactatgacccccttaccagg

SEQ ID NO: 31895 - DNA, 1044 bp, Homo sapiens
ctcattcgtggtctgtcactcctattcaaccttctcagtttgtgtctcaccaggcccactaagcggggtgctgcttgatcccccaggctggtgagacacacaacgccagagcagtcatttgatttgttactttttttttgtctgcaaggtggtcatggtagcttcaaacttcctaggaacctatcccaaattaatggccatcattggttatgatgattgcgagctccccaacagctctgaggcctctcacgccaaagccttcatagtactccatccacagcccagcacagagtttctgaagagtgcctctgcagagctcaacaaggggccagggctggagagacgcgctccttatcttagcgacacaccccggcctggcatacttacaagcagcagtttctgcgctgctgatagtgcttctttttccctcccttcttggagggacttgtgaatgagtgcccaccaaaaaaaggagaaatttttttagtaacactttttatgagaaagatatattaggtagatagctttgttgctttaaaaaggaaacatttactccattcacctgtcgctgcggacatccctccccagaaaccacagcaatgcagtgcttgactgaaagtatgattgttcttgttttcagggaatagaacaattgaaaaaggaagagagaagatgggctaaaaaaacaaaatggatgaacatgaaagccgtttttggccaccccttctctctaggctgggccagcccctttgccacgccagaccaagggaaggcagacccgtaccagtatgtggtctgaaggaccccgaccggcatggccactcagacacaagtccacaccacagcactaccgtcccatccgttctcatgaatgtttaaatcgaaaaagcaaaacaactactcttaaaactttttttatgtctcaagtaaaatggctgagcattgcagagaaaaaaaaaagtccccacattttattttttaaaaaccatcctttcgatttcttttggtgaccgaagctgctctcttttccttttaaaatcactt

SEQ ID NO: 31896 - DNA, 1092 bp, Homo sapiens
catagctctcatttccttgcacgccctcatcatggtgggattccacttcctgcattgctttgaagaagattggacaagtgagtatgtgctgaggctttcctccctgctccagggtgggtgtgtgacctgagtggggggcggggaggctctttgtttccttcatggtgccaggggccaacctcattttattaaatctcctgaaagcctatggactgaacagggaagaaatggcagagactggaatctctcttcatgaaaaaatgcagccccttaacttcagttcgacaggtaaagtcatgagttggacagacagaccctctggactgagcgtgcccagggagaatgcaggccccaagcaagcacagaggccggttccaatgcgtgggagccatgctgggagagaagttttgttttctgtctttccatgaggcacttaaatcaaagatcattttattccagtcttgcagagattcattttttactttctggctaggacatggagtttctttattaatttctttggtttttgtgatggtgttttttaactgcttacactgataatcgtgaatttacattaagattgtagataattcttcctgctttagaggcttcccactgaaatgtgcaaatactgagggagaaactccagccagaagattgcacagatcctgaaggaaaacaatagatgctggaggaaaagaaataagaggccacctgctgggctggctctttcatactcacaatctgtgagacaaacgtcttgagcaaggaacattgtatttcctaagcttttccctccatgggcctccttttttttatttcactgtctttagaacttttgctcttcctatacatgctgacttcttcccacaattctggcataagtcaaatggcagaggtcaagccagcagacaatagagataggagaggagggtaggggtgagtgggtatgtgcagaacttgccattctgcatatctaggtgagtcgccagcaagttcctgatcacttggtgagcattctgaagtacatgccttctgctaggcctggggaaccagatctactccagatgtggccttggttacttgacaagg

SEQ ID NO: 31897 - DNA, 1076 bp, Homo sapiens
agcacctcatagtgcttctagaacttccacccatcccttggtggtttggtcttttggggaaataggtagcagccattctccaaatcttagcccacttggtcaagtttttgaaactgcttcattctttttctctcgggaaaccaaatcgtaagccccattacttcaggagagcaggttctatcttagccatgtaaccatgtcagttccgtcctatgtatgtgttaagctaaggggctttggagaatgactctgtacccgtttggaatgactgccacccctggggtcctgaccctgcctcccaagccccacgtgacacacacccagcaaaacccctggcagtgcccaaggaagccatttcagaggagtggagcaggagccatgggttctgcgttcccccggggccctcccaacaccatggggatgccctaaaggtctgacctgtgggctgtttcagtgtttgtaagcggtgcattcggaagatggaccaccactgtccctgggtcaacaactgtgtaggcgagaacaaccagaagtacttcgtcctgtttacagtaagtcagcttgcaaattctgccctgccccccatgaagcaatggagcactttgttcctttgaaaattctcagcattcacgatgttctttgctcagaatactgcctggccctgtagatctctgccttcctgccaaagatctctctggctcaacaagtgcctgtacctaagcccttcacttgagcgtttagaaaattgatttcagttgattagctatgagcaagggctgtattctgggctcccattccaagtgttggacctaagtagctcaagaaggcagtttgggtgatgacctcaaatcctgaggtgcaggtaggtggagtctacttagtgcaaggactagaagggccctcagcagtcagcaccctggcttttcaagggaggaggtacagcaggcttgaaccccccgcccaggcagctcatactgcctggagcccaggtcatgcctggtgacgggcttgcttctgttctggttccacgtactcccggaggtggctgctcacttgacccagggctggtgggtaga

SEQ ID NO: 31898 - DNA, 1050 bp, Homo sapiens
catcctattttagagtttctactattttgctgatgttcatgacatctgctaagaggctgatgaaattgagtttcgattttatagttcctacttgtagggagccagaaagtttaatccctcaatttttgttttaagtatatagattatccttatctctaagccaaggggagatcattgcacctgatttcaagtttgttaaaccagtctgtatacagctatttcatacaggctccaatggttgaattaattgccctttgttgatgctactttgtaccgtctcaagatgtgtgctgttcacgagtgcatgaatgttcatgtggatgtgagaatgtgggtggatgcggtgttttagaaaagtaatcctcacaaagtactttgaggtgcttccaaagatttggttttagatctggctgaactactccatgactttagtgtgggatcttgtcttataaaagcaggtgaataggacttgttggcaatctgagaggatgggggtccttggtacacttgctggactgagaacagtggcattttgggactctaatacattcagtagagaactttatgtttgatgtgacaatcatgctttgaccctgtccataaagcatggactgtgggtcagggttttgttttgggtttttttgccacatgataaagattagtagggatttgcccctcactcaacaaatgatgtagctggattctgcccatcactagcagtcaacacttggccaggccagttcatcctggccaacccgatgaagtgccacagtgggatggggcctgagagcttggcattagcaccacgatgttcaaaccctttgagctgcctaccatggagagacagcatggggactgaggcataagtggtataccccaaggctgactcagcaacccagtccctggggctcatggagccccagactccacttcactaagtatatttgtgtctgtcagtgtgggttagtggaagagcacacttatgataaggtataatgaagcacgtgtgttatgtatggatctggaggcaattctctggaccacaggcag

SEQ ID NO: 31899 - DNA, 1042 bp, Homo sapiens
agtagcagagaatctagaaagacaggttgtttaggaagataacaatctatggtagaaagacttccgggcatcttagtccaaagatttgggctttgctattaacttgctttatgactttgaacaagtcagttaacctaagtctcattttgccctcaagtgagtatcttgccaggtttttaaactcagaatggatcctggatatgcaaatatttgaatattgaaaaatgaccatgtttaaattggggtttttaagacttctttcatttaccacttcattatacttgatatattttgctagtgctttttccactctgaaaaaaattaaatgaacaaaaggaagtcgtaattttatgctgtacttgattgaaaaaactaaacatgctcaggaaattgctaagagagatagttactagtgggcttctttttgaatattagcaaatcgggaaaagaggtaagtgaagcttttggtaaaaaaatgtaaaatccaagatattaacaaagaaaacgttgaatttgctcctgagaacagaggactcatagaatctcagccctgcaaggggccctagcaatcagcgtgatcttcccctttgttttatcaaatgaggaaactgaggcccagaatggtaactgtcttgcctgagatcatgaggttagcgagtggcaggattgggagtaaactctggcctcttgattccaagctcagtcttcattccctttagcactagcctcccatctatttccaaagccctctggtgaatggctggagagcccctcaccaggtaagcaggggctgtgttctctttctcacagcccattacagccttctttctgtggtcccaggttcctcccagggctctgctcttgcactgccacttacagtgcctggaataagtgataccagcagattcctgaaagtcaaatggctcccctttttaggccctagtacctagtacagttgcaataactggttctctcccttccctagctagtctttcggatttctctaagcacttttgcttttagtccctaaaaacaaccaagc

SEQ ID NO: 31900 - DNA, 1044 bp, Homo sapiens
cactcggaaatgaaggttgtcattagatctgatagattttatgtaatgcattagtaaaaagacacatatattactagttcatatatctgctttaatatttggagaattgtgtttcaatttaattggtttgtaattctattttattgtttgcattttaaagcattctgagaaaggggctataggctttgtcagattgtcaaaggtgtggatgaggccaaaaaaaaaaaaaagttaaggatctttaggttgtggcaggtcctcatgaaaaacaagagaaagatcagctcattgcagcactggtttgttaatagtaacaatagtagcattgtttaatttgtgtaattgtataattttctaggctcttgctgtaagtcagcccacttttacagatgaggaaccaagacccagggaagatggtaagtctgaaccatttacagaacatattactgctactgcgttatgctgagacagctgtaggagtggttttctctaaaccattctcattttacttgaatttagattatctgatgacttataaaaagcttttccataaaccaggatttgctatggcagcccttgaccttcagacctttattatgattgttaatacaaaaggctgtatcagttacctgttgtcagaccaagctgcattattctgcgttatttgaagttggataacctcaaaaccgtggcttaaatcactgaagatttattttgctcacgaatatgcaggttgactgggggctctggactcttggtgggctcactcccttgtctgcccgtggtcagctacgcattgaggctgtgctcccacatgtctgagggttggctgctcattggctaatcgtggctggggttgactcctacatctgtggtcagttggtcaaagaaaggctggctaggctaggatggtcttggccagacaacttggctgtactccatgtggtctccctgaccccaacaggatagcctgggcttattcagatggccactgagcaggtttccaagagagtgagtaaaagtgcccgagcttcgcaaagccca

SEQ ID NO: 31901 - DNA, 1025 bp, Homo sapiens
ccagctccacgtctccaggcctctctttcacctcttctaaagagcagaggtggacactcaaaaccaattatttgtcagtaacttattattaattgttctttgattgttgacccctctcctgtggtgttccagtgttctttagagattttgtgacacacaggctcatgcttgcagagtcttaccatgtcactgctgaggggtagaggagtgacactcctaagtcacagagccagtggtggagctggatctgaaccaggcggtctggccagtctgaactcttcataaccaaggtgccctttccctctctctgatattgattcccactgctctgccactgccctgcccaaagaaggggcttaggaaatacaatggaaagactgaatgaatgaatgaacgagaaagggagaaataaaagaaggaagggcagagcttgagataagcaagcccaaaactgcaccacaaagcccctggccatgtggcgggagcgacaggtgccatctctgggaagcactctgagaaccagctaaggttcaggagtgtataggttgggagatgggggagaagctggacaagagaatgagaatggagggagatgaggccagagggatagcaggaggggagtggagacaggaccagcattgactgagtatctgccaatcatttggagaggggctgggcacctgcccctgtttatgtcttctgcttcagcacagaccccttaactggaaccagctctttagagagaactgcctgatctgtttctggccacatcctctctgagcaaggtcctgggctaccggtcacatccccagcatgggtacttggctcttagcagaataactagacaggacactagggaaaacctgagtcatcccctcaccacctccaggccttgaactgccagggcttgtggccaagagtgcccaccagaggaggggttggaagatgaacttcccacctcaccccctcctgcccctccgtacactcccaagtggaaatgaaagcacccctggagttagcaggac

SEQ ID NO: 31902 - DNA, 1031 bp, Homo sapiens
aaaatacaaaaattagctgggtgtgttggtgtacacctgtaatcctagctactcaggaggctgaggcaggagaattgcttgaatccaggaggcacaggttgcagtgagccaagatcacgacactgcactctagcctgggcaacagagtgagactccatcttaaaaaaaaaattttttttaaatgttggttggctctagcctagcatggtggctcacacctgtaatcccagcactttgggaggctgaggcgggcagatcacctgaggtcaggagttcgataccaacctggccaacatggtgaaactccgtctctgctaaaaatacaaaaattagctgggcatggtggtgggtgcctgtaatccctactactcgggacactgagaaaggagaactgcttgaacctgggaggtggagattgcagtgagccaagatcatgccactgcactccagcctgggcaacagagtaagactccatctcagaaaaaaaaaggaaaaaaaaatgttgactggctctgccttatctcctagaatattttcagttttaaaatgaggcctgtgtcttagctggtaagtaggttgaagagcctgccctggtggggaagaagtgagccattcaaagacctccctctgagccctggccctgtctagcacacaccctttgcacagattttgtctctgacagtgaggcccttcaaaaatcgtctgaaaaaaaaatcaatatcagtgtctcctgggactaatttctcattctcagggaaggcagagagtgaataggaggctgaggcccaggcacgggaagatgaaagggtcctggggcacatggaccagccaaagcacagccaggagacaggcctaggtggagccagagatgtcgagcctggaggagagtgggcccagcagctttgtgcctggaagattgttatctggaaggaggtctcagcctgtcctgcgagacccaagggcagcaccaggaccaacaggagacagctggacagatggatcccacctagactaagcttcatatcctgaag

SEQ ID NO: 31903 - DNA, 1016 bp, Homo sapiens
actccaaaaaagaaattctgtgcccattagcagtcactccccaacctctgcccccagtgaccactaatctattttgtggatatgctgattctagatgtttcatgtgaatggaatgaatgaaaaacagctggaatgaatgaaaaggctacagagtaagatgttttaaagaaatgaagagtatcattttcaagaacgcacattaatctatgttaaacatgccctcttcaggggacctgccttaaggagctcttgatgttgcttgtaatcaaggtagtgagtgcgagggtgtgcagggtgggcacaccaaggtccccatgcaaacagcaagccttcccctccagcagctccttcccatacacccctgctgcagtgtctgagaccaggccagagttgttaggttgtggatcacagaaacagaaccaacccctcactctcccgggatccttagtccctggtggaactagaatgtgatagaatattaatggaagtaaatgagacgccgtgtgcagaagaggcagcacagagcctacgtgtagcaggccctcagtgtacactctttgtacacctttgtcccctccagccttgtcaggggcccgtcctactccctcaccactaccagctgccagcctgagcaagcacactgttgtgttaggaacacaatgctcgctctccctcccatgcctttttgattccccttttgatttcccttcgatccacacgtttgaatttgttatttagttttcaaatattttgagattttccagagatctgctcttgatttctaatttaattccattgtagacctagaacatactttgtataacttgaatcctttgaagtttgagaggtgttttcttaatggcctagaacaagggtgtccaatcgtttggcttccctgggcctcgttggaagaattgtcttgggccacacataagatacactaacactaacgatagctgatgagctaaaaacaaagacaaaaacaaataaaaaaactcataatgttttaagaaagt

SEQ ID NO: 31904 - DNA, 1024 bp, Homo sapiens
tatcctctataattaaaatcctattttgttttctgaaaattaaaaaaaaaatctacaactttggaagtagtgtaaaagtctgataatgatgaagcaaattacaattcatacataaaatagaatatacttaaatgtttaggaagtatttttactgattttggaaaatgcaatacagttaaattgctaagaacagtgtaaacacaaagtaaatatgcaaaataagtattaactattactattacaacaaatagatgtcaaaaggatataaaattgtgattcttaaccttttttgaccataaactcctttgagaatctcctaaaaactgcagaccttttctcagaaataatgtatatatatatacacacacacacacacacacagacacacacgcacacacacaaacacccctacaattctgggagtccatgaaccccttgaatccttctgccatgtattctgtgggccctcacataagagttcatgataaactatgtgattttaactgaccgtacttttagaaacctggaaaaaatgatcacattttattaacagttggcctccagctggtggaattatgggtgacttatttcttcctttttttaaaatagttttcaaagtttctacagtagtatgttgatttatattgaaaaaagaacataaatgataatctgataaaacagcctgtcttatgcaaaagaaatgaaaacagagattattcattgagcaaatatagacaataactagattctccttatctccctgggtgggtctgactatgccattactagcagtaccatcagcctgcaagcactaactgtgtgcctggaaacatgttcagtagttttcatgtttctccagtttaacccacacagcagcaaatggcagtgatggaatttgaacgaagagcagctgagctccatagcctggcattttgcactgtaccctactacagacaggaatctgagaataccaacaatacctggggttagtcctccctgtcttcttttcaatataaagagtaaa

SEQ ID NO: 31905 - DNA, 1028 bp, Homo sapiens
cattattagttggcattctactgtaaggaagatctttttctttttccccatttattcattcatagcagtattgactcatggattcttattttattcaataggttgcattctgtcactgtcattatttattttgaagcttacattatcccatttatccaattaccccagtggggagcccccttcaagctggctcttgtggggaggtttggttacatctgatacttttttaagaaataaaatattatagatcagctaaagccccaccccaatgccatcctttctcctttgttcccctttcagaagtaatcatgtaatcaatgcatttcattctcagatcttatgctttcattattaattgtgtatttgtaaatattttatatatgtatatatatatagttttattttgtaaatgttttaaaattttacacatgttgaatcatgtaatagctatcctttgcaacctgcttttttcattttgccttgtttttgagattttgtatctgtttatacatggagttctgtaagtgtagagttgggttggcaaagcacagcccagagggctgtgtggaacacagctttgcccatttactcacctgttgtccatggctgcttttatgctaacagtgccagttgagtgacagagaccatatagcccacaagaccaaaatatttactatctggcccttttcaaaaaaaaagaatgccaacccatggtgtagagaattctgttgggtgaataagccacagtgtatctctttccatagcagtgtagagtttgtttggtttccctttttccagttacagtgctgccaagagcatccccactgtctccttatgtacatatgtgactgtcttcagggaagatactgtgaagggcagttgctgggttttggagactaggtttgaacacacaataattttagatttaggagatgattctgatgaagtaaaaatgtgtttcgtttccagtgttcctgctaaacgagagttatcacacaagcctttgtatttctaaagcagtgccatcc

SEQ ID NO: 31906 - DNA, 2084 bp, Homo sapiens
ctgcatcttccctcttctctccctggacagcctgcccacctggctggccttccaggtgttctcgggtcccaccttctctcattcccagtggcattcaggctttggatgcactatagggtggttatctgttcactgtctgcttctctcttccctgcccctgacttccctgagggcagccatcttgctttagtcacctttttgtctgccccatgacaagactcagagactccgtaaacattcaaatgaagaagcaactaggcaggcacatggatttgggagttagttgggctgagattttcctcaggaaaaacagacttgcccacgaggacaagtccaagagtttatttaaaaagtgcaggctgtggcgatgctaacagcaagaagaacttcactgggtgattgtgaagtcagttaggtttcttcgatctgtagtttaggcatggactaggggtgctttgacagccgttaacattggaaaagaactgggcattttagttggtcacaggctttgaataagccagtggtgtgacgtggataccaggaacactgatgtcccagctgtggtgttggctgtcggttggttgggaaataactttttttttcagacggagtttcgctcttttgcccaggttggagtgcagtggtgcagtcttggctcactgcaacctcctccttctggtttcaagcgattctcctgctcagcctcctgagtagctgggactacaggtgcccgccaccatgcccagctaatttttgtatttttagtagagatggggtttcaccatgttggccaggctggtcttgaactcctaaccttgtgatctgcccgcctcggcctcccagagtgctgggattaccaggcgtgagccaccgtgcccggtggaaatacctgttcttttaataaatggtagctcttattcccttgacccaccccattttaagaacaaatctacccacatgaaaggtcacatagatgctatagaggttgatgcatctggtgccaggtttgagtgagggccgttggcagctatcaaggaaactgttttaggggatccagaattgatgtaaacagggccatgggactagggtgtgtgtgggaggcgaaagggtatcatttacaggggccacccactgaggttttcaggtccttgcttgctgtctctgttggatccagcgaaagtgaacacatagtggttgggctttctcctcctcttccctcctgggctcagcctaaggatcctatctaccagccagagtttgtggagaaaggtcaccttcttttgttctacaggccttacagatctggggatggtcaggtagcagccacatgtcctcaggaccagagagtctgggtggttgttccagtccctggaactgaccaggtgggccccctgtgcctgattcctctgactgtccactgtgaggcaatggggaaggggtttctgggtgccacacgaagctgtctcccaccaggggaggggtcttccaatctgcatggaccttatcatttgcttttgtgatttgctcactgctgctcccctcgtgagcttagaatggtgaggaagtcctagtggttgtgaattctgctttgtggtgaaggaggcttttttcccctccaagaaaagggaaatggtggggtagggtgagagggtggggaggtgacttcattgctcatcaccagttagtttcttaaccgacatttttagccccccagtaatggagatgtctatcctgatttaagagggcttagtctacaattggctgctgcatttgctactgtggttagagtcccaggctgcagagggacgctggtgtgtgcaggctcaacctgtcctcttctgcaccagcaaagctggacttttttttttttttttttccaagcttgagaaaagtcattaggcattgacaaggctgtgtcaggcctgagtgccagccatggtttcctgcttccccatttagccaggtgagggtcaagagaatctgtttagggtatgagtcaagatagtgagccatagtcagctaggttcctctggttacttttattattaagtcattttgacagcagaattaaggaagatggaaaa

SEQ ID NO: 31907 - DNA, 1050 bp, Homo sapiens
tgcagtgagccgagatcgcgccactgcactccagcctaggttacagagtgagactggtctcaaaaaaaaaaaaaattgggaaaaaagaagagggccttagttctttctttggggatgggcctactagcctattaattgccatattcggaagcatttttctttgctgtcgtttaacagcaaatgaaaagttccatttctactttgttcatctttccaacgtaatggagaggaagaagaattctgaagttcactacctgtgtgcaaaccctagtttgcttttttacctggacttgggacacattgcttcatctctctgagctgggtttcttcatgtctccagtggggaatgacagtccgtacacattcattctcattgggttattgtgagatctaatgggataatctgtgtgaaagggctacagagacagaccaatgagggccgtagttttagatgggtgaaaactgtgtccttcagtgtgtgaagtaaaagaatgttaaatagctagacctgtcagagatggggggcacttcccactttccaactgaaaaaacaggctggacagtctgacccctattttccttactgcatggcagtctgggggtcctgtgtgaaagtgaaaagggaagtaatagggtgtgaaagctggctagagtggcttctgcttttgttggctgcctgtggaacatatcagacagcccctaaattgcctgtcccagagaagctcaaacctcagcctttcaaacaatggctagttcacctgagctgttcgcttggatttagggcaggttattggggccgggtttgaggtcggaatgcaacggacaaaatagcatccacagagcccattgccagggaaggacgtgctagatcatcaggagaactggcttttaaagagggatcctctcagtgggctggaagtatggcctgattgttattttttctatgttttaaaattgtgggaaaatacacatacaatttactattttaaccattttaaatgtataattcaatgtccagaacgttttcatcatcccaaactctgtacccgt

SEQ ID NO: 31908 - DNA, 1017 bp, Homo sapiens
gagtgcaagtgttaagatttggtcttggttttcagtcagaaattcacatatacaatcaatcagattaacttctctatactcaagagctgagtccccctcagttcttaggagatacacacattcccctaggcttcaagccagcctccttctagattacttctccttcaagcctgtccctgcctacactggcagtcctgcaccatgtgcttcctcagcatggtacaaatggttgcttatagctctgttatgctttttcatcctgggagcatagaagaaactcaaccagagaaagttaggaggactttgtgagaaagtggcatttgagctttaaaggatgaggaatttttcagtaagcaaagataggctaaaaggaaagctggagcaaaggcagggaaggaagggagtgttcgggatatgtttggggaatagctctgtttacttgtatgggaacataggcatcataaaacttgtaatccagcatgaggttggaagggcattgttggggatagatcttggggatttgaaaatgtaaaagaatatgaacctttgtatggtgggaaacctttgaatttttttttagtaaaatttatctcaaggcttatgtttataggccctaaaattcagaaatgatactgtaaataaaggaattgacaagtacttgtggaaagcaattcagtctttaaggatggctttttttttttcatctctgagacagtctagttctgttgcccaggctggggtgcagtggtgcgatctcggctcattgcaacttctgcctcccgggttcaaacgattctcatgcctcagcctactgagtagctgggattacaggcacctgccaccacgcctggctgatttttgtatttggagtagagacagggtttcaccatgttggccaggctggtctcgaactcctgacctcaggtgatccacttgtctcggcctcctaaagtgccgggattataggtgtgagccaccgtgcccagctttattatttgtttttaaatttttatttgt

SEQ ID NO: 31909 - DNA, 1095 bp, Homo sapiens
tttgtatttttagtagagatgaggttttatcgtgttgcccaggctggccttgaactcctgacctcaagcaatctggctgcttcagcctcccaaagtgttgggattacaggcatgagccaccacagctgaccgtatgaagtgtcttgaatgaaatcagatatcatatttttatgttctaaaacctgactaatatttttttaattttgaaaagaattaagtacttcagtggttaaattattgggaataggtggaagaaggaagagggaagaaaaggagctggagtgagaagggattaaagtagaaatgaattcattcttgtttatattttattcacttttggaggaaatattttcctcttttcacatgtgtttggcatttgcaaaaagatacacacttacgttcaatccatgtggagtttgctaaatttcaaatgaatcacataaatcacttagccacttcactccagctgttgtgctgtcttgttttcctgaatcatttaggaatatgcccaagactgctaggcacttgacatttaaattatatgtaagcttaaatacaaacaaaaatcacaactcccatttccagacttctgtactgtgttagttatatcttttgaaaaataaacaaagggattaagataagatctggtgcagcaatacagctgagttctggggccaagtttataaagcatgttggaggccttacccttcttaaaagcccaagttcatgggcaccgtaactattaatcttgattcagtcttttggtctagtatatgcatattaaattaggcctttcaaagcgaatgaggaatgggcatgaagttcactgttgcttatttaatgctcaaggaattgcctttcttatatgaagacctgtgttaggaaatccaggtcatcaaactagccaagcacaaagtaggagctgagaagtaggggccaagtaaaagggcagcttatgtgccatgctacacaattagacgttcattctctggctagctggtgagaaagggaaacctttaaagtgatttgatcagtaacatttgccttttacaaggctctctgctggagatggactggaggggttgaccatggagc

SEQ ID NO: 31910 - DNA, 1047 bp, Homo sapiens
ggtttgatctcgcggctcactgcaacctccgcctcccaggttcaagcagttctcctgcctcagcctcctgagtagctgggattacaagtgcacaccaccacacctggctaatacttttgtatttttagtagagacagggtttcactatgttggccaggctggtctcaaactcctgacctcgtgatccacctgcctcggccttccaaagtgctgggattacaggcatgagccactgtgcttggccgactaggcatttttaatacaaacataaataagtttccatttgtattcttaaaagctgatctttcaaataagagagatgatgatcacaagagaaagatggtgactacactaaaaataaagttttgtgttgggaataagtactgaatggtttggaatatatattttttcttttttgccttaaactattaagagataaatggtttggaatattaagggacacagaagcttggggaaaagaggtcactttataagctaaaggatagggtaatggaggaattgaaacttaagctgggccagaaaaccccagctgggtgaaataagagataaaaaagagtatacacaaagcaagaatgctcaaagacccgtgtttgcttaaaagtgaacacattttatctgagcctggggtcttcaggttcctctttaactgtgcaagcaaaggtaaaggtaaaaaatgtattcttcattaataggcttgaaagaaggaacaagtatatatccttgtggtgattactagtctgctagggctgcggtaacaaaataccacagactgagtggattaaataacagaaattttctcacagttcttgaggctggaagtccaagatcaaggtgtcagcagtgttggtttctcctgaggcctctctccttggcttgcaaatggctgccttcttgctgtatataccttttctctgtgagtgtcctctggtgtcagttctcttttaataaggacaccatcctattagataaaaagtcctcactcttttgacttcattaatcttaattagctctttacaggccctgtgt

SEQ ID NO: 31911 - DNA, 1104 bp, Homo sapiens
catactatatggaacatactatttcgagttaaagactttctaccttttacttttatttgtttttttttttctgtatgttttgtgtctgggcaatctccagcagtatcactatatgttattgtttcttaaatttccccaaattgtgatcttttgctttagcctgtttcctgaatttcaaatgtatatttatcactctgaccctggaaacacaatgttttgggctgtaggtgaggcctttaaacagtagttctttccagggataaaagcgtagggtatatgcagtattttgagtttatgtagcactgtgtaggtgatttctataaattagaagtagaatttcacttgttggtccattcagaaaggaattgagtgttgattatgtgccagacactgttcttggtgctagagatacaataaagaataagacagtatgggcccataataattatagcttgagtgtgtatgaattgtgtgttagttgaggtttgcacctagacactaaagaaataagaggacaatatgtaaaaagtatcagatggagtgtggaagcagattcttttaggtctgtctgagggcaagagcagtcctagaacctaacttacagaatatcaaacctgccaggcatagtggcacgcacctgtaggccagctacttgggaagctgaagatcaaagcatcccttgagcatgggagtttgagggtgcagtgagctatgatcacaccactgcactggacatgatggcttccagcacttcgggaggctaagacaggaggatcacttgaggccaggagtttgagaccagcctgggcaacagagcaagaccccatcgctatacacacatatacacacacaatattaaatcttagaacatccacagtattgtcttcagtattctcttccagtaaataacattttgagaccttatagatctgaaaaatgtccttattctattctcccttgtttggcagatcatataattatcattttgaaatcttctgttatagtatgccagtctcttgagtggaatatttaacaaagtaaggtgatcttacattaagggttaacatgaatgaagccaatttaaacattttctgtaacagactc

SEQ ID NO: 31912 - DNA, 1064 bp, Homo sapiens
tcttaatactttaaacttttaattatgatataatttcaggctcaatgaaaaactgcaagaacagcattctgtacatattctacatgttacacacattctagtgacgagtctagagaaaattcagtgaaaaattcctctaaacttttcactgagattccccagtgttaacattttaccttattttttttattgttttctgtttctgaactttaaaaaagtaagttacagcagaggtgggcagatcatttgagcccaggagttcaagaccagcctgggcaacaaagcaaaaccctgtctctacaaaaactaaaaaattagcgaggcatggtggcacatgcctgtagtcccagccacttgggaggctgaggtgggaggattgcttgagcccaggaggttgaggctgcagtgatccatgatggtgtcactgcactccagcctggatgacagagtgagactttgtgtaaaaaaaaacaaaacaaaacaacaacaactaagttatagatatgatgcccctggatattgtgtatttcctaaaaccaaggatattcttctgtgtaactttagtgtacttaccaaaatcagcaaatcacagtgataaaatactatgatctaatcagcagacctctttcagattttgccagttgttcacataatggcctttatagcaaaaaaaaaaaaaaaaaaaaaaaaaaggctgagaatctaatatgggagcacacattaattgagttgtatgtctccttagtatcctttactctgaaatagttcttcggtctgcctttattttttataaagttcacattttaaagtatttttgaatttttgtagaataccccgcagttgggtttgtctgaaactttcctttgcttggattcaggtatacatttttttggtcaggaatattacagtagtgttcttctcatggtactgaattgtcccattactagcattgtcaacttttatcactcgattaagcagtagtctgccagacttttccagtgtaaagttacgatttttccctttataattaaaaagcatcacatatgagcaactttggaaatatg

SEQ ID NO: 31913 - DNA, 1062 bp, Homo sapiens
gaattgcttgaacccaggaggcagaggttgcagtgagccaagatcatgccattgcattccagcctgggtgacagagtgagactctgtctcaaaaaaaaaaaaaaaagtcaactgtacaaagtgatgtaatttttttttatgtttaatcagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggtaaggaagcatcttttgttcatttcaacttgaattactcaggtttagagttctacaaacctaagcaaaattaactactttttttagccatgcatatttctgaaaaatggaatactgtctctcttactgttttatttataagtgtctcaaacatcctctaaaccgtggcaagagtcatattagccaaactaatatacaaatgtcttcttttctgtcacttagaaaagtacatcacaatagtgagttcag

SEQ ID NO: 31914 - DNA, 1072 bp, Homo sapiens
gaaaaataatgaatatttttaaagagcagttttcagacatttctattagtaatagcagacttgttggaatctcttcaagttatggtttttgtttgtttgattttgtttagactggtatgacttttgtgtgtattgccaacagttttgtatggtttacttccacatagctgacttctttcctatgctctttgaacagaaaagaagcccagaaatgtttctgcggatcagccaattgccggggttacctgggaggagaaaacagagtcagcatcagagcagcaggagggaaaatgaagaaggaacgatctcgtaagaaggattcagtaagtttgcatttttctttcaactttcacaataaaaaatttaaaaagcgaggtggcttttctgattgaaggttataaagtcatactactgccaccagagaaatccaagatcagatgagttgttaccagaaaagagatgcaattgctatttttatttcagattcatagagattggaattgggtactgagaactattaaagtattattgaaaacacctggactaatagtttttcagattctttaaaactcctaagtacaagtaaaacatatcttttctccctgatagctcactatgtctgctgtacgtttctaatctcttgttattggtttgtctttgtttggtactctaaactttgagtgttcttcaaatctctgaaaatcctcttttgagtgtgagaaaagttttgagaggaagtaggtaacctaagaccaacaggagtagtcacagatgctctttttatttaatgaaacagcagttgatagcctcattttgtaccctgtcttgcctgagttactcctgggatggggatgggattgttggtggggaatatcctgttactaaagggactatcaattgcaaaaaggactttgtgtttaaaaaaatattctcctcccttttttgaggatccctttgctagagcactgtttttcaaaaatgtgatccttggatcactttctttagaaccagctggctggatccatagtaaaaatgcacatttttgggctactctctagacctgtgaatctta

SEQ ID NO: 31915 - DNA, 1051 bp, Homo sapiens
cattttaattcttgagtcttatgcatctgttctgatgtccctttcactatactcagccagatgaccaccacttcatggaattaaacttttgggatcagtgtttcctagtttctatatctcatcttatcttacaacatggttacttttaacatatgttaatatagacttgcctttgatactcagtgacacaagcatcctctgtttgccaatttttagtacaagtgaatctttactgtatggaaatgttaagataaattaaaatagcagttacttttttttcttttttttagcagttacttttattagagacgaattagagatatatgcaatctggtagtccattaaatgagagttacacttaaatattttagttcttttaaagaaaaaagtctccatgtgctatttgggaaaaccttcattgcctaaagacccacttgcataattaaggcagatgatgatgatctttatatatgcgcacacacacacacacacacacacacacacacacacactaataagttactaatttcttttgttttcaaacatcatctcagtggactgtgaacggacaactgagggttgggttttttaccaccaaactggttccttcaggctcagagttaacgtttgactatcagttccagagatatgggtaagtattgtttctactaattttgctgcttctgatggggaaataggctgttcagatataaggatataaaactttaatataaattacttaaaagttatatttactcttaactcttatctataagatattgttttggttttgtgtgtttttctactgtatgacacttctgacccttaagggatgttgtacaggaactgtataattttctcctcaacttcatatggtctacttgtataattatatttcttatgtaattctgaaaaactttagacatgccaactctttttgtgtctgaagagaatagtacagtattataaattcctctgtatccgttattcagcattaacagttagcataactcataaccagtctatttcatctgtaccattttgtactctt

SEQ ID NO: 31916 - DNA, 1061 bp, Homo sapiens
ttgttctttttttttttttcctttgaagataagaaatgatgttgatattaatctatccttttgggaaccaatcagaaagcaacatgttttgttacacaaaaagggggctagtaggaacctcatagatttctcttctcctctaagttttgtaaaaacacaccctggctcataactggtttttattgttttttatttttttgagacagggtcttgccctgtcaccctcgctggagtatcctggcgcaatcatagctcactgcagtgtcgacctcccaggctcaatttatcctcctgcctcagccttctgagtagctgagactataagtgtgagccagtatgcccagctactttatttttctattttttgtagagatggggtcctcactatgttgcctaggcttctcataactggtttttaattgtttatttgaagcaaatatcccacagaattgtcatatgccccatatccattcattggattctttataatattttaaacaaataattggttacacttcctttgaacactgttgatacagaactcaatacctctcaaagcagcccattgaatttccaaaatcactagttctagtccagacgcacattttcaaagatgccttctttcattctgccctagccagccaggccttcttgagattttttttttttttttttttttttttttttttaaaggaaccacagtttggacacaagcctctcttacagggacaatagtggatgagctgtctggatgctggtcttttgtggtatctgcagtaaaacacatagcttcaaacctgatctaaattctgttacttgcaacagacactctttgatagctcagtgctcttctcatattaaggggaaaggagactggggaagggaggaaaggatatatggctccagtttataagccaggttaaaatttcctaaagctcttccgttttcttcagctattcacagagaaccctgctttggtaaaatatactaggacttaatgtttccatgtttcccataccttcctactcctataactgccacatgatgatgtgtaataccaa

SEQ ID NO: 31917 - DNA, 1047 bp, Homo sapiens
gtgggaaattttacacatgacctgatgtgaggggctgcagtcaaaacacagccaagctgggcatggtggcatgcacctgtagtcccttcaggagcctgaggtaggaggatcatttgagtccaggagttcaaggctgcagcaagctgggattgtactactgtacttgctccagcctgggcaacaaagcaagaccccgtctcttaaaaacaaaaacaaaacacaggcatacaacacagtttattccatgtcccaaaattattaaaaaatattgtataaaattaccttcaggccatgtgtataaggggtatatgaaacataaacaaatttggtgtgtagacttgggtccaagatatctggccccaagatatctcgtgtatatgcagatattccagaatctgaaaaagttggacatacttactgtcccaagtgttttcagtaagcgttactcaacctgcagtttttttcatcattctagttatgtttacacattgtcagttttgatttttcagtgttctcacctctgtagatgtaggcatgaaaaccagctgcgtactttaacttttggatataatattgtctactatttaattccaagccatattctgttatttttaaaatatttatttattgtttgtttgtttgattgattgattgtttttgagacagagtctcacttgtcgcccaggctggagtgcagtggtgtgatctcagctcactgcagcctcagcttcccgggttcaagcgattctcgtacctcagcctcccgagtagctgggattacgggtgtgtgcccatctaatttttgtattttttgtagacatggggttttaaccacgttggcatgaactactggcctcaagtgatccacccgcctcgacctcccaaagtgctgggattacaggtgtgggccaccgtgcctggccttatttctttttctggacttacttattttttatttttatattttgagacggagtctcgctctgtcaccaggctggagtgcagtggtgcgaactcggctcagtgcaacctctgactccctggttc

SEQ ID NO: 31918 - DNA, 1051 bp, Homo sapiens
gggtaggccgcgaatccccgggctcgggtggaagctcgacccgtcgcccgacctccccgcgacggcggcgcctcggaccggaagggcctagcgcgggttgcctggcccccgggccgtggaggggcccgcgctgcactcctgagtttgattttttcctcctgggaactcgatcctggccttgcagtgcttccggattcacattgtgcacctttggcacttgggttttgtaatggcgaggtttgtgtggtcccgttgttgaggtgacaccgggtttgtttttccgcttgaaaatgaaagcctcctgagggacatacattttcttgcaggttgtgagattttcacactttcggacacaattttcttggtaacaggaatctcttaccctaaacggatgactttctatttcttgtgaagacttggttaaaaaccaagaatcgtttgaggattctctaaagaagacaatgttgtggaaaaccgacacacagttttgcccaatagtaatttttcagtctaggacacctttacatttctcttgaggtctgaatctgctgctgtatctgctatctcagaaagcctggagtcacttctttccctgaaccctcacgagaccattgttttgaaaagccgttcttaaacaccgtttgctggtgttagacctaggaatatactattgatttaaaacttatcggttgataggggtttcacatgaaactgtcaaacttttatgaccaggatgattccaagagctttgctgttttgacacattttaccttaggtttgctctggctcgtttttgaatcccttgccacatcttctcacattggtccagaaatgtctggatcttaattgatagttttgattgcaacacaaacggattctgttgaggtgttggtcatttctgcacaacaagataaatcattattttgcttttctaaaaacccaactcttacttgcaatagtaagttaacatggctttttcctttcatgggttcttggccattggttaacattaccttaattagattggtctttttgttttgctactggcagg

SEQ ID NO: 31919 - DNA, 1049 bp, Homo sapiens
aggctccttgactgttggtggcagcaccatctgacctagagctggagtctttttccttggggagggggcgtcccttgcccttagtgatgttgatttctgccagtgggctgctgccgtcattcctgtcaccacaggttctgcatgggctttggctgacatcctcccctccagcctggccaatttcaccaggcccctccatgcttcttggaaattctcctttgctgcttgttttagctttaaggaaagccccgatgtctcaacctgaccatcagggttcctggtgactgtggtctctccttgtccacccacttccaatcataaaactggcttccccagctctggtgcaggcccttcaaattcatgggcagaggttgtaggcagacatgcattgcctttccctgcagtaagattttgaaccccatctgctttgaggctttggggttactgggcaaatatacccatccctgcctgtcagactgtacctaggaattttggagagcaaagaaaatccttgtttctttatggaaaaaggaattgatgtgagctgtgcttgggttgaagctgcttttatgtggagaatgcaggcttccgcaacacccaacatagcccaccctgcatcctgtttcccctcagcagccctcccttcagctccaggctacatggagccctctgcttgtttttaatttacaaacttacgtgatattcaccaggtaccaccttacacgttagctcacttgattctcatgaccaccctgtgaggtgggtactcttatccccattttacggatgaagaaactgaggcacaaggtggttaatatttggagttgccctctggctccagcatctgttctggcaccatgtgctttcctcttggccatgtccctcctgtgccttcttgaactggcccttaactctcatgtccacatgctcagccccagggctggggctctaagggagaggcccctggcagctgttcttctcttccaggattgtggctgcacggctcaacggttcccttgatttcttctccttggagacccacactgccc

SEQ ID NO: 31920 - DNA, 1011 bp, Homo sapiens
gggccggagcctggcccataccaacaccgggcttctgcaggacatcgagtgcctggccagcgacggcatgctgctggtgagctgctgcctggcaggccacgtctgcgtgtgggacgcgcagaccggggattgcctaacgcgcattccgcgcccagggtaggtgcggctgccctttcctcctttgtgcccccacaacccccctcaccccaccccccgccgccacgtatctcccctcctttcttcctccgaggtatcccccaacccctccaggccccctctccccccacccccgcaccccctcccaccaccccgtacccccctctccccaccccgcaccaccctctccccccacccccttttcccttgccccttctcactcccacgccccctctcacccccgtcccccgccccctctcacccccctcccccgtgccccctctcactccgccctcctggcccccagcaggcagcgccgggacagtggcgtgggcagcgggcttgaggctcaggagagctgggaacgactttcagatggtgggaaggctggtccagaggagcctggggacagccctcccctgagacaccgcccccggggccctccgccgccttccctcttcggggaccagcctgacctcacctgcttaattgacaccaacttttcagcgcagcctcggtcctcacagcccactcagcccgagccccggcaccgggcggtctgtggccgctctcgggactccccaggctatgacttcagctgcctggtgcagcgggtgtaccaggaggaggggctggcggccgtctgcacaccagccctgcgcccaccctcgcctgggccggtgctgtcccaggcccctgaggacgagggtggctcccccgagaaaggctccccttccctcgcctgggcccccagtgccgagggttccatctggagcttggagctgcagggcaacctcatcgtggtggggcggagcagcggccggctggaggtgggcagaggggctaaaggtgggc

SEQ ID NO: 31921 - DNA, 1080 bp, Homo sapiens
agaacatggccacggagctgggcatcatcctcatcggctacttcaccctagtgcccgccatccaggtaaggccccaaggcctgccacctggatgagcatggaagcaactgctgtgctccccagctgtgcagccatgggcagggtgctcccctcttcagcacaggcatccttgcttctgaggtgggacctctttgcctggcaagcagatcactacagcacccagatggcccctggcatgcctggctcagaagtgctcagcaaaccctggctgggttcccagattgagcacctagccaggcagactctgcccttgaccctgtcttcctacccctccctgcctgcttccctttcagccaagtggcaggaggaggctgcaagggcatggcaggagctggggactggctgtgcagtttgtcacacctgtttcccatttttgagggagaagcaccgtggggttcctagacccttcctccggtctcctcccttggccctggcctgtgccgcagtcgccagacgcatggccttgcctggcctgaccagtgggagggccaccacccattgcccagagtgaccctgctcttggcaaagtgccctcactcagctgtgggctgtgagcagaggtggaggtggccctgcactgagctggaaccccagactgatgccagccattccagaaggagttgcaggaaggggaggatgccatcttttctcgcccgtctttcccccagggctggcaggccagctgagggatgggggtgagcagagaacagatgggctgtgggctgcttctcctggaaaaacagtagtatctgcaggatagggtacagtcttgggacgttagagctgagacaaccactgtgccactatctgcactccatggtcttaccccagatcggagtagcactgtggtgatgtgctagaggtctcaacaccgacatctcagaaaattttgtctgctgacagagcttggggagcagagagctcaccctttttcagttttagagaattaatccctctctctctctcttcattgttccggggcagttgctggctgggaacctttctgagagcccctgaatc

SEQ ID NO: 31922 - DNA, 1285 bp, Homo sapiens
ttccagcctgcacttaaagtcagccccaaacctggaaatgtgtgctggatgtgcacagaaagaggtctaacagaagccatctttctagtttgaggagcaggaaaggggatcctcatgggtcaggaatggggatggaggaagaaatctcgtgtgttgtttgctttgtcttttctccttttctcttgctctggccctccacgtaattgtgtagtggtggagacagcagtgacattggcaaatggataggagaggaagtcttctatttaaagggactgtggtcccaggagcatggagggaatccttgattttgttctttcctttctctcattgcttttccttggaggtagtcacagttgtgggaggtactcagcaggttagggaaattaaacccctgacttttagccagaagaccaggaaaggggcccttgggatctggaaagtgttaggaagattgtgtagaggaaggagctcaacaaattgaactcataaagttgcatatgaactcttgggctgttcctcagaactaacatacgtgcatctgaccctaaacagcataccaaaggctttgaggaccaaactgtggagtacattactgctcaagtagttctgcactggcccctggacggtatgcttgggaaaaatcaaaataatacttaaaaggctttgaaaactgatatcatattggtaccacagcccacagaaggtgggtaggaacttgtggactggacctaattaggttgattgctgcaaagacaaattcaaaattttacgtgggacttaaacaagagctagagtcacatagcataatattcaaaatgtccagtaattcagaattacttcagctatgaaaaatcaggaaaatcataaggggaaaagacagccaacagatggcaaccacaacatgacacagatgttgaaattatcaaaaaattaaaagccaaagtataattaaagtattaattaaaaccttgctataacaagtaagggtgaatgctcttgaaatgaacagaaaatcagaaatttatttactgcaaaatatgacaacctaaatgaaaaattaattgggtgggctcaatagcagaatggagaagacagaagagtcagtgaacatgaaggtagaataatagaaattatccagtctgaccaacagagatcgaaataaaatgaaaaaaaaaaatgaacagagcttcagggacccatgggacaataacagaaagtttatcttttatgtttttgaagtctcaaaaagagaggagaaagagtggtgcagaaaaaaatttgaaga

SEQ ID NO: 31923 - DNA, 1046 bp, Homo sapiens
tgcctgaggtgctttgtatcacagttagaagttgagaagatatgtactgagcactgtcctaataatatctgatcctggttgggttggttggtttgttcatcacttattcaacaagtggtttgttttcagagacagggtctcactgtgttgcccaggctggcatcaaactcctgggctcaagggattgtcccacctcagtctcctgagtagccgggattataggtgcatttaataaaaatttaacatgccaagtgctattaaagaccctgaagaacagacagggagtttatttatagtcttgacagaggacagatagtaaaccagggaataagtcatttgtacaattacagagttttaaatgcactgaaaaagaagaaataggctctgtaaggaacaataaagagaactactggaaaatatatggtcaagggaggtctttttgtagaagtgatatttcagctgagacttgaagaatgaaaaggaaccagcctataaagagaagagggaatagaggatggaacagtatgtgccaggcccctgagatgggaatgaggttggcacacataaggcattggaagaaaccagaacagggagaggtgacacgaagtgaagttgcagaggaccggggtgggttgtgcagagccctgagagctagggggaggcatttgggctttgttctaagtgcagaagggtatccagctcacagcattagtagaatctgtgtccactctgacctctgagataaagtgaattgtaaagggataggtaggaaggggtctatgagggccaggcatggtgggtggctcagcctgtaatcccaactctttgggaggctgaggcaggaggattgctggagtctaagagtttaagaccagcctgggcaacatggtaaaaccccatctctattaaaaatacaaacatttcgttgggtgtggtggtgcacgcctatagtcctagctacttgggaggctgaagtgggagaattgattgagcctgggaggtggaggctgcagtgagccatgatcgtgccactgcactccagcctg

SEQ ID NO: 31924 - DNA, 1086 bp, Homo sapiens
ggtcgggcatggtggctcatgcctgtaatcccagcactttgggaggctgaggcaggcagatcacttgagtccaggattttatttttatttatttatttattttgagacagagtcttgccctgttgcccaggctggagtgcagtggcgcaatcttggctcactgcaacctccacctcccgggttcaagcgattcttctacttcagcctcccgagtagctgggactacaggtgcctgccaccacgcccagctaagtttttgtatttttagtagagacggggtttcaccatgttagccaggatggtcttgatctgctgacctcgtgattcgcctgcctcggcctcccaaagtgctgggattacaggtgtgagccaccgtgcccagccagaagatctgttttataaaaagggttataaagataaaaacaatcctaaaggctgggcatggtagctcatacctgtaacctcagcgctttgggatgctgaggtgggaggattgcttgaggccaggagtttggaggccagcctgggcaaaatagcaagaccctgtcttgaacaacaacaacaaaaagctgggcatggtggtgtggtcccagccactcggaaggctatggtgggaggactgtttgagctcaggagttcaagcctgcagtgagctatgatcaagccactgcactcgaagctgaatggcagagcgaaactgtctcaaaaaaaacccaaaaccggccgggcgtggtggcttacgcctgtaatcccagcacttcggggggccgaggcaggcaaatcacgaggtcaggagatcaagaccattctggctaacatgatgaaacctcgtctctactaaaaatacaaaaaattagccaggagtgcttgcaggcgcctgtagtcccagctactcgggatgctgaggtggagcttgcagtgagccgagatcacaccactgcactccagcctgggcgacagagctagactccatctcaaaaaaacaaacaaacaaacaaacaaaaaccctgaaaccaaaaaccaaaacaatcctaaagactgctgtagcctaatgagaggttgatatagtttgggtctgtgtccctg

SEQ ID NO: 31925 - DNA, 1028 bp, Homo sapiens
aggcatggtgatgcgcacccataatccagctacttgggaggctgaagcaggagaattgcctgaacctaggaggcagaggttgcagtaagccaagattgcgccactgcactccagcctgggcaacagagtgagactctgcttcaaaaaaaaaaaaaaaaaacataaaaatactttaagggtcttcctctgaaagactttttccttctgtttcctttttttttcctctttcacattttctgtattgagccaatatgactactgtaatggaggggaaccctttatttgtagttagctggtgataggctttattttacaagttggccccattaccagatggcacatctgactatcatctcatagaggcctcagctgaagggcacagagaaggtagggtggggttcccagtggagcaggtcctggggtggctgctcctctttcattcttctctgtctctgtagctgaggatcctgtggaggagaccatcgcagcccgcagtccaccgggatcagagcttcacttaccagtataagatacaggacaaaagcgtgtccttttttgccaaaggaatgtctcctgctgttctgtgacctgatttcggagcagctgaagctacataggactgtttttggacgtggaagatagagcaacatagcaagaatgggtctttctcctctgtagtaatatttcaggctggaccggcgactccactgtgaccagagggttgagtgctgcagtgatggcatgccttggctgccctgggccctgttcagaaaacacaagggaccacaatcctgcctttgctgagagagaggctggatgctagacccaagtgaaaggggtcctttggagcctttgtttaaatatgccttagccccagctgcccatttttggttgacaagcctttcagagccagagtgggtatagatgtgccagccaggagatggcaccggatggcaggtgtgcaaggtgacaactaggataatcatggctggaataaagtaagtttccacactggagcttcctgtggg

SEQ ID NO: 31926 - DNA, 1071 bp, Homo sapiens
ggcgtaccaccatgcctggctaatttaaaaaaatttttttttgtagaggtatagtcccactctgttgcctaggctgttcttgaactcctgggctcaaatgatcctcccccgctggccccccaaagtgctgggattacaggtgtgagctactgtgcccagcctgtttaactttttccagctgtgtataacctcctgggaaggtttccgcctgcccaatccaagctgatcttccagattccttaagctcttgggttgagaggctgtatggtgtctcttttttttttttttttttttttttgagacagagtctcattttgttgcccaggttggagtgcagtgggatgatctcagtcgtggctcactgcaacttccgtctcccaggttcaagcaattctcctgcctcagcctcctgagtggctggtattacaggtgtgcgccaccacacctggctaatttttgtatttttagtagagacggggtttcaccattgttggccaggctggtctcgaactcctcacctcaagtgatccacccgcctcagcctcacaaagtgctgggattacaggtttgagccactgcacccagctacgtatggtgtctcttaagggcgctaggagctgtttatttttgtgtcttccagtttctaacacagtgctttatacctagtaggcctcaggaaatatttgaattactcctgtacatgtgcatgccttttctttctaaccagatcatgaagtctttgttgccaagaattgtgatacagttctttgtcccccttagccctctcctgtcgtgctacttggtccttgataaacatctgtagagagagtgaagtctggtaacttttgtcctgtctctccagggaggctaatgctgggaacttgaaaccattgtttgagtttgtacgggaggccctgaagccagtagacagtggagaggctcggtggacgtacccggtgctgttggtggacgacctcagtgtgctcctgagcctgggcatgggggcggtggctgtgctagacttcattcactactgcagagccaccgtgtgctgggaactaaaggtactca

SEQ ID NO: 31927 - DNA, 1030 bp, Homo sapiens
tagaaaaagaatttttccatggcctggaaatgccccagccatatccacaagtttattaattaccctttctatttcctcatgactagagatgatggtgtttccaaaagttgtgctactagataataaagatctatttcttcaaccttcagtactattttcctccctgtactttattacctaatgatggttttcttaaagccctttcagcttgcacccactatgtggtcccaaagccaaagagaaacattttaggtttctgttacaaaagctccccatttccagataccaaattattttacaatagcaaaattgagtagtttaaaacataacaattttattaaatctcataattttgttaaattttaacaccaaacagctgggcaattctgctacatgtatcaattgagtcatttagtagtattaacttcataggtaggtttatgtagaaggtctgagacggcttcattagaatcctagtccttgacaggggtaactgaggtttttttccactccatgtagtctcagaatttccccttgtggtctttccagcagggtgatcatactttgtacatggcaacttgagactcccagagagaacattccaagaaacaggacatgaaagtttgcaggattgtaaggcctgggcttagaaaaggctaccactaatttttattgggcaaggcagagagcctgtcttgatctgcctcttaatgaaataaaggccagtgaacttgtggctatctttaatctaccacaagtcccttctaagaattacccaggaaagtatccactcaagtatcaattattccaaagatgcattggaaaataactaatgggcctttgggtttggaattttaatttttagttccagctctgccatttactcgtctcttttttctttttcctttttttttctttctttctttcttttttttttttttttaaagacagggtctcaccaggcacggtggctcacacctgtaatcccatcactttgggaggctgagtcagacagatcacatgagatcag

SEQ ID NO: 31928 - DNA, 1029 bp, Homo sapiens
actgcaacctccgttttctgagttcaagcaattctcctgcctcagcctcccaagtagctgggattacagccacgcgccaccacatccagctaatttttgtatttttagtagagacgtggtttcactatgttggccaggctggtctggaactcctgacctcaggtgatccacccaccttggcttcccaaagtgttgggattacaggtatgagccaccacgcccagcctctgggcctttgtgttcctaatactgttactgcacatagggatcagtcagtcactatttgagtgaatatatataagccaagattgaaggtcttgattatatgtggtattctaaaattgtatatagttaaggggagggtgagggtaataatgaaattgattatagttcctgcattattctaaagacgatatttgtacttcacatttttaatttcatttaattcctaaaagagtctcagctgggtgtggtgtgtcatacttgtagtcccagctacttggaaggttgtaggatcacttgggaggctggaggatcacttgatactaggactttgaaaccaccctaggcaacatagggggaccctgcctctaagcaaacaatatagcctcatgaagtcagtgatagtcagttgcggttttttcagtttctaaagcatgatcactgatgttctctcatggttcttcctgaaattattagcagatggctgtattaaaagactttgtcaacttttccagcagcatttcaacttgcttctttgttgatggtgtgacatttaaatgctcttaattctttaaatcaatcagtaattattaagtacacacacacacacacacacacacacacacacacacacacacacacacatatatatattttgttgtggttgttgttgtttttgagatggagtctcactcttgctgcctaggctagagtgcaatggtgtgatcttgggtcactgcaatctctgcctcccgggtgttcaagggattctcctgcctcagtctcctgagtacctgggattatagg

SEQ ID NO: 31929 - DNA, 1032 bp, Homo sapiens
tattgcgtttctcccacattatacttattcagtctctgagccaactcagtcaaggtgacctaattcatatttatttacaagtaatttgtgcttaatctgtcatgggattagaaagaaattttaaaagtaacctgaagtttgggggttttgtttgtttttaataaacaaggtcttactctgtcacccagtgtggacggcagtggcacaatgataccctgctgtaccctcaaactcttaggcccaagccatcctcctgccttctcagccaggtagcctgtaatttttatttcagttttatttaacttcaattttactcattttaagaagattgaacctttatcttcatctaatgtctgctcatactcactgtggggttgcatatttgagggttggtttttttttttttttggtgggggggacagggtctcgctctgtcacccaggctaaagtgcagtggcatgaacacagctcagtgcaggcttgacctaggatcaagagaccttctgggatcaagcagtcttctttcacagcctcctttgtagctgggaccataagcatgcgccaccacgtccagctaattttttgtagagacagtgtctcactttgttatgcaggctgttctcaaactcctagtctctagtgaaccaccacacccagcctgagatattttcattgatggagttgatagaaattattgactaattgctattggaaggtgagagagtgaagaaagtcaagattgggttgactccccccaccttgccgtttcatggaataccaagaggatgatacagttaataaagatactgagaaatacagaaattaatctttcatcctcatttcctatttgcataaaaccaaccttttaaaatttttagtttttaaaaaagttattcttggctgggcacggtggctcatgctgataatcccagcacttttgaaggccgaggcgggcggatcacttgagctcaggagttcgagaccagcctggccaacctggtgaaaccctgtctctactaaaaatacaaaaat

SEQ ID NO: 31930 - DNA, 1049 bp, Homo sapiens
gcttgctaacgtattgaatatctcatataatttatggaatattacatcaaaaatgaaaagcagaatgatcatgtggatattcagattatggtttcaacagaatgcatcgcttttgcaccattgtaaagctgaaacaccatgagtcaaatcactgtaagtcaggtaccatctgtaatataaatcaagactgaggaacttttgaaagaattcacgagtgcattcttttcgctgtctgaccgatcatttcattgtgcatcatgcagcctctaaagtgtcagactctaaatctatgtgagaatgagaatgaaaaggcaaataacatcttagtgttattatgaaaatagttttgaccttaagtagaggctcatgcagaagaaacacagttagttttgcttgggtccattagggaagtcttcacaaagaatgtgacattttatacaggaacaaataaggaaaaaatgaaggtaggtggcatattctggaatgaatgccaagaggtctgtggggagcaggtactctggtcaagtgcatgcaactctggagatggctgggggactgattttgaagggttgttaccttgcagacattgggaagtcatcagaaaatagaagtagcatgattcagtctgtttttgaaaataactgctggcagtttacaaatgaagtgcagaaaatggagggtggttcctgccaaatagtcgtaattcatgattattacacacttatattaaaggcagctatgtggcaaacatttaaatctcttctccaatatgcctctcccagttatttcagcctgttaggaaataattactagacctttcttcatactgtttttgctaaccatgttattactagaatgtctttggcacgggacccactagtttaagttatatgccttcttgtttaagtcgtttaatcctcttttaacgctgcagacatgggtcagattacacatttttggggaaggatttttaacctgttggtttatcaacaataacaaaatgacatgagatacatggagaggctgcagcctcctaagtgtttatgatt

SEQ ID NO: 31931 - DNA, 1071 bp, Homo sapiens
gagaatggcgtgaacccgggaagcggagcttgcagtgagccgagattgcgccactgcagtccgcagtccggcctgggcgacagagcgagactccgtctcaaaaaaaaaaaaaaaaaagaaagtaaagctggatgaacactcaaaacacctcttacatttatattttaagtgatttcccataggaattatttaggaaatgagtgttttcttatgagaagggtcttcttcagtccatctttttaactatggtcactcaccaagaactattaatttctgtacatttatatattttttgtttttcattgactggaccattctaggcatacaaaaaatacttctgagtacccatatttagtccacattgtatagggatttttgattggccatttgagtttcttttcaggagaatcctttggaggaagtaactttttttttttttttttgcaaaagcaaggaaactgaggcatggagaggttacataagtgtgtatctgaaccagaaatttaacctaaatctctctaatcccaaagctctacttctcttcattgtagcaggctgccagaagtaaaatttgtagatgtgtctgtgtggttttcattcattgaacaagcatctttaaaggcttaatagctccaaaatactattccgtcttagatactatgggaaatataatgctgaagagcccaggccctcttgagaacttaacacctgtctcctgaaataggcaaatgcatcaggcagagcagctgtggttgacttcctctatatgccactgaatgccaacaaaacccacagaagcctgggtgctgtggcttatgctcgtaatcccaacattttggcaggcaggagaattgctttaggccaggatttcgagaccagcctggtcaacatagcaagaccccatctctacaaaaagtaaaaataaaaaaattagctgagcatggtggtgcaaacctgtagtcctagctactcaggaagacaaggtgagaggatcacctgagcccaagctacagagagctgtgatccacactactgcattccagcctaggtgactaagcgagaccatgtctc

SEQ ID NO: 31932 - DNA, 1029 bp, Homo sapiens
atatgttgaatttttgttagaagtatagtgtagaagtgtgggtatttattgttttttgtaggaaatccaccaagagtggtttaagtgccaatattaaactttttttttttttttgagacggaatcttgcactgttcccccggctggagtgcagtggcatgatcttggttcgctgcaacttccacctctgggttataagcaattctactgcctcagcctcctgagtagctgagattataggcacgtgccaccacgcccggctaatttttgtatttttagtagagacgggtttcaccacgttggtcaggctggtcttgaactcctgaccttgtgatccgcctgcctcggcctcccaaagtgctgggattataggtgtgagccacggcgcctggcccaaacaaatttttaaaaacatttaccctcttgactttaaagaggctaactcagccatttatcatttatttgactcaggttcctgctgctcaacagatgctaaattttcctgagaaaaacaaggaaaaaccagttgatttgcagaactttggtctccgtactgacatttactccaagaaaacattagcaaaggtaatttttctaatcacacatgggctgcaatccagcacatcttagtccttctaagatacatctaatgagctttctactcaaatctgatggtatttttaaaaacaattatgatttatcttaccttttatattcctatatgacttagtagataggtattttaaaaataacactattagagaaattcgaggggaaaatggagaatttgaagagagaattagaatctgtaaaaagaatcatgaatattttagaactgaaaagtatacttgaaattatttgataggtttaataacgactgcatacagcagaagacaggttagtgaactcagagacaaattagtagatatattgaaactaaagtaccaagagaaaaaattggattgaggtagggaggggccaggacaaagagaggagagtggaacagatatgtgagatagagttcaggctg

SEQ ID NO: 31933 - DNA, 1028 bp, Homo sapiens
gatcgcaccattgcactccagccttagagacagagcgagactctgtcacgaaaaatgcggatttttttaatgtgtgtatttggtctatgtgtgagttcttttattaccatggacctaaatgcgtattcgtgctctcatttctgtgattgaaatgattaggctttgtaataggtttgggggtgctgtgttatcaacattacttgtggcttgtagaaattgttcgtcacataacaaaatctgtcaagtagtttgtgatgtttgacagcctgctgagcacatttactggttttattgtttctgttttttaatggcatgatgatgatagtaaaagcacatgaagttgattctttagattttaactttccgagctttattctttagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggtaaattaatgttgacttttcatcagacctggatagtaacaaatggccatttatagcatatctatttagaaacaattattattatactataatgctattattagtgctatttctttgatccttgcttgtgtgtgtattttggtgtactgtaaatattacagtccaaaagaatatatagtgtttaagttaatgctgtcccaccaatcccaagaccgaatgccttactctgtcaaattattaatttacttttatatgcataaaagtaaattatccttctgtcatcaaaaagacactcataagtaagcagatgatgcaaaatcttctttcccttccttcaatctgtgttctagaaatgtgaagcaaagaaatctttataacttgtcctaagatttgtaaagtgtatatccatatatacattatcaaaacagattatgtcaaacaaattatatatagcattaagttggattcacaggaacctaaggtataaattttg

SEQ ID NO: 31934 - DNA, 1035 bp, Homo sapiens
tctaattaaagtactttttcaaatgtcactgaaagaattgtttttgtaacagtatgcaaaatgatactgtattgttagaacaaaaatctgtggagtgttaatactttgtaagccaaattaaagtttctaagcagtataaaatgagaatgacatcatcctttcctagtatttccaagtcttagagtacattttcacaagtaaggtataattcttgagtgattttgcaggagaatagaaaagagtataatcacttgttctccttaaacattaaataggggtagttttaaacatctttgttctggagagttgtagatgagacattaggcttgatttcttttcttcacttgtaaaggagaacctattgttttcagtatttactaaaattttgactttacggaactttaaacctgaaagggattttcaagatcttttttagaaaatgagatgtcagttctatcttctaattaaggaattctgtatttgaataaattgcagtcattattattttttgagacggagcctcggtctgttacccaggctggagtacagtggcacgatcttggttactgcaacctcctcctcccgggttcaagcaattctcctgcctcagccccctgagtagctgggactacaggcacgtgccaccacgcccagctaatttttgtattattagtagacatggggttttaccgggttggccaggctgatctcaaactcctgacctcagttgatccacccacctcagcctcccaaagtgctgggattacaggcatgagctttcgggcctggcaattacagttattattgatggcagatacgagtgggtattttggagagtgatccatcaactgtaaatttttgttctcagagctgttgtattttgttttttgttttgagacaaagtctcgctcttgtcacccagcctggagtgcaatagtgtgatcttggctcactgcaacctccacttcccaggttcaagcaattctcttacctcagcctcccaagtagctgggattacaggcgcctgccaccact

SEQ ID NO: 31935 - DNA, 1079 bp, Homo sapiens
gtggaggttgcagtgagctgagatcgcgccactgcactccagcctgggtgtcagagtgagaccctgtctcaaaaaaaaaaaaaaaaaaaaaaaaaaaaaaaaaagaaaaaaaattcaacttcagatttactgtatcattcaaaggtgtatatcctttagatttttttcaaactgctattacatactcataaggtgtttaagcttctcagtttgatgctatggagcttctgaatggaaatacagttgtaaggaataggatggcaacagagaaaattaatgtttaattcatggattttttcattttagcatgagacagaatctcattctatcgcctaggctgaagtgcagtgttgcgatcatagcacactgtcaccttgaccttcggagcacaagctatcctcccggctcagtattctgagtaattcgggccacagacgcacacccctacatccagctaacttttttttgtttgtttttgtagagacaaggtcttactatgtttcccaggctggtcttgaacttctgggctcaagcattccccccgcctcggcctcccaaagtgctgggattacaggtgtgagccaccgtgaccagcctaattgatgttttaattttagattatttacttatgcctctgatgcttttacctaatctagtactgataatttaggtgtttttttctttatgatagtctattttattaaattggtagttgctgtatgcaggcttacttttgtttgttgatcttaatgtcttgcaactttcctgaacttgttcattaggtctggaagctttttttatgtataaaattgtatcatctgcaagccgggatagtttttacttataaaggttgactttttttttttttccttctttgagacggagtcttactctgtcacctagggtggagtgcagtgacatgatcatgattcagtgcaacctttgcctaccgggttcaagcagttctcatgtctcagcctcctgagtagctgggagtacaggcatgctccaccatacccagctaaatttttgtatttttagtagagatgggctttccctgtgttggagaggttggtctt

SEQ ID NO: 31936 - DNA, 1047 bp, Homo sapiens
ggggcaggtgatcggcctctgcgaatgtgctctgtcatcaacacttagagtgttgttgataaacccaaagacatccttcgtgcctaaagcaatgactgattttggctctgtgctgttgaatgtttttatcagtgattttcatgaacataaggatgaaatgattaagcaaaacaaatttgagggactttgctatcaaaatctgggtctagtataaattattgatgctttcttgttctctttaatatggaataaaaatagagatgattaaattacaactcacatatcattagtagtatcacattattaatgttttatgcatttgaggctttgaaaataaatcagcttgtttccttctcaatactgtaaaaccttgagtgattttgttatttatgtagatattgatgctttgatatggttttaggttcatgtgaaatggattttggacactgatattttcaatgaatggatgaatgaggaggattatgaggtggatgaaaataggaagcctgtgagttttcgtcagcggatttcaaccaagaatgaagaggtattttctttggcacagtttctcatcattaagtctgtcttcttggcctaaatgttattaaatcttcatcagtaagctgtcatatacaaaccacttaggaactttcacatctgcctgatggctgatgtgccatcaggtgaaaattccaaagtggctgtaatagccatctcagaaacaataacctcccaaaaagtggtatgaaaatcttaaaaggttattaagatttaaagtggcccatgcagaagggtagtggtatagctgattttgcccactagatctgaagtgtaatatcacagcagaatttaatgtagctgttggttttcctatgcaaaactcattttgtttagtatgtatatatattttttgagacagagtcttgctctgtagcccaggctggagtacagtggcactatctcggctcactgcaacctctgcctcttgggttgaagcgattctcctgcctcaagcctcccaagtagctgggattataggcgcttgcc

SEQ ID NO: 31937 - DNA, 1035 bp, Homo sapiens
tgcatcaaaagaaatttttttcttgagttttttttttttttttctttttagagatgaggtgtcactttgttgcccaggctggaatgcaatggcactatcctagcatccttgctcactgtagctttggacttctgggctcaagagatcttccagtttttttgttgttgtggttgagagagtctcgcgctgtcgcccaggctagagtgtaggggtgcaatcccggttcattgcatcctctgcctccgaggttcaagtgattctcgtgcctcagcctccgaaattgctgggactacaggtgtgtgctaattgtatttttcgtagaggtggggttttgccatgttggtgagcctggtctcgaactcctgacctcgagtgatctccccacctcagcctcccaaagtgctgggattacaggcatgagccactgtgcccggccacaatggtttctcactatgttcccaggctggtcttgaattcctggcttcaagtcatcctccagcctcgccctcccaaagtattaggattgattataggtgtgagccaccatacctggcctctttttgagttcttaaagtaccagtgttttttttctctcccctcatctttagcttttagcctagagtagcatttaataaagtcattgctatggagtcgttagtcttattgtaaagtgtgcttacatagacctaaggaaactagtgtattatgtatcacagaaccctatatcacagagattataaagtcaaatagagttggtaacataattgttggtaagaagaaatgaagtattactttcaagtaatcctgtcttccctaaccccccattttatgtattctgttacatatatgatttaaaaaaaaaaattgaaggccgggcgtggtggctcacgcctgtaatcccagcactttgagaggccaaggcgggcggatcacgaggtcaagagattgagaccatcctggccaacatggtgaaactctgtctctactaaaaatataaaattagctgggcatggtggcatgccactgtagtcccag

SEQ ID NO: 31938 - DNA, 1073 bp, Homo sapiens
aaaaaatatcaaaattagccaggcgtttgggagggcccctgtcgtcccagctatttgggaggctgaggtgggaggattgcttgagccaggtggcgaaggttgtagtgagctgagattgcacctctgcactatggcctggatgaaagtgacaccctgtttctcctcttttttttttgggtcagagtttcgctcttgttgccccggctggagtgcaatggtgcgatctcagctcaccgccaccaccgcctccctggttcaagtgattctcctgcctcagcctcctgagtagctgggattacaggcatgcaccatcacgcctggctaattttgtgtttgtgtttatcttggccaggctggtctcaaactcctgacctcaggtcatccacccacctcagcctcccaaaacgtaggattacaggcctgagccaccgcgcccggccaacaccctgtttctaaataaataaataaattaattaattaaagggacagatagtaaatattctagatagtaaatattttaggcctgtaggctctgtgggctctgttacagccactcagtgtagtatgaaagcagctatatacaatacgtaaatgagtgtatgtatatgcagtacataataagtatggctgtgtactggtaaaactttaattttgatttttttgagatggtaccctgttgtgttaccaggttggagtggtgtcctgaatgaacacagctcactgcagccttgacctctagggcttaagcaatcctcttgtcttagcctaggcatatactaccacgtgtggctagtttttgtttttttttttttgcgaggctgaagtgggaagattgcttgagcccaggagttcaaaaccagcctgggttagatagtgagaccacatctctacagaatattaaaatattagcgtcagcatgttggcaaactcctgtggttggagctacttaggaggttgaggtgtgaggatcacttgagcccaggagttgaaggctgcagtgagtagtgatcattccactgcactccagcctgggtgacacagtgagacccttgttgtttttcgatagctgtttc

SEQ ID NO: 31939 - DNA, 1027 bp, Homo sapiens
acttgaacccgggaggcagaggttgcagtgagccgagattgcaccgctgcactccagcctgggtgacaagaccgaagctccgtctcaaagaaaagaaaaaaaaaattaaccgtcttaaccatttttaaatgcacacacatatttgtttttgtaagctcctttatagcacagagcgtgtctcagacatctataaatttcccataacgtaagtacttagtaggtactaggaagtaagccaacattttctcctgcaaaaattgtactagtttttgaatgcctgtctttatcttgcagtatgttcatgcggatgctcctaccaataaaacactggctgggctggtggtgcagcttcttcagttccaggaagatgcctttgggaagcatgtcaccaacccggccttcaccaaactccctgtaagtacatcagcttactgttatttgggcatcctcagttgctgtatacttttaggtgtagcatccagcttttttcctttgctgctgctagcgtgtagaatttaaaaaaaaaaagcaaaaaacaaattttagttatagaatattactattttttaactgtaggaagctgctttttgaagaggcatttaacatttgcattaaatattgcagcagtcattgtgaagacctaacaatattttactatgttgcagttccctatcctctcgccgtaccgagtcttctccatgctttctcctgatgcagctcttatgccataaatagaatttatggaattttttatattttgtaggtgagataccttctgaagttgtgtgagaatataattttggtgtccttgcaattgtgtgttttatttttgtttttacagacaggatcttgttctgttgcccaggctggagtgcagtggtttgatcacagcgcactgcagccttgatctcccggctctagccatcttcccacctcaggttcccaagaggctgggactactagcatgtgctaccacgcgcatatgggtgacttttaaatttctgtagtgatgggatcttgctgtgtt

SEQ ID NO: 31940 - DNA, 1042 bp, Homo sapiens
atgatccacccgcgtcagccctcccaaagtgctgggattacaggtgtgagccactgtgcctggctcattcttttttttactggtaatttccttgatgggtaagctcagtggtttgtcctagaatctggattcttctaattacatcctcatggttttaattaacatattctgttgtccctcaattttctttaaatttatttggttttggttttttccccacatgctagcatgacatgtaagtaggtaatgaggtttattctgtgagaaattacattcatgtctcattcttcggttgtctctttttttgtgatgttggcaattcctggacctgtgggttcagtaggcatatgccgtggtaagactaattctagcattacttcttcatttaccagctggaatacatccataatgtgaaactgactgcccctcaactattctttaattgcatactagacaaaaggtcaagagatagaggcttcaaatatggaacactgtctagaaatctgtggccctggccgatgcagtggctcacacttgtaatccaagcactttgggaggccaaggcaagtgggttgcttcagcccagaaattcgagaccagcctgggccacttggcgaaaccccttctctacaaaaaaatgcaaaaattagctgggcatggtggtgtgcgcctgtagtctcagccacttgaggggcttgagcctgggaggttgaggctacagtgagctaaggtcatgcctctgcacttcatcctgggtggcagagtgagaccctgtctcaaaagaaaacaagaaagaaatctgtggctctacatcttggtgagggccctgggcttggagagtgactgttaacttcttgcaggtgctgttgtggttacagctaagatgagcttgtcaccattgcttgaagacccatgttgggttggtttaagcagctaccagatctttggctggtaaaagtacccttccctatgccctctcttatgggggataaggatagggagatgtttggatgaggtcttcatgtctccctcttcttgaatt

SEQ ID NO: 31941 - DNA, 1039 bp, Homo sapiens
tgcaagtgcacagaaacaacctgcggggaaagtgagttttatttagacccacctctgcaaggtgaagatggtaaaatacttcttccagcctgagccacatgccctctcttgcactttttccctttccctaactagtttctacttcttctcccctatattcccttctctgtgcttgatgactcggccatcagaaaattttttgtattaaccttgaaagttaatagagttgggagcccattagccctttggagaatacatatgtgtataatttttggctggataaaatggatccaaagactttcattcatttccttcacactgaccttgatgtgaaacctacctggtatggatgcaaatacagtgcacccacattcgttatcaagaagacatggcaggggtaatttccaccacctggaaccctggagcccctgtgctttaccttgaagtagaagatccctctcataacgctgctgggtatggagataacttcatttgtcctggttccccgggtcacctcttaactgaaagttaggatgctcattcccaatggaaacccacttagtataggtatgcagcatcaactggagggcagaggtaagctgaaaccacaggttctttccccttgcctctgtaaacctggaaaccaggcccctcctgagtgcttgcaacacctaccttccttagctgtagcaggtaggtgtgcctctgccagagaagcccgcactccagcccttagggaccagcatgggaagtctcagcctagggcattcctacagtgaagaaagctgcaccgtggcttctgggtgactactagaggtcctaggttcagaccaaggctcattaagtagtttgctaaccacttggttaccatcaaagttgtgaaaaaggctagaaatgagtaggtacaatgaggtatatgggttggagtttctcaggatttctgtactctgtggagaactcttcagcctgggacctgcatcatttgcaaagaaaggaagttggcaactattccttcttgagaaggtcctaggattctttg

SEQ ID NO: 31942 - DNA, 1013 bp, Homo sapiens
ttagtagagacagggtttcaccatgttagccaggatggtctcgatctcctgacctcgtgatccacctgccttgggctcccaaagtgctgggattacaggcgtgagccaccacacccggccaatcatattttttcttgttactaattagaatcatgattctcctggcattcttcattttgttatacctcacttccttttccttagcaagatctttgccatagagtatggaaaccaggttccttgccagttaatctgtattgtgctttgtcatgtattgttactaaacagctcaagatcaaggggaagaaatgtatatgaggctcagttcatgttcagtttttttttttcagcattgcaacattgccactcatcatcatgagtgtagccctgtgtcaggtactgaaggtaatggaaaaggtatataaggttgatccctgtactcttgttgggaacttgagtggtatgaatagagaaggtgagttcttggggacagaggctacagtttagcaagctttcctatgcggaccttggtaatttctttacattttatagaccaaagaacaatcttaacttgcccttttttctaaaggcattgtttaaaaactgtcatcaaatcattgcagtttatggcaaatggcctttttttaaaaaaaaaaaaaaagcaatctaaatcttttcttcatcttggaaaaagacttctcttggatttctgatagaatatttccagtatgctatgttattgcaagacagtaacttacagctagacaagaaaaatcagctttgttcaaagtaagagtatagcctgtccttatagtgtaatttttttctcacagttttgttttatggttccttcagtttgaatatacaatatttgagctcaaagcccagggcagcaaaggaccatgctgagttaaatgggggcagtaagctctggtgagtggggaaaactccaagctacaattgttagagtccctaagtctggaggtcagagaaagatgcactgcccccagtgt

SEQ ID NO: 31943 - DNA, 1033 bp, Homo sapiens
catgagaaatgtttctaaaatgtagaatatggtttctgaaatagttttacctttatgtatgtatgtctaaacacttggaacgtttacttccagggaagaaactagattataacttgacaactttatcttttattaacaaggagtgagtgtcatcaatcattgttaatagtagaattattgactttcattgtaatgataattgtttcctggaggcaataactgggaacagttggtcaatctggaaagtagtgttgccttggtaactgataagaaagaatgcagagaaactagttgtctgtcatgtataaaaaccaaggccctgaacaggttaaatactaactccaagcacaaggctaaaacagaaatatctgccagtacatgtactgggattagagacctgcaggctttgccaagagtcctggaaaccaccttctgcccagacacacaggaatccatgcgctttcttcaaactcagacagaatggaatagaacttcacaatatttagctcaaaggacattccagatcaccaccgcttgggttgggttgaagacagctttaatgatggaacggatcaggtcaaatgatgcagatgcagtgtaaaaggaaactacccatcctttcactgagcagatcttttttgaaagcttatttactgtgagtcaagcactgtgcagtgcacccacatggcacaaatgcacagttcacattcctaccttctagaagctcctgggaaagtcatataaataaaagattacagtgtggtttctaaattctaaaaagagatagagtattatgataatataaagaactcaggaggggttcaaagagactttgcagaggtgagtgagtaggaataggacctagaggcaaggggccgggtgcggtggttcacacttgtaatcccagcactttgggaggctgaggcaggaggatcacctgaggttaggagttccagattagcctggccaacatagtgaaaccctgtgtatactaaaaatacaaaaattagctgggtgtggtgattagctggga

SEQ ID NO: 31944 - DNA, 1120 bp, Homo sapiens
aagagatgactcagcctaaggtggcaggcaccatgcaggcattgattcctttggaaagtggatcaggcatgactcagacttctggtgttagcacagaaacaggagatgtagtcaaagatatgggtgtcaataaccagagcaaggaaggaaggtgtccatggaaggatcatgaggcagctccctggatttctgaaaagcctaaaaagagaggcaatgaaggcaaaagcaaaaagtttaaaaataattattccacacagcctgctagaatggagaggaaggaagaaatccttaacccaccttttgaagggaaggatggagatactggtagtattccccataaaagcaaggaaataggatttactttccccaaaatgcatgattcttcgttctcacatacaccagatacacccacagtggaagcagttgacaggaagggtggaaattttcaggttaattttgttgagcttgggactcttggggaaaacaagataagcacagtcaaggcttctactgttactgaaccacctgccaaggtgacagatgtgagctgccaagagcaaatccagggggcaggatttgttccttcagtagtatctgaggagaataagacagatgcagccaatagatacactgcagtggctgacaaaccaagtaaaaggagtaatgatggaaaaagtaaaaaggttaaaaatagttctcctgagaagcacattctggagaataagatagatgcaacaaaaatacatgttcccatggaaaccacaggggaccagggaattgaaggaatggcctatatggacgaaaatagaaatattacatttacctgtcccagaacaccatcagagctgataaataaatcatctcctctagaggttctggaatcagcagcctgtgaaaaactgcccactcctactcctcaagtagtaaaggaaggtgattcctttccagataccttggcaaaaaatgggcaagagatagccccagcccagatttccaaatcattaatggtagataactacaccaaagatggagtcccaggtcaagaaagacccaagggtccctctgctgttgtgccctctacaagcacaggaggagttgctctacctattacaacagccat

SEQ ID NO: 31945 - DNA, 1821 bp, Homo sapiens
acagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccaggtacgtgcttgtgcttattctcagtatttctctctaccaggttgtagtctcgagaagactaaggacaaacatcatgccaggtaaagtacagacagtcacactgtactttgcaagtttattcatactcctgctctcctagacaactctttcccgcctttaccctcctcccacctccaacaccttttctatgttcattctctgctgattgtcctgtttttcttgcagataagtcaagcaataaaatagaacatcgacaaacttctattccattatctacccaactacttgtatctgtatccatggtctctgcttatgaaagttcccgtttttataagtaaactgttcctgctcctaattaagaccaacctctcctcattttgccctagattccatctcctctttcctactcgatatattgccccatgtattcttcccttttttgcccctcataccaatttaaatcttttttcattggatcattcccacccatttaacaaacgtttgttatttttcccatcttaaaaaacgaaacattgaccgggcatggtggctcacacctgtaatcccagcactttgggcggccgaggtgggcggatcacctgaggtcgggaattcaagactagcctgaccaacatggagaaaccccgtctccactaaaaatacaaaattagccgggcatggtggcgcatgcctgtaatcccagctactcgggaggctgaggcaggagaatcacttgaacctgggagacggaggttgtggtgagccgagatcgcaccattgcactccagcctgagcaacaaagagtgaaaaactccatctcaaaaaaaaaaaaaaaagtaacataactagacataccttcccaacttcagcttccaactaccacttcactcctttgctgccccttgtaggagaactcctcagaaactaatcccatatccaatttctggcagatggaaaatagctgaaatcatgcttctctgaaacgtgtgtggcttttgttattacctttagaaaccgtcacaggaacggggaaaaagtgcagcttgccggccgaggaggattctgtgttagaaaaactaggggaaaggaaaccatgcaacagtcaaccttctgagctttcttcagagacctcaggtaagttaggaaaacaaaatgaactctttgaaacaaattaggggcgatagagtagtgatggtagacattgtctctagttccctgttgtatggtggtaatcagcagtatagtttatgaagtcaattctcttagacagattttatctggtttagacagaatgtcagcttgttatatctttaaaaattactactacagcaaatcaggatacctaattttttttttctccactgttttttttgttgttgttgtcgttgtttttttttttttgagacagagtctcactctgtcgcccaggctggcgtgcaatggcgtgatcttggctcactgcatcctccacctactgggttcaagcgattctcctgcctcagcctcctgagtagctgggattacaggcgcctgccaccatgcccggctaatttttagtagagatgaggtttcaccatgttggccaggctggtctcaaactcctg

SEQ ID NO: 31946 - DNA, 1035 bp, Homo sapiens
cgcggtgtctcacacctgtaatcccagcacgttgggaggccaaggcgggtggatcatgaggtcaggagttcgagaccaatctggccaacatagtgacaccccatctctattaaaaatacaaaaaaattagccaggtgtggtggtgtgtgcttgtagtcccagctacttgagaggctgaggcaggagaatggcgtgaacctgggaggcagagattgcagcgagccgagatcgtgccattgcactccagcccaggcgacagtgcgagactctgtctcaaaaaaagaaaaaaaactttttttgcattgttttttattagtctgtgtcttcctggcaatatatgcagctgattttaaatatcaaatacctcttaggccgggcgcggtggttcacgcctgtaatcccagcactttgggaggccgaggcggttggatcaagaggtcaggagatcgagactatccgggctaacatggtgaaaccccgcctctactaaaaatacaaaaaattagccgggagctgtggcaggcgcctgtagtcccagctactcgggagactgaggcaggagaatggcgtgaacccgggaagcggagcttgcagtgagccgagatcacgccacttcactctgtctgcgtgggcaacagagcgaaactctgtctcaaaaaaaaaacaaacaaaacaaaacaaaacaaaaatatatcaaataccttttgtttccaatgtttactaagtttcaaaatgtatttgtttgtgtttcaatattaggtatgtctccctgcaacacagctgttgtacctcaggggtggtctgtggaagccttaaactctccacactcagagtcctttgtttccccagaggctgttgcagaacctcctcagccaacggcaggtaaactattagagactccctttatcagttaatggttgcagtattggtaatcaatataaatcatcaggtgtattttttagcagcttacagcaggtataaaaatttcagaacaatcacaaatgttttgcttatattagtgatatcaccactgga

SEQ ID NO: 31947 - DNA, 1041 bp, Homo sapiens
ccattttggaaacagtttggcagtgtctcaaaatattaaacataaagttgctttatgacccagcagttctactcctagggatatatcaaagataattgaaacacgttcccacaaaaacctgtacgtgaatgttcatagcagcattattcacaatatccaaaaagtagaaacaaccaaatgtcagctgattaatggataaacaaagtgtggtggatctacacagtggaatgttatttggctataaaaaggaataaagttcagttaccatactacagcatggatgaaccttgaaaacattgtgctaaatgaaagaggtcagtcacaaaagatgacatattgtgtgacttcatttatatgaaatatctagattaggcaaatccttaggaacaaaaagtagacgagtggttaccgaggggtaggggaaagtgggaaaggagaaaagatatgggatttcttttttggagtgaagaaaatgttctgaagttagatagtggtgatggttgtataactgtgtatatgctaaaaaacctttgaactcgactttaaaagagtgaattttgtgaattatactcgataaaactgttatttaaaaaataaaaagaggctggtccaaaggtagtgagttatctcaattgttcagtcagttacagattgaactccacgttccactctttccctgcttctcactgttgtacttgactagtctttaaaaatacagatggagccaggcacagtggctcaaacctgtaatcctaggacttgaggaggttgagatcagagaactgcttgagcccagaagttggagaccagcttgggcaacataatgagaccctgtctctacaaaaaaaaaaaaaaaaaaattttgtttaaattaggcaggtgtggtggcaagtgcctatatttgtagctacttgggaggccgaggtgagaggattgcttgagcttgggaagttgaggctgcagtcagccatgatccacaccgctgcattccagcctggatgacagagcaagaccctgtctcaacaacaaaaaaagagcaac

SEQ ID NO: 31948 - DNA, 1022 bp, Homo sapiens
aacagaaatattgcaatttgaacaagggaaagttaacataaagaattattaactagtaatagattaaccattaaagggtaaagagaactctgaaagatgtaggtgtatcagctataggagcagctactccctctgtgcctgaggcagagtatgaaagaaagagacagattggagagagagcctacccaaggcggagattcagaccttttgaggaggtaaagctgtagtctgttgcagttttaagttcctgaggatggcaccagccgagggttaaaagcaagagtattgtttgctggagtgccaacaaaactgtctaggaagctgctctgggtggtgctgtcgaaaatcactgggaagttagctggggtgactggaactcacctgaagccactcattgtggtatccctaaaactggtgggtgagcaccgctgggtgtcccacgcatcacatgaggccacgggagaaagaagaggaaaacacagtggaaccaggaggaaatcctcttcctcctgtagtattcctccagtgcttgctattggcataagaaaaacatttgaagagtccagcttcattattgcaaagcagagcagtaaagtatagatttggaactgaaaggcaataaattgataactaatatatcatacctcttaacctatgcctagaatggaatacaatttccagatgtagtttagccagcataagtagagcaggatacctaccccactccgcatcattcctggtactatgttgttgatgttgcttgccaagaatgtaagctctctatgggtggtgattcttttttttttttttttttttttttgggacgcagtcttgctctgttgcccaggttggagtgcagtgggacaatctcggctcactgcaacccccgcctcctgggttcaagcaattctcctgtctcagccttctgagtagctgggactacagatgcacaccaccacactgggctagtttttgtattcttagtagagacggggtttcaccatgttggccaggctggtgtt

SEQ ID NO: 31949 - DNA, 1461 bp, Homo sapiens
tctggaaatatgttatctgtcatgaatttgtttaaattttgaggaagctgtggatagagcacctactagctttgatttcttaggcaagttgtttgccctctttgaggctaagattcctgctgtgtaaaaggagagctctataaaaatagttgtttgcctgaagtgacagaaattattttcagtgctttgaaacctcgttgaaggggttaatatttaaatgtaagatgatattagaatgatgattaatgtccacatagaaagttcttacagttcaacccattatatacttttgttaaatcattctgtttgaccatcagccccttttcctacttaattggttgtgtaacagtattttaatcggatgtaactggagcatattggtccattgtgaagcagaaatgctctgtttctagaggacaaaactggaggtgaaacttcaaaagtgagctccaggcagactgaaagaagagtttttttgttttgtttcttgtgaaaaaattaacttaggactctcactgcaaaaaactggcaagcctggccctccagtgggttttcagcaatttaaaatgaaatgagaagatgcaaaactatgtcaactgtaaacttaagtattaacattagactccttagaggtcttcattgaaggattttgctttctatttaacaaattaatatttctggtcttcagtttttctgtgtaaaacgaacaggcattctgctgtttctgctgctgctgttagtgctgagcaacagagatacagtatgttctgcggtaggtgatagctttttagacatttagagattaacatttgccttctgatttattttctttgggttaaacatctttcattttttcttccactctttcctattatgtagatttatgctgtttttaatggccaatatttggatcagagtctattcaggagacagaagctacaccataaattgaacagagaatttactataggggtaaagagaactctaaagaatacaggaatgacagatatagggaatagtcactacccttagggctggggcagagtacacaaagaaataacaaatttggaaaagtatgcgcccctcccccaccctgcccccaaagctgattgcatatcttggaggaagtctccatttggtagtaaagatgtttgctgagttgctgcaggtcagggtgatgtggggcaaacaagcccccagactggggcttaacccaggagggttcttggctttgccaggaaagaatttaagggtgagccagtagtgagagaaagaaacttttattgaaccagtgctgcttcttgctgagcagggctaacccataggcagtgtgcccagaatcggtgtctgtgagctgctagctagctgtttatatctgttattaattacatgctaattaagaggcaggttatttagaactttctggaaaaggggctggaagtttctgggaatcagataagg

SEQ ID NO: 31950 - DNA, 1032 bp, Homo sapiens
ttgggaccattatcttatattcaaaaattaacttaaaatggatcaaagacctaaacaaagcaccaaggctatacatttcttagaagaaaacatagagggaaatcttcatgacattggatttggcagtgttttcttggatatacaccaaaaacacagacgacaaaagaaaaaacagataaattaggctatatgaaaattgaaaatttttgtctatctctgtagagtgaaaaggcaacccatggaggcaaaatatttgcaaatcttatatcttctcaggagttaatatccagaatatgtaaataacttctagagctcaacaaaaaaaaattaaaaatatgggcaaaggacttgaagaaacatttcttcataaaagatacaaaaattgccaagaaatacatgaaaagatgctcagcatcattaatcattagagaaatgcaaatcaaaaccacaatgaaatatcacttcatactcattaggatggctagtatgaaaacaagaacagaaattaacaagtgtttacgaggatgtggaaaaattagaacccttgtgtactgctgataggaatgtaaaatgaaagtgctatggaaaatagtatggtggctcctcaaaaaattaaaaacagaattattgtaagatccagcaacccaacttctggatatatgcccaaaggaattggaatcagggacttgaacagatatttgtacactcatgtttgtagcagcattattcacagtggccaaaagatggaagcaacccagatgtcccatcaacacatggaatgaataaacaaaaatgtggtacattcatataatggaacgttatttagccttaaaaaggaaggaaattctgatatggtacaacatgaataaaccttgaagacactatgctaagtgaaaaaagccagtcacaaaaatacaaatttatatgcggtacctaaagtagtcaaatttacagaaacaaatataaatatactccatttatataaattaccttaagtagtcaaatttacagaaacaaagtagaatggtggtt

SEQ ID NO: 31951 - DNA, 1081 bp, Homo sapiens
tcagctcaccacaacctccacctcctgggttcaagcaattctcctgcctcagcctcccaagtagctgggattacaggcacacgccaccatacctggctaattttgtatttttagtagagacggggtttctccatgttggtcaggctggtctcgaactcccaacctcaggtgatccacccacctcggcctcccaaagtgctgggattacaggcatgagccaccatgcccagcttttaaagactttttaaaaaacctatcttaagttctagttactgagagaaaatccatattgaggcaagggctttgcatgtaggtagtttattttgggaagtggccccagggcacaagagtgggatactgggaaaagtgaaattagaggaaaagaatacagtgaagtatgactactgacctagtcactgctgtgggcaaagtgggcttaagtcttttggggtcttttgaggacctgtatagaatgcctctcagtgttcactacctgagtatcttggttatagaagtggataacatttattcaccatttaccatctctcattgcttaagactcttttttttttttttgagacagagtcttgctctgtcgcccaggctggagtgcagtggtgcgatctcggcccactgcaagctctgcctcctgggcctaacactcttgtacttctggatttgcacatgtgtggtgccaggatgcagatgtcttgtctcttggtgtcagagaagttgtagggcagaaaactctggtttggttgatacaaagtgctgtcaaatcacacctatgtgcagctggatgctgtagcaatagctagaataaatagtgaacttaacagagtgtgaggtgggggcacaagaagtgtctaaccaagaggttacttcaaagcaagattctcttaacataagatttgtctgcttatgccttaccatagaggatgagatccttcaactctgtagaggaaatttgaaggaactccatctattatggtactaatccttttttttttttctctccccgcgccccgcgagacagagttttgctcttattgcccaggctggagtgcaatggcgtgatctt

SEQ ID NO: 31952 - DNA, 1814 bp, Homo sapiens
tgagccaccgcgcccagcccacttatgatttttgatagttattgtaaactctcttttatccagaattataaaagttaagaagttcaaatgactactgatatttaatgtcatttggtgagaaagtcacttgacagaaaggtgtgaagaagttattccaaaaggaggtttccatggtatatcaattgttgttagatgctttctaatactacatttattaatttctaacactacatttagtttagtgcagttaaaattcacattcaaagtcttcctaaagtgcctcctgaattatcagataaaatttactacattcagtaacatttaatttgataactttgttatttgataacccagtatgcagtatctgggaagaattcaacaaaatgcgcagttccctagccattctgggttagtgtttgtttacagtagggttgcaagtacaatatgttgactgaattaagacattaaaaatattttatatctaagtaatttgcatagcataaggaactttttaagcttggcagacattttagttaagaacacttaatttaatgtttttagatttcctttttattaaaacagctcagtaatctgttctcaggtttaaagcacagattttaaatactataaggaataattgaccattaactttcttatacataccctaggtttaaagcttttggtaattgaagcaattcttgaattttgttattgtcctcatccctgatgcgaagtgaaacctggcttcatttggattcttcctccttattgacttgataatatggtgggaggctagagggtgttctaggcaaagacacaggactggtccagcaggcacagaatgttagtttcattcctaaatcatgtgtaatactgtattatcctcaattttatgttgatgccgtttccattacagtgaaggtttaacaagacttaactacaaattatttgtgggataaagctctgtgcgaccatggaggtaaattactcttatttatagtgtttggggctagacacattgcactaagtgctgtacaaatggcagtgttactggttgtttccatcgtaattagagtaggtaaacagtttactattgtgataactgtttgcatgtgtaaagtcatgccagcagtgaaacagtaaatctacttttttagaatatcatgacacagaaggtattctgtgtgcttcatcactatctcatctggtaggatgcaaaggatttagcatcagaaaaatgcaaaagcaccaaaaatgtgaaatattaacagataaataaatctgtggtgtgttagagtttctgaacagctattggagccacgctgtaaattggcatcataactcacaagtggagcccagacataagctgcacattatgttgctatgtatagacagcaagacatccatccgaactccaccaaattcctggaacaaagttttatttcttttctttcattttccagttaatgagttgcatgctggagacacatcagcaaattaacagcacgtaatgtttcttaaagtttttttggttcatggttttctaataaaaatacagaatttctcttcagaaaagtccacatatacccatatacaagatgttacatttacgtttagagtgtttaggactccattgaaaccagctcatggactacaatccttttctaagccaagcatttaattaatactctaagccacgttatttcagtttcttttggggctttgtattgaataagacaaaatagcttcttcttgagctttaagtgaaaatataattctgatttttttttgtttgtttttgtttttgagacgaa

SEQ ID NO: 31953 - DNA, 1037 bp, Homo sapiens
tggctaatgtgacacagtaaaatgaaggtttcctaacacagtggttaggaaaagtgagtatgatggtgggaatcaggcttctgttcttgctttttttttttgagtcagggtttcactctgttgcccacgccggagtgcagtggtgcaatagtggctcactgcagcctcaacctcctgggctcaatcagtcctcccacctcagcctcctgagtagcagggactacaggcatgtgccaccatgcctggctaatttttacatgtttttgtagagatggggttttgccattttgcccaagctctgttctagcttttcatgagttttttccctgcattttagctcccatagtagcacctttcaaggggtgaatagaagaggacagagacagcaacaggccattggtaaaccagattgccaatttctcatcagacagaatgagcacagaccccgagtgagtggctctagatgcgaatgacctaaaattttcaggaggacttcatggagcttaaaaggttcttcagaacttctgtgtaattaagttagatattaacactgtttaatctgtatagacctgtaaaatatttttagtacagtaattaattccagagtttgtgaactatccaaagtaaagcatacaacaaagtactgtggcctcatcatatatccttatttcctgtttatgagcacctagctcttaatagtgagattgtagtcaagagagtattttatcatcatgccatgtagttgcctcttgccttagtttacctattttaaaaaacccggctcactaatagtttcacttcaggcatgtcatcagaatgaaagatcagatatacaaagtgctgtgcttgaaaactgtgtgttcccttagtgcctggttagataatacagggcttattttctggcagagtggtgttgagtctcctttgatgttagccagaactgggtggagtttcttaagctccagtcagattggctcaagcagggcaccatgcagtggtgaatttgttttcagtccctccctttgccaaaaagcttt

SEQ ID NO: 31954 - DNA, 1027 bp, Homo sapiens
atttcagtaggccgggcacagtggctcacgcctgtaatcccagcactctgggaggccgaggcgggcggatcacgaggtcaggagctcaagaccatcctggctaacacggtgaaaccccgtccctgctaaaaatacaaaaaattagctgggcgtggtggcaggcgcctgtagtccccgctgcttgggaggctgaggcgggagaatggcatgaacctggaaggcagagcttgcagtgagccaagatcgtgccactgcactccagcctgggcaacagagtgggactccatctcaaaaaaaaaaaaaaaaaaagtttcagtgcattgtacatagtatggatgagtattgatttataaaacttctgtttcatttatatatgtgtatgtgaatatggatcataatataaatttttttttgccatggatggtgataaaaagaaaaaaatgaagacttgagaattagaaaaacacatatttttctttccttcactctttcatacgttcttttgcatctgccatgctcctggaactgggataggtgctgggtgagcatccaaatattccgaaaatcctcactcttttttttttttttttttctttttttggagatggagtcttgctctgatgcccaggctggaatgcaatggcgtgatctcggctcactgcaaactccacctgctgggttgaagcgattctcttgcctcagcctcctgagtagctgggattatagacgcctgccaccaatgcttggctaatttttgtatatttagtagagatggcattttgccatgttggccaggctggtttcaaactcctgacctcaggtgatccacccaccttggcctcccaaagtgctgggattacaggcgtgagccactgtgcctggccgaaaatcctcactcttgagctcacagtttatagagggtaataggcacataaataataaagtggtatagtagaagcacatgtcatacattaactgtgtactagaagtacatatcatatagagtgctcctgaagtcatggcgact

SEQ ID NO: 31955 - DNA, 1086 bp, Homo sapiens
cccagcactttgggaggctgaggcgggcagatcataaggtcagcagttcaagaccagcctgaccaattggtgaaaccccgtctctactaaaaatacaaaaattagctgggtgtggtggcgcatgcctatagtcccagctactcaggaggctgaggcaggagaattgcttgaacctgggaggcagaggctgcagtgagccgaggttgcggcactgcactccagctgggtgacagtgagactctgtcttacaaaataaataaataggctgggcgcggtggctcacgcctgtaatcccagcactttgggaggccgaggcgggcggatcacaaggtcaggagatcgagaccgtcctggctaacatggtgaaaccccatctctactaacaataaaaaaaaattagttgggcatggctgcaggcgcctgtagtctcagctactcgggaggctgaggcaggagaatggcctgaacccaggaggcggagcttgcagtgagccgagatcacgccactgaactctagcctgggggacagagcaagatgccgtctcaaaaaaaaataaaaaaataaaaataaataatatgattttgtcaaatttaaaaccttaagatcctattggcttgtaatagcaaggagtagaagcgtggattgtagaatgttcttatgaaggctttatttcatcaatggcttttaagcactttggggtcagactttgagctgttagtgattgtttttgagctgtagtccttagagattccaaactgatgactgcatatgtcacttgtatagtcaatgtgactggttttcaaaagccctttcagttatagagccaatgactgggcaacagaaatgcctttcatttatatcattcttctgttttcttggtgcaaagggctgtagttaagaggaacagttagattttagtggcttaccaagttgctttagaggaagtctatgaaaggactgttgagccaaacaatgttcagattaaaaaccagtctgttagcaggacagaatcctcttgcagatactttgtttaacctttaacttagtgcaagaagagttcaagctatgacttttgagattaaatc

SEQ ID NO: 31956 - DNA, 1049 bp, Homo sapiens
gtggctcacgcctgtactcccagcactttgggaggcttaggtgggcagatcacgaggtcaggagatcgagaccatcctggccaacatggtgaaaccccatctctactaaaaatacaaacattagctgggtgtggtggcacgtgcctgtagtcccagctactcaggaggctgaggcaggagaatcgcttgaccccaggaagtggagattgcagtgagccaaggtcgcgccactgcaccctagactggacacagagcgagactccgtctcaattttaaaaaaaaaaagattacagagcaattgcagtttttctcattaattattatgatcactttgcatggtttcagcgtgcattcttacttttacggttttgcactattgtgtaaaatgaaagctgcctgtttgtaaactgtggaaagtttaatttttcttcttagtttttaggggtaccccctaactagccttttctttgcagagtttgtatatgcatctctaacaaagtatgtttcctttgacaagttttgcttttaaaaaacttggactgactgaaaataatatttgtagaaaatattctaaaagtaatgcaaaaaggaaatatccttaaagctagtattaagaataatctcataggaaggaagtttcatgtgtttggtgttatctctctttttggtaacagttttgttgagatatattttatataccataccattcacccacttaaagtgtagaattcaggccaggcacagtggctcatgcctgtaatcacagcactttggaaggccgaggcaggtagatcacttgaggccaggagttcgagaccagcctgaccaacatggcaaaaccccgtctctactaaacatacaaaaattagccgggcatggcgacacgtgcctgtaatcccggctacttgggaggctgaggcacaagaatcgcttgaactcaggaggcggaggttgcagtgagccaagatcatgccattgtactccagcctgggtgacagagcaagactccatcacaaaaaataaataaataaataaaatgtacaattcat

SEQ ID NO: 31957 - DNA, 1029 bp, Homo sapiens
aataaccataaaaaagaatgtgtagaagagtctgatttttatagtttatttcaaagaaatttaagagtctcaatggtgctataaagaaattaaagactggctgtggtttggttgacttgaaaaggatatgtgggtctgagtgtgtgtgtttaattttttaaattttcttttgtttttgttttcagagagagtcttgctctgtctcactgcagcctctgcctcccgggttcaagcagttctcctgcctcagcctcctggtagctgggattacaggtgcacaccaccacacccagctaatttttgtatttttagtagagacggggttttgccatgttgcccaggctggtcttgaactcctgacctcagatgatccatccaccttggcctcccaaagtgctgggattacaggcatgagccaccacagccagcctaagtgtgtgtgtgtgtgtgtgtgtgtgtgtgtgtgtggaaattgaatggttttcaaaggtgatttgattagcatttgcatagactgtgaatccaagatgtttgtgttcccttccctcattcttccattcttttctctgtttgtcaatttttgtaccgcgatatatgagggattaaagaaaaatcttttagaatagttttggctttctgccttttttttttttttgagatggagtttcactcttgttgcccaggctggagtgcaatggcgcgatctcagctcaccgcaacctctgcctcctgggttcaagcgattctcttgcctcagcctcccgagtagctgggattacaggcatgcgccaccatgcccagctaagttttgtagtttcagtagagatggatttcaccatgttggccaggatggtctcgatctcttgacctgtgatccgcctgcctcagcctcccaaagtgttgggattacagttgtgggccaccgcgcacgtcctctatagtttttttttttttttaagtttatgataaattgaaacaacactaagaaaatcagataatacaggaatattaaatgaaaaccgaatcttt

SEQ ID NO: 31958 - DNA, 1155 bp, Homo sapiens
acacctgtaatctcagcactttgggaggccaaggagggcagatcacctgaggtcaggagttcaagagcagcctggcccacatgatgaaacccatctctactaaaaatacaaaaattagccgggcgtggtggtgcacgcctgtaatctcagctactcggaggctgaggcagggagaatcacttgaacccaggaggtggaggttgcagtgagccgagatagtgccattgcactccagcctgggcgacagagcaagacctcatctcaaaaataaataaaataaaataaaataatattgtatctagattttcaaatcaggtgtttatgcaggaaaagacaattgttttattggttttagaaaaccaacaaaccaaagcaacaataaagattcctgtatacatttttttctttaattaatgaattacttgggtcattctggtaaaataagatgctttcttgttaccgaatgccagttttatcagatgaaaaggactgtgttcatagatgatggagataatcaccagttctgatagttactctaaaagataagacataatcctgttcagccagacctagtgaaaatcagaaataccgatgaaacttggacacgtagagtaagatttttggcttaaaacacctttgcaagtgggtgggtatgtgtagtatttatgtgtgctacttggtttctaaagactccctactatatgctaatttttaaattatgtacatggtactttttaagcctcgcaggctggccagccggcctactggcctccctccctctctccgtacaataaattagccaaaataatgaggtaatatctaagtcattgtagtctaggactgagtcatttttctctttgaaaaaattccagaatactttatattttcttgaaggtaacttttttgcacttgttttaaggtattgttactttatttacagccaacgaaatggaactgttaggtttgtaagcatcttatatttttgaagtgctgattgtatgttcaatctaattcaataaatatttattgtctaatatgttctaggctttggtgtaggtgcttgggatataaggatatgtaactcatagttcagccttaagtctaaatatttagtatatttgtgttttttaatttagtttttaaacacagtttttt

SEQ ID NO: 31959 - DNA, 1074 bp, Homo sapiens
aatttttgtatttttagtagagactggggtttcaccatgttggccaggctggtctcgaactcctgacctcgggtgattcacctgctttagcctcccaaagtgctgggattacaggcgtgaaccactgcgcccggcccaaaatctttttcatttgttttttttggtgtgtggatatctagttgtccttgaaccagttgttgaaaagacttctttttccattgaattgtgtatcatcttagcatccatgttttgagtcaattgaccacagaggtgtgggcttatttctggactttctttttttttgagacagtcttgctccgttgcccaggctggagtgcagtggcgtgatcgcagctcactgtaacctctctgccttccaggttcaagcaattctcctgcctctgcgtcttgagtagctgggattacaggcatgcaccaccacacccagctaatttttatatttttggtagagacggggtttcaccattttggtcagacgggtcttgaactcctgacctcaagtgatccgcctgactcggcctcccaaagttctgggattacaggtgtgagccaccgtgcccggcctggactttcaattctattgcattggtgtacgtctatgccagtaccatcatgcttgctttcttgtattttcaccctgtggtactactatctgctactatctgcataaatatgctgtcttgattaatgtacttttgtaatatgttttgaaattaggaagtgtgagttttctaattttgtttttttgaagattgttttggctattctggatccttggcatttccatttgagctttaggattaacttggcaacttttgcagaaaaggcagttggaattttgatagggaatgccttaaatctgtagatcaatttagagagtgctgccatcttaacaatgtcagatcttccacttcatgaacgtgggatgcctttccatttgtttatgtctttaatttctttcaagaatattttttaagctgagtgtggtggtggctgacacctgtaatcccagcactttgggaggctgaggtgagaagattgcttgagcccagg

SEQ ID NO: 31960 - DNA, 1025 bp, Homo sapiens
aattttacttgatagaacctagaaatgagtcaccaagtcatatccatattctgggggaagggaattaagctccaacccctgaagggaggagtatcaaagaatttgtgggcatgttaaaattcctaaagtaattagttaatattttggggaagataactgtgaggttatacagaatctgatttctccttaaaaatttcctctacttattttagcattcattagtgaatcttgcctgcggcagcgttgattatattattctgttggttttctatttttctaattctttctacttttatgatttggaatccttttgtaaggaagatttatgcctcccccatttatttattaaatcatttatgtcaacatggacccatgaatatttttttctttgcttataatccagtactgtattttgttgctcaagttgttccagctttggccattctaacattggcacctatgttcttttgaaatacctttccctacctttctttgtcttttagcacttttgtacttcctggcactgtaagatgccccagtctcatcttgtactttacctgccccaaccctaaaatcagccatttctccaaggtgtcctggttccttctgttggagaagagtatttggaaaccactatctggtttctaaatgagcttgatgcactcattactgctagggtatcactgcttctaggccctctcaggggatagttaggaagtaatatatatatatactgacccacacatatcttcgtttacttccgtatctgtctgtatataaatataaacatgagtttatactgatatctctgatgctgatccagcaccacagagttcattctagcattctcttccttgcttctttctctgaaagtgagaaatttggctgatttaatgaataatacatgctaattttttcaactctaatatatatatgaagtaaaaaatagtcttaattgtcatataaagtaaatttccaaagcattttgcagttgttaactaatttaaattatactcctataatat

SEQ ID NO: 31961 - DNA, 1043 bp, Homo sapiens
agtttgcatatatttaaatatgtttaaaaatttatttatgctgggtgcggtggctcatgcctgtaatcccagcactttgggaggctgaggtgggcagatcaagaggtcaggagttcgagaccagcctggccaacatggtaaaaaccccgtctctactaaaaatacaaaaattagctgggcctggtggcgggcgcctgtaatcccagctactcgggaagctgaggcaggagaatcacttgaacccgggaggcagaggttgcagtgagccgagactgcaccattgcactccagcctgggctacagcgagactgtctcaaaaaataaatttttttatttataactttcctcacttctttttatatggaaaatagtttaaaactccttttaaataatttcaggtttacagaagagttgtaaaggtagtacagactttctatatacattctgtattcattccatttctcttagcgttaacattttatataacctgatacccttatcaaaattaagaaattagcattagtggaatattattgagcaaactacagactttcctctgattttcctgtgttttccactgatgtccttttcctgttacaggatccaatccaggataccacattgcatttagatgtcacaattctttagtttcttccaataggtgacagtttcttagtctctccttccctatctttccttgacacctttaaagatgagtggtcatgcatttgtagaatggttctcattttgggttttctggtgctttctcatgattagcccgaggttatgcattttggggaaaaataccatagagatggtttacccttcttgtcacatcatatctgggaatacctgatatcaacatgactcgttactgattaacttttttttttttttttttttttgagacaaagtcttgctctgttgcccaggctggagtgcagtagcatgatcttggctcacggcaacctctgcctacccaattcaagtgatttttgtgccttagcctcccaagtagctgggaccacaggcacgtgccacca

SEQ ID NO: 31962 - DNA, 1040 bp, Homo sapiens
gttggggtttcaccatgttggccaggcttgtctcgaactcctgacctcaggtgatccactagcctcggcctcccaaagtgctgggattacaggtgtgagccaccgtgcctggccattaatgtttgttttttaaaagatgcctcctaccagccagacaaaacagtataagtgtgaataatatataggctttcagattctctaagtatctttttttctttttaagggttatctctttcatacagttgctgggaaacatcaggatttaaaatacatctctccagaaattgtaagtccatccttttgaaacccaccacacatcgggtacttgaatctagttttccctgacggtcaaagttgattctccctaattttctctcaacagatggcatctgttttgaatggcaagtttgccaacctcattaaagagtttgttatcatcgactgtcgatacccatatgaatacgagggaggccacatcaaggtatggattcctgagacttgctgtagaaggagccctaaacaggatctgtggttttaaagtggggaggacagtgacacctggccacttagctcatatgctagttgttagaattttgaaacaatacagtgagtgtggaaggcatttgattccgggtgctcttaacgaatgttcccttgtctgcaatactctctaccaccttgtgcacagttattcttcatgtttgtccctcacaccatcattatcaaggacacttgtaggaggtacccactgatgtttaagtcattcgggggacaagaatgggtttcatagcatttaagaggcttgggtaccaatgtctgagcaccccagggctcctgatgaggagaagaccatctctggcaacatgtcctggtgtctgtgccaggcctagtgatgcctccaaagttgattgttcagcaagctgcctggtggaggggcgtgttgggacacacgttcccaagaagaaaggaactgattttgccattttaatctttttttttttttttttttgagacagagtccgctctgtcgccaggctgga

SEQ ID NO: 31963 - DNA, 1028 bp, Homo sapiens
tctgtcttttttttttttttttttgagacgctctgtcgcccaggctggagtgcagtggcgcgatctcagctcactgcaagctctgcctcccgggttcatgccattctcctgcttcagcctcccagtagctgggactacaggaccccgccaccacgcctggctaattttttgtatttttagtagagacggggtttcacagtgttagctaggatggtctccatctcctgaccttgtgatccgcccgcctcagcctcctaaagtgctggaattacaggcgtgagccactgcgcccagccctgtctgtctaattcttcaagttaattcattgcattgctcatagttgtataggctgttttgttgtttcctgtttctgagacagggtctctctgtcacccaggctggagtgcagtggcatgatctccgctcactgcactctccacctcccaggctcaagcagtcctcccacctcaggctctcaagcagctgggactataggtgtgtgccaccaaacccagctaatttttgtattttttgtagagacaggctttcgccatgttgcgcaggctggtctcaaactcctgggctcagggcaatcctcccgccttggcctcccaaagtgccaggatcataggtgttagacacagcacctggcatgggtgagctagtgtcatggttgtctgggcctaagtcctatggtcctttgtgttattttttctatttattctgtggctagacacacaaaacactggtttatttgtatgtttttccttcattatactgtccttatattgaggtttggtattaagcattataaaatggtgaactacctgtgttttctgtggcatgaaaaggtttaagtaaatctcatcacagtcttaaaaggttagagagatgacagctaggaaaacatttagcatttaggcctactgccttatcgtatctgcttttgtttttaatgctttatgaatgtttttaaagtattgttctaaaagaatattttaataattgcatagtatttttgttttggg

SEQ ID NO: 31964 - DNA, 1053 bp, Homo sapiens
tccactcagaaaatcagagggccacttaactaacaacagattcataccccaaagagatttggattttaaggattacttgtaggtcataacattgggactaccctgctactgtgaaaaaaataactctaaacttttttttctggatttgaaagtgcctagaaaataaataattcagtattagcagtgtttgtattggtaggatttatcttcaggtgtggatttatgagcagtttttctaaattttctatattccatgtttagaggtttcccaaaaaaagtatgactataggttggctaatgaggtaccgccattttaattccaggaatggttttctcctagggagatagtgtggtgagaagagtttggattttggagtcaaacagatgaggtgtataatcttggtaacctcttaagcaccagtttcctgatttgctaaagaaaaaggaaaggattagctacctttagtgtattgtgaggcttctattggattatatgtataaagattatatcgtagtatctggcacacagtaattcctcgtttaaaaactgagcatttaaatcccaagtctaaagaacgaggatagattttatagaaggaagttaccctttattcccccctgtcagaactggagttatatataagtgcattctctaggccattttatggtctttatagagatttgcatctgcttgccctaactcatttcagcagattctcatactgtcacagtcctcaatgctgatcggtgttcactgatgcaaccttctaataaaagaaaccttgttcttcacaagaggctatctctagtacccattataaggtgaattgcttctggcaagagttctctgtaaaggctactgactactcagggctgtgtgtggtcatcaaatcatttataatcttgggatacattttcatataatcagtaatggctaaaattttgctttgtataacaagtataacatagtatgttttcatcataaaaactagtgacccattcaaggaaatgaaagtggatcagagctctcattattaatccatgaattttgtc

SEQ ID NO: 31965 - DNA, 1032 bp, Homo sapiens
cagttcataatccttgtccttacaatcttcaggtttagtgtgaaacccactgcctccatgaactctcctgatgatttctttatcaacctgggaagtgtcatgagaaagaatatggaaatgagttccagccttgagtgcttggaacagtgtatcagcctctagtgctttttaccagggcaaagctgtactgatgcctggttttcccccgaaatagcttctcagggttgcttgcctggagctttgttttaaagggaaaacagcatagatggtggttaaagagctctcactctggagttgtcctgttttacttcaatattttgggcacattccttaacctgcaaggtctagttttctcacctgtaaaatcgggacaatcaggttgtatttgatggttaaaaagttaatgcacagaaagtacttagtactgtgttggcatagaaatcactgtaatattagccattactgctttttttttttttttgattcttcatggttttatttctctcagaactttaaaatgtgaacattctataattcagccagtctttacttccaggtaacttctttattgggtcgcaatacccttttaaataacatgctcttgttccggaaggtagttagccgttcatcactctttctgtctaaataacatccagtgacaaatcccatagggacaagaacatgaacccagtggtcccgcacaatctgaagtaagttcaccatgatagctgcagcctcagtgccgaccgcgaccccgagaccaagggcaacggggaactcagccacccacgccagtgctagccattactgcttttaatacttaattatgagttcttaagtgaatattttagggcaagggacctgtgagtgttttcattccataaagtggaatcatacgatatgtattctatcatatctggctttaaaaaacattatgcttgtaagaatcgtccacgttgagtaaaccagtagggcttttttttttttcattgcttttagtatagaatagaataattataagtagaaaaaatt

SEQ ID NO: 31966 - DNA, 1072 bp, Homo sapiens
tctctaacagagctttattaaaccaggaagggttcttttgatgcaaatgttatttggggattgatttggcactgtaatccctgttgaggggggcactgtagaccttgtgaggttagctgtaaacccatggaatggaaacttctatgctgtgtcctggctgtgtcctggcaaggtggattcctggccacatttactggttacctactgcagtgtgtgaggagctagtctaccccctattcaaccccccttttttttcttttgagaactgaattttccactgaaattttatttgtgtgccttaattattttccttttttactttgatagcagaagctgttgggatgtagtccagctctgaagaggagccattctgattctcttgaccatgacatctttcagctcatcgacccagatgagaacaaggaaaatgtgagtgtgacttcaatgtactaacctgaggcagaggtgaaacccacaggctgtcagtggcttagaagtggctgggctgctttctgggagactaaacttggccattatgtgcggtctttggagtcagagaattctgggtttggatcctgcttactagctgtgtgatgttggcaaattcttctctttttaatctttgctcttttgtaaaataggagtagtaataccttttagggatgttgtggcaataagtaagattatgtatgaagtattgaaaatggtgcctgacaggcgggagttgctcagattgtagctcacaggagtaattacatgtacaaatagtgtttgtctggaaggctctgcccaggctgtccttgcctctttgctctgaccctgaaatgaattgtaagcttaggaaaaggctctttggcagtatttgtaagaacggggtcaacaagttctagggaatctcagagtaactgaaatggtggcttggaaggtgaatttctggttatctaccctgaatgagcctggcttttttgttcttttagacattgcacagagtaggcatccaaaacagttgtaattttttcagccttctctctactgtatttctatatatttactttctccccttttccattcc

SEQ ID NO: 31967 - DNA, 1050 bp, Homo sapiens
gagtggccagaccctccctagccagctgtggtgggagtgcacctccagggacacctggtggagactgcagtcagcgcttgagggaagccagttggggcctgagtggtccaagttttccctgcctgcgcccctgcattcattcccacctcccctcccaggctgccggagcagcagtcagaacaactgcggtgtgagaccagcccacgccccacgcctgccacgctccctgtggctgtgtggtttggggccacggagcggaggcttcaacgcggacagttcaagtataccttggaccccaacatcacctctgctggccccaccaagagcttcctcaggtgttgggccaggggtgtggctgcatggcaggtggcagggaggtctttgcagctccactatgtgggggtttgtagggctttatgttgaggcactgagaatcccatgctgctagtaggggcaaggggtcgtgtggtttggggctggggctgagctgacctagccgggactgggctgtgctttaggtccaggtaacataagccatcttacgttacgtaagctcacggtctgtttcagtggaggacgtgagatatgcgtccgtggccagaatctggacgtggtacagacgccaagaatccgggtgaccgtggtctcgagaatgctgcagcccagccaggggcttggacggaggcgtcgcgtggtcccggagacggcatgttcccttggaccctcctgcagtagccagcaagtaggacacccttgggtacccccacactctccccttgccccataccacaccctggggacagccagagcaggtgccagaggaggctcttcccatctttgcttggcccctcgtcaacctgcctgtcttccttccagtttgaggagccgtgccatgtcaactcctcccagctcatcacgtgccgcacacctgccctcccaggcctgcctgaggacccctgggtccgggtggaatttatccttgacaacctggtctttgactttgcaacactgaaccccacacctttctcctatgaggccgaccccaccctg

SEQ ID NO: 31968 - DNA, 1038 bp, Homo sapiens
cactttccagagccacgctctgaccgtgtcgccctgagggagtctccacacccatttctgacctctgaccatgtgccccgtggagtccttgcatcccagctctgaactctaacttgagaccccatggggtccccatactccatttctggctctgccctccaacttgtggccccatggggtccctctgaccctatgctcctaactggtcgttttagtcctttctctgactaacccctccccaggcctgacacttcccccagtgcttgactctgaacccactcccatttctccagctcagctatgaggctctgcagccggagctccgtgtggggctgtttctgcgtcgggccggccgtctgcgtgtggacagtgctgaggggctgcatggtgagccacctgcgggctgctgggctggcggtggtagcagggctctcccaggcctgcctctcacgtgtgtctctgccacccccagtggtactgtatgactgttccgtgggacatggagactgcagccgctgccaaactgccatgccccagtatggctgtgtgtggtgtgagggggagcgtccacgttgtgtgacccgggaggcctgtggtgaggctgaggctgtggccacccagtgcccagcgcccctcatccactcggtttgttgaaaggctggccatcccttcctcagtgctgcccttagagggagggtgtgggggcccaaaggtgggaggttggggctgcctttccagttgagtagaggtgagcagtccttgtcctggaacaggtggagccactgactgggcctgtagacggaggcacccgtgtcaccatcaggggctccaacctgggccagcatgtgcaggatgtgctgggcatggtcacggtggctggagtgccctgtgctgtggatgcccaggagtacgaggtctccagcaggtaagctggctgcacccagcaggagcacggcgcagcctggggcctccgcggttggcgttgctgcttggggcctcccacccaccgctcatctgcccccctctctccctgttcct

SEQ ID NO: 31969 - DNA, 1088 bp, Homo sapiens
ccgagatggagtcttgctcttgtctctcaggctggagtgcaatggcacgatcttggctcactgcaacctctgcttcctgggttcaagcgattctcatgcctcagcctccccagtagctgggattacaagtgcccgccaccatgtccggaaaatttttgtatttttagtagagacggggtttcgccatgttggccaggctggtctcgaactcctgacctcgtgatccccccgcctcagcctcccaaagtgttgggattacaggcgtgagccaccgcacccagccaaagttgttatttttttaaataacagtgctgagcgctgggatgctacagtgtccagagattaggcagatgagtacattttttgctgggtacgtactatatgtaggtaccaagctgaaattctagtgagtgagacagactataaccaaagcaaataaatgggatacatgttgcaggtcatgtgatatatgcatggaaaaaataaagcagagaaagtgggtcaggagtgctagggtgggagtgggatggccatatctgatagggtgcatggggaagacctcccaaggggctactatttgagcaggacttgaagaaggtgagggagcgagcagcacagatagcagctgtcgtgaaggccctgagctggggacaacttggtgcgttccagcaacttcaagaaggtccatgtgcttggagtggagtgaggaaagggagactagtgggagatgaggtcagagaggaatgagagccagtgggtaggttccctgtaggccatggaaaagacaggcttttaccttgagagaagtggggaaccattgtagaggttgagcagagagacaatggttccacctgtgtttggaaaggaacactgactgctcgactgacaataaattgtaggggctggaatagaagcagggtgacatctgtcaggaggctcttgggataatccaggctagagatgtgatgtgggtcactgggaccatttggtagcagtggcagaggtgagaggaggagggatcctggatttggaaagccaggggcatttgctgatagatggatgtgaggtgggagagaaatgaggaatca

SEQ ID NO: 31970 - DNA, 1045 bp, Homo sapiens
tgcagagatccggggtctcgaaggtggagtcagctactcagtgcgagtgactgcacttgtcggggaccgcgagggcacacctgtctccattgttgtcactacgcgtaggcagagcatgcgctggagagcttcggatgggtggtgtggatggtttggggatccgggcttgtgctctggattggagaaaggaccaggattggtagtgagcctttgggggcagggtctgagaggagggagaggggtctgagaggctgggcggggtgcgtgtgccagggtgggcctgggattggtgcaggggccatgggggcagagcctccctgattcctgagctttctctccagcgcctgaggctccgccagccctggggacgcttcacgtggtgcagcgcggggagcactcgctgaggctgcgctgggagccggtgcccagagcgcagggcttccttctgcactggcaacctgagggtgagaggtgtccccaggaggaagttagggaccattgggggcagggctgtggcagactccgcaaggtaggcgaggacagtgatggtgggcggggtctgtcactgggggtctgcgggatccgtgacagtaggtaagatcaatcaatgaagtgggtgggatcaatgagttcatggagggtcagtctggcagggtccgtaaagtgggcagggtcagtgaggatgaggaagatcagtcaggagggtgaacccagttaacagagccagtgaagtgggcaggccctttaatgcccccaggtgtcactatcccacatgctcttggcccccaccctcacgcctgccccaggtggccaggaacagtcccgggtcctggggcccgagctcagcagctatcacctggacgggctggagccagcgacacagtaccgcgtgaggctgagtgtcctagggccagctggagaagggccctctgcagaggtgactgcgcgcactggtaagcctgcctcaccttggcgtgctcctcccctgctgatgacccaccctgacttcctgcaccccgactctgagtgactcctcctgtacccc

SEQ ID NO: 31971 - DNA, 1407 bp, Homo sapiens
aattaacgtgtgtgtgcacaccaagagatagcaccactgttctccacacacaggactaggattgggtcccacagaggccactagcatgtattcacaaacatacagtcatgggaatggcatgggaggagtgggttctatcacttgaacacaggtgtgggcttacctgaccatggctgtcaataaggaggggggaggtgtactggtaatgatccccacagcttgttggtaagctgttacaggagctttaggcaacacttgctctggccatgcccttcagtcctggccctggctatctctgttctgttggcgcatgatgccatggttttggtcacctcaaggcctgcttagtgcttggtaaacagactctgggatctgtgtccccagagtctatgctgagggaggtacctgtggaccagtggtcctgctgggtgtttagcctctgaggacagggttcttgggttcctgtgtagctcctgattgttctggttgatatctggttccagggaacaaagaatcggcctggcagtgccctggagaaggaggtggagagcatgggggcccatcttaatgcctacagcacccgggagcacacagcttactacatcaaggcgctgtccaaggatctgccgaaaggtaacacctggaggaagaggcggggacagagggcagggaagcagaggacagctacctaggagcccctggctgaccacagaatcatattacccttagcgtatggctttgcagctgggcaactaggggtgggcagcaggagatgccaggcctggggattttgtgctgtcgttggtctgcagtggtccacctggcacctaaacatgtcctccttgcatctagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggtgagagttggctggccttgtggggggatgcttgctccattctggcctggccagaccctttccaggtcacatttttagttggctagctgtcggggttattttcctgagttatgcaactggagacagtttctgtatccatgtggtccagtgagtcttttttaatggctttgtgggcttcacttgaattttgggctttgttttaaggtatgttttggtgcatgtcctgacagtccaagggcgaagtgtctgggtgtcccctccatgtggtctcttgtctcctttgtggatggctccgggagctttgatgctgcccttttgagagtcccacagtgttggctcacgccttctcagagaag

SEQ ID NO: 31972 - DNA, 1035 bp, Homo sapiens
cactgtccccaccccaggcggtcctggcagccatcatcattgtgaacctgaagggcatgctgaggcagctcagcgacatgcgctccctctggaaggccaatcgggcggatctggtgagtgcactgggagcccagggcagggactgggcagccccatggctcctcgccgccctccaaccgctgccctctgttctcagcttatctggctggtgaccttcacggccaccatcttgctgaacctggaccttggcttggtggttgcggtcatcttctccctgctgctcgtggtggtccggacacagatgtgagtccgccatgttggtcccctcattccagctagtgagagagtaccacagggctccccgcagctttccccacatctctggggacttcaggctccttcggacccctctgttatcccctttttctgccccctcttcgtgcattctctctctccttcacaggccccactactctgtcctggggcaggtgccagacacggatatttacagagatgtggcagagtactcagaggtgagtgtcaggggctgagtgagatggtgtggatggggagacggaggaagaatgagcctttgtggattcgttccacacttggccagggaactgggggctgaggatactttggctttggtctttgggatttcaagggaggagtttaggtctatgaccccctctagaggtatgaagggacagagggagagtggacagagatgggtctggggctggggaggggtctgtcgtggagtcaacagcacaagctccacctgcagagcagccgtgggtcagagagccggaatggcagctccctggggcgccaggttggaagggaggcatttcctgatctgatcagtggggttactaagtcctcagtcatccatttatctcctgagaggtcttgggccaagtgctaggaacataggtggggggctctggaataaaacaaggctgttgcctgcaacatgggcacagtgcaattaggcagtgcggggaggaattaaggggtctgagacatggg

SEQ ID NO: 31973 - DNA, 1034 bp, Homo sapiens
ctgcacctcccaggttcacgccattctgctacctcagcctcccgagtagctgggactacgggcgcccgccatcaggcccggctaatttttttttgtatttttagtagagacagggtttcaccgtgttagccaggatggtctcgatctcctgacctcatgatccgcccgcctcagcctcccaaagtgctgggattacaggtgtgagccactgcacctggccaagctaatttttttgtatttttagtagagatgaggtttcaccatgttggccggactgatctctaactcctgacctcaaatgatccacccaccttggccctccaaagtgctgagatttcaggcatgagccaccaatgccaggcctatgtctttatttccctcaataatgttttatagtttttttgtatgtgtgtatgtagtctttgcacatctttcattaggtttattcctcagcatttgatattacttgatgctattgtaaacatcattgtttttaagaaaaaaaatttttttttctcgttcactgcaacctctgcctcccaggttcaagtgattctcctgcctcagcctcctcagtagctgggactacaggtgcccaccaccacgcccggctaatttctgtatttttagtagagacgggatttcaccatgttggccaaactggtctcaaactcctgacctcaggtgatctgcccgccttggccacccaaagtgctgggattacaggcttgagccaacatgcccaggcaagaaatttattttctaactgttggtgacatatagaaattgcaactgatttttatatattgatcttgtgtccaacaactttgctgaactcattctaacaacttacctataggttcctttgaaatttttacatatacaatcctactgcttgtgaattagttttttttcccttccaatcttcataacttattatttttcttgccctactgcactggataggccctccgatataatactgaggcttgtggtcatgaatataaaatgagaccaattagcacggttgtttg

SEQ ID NO: 31974 - DNA, 1091 bp, Homo sapiens
gttcctattttcccagttgccagcttttggagtcaggggaacctggttgtactggaggctaggtggtaccactgcctagaagagggcagtgaaggctctccacatacagggctggggagcaggggctgatcttggatcttaggttctttttgctgtagaaaatagtggttgactggtcccttaattttattttctaaaatcaactttcttgaggtatacatgtggtaaaatgcacccatttggagtgttcagagagttttggcagatgtttacacggtaagccaccaccacatcaagaagtcacttttcattactgtagaaagtttctggccgggtgcggtggctcatgcctgtaatcccagcacttcaggacgccagggcgggcggatcacctgaggtcaggagttcgagaccagcctgaccaatatgatgaaaccctgtctctcctaaaaatacaaaaattagcccggtgtggtggcatgcgcctgtagtcccagctgagacaggagaatctctagaaccgggaggcgtaggttgcagtgagctgagatcgcaccattgcacctgggcaataagagcgaaactccatctcaaaaaaagaaaaaaaagaaagtttctggattttatttatttatttatttatttatttatttattttttgagtctttcttgttctgttgcccaggctctggagtgcagtggcacgatcttctaggctcactgcaacctctgcctcccaggttcaagtgattctcctgcctcagcctcccgagcacaccaccacgcctggctaatttttgtatttttagtagagacagggtttcaccctgttggccaggctggtctccaactcctgatctcaagtgatctgcccatctcggcctcccaaagtgctgggattacaggcatgagccaccatgcccggccttctgaattctgataagacatactgatttattggtccttatctctttatagccataagttagaagaagaatttgagtggctaaagaaatctgaagtcttgtactacactgtagagaagaaggggaatataagttcccagcttaaacactataacccttggagca

SEQ ID NO: 31975 - DNA, 1051 bp, Homo sapiens
cttagttaaacacctaggagtgggattgctatgtatataataagtatatgtttaactttataagaaactgccagactgttttccaaagtggctttgcattgctaccagcaatgtatgaggcattgcataattaaccctggcttgtatatgaatgtgtaccaggcagatgctgggtggtggctctggaacacacaggaggtatgggtggtaagggttgtttttccaccatcagtatagtgtgccttatgccacccctctgtgactgcctgaccctggggcttttcttaagccagagtaagtagccccagtggatcccattttgtagcctctttaactaaattctggatgagtgaactaaggacccaggggctttcatgagtcatagccattttatttgcattactttaaaagttaagaatattaaggcattgtttccaacagatccttaaaccaatttgatagatttgggggagggactgagtgggaaaactgtatgctgtgctaggatggatgttctgtgtttcttacctgttcatagtttcatggacaaatgtgaggcaatgtggaaagctaaaatagatgctaaatctgaagccagtattttgcagttatttcctgtctttctaggtactgggcccacacattgcatgggctttatcgtaaccattaattttccagccttccagggaaacagctttagaccttagagatcacactgctcaaaaagagagagagagaaacaggtgacatggagattggtgctttggggcttttctttcttctggtgtagttgaggctcctagggaggaagctgatttgctttgtaatctttggaaaattgatccttcatttccttgcagagataggggctgtgagggaccctagaacagaagtgccacttctttgcaactccaaatgtgagaagtatgttttacagtaaaaccatacttatgttcatattgagagattgaacataattaaaacaaaaggatcaaaaagcaagacttactatgtgcaatgcattgatattttgtttattattattttatag

SEQ ID NO: 31976 - DNA, 1049 bp, Homo sapiens
aaaaatatataaaaattagccgggcgtggtggcgcatgcctgtaatcccagctacttggaagtctgaggcaggagaatcccttgaacctgggaggcagaggttgtggtgagccgagatcaggccattgcactccagcctgggcaacaagagcgaaactccatctcaaaagataaaataaaaccagaatgagatgctattgagggctctgaccttctagcaccttgtatacatcttaaggacagtgcgtgttgtggtgttgtggttgttattctcacttggagtgaagctctgagtacgaagggtgggccggatcagtgtttgtttctaggtggatttaaaaccatcaagagccaggcagccatctgtgttttcctgtttcaatcttgaatcctcctcttcccccagtattttctctctcagttataaaggtaatgtgtgctcagagttggaggatattataagtttgaaacattcagaaaactgaaaagcgggcaatcatgatcttaccacctagtatagggcaggttttgtggtgtctgaagcttatataaaataatataaatatatgtaacataaatacataatttgtaattatacatgtaattataaatgccatctttaaacaaaataatgtacaattatgataacaaaattaggtaagaaagtgaatgtttgtttagattgaaaaaaatcacaaaaagttacacatttaaaaatgcagaagaaagttctatagtacttacctccctacattttggggcagcattttgaccaccgctttctttcttttttatttttttggggacagggtctcattttgtcacccaggttcactgcagcctcagcctcccaggttcaagctattctcctgcttcagccccccaagtagctgggactatgggcccgtgccactacgcccagctagtttttgtatttttagtggagatggggttttgccatgttgctcaggctggtcttgaactcttgagcttaagtgatctgcctcccaaagtgctacttttacaagcctgagccaccgcacctggcc

SEQ ID NO: 31977 - DNA, 1063 bp, Homo sapiens
ttgagcagtttaatgagtgaattcagcagcaaagtcgcaagaaatggttctccagccaggagaggttatgtttatcctctgattgcccgttttctctgcacacagtgatatcgtattcagtgagaggtgctgttggcacccagcagcaccctgggcacacagcatttcatgtcatgtcacagtgtacaagctaccctctaattcagaaagaagagcattttgcacagagaaaaataaaaagatccatgaatgtcatcttttatcttttattttcagttggctgatgttggaatttttgttcttgtcatgaacttgtaaaccaatcttgccaagatacaagttgttttggtttttcactacaatgacctcttgttcctcctgtcttgactgctgacgttcctcaatgattctattgtctattttatgggaagcagccttcccataggtttccttttacacactgcagggctatctttatactttaaaaaaaaaaaaaaaaaaaaaaaaaaggacaagaactgtcactaacctcatggaggggtttgcgtaaaaccatttagcccaccttgagcaaagggtagattccgtgttgtttttttaagctcactgtaataaaataaatctaattcagcattattgtgctacctcaaaggtaaaaaatgttttaaggtcttcttttggtcctgagttctatatacagtgtttgaaatgtccttcatttggaattattttttaaattcttggagtgaattttattttaatctgttttaatcttgtattttaatctcagaagaataagtgattgaaacgtgatcaattcttgctctgtggtgttaaacatataatgaacagtcattaagaattaagtcactgtttgccataaacaaggttgatgttctttttgttgttgttaaggaaaccctagggctcggctttactcttgattaataaaggctgacaaatcatgtctgactttctggtgcagtcttatgttacgtgtttgccattttgcttcagggctccaggccgtcatagcactcctttggcagattcattcttctgg

SEQ ID NO: 31978 - DNA, 1079 bp, Homo sapiens
ttcattctctccctcacctctttttaacaatgcagttatggatgtacaagcattcgagaggcttctggggccctgcatggacatcatgaagaggaacatctcacactatgaggaacagctggtgaagatgtttggctccagcgtggatctgggcaacctcgggcagtaggtgtgccacaccccagagccttcttagtgtgacaccaaaaccttctggtcagccacagaacacatacagaaaacagacatgacagaactgttcctgccgttgccgccactgctgccattgctgtggttatgggcatttagaaaacttgaaagtcagcactaaaggatgggcagaggttcaacccacacctccactttgcttctgaaggcccattcattagaccacttgtaaagattactccaacccagtttttatatctttggttcaaaacggcatgtctctccaacaatttaagtgcctgatacaaagtccaaagtataaacatgctcctttcctctcttgctgctactcttgcttttggaagttaccacagggtctgcagaaacctgttgtataactgtagacactctctaatggttctcaaaggaggaaatgtagccttcagtctcctcatttgtcctttgaggaagtccacatttgttcacagttgcagcctttggttttacagtgggaaatggtggtggatgatatggacatatgtagcccagtggcattgtactttctgctgacagctgcacacattacagctgtctccaaacccacagtgatgcttagggaaagaccctgctcaggacccagcaggtcagcaccccagagcagactgataggtccgtgggacccatgttagagcagaaaatttgggctcagcacattttactgttagtagagagccaggaaacgttttctgggttggggattttgtgggattttttaatttttttagtaggttttgtttaacctctgtgcagtttgtatgaatgaattgctatacatttataaggagccagggtctggagggttgctatcactttgtccagcccaaataccttcctgggcaactcctaccatt

SEQ ID NO: 31979 - DNA, 1011 bp, Homo sapiens
tgaacctgggaggcagagcttgaagtgagcggatattgcgccactgcactccagcctgggcgacagagcgagactccatctcaaaaaaaaaaaaaaaaaaaaaaaaaaaaaaaaaaggaggagggaaccactaacttaaggtacaaatagtacttaaaaagaaatttgttggccaggagcagtgaatcactcctgtaatccgagcactttgggaggccaagatgggaggattgcttgaggccaacagttgaaggctgcatgagctgtgatcattcctctgaactccagccttggtgacagagtgagaccctgtctcttaaaaaaaaatgtggggggcatgggggattttgtcactgtaaaatgttgttcaaggcgcagtctcaaatcagagaaatagcccaagtttgtggctcattacctaagagaagcattgtccttatttagacaagattgggcatgttcagaatggtatggctgtagattaccttgaaaatgttaggactccgagctctaggtaaaaagcagacttttctgatcaaaccagaccactgagattagtccatggagtttacatggtacagttagtgaattttctgcaaagtgaattcctcagtaattgtgtagagtatgctgagaacagtgtatgtgtgtgcaactggacatgcccagctgtgatcctggagtcagcctaggtcatgttctttgcctgctgtagactaaatcaaacaaggatggtgggaaccaggaggtcgagattgcccgctgccataaggggcagtactttggagagcttgccctggtcaccaacaaacccagagctgcctcagcttatgcagttggagatgtcaaatgcttaggtaagaaaagttctttatgcattaatattctttttctaacatgtaatatttttttcccatcagcaagccttgacatattctgccatcttttactgctgtctaggcctaggcagtttatgtgaccaaccagagatggatgaatggatgctttcag

SEQ ID NO: 31980 - DNA, 1051 bp, Homo sapiens
aaaaaaaaggaaagaaaatagggaaattatataataaaaagagattggaagggatgaacatgaagaaagcttccttgttagagcactgttagaagaggtctctaggataactgtggtcatttaatggatggtgtgacctagaaaactgaggagctgtaagtaggaggaatgactgttactggtaaatctgtcatcaccagatttttcggtttcttttttttcttttttgagaatacagagtgtgttaaaacagttatatataatactaagtcgagttaatatgaaaactttagcaaaatatattgagtaaaagttaataagtagccgggcacggtggctcacacctgtaatcccagcactttaggaggctgaggcgggcagatcacgaggtcaggagattgagaccatcctggctaacacagtgaaaccctgtctctaataaaaatacaaaaaattagccaggcatggtggcgggcgcctgtagtcccagctactcgggaggctaaggcaggagaatggcgtgaacccgggaggcagagcttgcgtgagctgagatcacaccactgtactccagcctgggcaacagagcaagactctgtctcaaaaaaaaaaaaaaaaaaagttaataagtatggaaaaagaagaatattactgtctgtaagatagctggatttgttttctctctctctctttttttttttttgagtgagtcttgctctgttgcccaggctggaatgcagtggtgcaatctcaactcactgcaacctccaaccccctagtttcaatcgattctcgtgcctcaccctactgagtagctgaaggtagcttgattcttttttattttaagctagagtgtcgctcttgttgcccaggctggagtgcagtggcgtgatctcagcttactgcaacctccgtccctgggttcaagcgattctcctgcctcagcctcgcaagtagctgggactataggctcccaccaccaagcccagctaattttttgtacttttagtagggacagggtttccccatgttggccaggctggtctggaac

SEQ ID NO: 31981 - DNA, 1022 bp, Homo sapiens
ttgttaggaatgcaagttctggagccccccaccagacctgctgaatcagaaactacattttatgttgtttcatttgttttgatcagctttgttacagtgtattttacatacaataaaattactaagtttaagtgtacaaatcggaagagttttgtaaccatccccaagtggtatttccatcacccatacagttccttgttttgtatttgcagtcagtaccctcccccacactcacattcctggaaaccattgatgttttctgtcactgtagaaattcctttctacaatttagtataaatgaaatcatgtaatgtatagtctctgtgtctggcttctttctcttagcataatatttttgagatttattcgtgttgtatgtatcagtagatcgttcctttttattgctaataatatttcattgtacaaatgtaatttttttttctttttgagacggagttttcctcttgttgcccaggctggagtgcaatggcgcaatctcagctcaccataacctccacctcccaggttcaagctattctcttgcctcagcctcccattactttttctttttaatgagatacagtcttgccctgttgcccaagctggagtacagtggcataatctcagctcactgcaacctctgcctcccaggttcaagcgattcttgtgcctcagcctcccgagtagctgggaccagaggcacgtgtcactctgcccagctaattttgtgcatgtgtgtgtttttttagtagaaatgggatttcaccatgttggccaggctggcctccttagtaaatacttaagagtgcaattgctaaattatattttaacttcataacaaactgtttcttaaaatggctgtactgtcttgtattcctaccagccatgtatgaaaattccagtttctctgcattctcaccaataaatagtatttacagccttttttaaaaaaattacagtcagggtcttgctatattgcccagcctggtctcgaactcctgagctcaagccatctgcccgcc

SEQ ID NO: 31982 - DNA, 1042 bp, Homo sapiens
tccatccctactccttaagagtccttagtgtgatgcagtagacatgtggatcgtgtctgtgaatagccactgcactccagcctgagcaacctagcaagactgtttcttagaaaaagaaaatcaggccgggtgtggtggcctcatgcctctaatcccaaggaggccaaggcgggcagactcctaaggttgggagtttgagaccagcctgaccaacatggagaaacccaaattagttgggtgtggcagtgtatgcctgtaatcccagctacttgggaggctgaggcaggaggcatcgcttgaacctgggaggcagaggttacggtgagccgagattgcgccattgcactccagcctgggcaacaagagtgaaactctgtctccaaaaaaaaaaaaaaaaaaaaaagaaaagaaaatcagtataaattcaagaacttaaccatatttgatatgtttgagttcattgccttttttttctttttcttttttgagacggaatttcactctgtcgcccaggctgtagtgcagtggtacgatctcggctcactgcaacctccgcctcccgggttcaagtgattctcctacctcagcctcctgagtacctgggattacaggtgtgtgccatgatgcctgactaatttttgtgtttttagtagagacagggtttcacatgttggccaggctggtctcaaactcctgacctcaagtgatcctcccgcctcgccctcccaaagtgttaggattacatgggcgtgagccatcatgcttgtcctcatagccattcttattcaacttttattttaggttcaggaggtacatgtgcagggttctttctttctttctttctttctttctttctttctttctttctttctttctttctttctttcttatgattttggaatgtacaggtttgttacatgtgtaaatttcatgtcacctgaggtttgggatatgaatgatcttatcacccaagtaatgaacatggtacctggataggtagttttttcaacctttacccttctccccttttttttttggagac

SEQ ID NO: 31983 - DNA, 1049 bp, Homo sapiens
ccctctagactccgtttcacaacctactcccgggtcttcctcctgggactggggatgggcgggttctgatgtggccccagggcgagtgacctgggggcaggagctcccccgccccccgccaacggctggacagcgggcaacggaatcccaaaagcagctgttgtctccagagcattccagctgcgcttggatttcgtcccctgctctcctgcctgagcagcgccctggcccagatggggtgcccctgacccccagacatactttactgagctgcttgggtctcagttcctctcagttgcgccctcaggctggaggtgatgggtgtagacgtgggagagccgaggctggtggccatctctggaaccctggggaggattggcgagggagggtggacccaggacctctgggtagggctgcaatggtagtgactcccccagggctgcctcagcccgcatctcgctaaagatagccctcttacttcctggggaaaaaccaccccaaccgtcttcgtggatgagagtatctgaagtcctcagtttgactgagggttcccaaccctgctaagcagttgtctccaggtcatgcaccttcagaatggaaagcgctttggaatgacacgatcactcccgttgagtgggcacccgagaagccatcgggaatgtcgtgtccgcccagtgctctttcggcgcctcccagcagggcctcagccctggcccagaaaggggccttgccaagcttttcctgcccctgggtttccctgctctccggatttcccaactctctctactgagttagcttctctattaaaaggaatgggggtggggtggggggtgagtaagttacagtgaaatgaagacatttgggaacctttgtgggagaaagaaaaagacctttcctattggtagaggagcaagatactccaactgaggcctattttctattatggtcgcattatttggttggcccgtaaatggctgttgcctaaaacaggaagctttaaggatcgttgttaaagcacaccaggttaaaggagtcacattaaaagctgg

SEQ ID NO: 31984 - DNA, 1100 bp, Homo sapiens
tgatttttgccacactttagggagagtcccctgatgaaatttatactcctgtgtggtccttatgcttcacacatcccatattgtacctttgagagaccacctgccatcctcttgttgtgacagtactctattcctcctaggctatgtcttgcccagccacgtgactgaggagatgctatgggagtgcaagcagcttggggctcactccccctccaccttgctgaccaccctcatgttctttaataccaagtaagtgttctagaggctccactgctggcatctgtccagtgaagagtgtggaagctatccaagaggccttctgaattcctctgacatatatttgagaaactgggctactgaaagccctaaccccacttggctgcattttatttggtaaccagtgaggcaaacacccttgccagacccctaccatccatcttgatgtggttcctgcactggacactgcttgggtacgggcctgcccagatcttgggaatgtgggcagtggctcctctgaagcaccagtgggcagaggatgagtcatggtatcctcccggcacccctccctctgccttgcattttacttgtgatccaggtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaaggtagggaaaggaggcagggatggcaaaaacaggtgctacttgtcctgccctgtcctgcccttgtgcctgtgaggctagtgataagtgtaaaggttgggatttgctggataaaattctccactcccttctccccagccaaaaattccaaactttcctcctagaagcagagaagccccagacagaatagctgcctcttcccttagtagtcactgcccatgcctcataccttccctcccccgaccctgtatttcctagttgggctggctgaaagcctaagtttcctgatctgggcctgaggtaaggcagtctgatgccaggtctgtggtggtggggatgtgtgttttatagttaca

SEQ ID NO: 31985 - DNA, 1045 bp, Homo sapiens
tcctaccttggcttcccaatgtgctgagattatagacatgagtaaccacacccagccaagtttattacaaattgtagagaagagaataaaattagggaagtgacatcagagggagcaagtgacagagcgaacccagagaagtggaacatgccaaagtatggcaataattgttcccaggagaaaaattatttttttaagaaaaggaaggccaggcatggtggctcccgcctgtaatcccagaactttggtaggccgaggtaggagaattgcttcagcccaagatttgaagaccagcctgggcaacatagcaagacctcatctccactaaaaatcaaaaaaaataatcgagtgtgatggtgcacacctgtgatcccagctactagggaggctgaggtgagaggattccttgaatccttctttgctgagaagggctgttttctgctcatcctggatcttgggggcttcagatatgtctaagagcagaaaagcttttcccattgccactgggtcacaaaatagccgaaaagtagacaaaaaatagagtcagaactgccttaaagagatggaaatgcactattagagagccagctttgttttggcaagagcatagaacacagaagaggagtgtatcgggcagaatgttcttttttctgcttccaggaagtgtcacacactgtgcttgcttggagaatcccgaaaccctgcaggagaatactgttgcctgctcctatctcattatgcacccagtgcacaaacatgtgcatactgactgacttcagcacatgaaggggcttggtagtcattcaaatgtcatctttctttggtgcagacctggctgaccagggctcttattcaaattattgacctttgcctgtacctagctctgggctcacttatgaaccagggtcttacagtaacaccagccctgtgggggggatcttgtaatagttcaaatactggcatattggctaggcgtggtggttcacgcctgtatttctaactgctcaggaaactggcaggaggagtctttgagtccaagagctca

SEQ ID NO: 31986 - DNA, 1027 bp, Homo sapiens
taaggcagaataattatgacatatacacaaagacaaactgggaatttagaaattctaggttaagaagtcaacagaggtctttgtggacaaaatgacgtttgaactgtagtttatttatttttgagacaggttgttgctttgtttcccaggtaggagtatggtagtgatcataattcactgtagcctctaactcctgggctcataaaatcctcccgcctcagcctcccaagtagctgggactataggcacagactaccacactcggcatatatatatatttgtagagacagggtctcactgtgttgcccaggctgctcttgaactcctggcctcaagtgatcctcccaccttggcctcccagaatgttgggattacaggcatgagccactgcaccctgccttgaactgttgaactgtagtttatagtttagataaacaaaagaatggaacagcataaatacagagccaaggatggacagaagggacatgccctaatgcaacttgagaagggaactgtgagaatggagttagtattgaggggtgggggtggggttgttgccttcccaaagtagaactgagtttgatctaatctgtggtaggaaatcaggaatttcctagatttgtggtaacaggaggaatcaagtagatgtgtgtagaattgactgcatataggagaaactagccagtagatttgtaacaggtctctatgctcagcttttgttcacagagatggagcccattaggcctcccctagctctcctgggcctgatggtccaattgcaggtcagtgcctcatttggtacttagtggtctctgtttataatttccatgtctgggtcttcagcaggagaagatcctttctggagttcattttagtgggccagtgttcttcagaggctgtatctgatttgggaaagtcttagagtgatttacatgaagttattattaccagaaatagaaaaattgtgaagaatcccgattttccatcccaagggaaagatgccaagggaaagatgagtttgtctata

SEQ ID NO: 31987 - DNA, 1080 bp, Homo sapiens
acagacaaaagcctggtgcagtggctcaggcatgtaatcccagcactttgggaggtcgaggggggccgtggaaatgaactcctcacctgaggtcaggagttcgagaacagcctggccaatatggtgaaaccccgattctactaaaaatacaaaaaaattagctgggctgggtggcgtgcgcctgtagttcaagctactagggaggcttgaggcaggagaaccacttgaacctgggaaacggaggttgcattgagccgagatgatgccattgcactccatcctgggtgagaaaacgagacttcgtctcaaaaaaataaaaatacaaagaaacaaaacccaggcaaaagaatagaaatacgtcaattctggtcgggcacggtggctcacgcctgtaatcccaccactttgggaggccgaggcgggcagatcatgaggtcaggagatcgagagcatcctggctagcacggtgaaactttctctctactaaaaaatacaaaaaaattagctggatgtggtggcgggcgcctgtggtcccagctacttgggaggctgaggcaggagactggcgtgaacccgggagacagagcttgcagtgagccgagattgtgccactgcattccagcctgggtgacagagtgagactctgtctcaaaaaaaaaaaaataaatgaaataaaatgaatatattcacatggaaaaaaaatcaatttccattttaaggagtcatgtctgtcttataaacatatggagttatttcaaagaagcatagaagacattgttctttttttttttttttttttttgagatgaacctccgcctcctgagttcaagcaattcttctgcctcagcctcccgagtagctgggactacaggcgcatggtaccccgcctggctaatttttgtatttttagtagagatggggtttcaccatgttggccaggctggtcttgaactcctgacctcgtgatatgcccgactcggccttccagcgtgctaggattacaggcatgagccactgcacctggcctatttttttatttttattttttttaaatttatttttcttattattttttgagat

SEQ ID NO: 31988 - DNA, 1023 bp, Homo sapiens
atttttagtagagacggggttttgccatgttggccaggctggtcttgaactcctgacctcagattatctgcctgtctcagcctcccaaagtgctgagattacaggcgtgagccactgcaccagcccaccctgtctttcttactccttaaagtagggggcaaacatggtggttgttataatccatataaaactataccctggacccccacggtggttgttatggtccatataatactatagcctagagccccattcagtcccttacccaaagtcacaaagttattgaggacccgggcctcctgacccttagtccctcggcttctttggcttaagaaggatgttagggggaggtgtctgtggtgaaacctgcccaggcctccctggccttgttctgggttggtggtcatccttttccctctgccctccagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagagtctgtgtgttatctctgcacttctagcatctgaaggccctgaagacatgctggtggtggtggtatgattgggggatggagatgtgccttttgcacattttgtctgtgagaatggactttcccagaacagagtggtactgacagctttgaaagcaccggtgcactttttggtgcttaaaggcaggggcctgggtaggattcataccctccgcacctggtctgagagaatggagggccctggggtgtttgtccatggttaggacccctgtgccagagggatctaaaaggtttgtttctgctggtgtggagaggcctagctcccagtctgatcattcagcatataattttttttttttttttttgatacggagttccactctagcccaggctggagtgcagtggctcaatcttggctcactgcaacctctgcctcccgggttcaagcga

SEQ ID NO: 31989 - DNA, 1022 bp, Homo sapiens
aggagttcaggaccagcctgggcaacatagtgagaccctgtctttaccaaaaatataaaaattagctggctcttatggtatgcacttgtagtcccaaatatttcagaggctgagatgggaggatcgtttgagcccaggaggttgctggaccctacctctgtccattccacgactgggccttgctggctgctgcctggtttttccacttggtcatctttgtcttgacttttcctggaagcagtgccaggggcttatgcaggcaagctaacctccagactgggcccatacaatttaacatttctgctttgtgcaagtcgtagacatctagggcactagctggatatcgactggtatgctaccacttgtggcattcttggtgacactggtggggctactgcctcattctatgacttgtagccatggcgtccacagtgtaccatgaagtaaccagggaagggagtgcagatcttgatctcattgagggagccatcactagacctgtaggacttggtgatggtgctacagtgaatctattggcagcatcaggtactgaggaaatagtggcagtggcaggcactctgcatggctttgctcaccatgggcacctttatggtgggctgggtacttgcagcttcaaatttggtgcacggctggtgtggctatggctctgcttcttggtacctgtccttagcaccactggtctgcatcccctgcttaattcctgcacctggcctttctcatgcagtacactgcagggctaggcatctggctggggccacggggccatggagatgtgggaagccccaggacagcattggacctggatagcgatacagcatgtggccctggtctgcacctggcatgtgatcattaggtggtatccagatgtaggcccagacttggaggttggtcattaataatgggatgtgggcacaaaagacacagaatatagataaagactagtcaggatcctgcctattccttgaaggtccagaagtatgagcatcaccaattcctgcaag

SEQ ID NO: 31990 - DNA, 1060 bp, Homo sapiens
ggaggctgcccttgagcctgagcagaagcagctacaatggccgtcaggggccacatttctcaaaaggttggcagaacctgaattaccagaccctttttaaatcccagttgtgtccctttttaagctgtgagaccagttttttgaattccattgctttgaaatgtttcctattactgatttttttttttaactttccttgacatcttgaatgtgtttttttgattgatgttcaatatacccagtacccatggtaggtgtgggtcatgggcctctgctgtgtctcttagtgttcttttccacgggcccctaaaaaagtacaggagtggccaggcacagtggctcacgtctgtaatcccagcactttgggaggccaaggcgagtggatcacttgaggttaggagtttgagaccagcctggccaacatggcgaaaccccatctccactaaaaatacaaaaattagccaggagtggtggtgtgcacctgtagtcccagctactttggaggctgaggtaggagaattgcttgaacctggaggcggaggttgcaatgagccgagatggcaccgctcccctccatcctgagtgacagagcaagactctgtctcaaaaaaataataatttagctggtcatggtggttcgtgcctgtagttccagctacttgggtagggactgaggcgaaaggatcacttgaggccaggaggcagagattgcagtgagctgagatcacgccactgcactccagcatgagtgacagagtgagaccctgtctcaaaaaaaaaaagaaaaaaaaagggaagaaaggaaactgaatctcagggaagtgcccacctcctgagctaataagaggaaggaatatgggggtgaggcagagctggcaaaaggctgttttttgttttgattgtttttaaagaccaagtgaagtatagtataagaagtggggaaggagtggaacaaggagttagatctgtaactgtgagtagtcaattgagataactcaatacctttggacctgattgtttttaaagactgagggtagtataagaagaggggaaggagtag

SEQ ID NO: 31991 - DNA, 1662 bp, Homo sapiens
gatgtatcacttggtgcaaatttcttgattttatacactcaggggttttgtttttttgtttttttaatagacggagtcttgatctgtagcccaggctggagtccagtggcatgatctcggttcactgtaacctctgcctcctgggttcaagcaattctgtgcctcagcctcctgagtagctgggattacaggtgcatgccacccatgcacagccaatttttgtatttttagtagagacggggtttcaccatgttggccaggctggtctcgaacttctagcctcaagtgatccgcctgcctcggcctcccaaaatgctgggattacaggcataagccacggcgcccggccaaaaaaaatcaataataggccaggtgcggtggctggccaacatgctgaaaccccatctcttaaaaaatagaagaaaattagcccggtgcagtggcacatgcctgtaatcgtagctactggggaggctgaggcatgagaatggtggtggggattgcagtgagcctagatcgtgccactgcactccagcttgggcgatacagtgagactctgtctcaggagaaaaaaaaaaaaaaggtacaataataatcaaggtttaagaaagcaactagtatctataatattccagagataaattctgggtaattccaacataggtgaggaattagtatagagcagagagagatgagaatgtccagaactactattcttgaggatgagaaaggtgaacaattgtaagtttatgtaatttatggggaaaaataaaaatagagatcctaataagttaatggaacaactaacagaaacggaaaattgaatgtataactttgaaacatactacgtcagttaggaaaggcttgctggcaggtaagaaaaatctgcaaattagcgtattaagcaagatggaggcttacatctttctgaaaagaatttctgacgtaggcagtcaatccattgctgacgtagcagctccatggcaatattaaacccagctgacctaccccttcctttttaggacatttctcagatatcatacatcaaacctcctttgtatctcattggctaatcatatgacaatacctggctttcaggaaggctgggatgtactgtatagcaggactgcatcatgtccagctaaaaactggggttctcaaactaaggaaggaggggaaaatagctagcaggaggcgactagcaaactgccacacctgcaaaaggaaaattaatggaaggcaaaaatgaaggggggaaaaaataagaagtatggtaattagaaagcatgttagaacatgtggaaaaagggggaaaaaaaagaaacctgaaataaggaggctgaattaaattcagtgaagtctaataacagcattagaatcactgtagatgagttaaatttaccaaactaaagacaaactctcagatcagactttaaaagacaaaccacaccagggatacagtggtatgtgcctatagtcctagctactcagaaggctgagggaggaagcttgcttgagcccaggagttcgaagttaccgtgagccacgattgcatcattgcactccagcctggacgacagagtgagatgctgtctctttttctttttcttttttgtttgagatggagtttcactcttgttgcccaggttggagtgtaatggc

SEQ ID NO: 31992 - DNA, 1069 bp, Homo sapiens
tgcagtcagctgagatcatgccattgccctccagcctgggcgaccgacgagcaaaactgtctcaaaaaaagaaaaaaaaatcttttagatgaatttgaatactttttacttactatatgtatgccacactattagctaaaaggactatttttttttctttgctaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttattaatcttagtgtatgattactggcctttttcatttatctataatttacctaagattacaaatcagaagtcatcttgctaccagtatttagaagccaactatgattattaacgatgtccaacccgtctggcccaccagggtccttttgacactgctctaacagccctcctctgcactcccacctgacacaccaggcgctaattcaaggaatttcttaacttcttgcttctttctagaaagagaaacagttggtaacttttgtgaattaggctgtaactactttataactaacatgtcctgcctattatctgtcagctgcaaggtactctggtgagtcaccacttcagggctttactccgtaacagattttgttggcatagctctggggtgggcagttttttgaaaatgggctcaaccagaaaagcccaagttcatgcagctgtggcagagttacagttctgtggtttcatgttagttaccttatagttactgtgtaattagtgccacttaatgtatgttaccaaaaataaatatatctaccccagactagatgtagtattttttgtataattggatttcctaatactgtcatcctcaaagaaagtgtattggttttttaaaaaagaaagtgtatttggaaataaagtcagatggaaaattcattttttaaattcccgtt

SEQ ID NO: 31993 - DNA, 1050 bp, Homo sapiens
aagaacatgtggaccctgggtcagctgctgccctagaatggggaccccttctgtaagctatgtcagaatcatctaccagcagtgacagatgtcctgtaaagtgcctgcctttgtggggcaggaagtgccccccgtgaaactaccttgtgttgtggatcttttgctcctccagagcccttactcgggccccacctacagagatgctcagcaccactcttggctggactgagaaaaagctgttggttctctgtttaaaggaaagggattatatttcctttttatggttttgaaactagtgagtttcattaaatgtctagcatttttctgaagccacaaagaaagtgtctctgcaatttcactgaggttcttggaaagtcttcaagatagaattgtatgtatccccaaattctctacatttttctttcagaaaacatcccagaaaagtggaccccagaagtcaagcatttctgtcccaacgtgcccatcatcctggttgggaataagaaggatcttcggaatgatgagcacacaaggcgggagctagccaagatgaagcaggcatgatctggggcaggactgtcttgtagtattcttgaactagggccccaagtttggaggtttggggagcccagcaggaaccttcacaggccaggttgttttagaggctcagaagcccctctgtggccctctgaccctcattaattgggatcttcacagaagatccctaagatagttcaccagtcctgtgagatggaatgtttttttatgaggtagtgctatgcccataaggactgctggcctgagaatgaaccatttcattagtagctagtaatcagtggctctagatgtaggaactttcttttttttgatatggagtctcattctgtcacccaggctggagtgcagtggcgcaatctcagctcactgcaacctccgcctccggggttcaagcgattcttctgcctcagactcccgagtagctgggactacaggcaccctccaccatgaccggctaattttttttttttttaatagatggggtttcaccct

SEQ ID NO: 31994 - DNA, 1068 bp, Homo sapiens
gagactgggattcactgtgttaggatggtgtcaatatcctgacctcgtgatccgcctgcctcggcctcccaaagtgctgggattacaggcgtaagccaccgcgcccggcttctgtaacttttatttattgtaagttgttagctattggaattctggacagaacagagctcctgagtctgttcactgctgtaagaagtaagaagtgtcatgactctttttcagcagaggaattagtctattaatgacatgtggctggaaatagacctgccgctcagaacctgttctggagttaagtccttccaagatgggcctagggaatctgagaagcacagcaggttcctctcagcaagtgctgctgaaccccaaactaagctcacacattcttcttgggttctgcctggagagtccctattagcctcatccctaagcaaccactatgctcctttttttttttggagatggagtctcgctttgtcgcccaggctggagcgcaatgtcacaatcttcactcactgcaagctcagccccccgagtagctgggattacaggtggacgccaccaggcctggctgatttttttttttgtatttttgtagagatggggtttcaccaggttggccaggttggtcttgaactcctgacttcaggtgttccacccgcctcggcctcccaaagtgctgggattacaggcgtgagctaccacgcccagcagctgctttctgtctctgtagatttacctattctggatatttcatacaaatatggtatgaaacatgtggttctttgtgactggtttcttttactgagcatagtattttcaagattcatccatgttgtagcatgtttcagtacagtactgtacttcgttccttattgttgctgagtagtactccactgtatggctataacacatggttagatatgtagcttagataggattgttttgttaattaaaagctaatgaacaaagatttcaaagtgtgagatattagtcattagtaggctggccattgaacagctccacatttcaaaatgtgagatactaaattagttattagtgggctggccc

SEQ ID NO: 31995 - DNA, 1066 bp, Homo sapiens
gcgtgatctcggctcactgcaaactctgcctcccgggttcatgcggttctcctgccttagcctcccaggtaaactgggactacaggtgcatgctgccacgcctggctaatttttttttttttttgtattttagtagagacggggtttaaccatgttgcccaggctggtctccatctcctgagctcaggcaatctgcctgccttggcctcccaaagtgctaggattacagccgtgagccaccgtgcctggccttctggcctttttttttttttttttttttttttttgagacggagtcttgctctgttgtctaagctggagtgtagtggcacaatctcggctcactgcaatctctgcctaccagggtgcaagcgattctcctgcctcagcctcccaagtagctgggactacaggtgcgtgccaccatgcccggctaattttgtgtgtgtgtgtgtgtgtgtgtgttttactagagacggggttttactttgttggccaggctggtcttgaactcctgaccttgtgatccacctgccttggcttcccaaagtactgggattacgggtgtgagccactgcgcctggcttttttttggagagataaggtcttgttttgtcatctaggctggagtgcagtggcacagtcatagctcatggtggcctccaacttttggtgtcaaggtatccttacgcctcgtcctccctagtagctgggactacaggtgtatgtgccactgcgcccagctaatatttttacattttgtagagatggagtcttgctgtcttgcccaggttgggtctcagactcctgggctcaaacagtcctcccacctcagactcccaaagtgctgcaagtacgggcatgagccactgagtccagctatcttcaactttcactattcaggttacagtttgtagtaccttttttcgggggtggtgggagggtagtgggagtagcaccctaagatttcttggaataaaacagggcttactacttggttcctggtacttaagaacagtggttcctagactccactgttcccaaacttggaatccagttccccaaat

SEQ ID NO: 31996 - DNA, 1062 bp, Homo sapiens
tatacgtatatatatgtgtacatatacgtgtgtgtatgtgtgtgtgtatatatatatatttttttttttttctcttttgagactgagtctcactctgtcgtccgggccagagtgcagtagcgccatctcggctcactgcaaccgccgcctcctagttcaagtgattcttgtgcctcggcctctggagtagttgggagtaccagcatgcgccactgtgctcagctaatttttgtatttttagtagagacggggtttcaccatgttggtcaggctgttctcgaactcctggccttgtgatctgccccccttggcctctgaaagtgttgagattgcaggtgagagccactatgtctggccatatttaagcatatttatgatagtatcttaaatttaagtgaagggaaagaggaaaacatacacagccaatgaagtaagtttgaagtggagtgaaaggaaaagttggaggtaaaaagaggttagagaggtgggcaggggccaaatcatatagggcctttaggacatgggaaattctttggatttgttctgagattagaagtcatttagatattctttagaaagggaatgacatgatctgatattaaaaaaaaaactagaatcactgtgagtaggagtagatctaattccattctgactaaatagtaaactaatatgataatttggacaaatataaaaaggaattcctggctgggagcagtggctgatgcctgtaatcccagcactttggaagtgctgggcaggtggatcacttgaggtcaggagtttgagaccagcctggccacatggtgaaaccctgtctctactaaaaatacaaaacattagctgggcgtggcagcaggcgcctataatcccggctattcaggaggctgagataggagaatcactttaacctgggaggcggaggttgctgtgagcagagatcgagccattgcactccagcctgggagacggtgcaagactcaaaaaaaaaaaaaaaaaaaaaaaaacggaaaggatttcataatattaatttccttgacttagtgacttctgcctattttattt

SEQ ID NO: 31997 - DNA, 1059 bp, Homo sapiens
accgtagtccccaccacgcacgcgtgtggtcttccgggaccaggcccgttagtgcgcacgcgtaaacccagccagggtggggcctacttcgcgtgcgtgaagagttggcagttcggggaggagtattaaaaccgcgcacgcgcacctaaccccaccctgcttgcttaagggatgagtgactccgggagtacaaaatagcaaccaggtcttttatagccccggagttcccgtgatgccccacgcggctgcaatgattggttaagggttttgcttttagggcgtggacgggctcctgagcaatagtggatgagctgtgagtgcgcgcgcgtgcgcggggccgcgacctgtgccggctcgagcccgctgggcactcggaggcgcgcacgtcgttccccgccctcccgccgccgcccgccctcgctctctcgcgctaccctcccgccgcccgcggtcctccgtcggttctctcgttagtccacggtctggtcttcagctacccgccttcgtctccgagtttgcgactcgcggaccggcgtccccggcgcgaagaggctggactcggattcgttgcctgaggtgagcggaagggttccctccaggcgccgcggggccccaggcccgccagcccggtactcttccggccggcaggccgccgcaccgccgcggccgcgccccaccggctgctcgtggccgagccgcccctggcccctgacccttgacctgactcccagcccgggccccgcgccccaagcggcgaccccgcccgcgcagtccccggaagcgcgcccggtagtctcctgtgccccttcccccgcccggccgggcctggtggagcccaggctgcccgcctgcccgccctcggtccccggagcttcctctcccagcggcgccgggcagggcgggggctttgggccgggccccgcgaccgcgcagtgtagccggccgctgaaagcgcgcgtggctgtcggagttgaaatgggaaagaaactctttacaactccattttgctttttacgtttaacgagaaacgacaatcactgtttcatattgattaaagtc

SEQ ID NO: 31998 - DNA, 1058 bp, Homo sapiens
ttttccttagcatcagaaggactccatgagctgacagggcctatagttttatttctggctttggcatatttatggcagaatgtttggccttcagtgttttgaatgtggatggataggtggctgaagctacatttataaagtgtttgggactgttaaagtttcctagccacttggagaaagcagtgtgtttatttctggctttgttcttatttagcagccttagaatatttatttttccaaatttagtattcttctgattatgttttgaaagcaataaaaatcacccagtttcaaaactgcacaaagggcttgaatagagatttttccagagaggacatacagatggccagtagcacatcaacatgattagtcattaagaaatgcaaatcaaaaccaaaataagataccacttcataccaggtatcttattttacctagtatggctataatagtttaaagaaaaaagggaaataactgttggcaaggatgtggagaaatgggaacattgctgatgaaaatgtaaagtggtgtagccactgtggaaaagagtttggcagttcctcccaaaggtgaacacagaaaccatatgatccagcaattccactcctacatatatatccaaaacaattgaaaacagggactgtggccaggtgcagtggctcatgcctgtaatcctagtactttgggaggcgggcagatcacctgaggtcagtagttcaagaccagcctggctaacatggcaaaaccctgtctctgctaaaaaatacaaaaagtagccgagcgtggtggcaggcacctgtaatccccgctcctcaggaggctgaggcaggagaatcacctcgggaggcggagattgcagtgagctgaggttgcaccactgcactccagcctgggcgacagagcaagattccatctcaaaaaaaaaaaaaaagaaaaaagaaaaaacagggattcaaatggattgttgtaagccagtgttcacaacagcatcattcataatagctaaaaggtggaaacaacccaagtgtccatcaatatagataatacataacagatgt

SEQ ID NO: 31999 - DNA, 2250 bp, Homo sapiens
agtcccgctctgtcgcccaggctggagtgcagtggcgcaatctcggctcactgaaacctctgccttctgggttcaagtgattcttgtgcctcagcttcccaagtagctgagattacaggcatgtgccaccatgcccagctacctttttttttgtatttttagaagagacggggtttcgccatgttggccaggctggtcttgaactcctgacctcaggtgatccgtccgcctcggcctcccaaagtgctgggattataggcgtgaaccactgcacccggcctatttccttgactctcctcctgcaccattcttctgggtcacctggcactgtgacccctatcttttcccagccacccaatgactcaggctagaaaatttagcactctccttgtgtccatagtcagaagcattcccagggagaagcacagccagagataggcctccttcagcctgaccggggccagggcagaagccaatctacagtactgaacaggatccacagctgcaatgaccacctccagagaccctgacctgccctccacaatccagcaactctatttttaagtatttactacgtggtggaaactgccttggacttttgctgtggaaataagagacaatggtttggtggtgatgacagtgagttaatagatgacagcacagtggtatattgatatggtagagctggcatagggtaccttaggagtcatagatgtgtgcactatactcaggtttggagagaatggagtctaggaatactacctggggcagagttgccttgacctgaaggcagtattgccttgtcccaggtagtattcctagacttcattcaggataactaggcaaaaaaaaaaaaaaaaaagaagtgtatgtgcattaaaatagtgcaatctggggactgggagtacagaataattgattttggtgatagcagtgaaataaaacatagctagctgcctgggcagctttgggttaagattttgcagttttgcagtagttttttctttctttttgtcttttttgagacagggtcttgctctgtcacccaggctggagtgcagtagtgccatcacagctcagcagtggtattttgtaccccattttgtccataattacaagatccaggaaaaacaacaacaacaaaaaacccgatggtttgtctcttacatatgggaccatattcctgctctactaatactttttcttttttggtcttaatctttctgatgtattcttgctgactacattcctaatttaaaaatacactcagtgttaagaaatttgccaactactttaaatattttgagagaaaattgacattataaagagggagtttgagtacaaggagcttttccttgtcccactggttggtatagagtcagacagaaagggaatggtcataaattgacaaccatagatttaaagtagaagaaatctgaagcctgaattcctttgggaaaagcaaaaccttaatgatcctatagcaggggtccctgggtactggtccatgacctgttaggaactgggcctcacagcaggaggtgagtggtaggcgagcaagcaagcaaagcttcatctgtatttacagctgctccccttgcttgcattaccgccggagctctgcctcctgtcagaccagcggtggcattagattctcataggagcatgaaccctattgtgaactgcacatgtgagggatctaggttgagtgctccttatgagaaactaatgcctgatgatctgtcactgtcttccatcaccccaagatgggaccgtctagttgcaggaaaacaatcttagagctcccaaggattctacattatggtgagttgtataattattttattgtatattacaatgtagtaatagaaatacaatgtacaataaatgtacagcctcaatcatgctgaaaccatcgcccccacacccgttctgtggaaaagttgtcttccatgaaactggttcctgctgccaaaaaatttggggaccactgtcctacagctcagcaatgaatggcctgcctggtccttggcaccttcagtggagaatttgggaatctcatgtgacctaattcctcagacagaaacccttcctctgagtgaaggagagacccttaccagtactggatatcctaaggagtctgaacagaacaaattcccattgccttctgtttttttctgatctcatctttgggtgtgaagtaaaccgggataggtgctttcctgatggttgtaatgtgctgtagctcta

SEQ ID NO: 32000 - DNA, 1024 bp, Homo sapiens
cctgggtgacagagcgagactccgtctcaaaaaaaaaaaaaaaaagaaataattgaccttggccaggcatggtggctcacgcctataatcccagcactttgagaggctgaggcaggtggatcacttgaggcaggtggatcacttgaggtcaggagtttgagaccagcctggccaacgtggtgaaaccccgtctctactaaaaatacacaaattagctgggcgtggttgtgcgctcctataatcccagctactcaggaggctgaggcaggagaatcacttgaacctgggagacagaggttgccatgagctgggattgtgccatgcactccagcctgggtcacagagtaagattatgtctgaaaaaaaaaaagcaataattgacctcgtaaaacaagttgggaactactctctttctctctctttctgttttctgaaaaaaaattatgtaagattgatatttctttcttaaaagtttgatagaattcactagtgaaacctagtctggagttttcttcgtggaaagatttttgatcgcagactcagttttcttaatagatataggagtgttcagattattattattattattattattattttgagacagagtctcgctctgttgcccaggtttgagtgcagtggcacgatcctggctcactgtaacctctgcctcccgggttcaagtgattcttctgcctcaacctcccaagtagggcaagtagctatgattacaggcgcccgccaccttgccagctaatttttgtatttttagtagagacggggtttcaccatgttggccaggttggtctcagtctcctgacctcatggtccgcctgcctcagcctcccaaagtaccgggattgcaggtgtgagccaccacacccggcctgttctttcttaaagatgcttgtggctcttgcctgtaatcccagcactttgggaggctgaggtgggtgaatcacttgagtacaggagtttgagaccagtctgggccacatgatgaaatcctgtctttacaaaaaat

SEQ ID NO: 32001 - DNA, 1032 bp, Homo sapiens
aaaaggttttatattgtatgtatgtagatctggaaggttgtatattaattggttaatgaaaatatgactagatcatcttctactggctgagagtttattaaacaaaaaaaaaaagaaattatgaccagaggcctacaggaacttaaccatttattttgtctaggtgcagtgactcagtattcaataactcagtgtacacaatgactttataaaacataattaccatcaataatgagaattgactgtatagtttcttgtgtcagagccctagctaagtgttctagactttaatgtctgggagccacagacagtgcttttgttgataagtattcatcccttaaattccctctcccattaaaagtcatttccacaggtcacctattatgcatagctgaatttgtaatatttcattgttttaccattaacttcttgggccatactgactttcagttctctgaaggcaggaattatttttgtcttgttagtaataatatactacatggtcttactctgtagatactcaatatgtatttgatcatgtaagtacttaaattttttttttcttttttttttttttttttttttgagatggagtctagctctttcgcccaggctggactgcagtggcactatctcagctcactgcaagctccacctcctgggttcacgccattctcctgcctcagcttctcgagtagctgggactacaggcacccgccaccgcacccggctaattttttttgtatttttagtagagatggggtttcaccatgttagccaggatgttctcgatcctcctaacctcatgatccgcctgccttggcctcccaaagtgctgggattacaggcatgagccactgtgcccggcctgcaaatttaaatttaatggtccctgactaatttggagactttatagttgcaattcggacaaaaaattggtttggtggtgagtattctggttttatgtgtgtgttgtgtgtgtgtgtgtgtgtgtgtgtgtgtgtgtgtgtgttttagagagagtcttgctaa

SEQ ID NO: 32002 - DNA, 1043 bp, Homo sapiens
tggcagcattattcataatagccaaaaggagaagcaacccaaatgtccatcaactgacagataaaatgtggtgtatacatacaagggaacattactctgcaataaaaaggaacgaagtgtgatacatgttacaacatggatgaaccttgaaaacatgttaaagtgaaagaagtcagatacaaaagttcacatttacatgattccatttatgtgaaatatccagaataggcaattctatagaaacagaaagtacattagtgattgcttagggcttggaggtggttgtaggggatagggaaaaagatagcttaagagtatggaatctctttttgagatgattaaaacattctaaaattgtgatggttgctcctatttctgaatattttatactttttttaaattttatacttaaaatcattgaattgtacaccttaatgggtgaaccgtatgatgtgtgaataatatatcaataaagctgttaattaaaaacgtattggctggacatggtggctcatccccgtaatcctagcactttggaggctgaggcagtaggatcacttgagcccaggggttcgagaccagctctggaaacatagcgagaccccatcgatacaaaaaataaaaaaattagccaggcgtggtggtgcgtgactgtaactccagctactggggagtctaagatgggaggatcgcttgtgtctgggattttgaggctgcagtgagctgtggttgggccactgcactccagcctgggtgacagagtgggaccctatcttttttttttcttgagatgaagtctcgctttgtcgcccaggctggattgcagaggcacgatctcggctcactacaacctctgcctcccaggttcaactgattttcctgcctcagcctcctgagtagctgggattacaggcacctaccaccatgcccagctaatttttgtatttttagtagagacgaagtttcaccgtgttggccaggctagtcttgacctcctgacctcaagccatccacctgccttggcctcccaaaatgccgggatt

SEQ ID NO: 32003 - DNA, 1050 bp, Homo sapiens
taatgtggcatttaaggtgatatagtccagctggctccaggctacctcctcagggtttatcctaatccccactaaccaaatggtttgctaaacattccatacatactctttctctgcacaaatcctctcatggctgaatccagtgacctatggcctgtggagatgaccttttgcttcagcttttcccttgtccatagtccagctccatttctacctaccttctttataaaacgtccccaaaacatttctgctcctggggatatatttcataccctttgaactgcagttacattattgctctgaaacaaacatcaaaatagtatttgctcttttaagaataattttttaggccggcacagtgggtcacgcctgtaatcccagcactttgggaggccacagcgggtggatcacctgaggtcaggagttcgagaccagcctagccaacatggtgaaactctgtctctactaaaaatacaaaaaattagtcaggcgtggtggcgggtgcttgtaatcccagctacttggaagattgaagcagtagaatcacttgaacctggaaggcagaggttgcagtgagctgagattgcgccactgcactctagcctgggcagcaagagtgaaactctgtctcaaaaaaaaaaaaatcttttttgtttcctctggtagggcctaataatccttttctgacagggactgtattttacactttttgtgtctttttgcgcctgtacgtagtagatgaggaccaaatatttataaagatgtactagatttgtctgagttggaaacaccttttgtaattaaacagggaaatagaagggagtgggcaagtagaagtggggatttggtggctatgaatttctgcctccaccctgccttgccttgaagtgcttgcatatgttaactctagtgctttatagaggcaggcccatcccttagtgctgcagaacagagacagaacttgctcaaagggcagaactaaggcctggaaagagcccttcctggttaaagtgccacttttctaggaaaacatttctgtgagcatggcac

SEQ ID NO: 32004 - DNA, 1034 bp, Homo sapiens
ttaccttagcaacggcagcaaaggaaggcagagcggcactgggtacctacccatcagcctccagattgcaaatgccgtgggctgggtgtatttttcaggattgagcttctactccagagccagcgccctgaggtggaggagatgatccgagacatgggtgtgggacagtcagcggtggaacagctggctgtgtactgtgtgtctctcaagaagtgcgtactgtggcccctctcagcaaacacaggagataggccatggggccccagccgtgtcattgctccccatctcttgtaaagcagatggaactaaggggcaaactctggagccatgctgcctttgtttgaaccctgattccacctttcagcaactatgtggcctgctgccagtttcttggcctctttgaccctcaacttcctgaatggaaatagtagtagacctgcctcataggattgttgaggatttagtgtgaatcttaagtgctgtttctaagggagttgacctagctctctgggctataagccccattgtgattgatatgtagagcctgttccccattagcactatgatcctgcctggctgggatcaaactctactcatattcttcactctggtgggtgtaaggttggcaggaagggtggagggccacttagctgagaggcatagagggtccaagatgcctcctttaagaccaggtggtttagggagccccctagtgagactggggctttctgcatgccctctcaagtcaccagtgcctgcaggacaggcaggaggaaatagtcacttccttgcattctctgcaggaccctccacagtgccacctggtacttgttgggctcaggtgtcaaagtaggaatgagagtgagttgaggggttgggcagtgctttgtgttagattagtgctgtggctcagtctgacctgcaggtgttcttttctggcatctctttccatggccacattgcagagagtacgagaatctaaaagaggcacggaaggcctcaggggaggtggctgacaagctgaggaaggattt

SEQ ID NO: 32005 - DNA, 1941 bp, Homo sapiens
tgccttgctttccattcctactagcaccctatgcgtccataccgctcaggtagacagccaggagtgcgagcactaggcaagtgagcaccagcagcgcgagcagcagcaggaaccctcctcgtctgtacacagggctgcagccagcctgggcacacagtgacggcggcaaaacgcccagcagctcatcccacggtcgtgcctcttcagttagataggggcgcagtgtgcctgctgggtggatgggacattgggagggtggtgggtgcacctgctttcgtcccctcccccagcacatcatccaccccactgtccccactcacctccactatgtaggtcgctgatggactccacctggtgcaggcatacctcatgcacgtggttgggggccaatggccccctgctcctctggctgggcatcattggcgccacggagtctgcaggggcagcgcaggctgatttagccagtggtgggtcaacccccttccttctaccaggtggcttcaggcagcaaggacttgcggatgatagggatagtgggacatttggttccaaatcccctaaaactgactcaggaattacccttgatttggatccaggatgatcccagacccttacaggcttattctgtatacaggagcaacaggtacatttgatttgtttccttccaagcaccccagggactcactcaggcattcctctgcctgcttatttctagcagtttatcagccttgaatgctaaacctgcagcaaatggaattcagtcctgcctcttttgtcagttctccctgcagacccaatgcctggcatcttctggtcagaaagccctattgtagccactctggtgcctttccctcctggccttggttctgtgtttgttaacatactcagtgtgactctgctgtacatgtgtgaaccctgctgttttcattcaacatttactgttggggagacccttctttgttatactgttgcacatgcctctgaggtctctcccttcacacatctccctgaggctgcctgggcatctaggttgtttgcagtccccgccccccttttttttttgagacggagtttcgctcttgttgcccaggctggagcgcaatggcgcgatcttggctcaccgctgcagttcccttttgaaattaacccccaggacatccaccgttgaatatgaaggttttttcccaatttcctgatagtttaattcccagaagtggaattactggatccaagagcagggatttttgtttgtttgtttgttttttgagatggagtctccctgtattgcccaggctggagtgctatgtcgtgatctcgcctcactgcaccttccacctcctgggttcaagcgattctcctgcatcagcctcctgagtagctgggattacaggcgtgtgccaccacgcccagctaatttttgtatttttggtagagatgaggattcaccatgttggccaggctggtctggaactcctgacctcaagtgatctgcccgcctcggccttccaaagtcctggcatttacaggcatgagccactgcatttggtcgttttttgttttggtttggtttttttaagatggagtctccctctgtcgcccaggctggagtgcaatggcaagatctcggctcactgcaacctctgcctcccgggttcaatcagttctctgcctcagcctcctgagtagctgggattacaggcgccttccaccacacccagctactttttatatttttagtggagatggggtttcaccatcttggccaggctagtcttgaacccctgaccttgtgatccacccacctcggcctcccaaagtgctgggatttacaggcgtgagccaccgtgcccggcctgtttttttgtttttgagacagagtcttgctctgttgcccaggctggagtgcagtggcgcaatcttggctcattgcaacctccacct

SEQ ID NO: 32006 - DNA, 1075 bp, Homo sapiens
ggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgat

SEQ ID NO: 32007 - DNA, 1035 bp, Homo sapiens
taaatcatgctttctacctttgtctgcctgctgcaggtggtctctggtgctcacttgaggtagatttttgatggggatccctgtacggggtgacggtggctgggctccacatgggaagaaagagggtgggggtccctgaaggaggaaggaggcacagaggcctggcagaagcagctgtgtcccactcctgccgttttgtcctagtgtccagggacagggtcactgcacacatgagaacatgtgtcacacacacacatcaggccgccccgagttgggggtcgagggtactgctcaaaccatcctggatctctgcccaggttgaagggtccgcaggattggagtccattctctgagaggagccttgtttgtgtgtgtgtgtgtgtgtgtgtgtgtgtgtgtgtgtgtgtagggatagatctggacaggggatcacacacgtgcaactacaagggttggggggaagggagaatggggtaactgatggtagggggttgtgagcaggacccatgagtgtcccctgtaggtgcagagtggtgtgtaggcatgaacgtgtgtgcccttgtgcccatggtggcagctggggtgctaggcaggtgggttccatctggctggaaacacacaggttagacacaggtatacctgttggggggtgtgcagtgtgcgcatgcgtgtacaagtacacttgcctgtgttgaagcaggatctggcatgcccctgcccctccaagagcccccgcccccacccctgcttgcttctggccccagttgattaatcatggagctgagtggcttccagcttatcaggtaacttaatagctgaataattccagccccatcagcaggcccttaattgctttcttgtggctgaagcctggagtgcatgctgaatgggtgagctcctgggggaccagtgctagctccaggcagcatgctggactgagggctccgagttcccagcacccagccacctgggcagcccctctccagaggctaccagccacagctgccctgcctgctcatgtgggacctggaggaa

SEQ ID NO: 32008 - DNA, 1037 bp, Homo sapiens
taaaattcaaggagagcctaaaaattggaagtaggagaaaaaggaaaacttagaggagggagtaagatggcatcaggaggtgctgacagaggaggtaaatgagatggcccaggcatggtgtgtccccttgcacacttgcttgcacattcacagtgactctggtgcctactgccttaccggtgccttgtggtcagctgcatcaagaactcagaagggggagcctagctgggctctcctgggaccctggttcagagtccactgtgggtcaggccatgcccttgccccatccaggtccggcacctatgctgttaggagcccttccaatggtgtgttcagcaggatttagggtcatgaccttcaggtagccccaaccgtccaagccagcaaagttccactgcttaaaacatctcagatggccacacaccactttttgaggtgtgaatggacacccacagagcctcacgcaggcctggggctgccatatatccagtgacagtggacaggcccatctaggctatggtaccttttctgtgagcctaagtgtgagacttgagcaagatctgcaaggggcttcctgagtcctaggtgtgaatgtggtgaggtcagtgtgtgtgacctggtatgcaaggtcaagtgcatgtgcctgctgctgcatctgtgcactggtacagggcaggtccctgggatcaccttgccccaaaagaggcccctgataccatgagaggacatgggctcatcttctgggcttaccttcatctctctacccttatctcccacacctgccatgctaagatctcatgttttcacaagagcagccagcctgagggcctcagcagcacctcttactgtgattggggctgtcgttggtgctgtctttatgtggtgacatctttagcaagtctcagcagcacaggacagaattccagcctgtgaggccgggaaagttggtccctgcaggacagaatggatcagggaaggtgctcagggccttgggagcaaccctggaaggcggtcccatgaaaagccaccagcacccc

SEQ ID NO: 32009 - DNA, 1072 bp, Homo sapiens
gcccagctcatttttgtatttttagtagagatgaggtttcgctatgttggccaggctagtcttaaggcttaaggctagtcttaaactcatgacctcaagtgatccacctgcctgccttggcctcccaaagtgctgggattacaggcatgagccaccacgcccagctgagaacattttcagttggcttcctgaggacaggtacaggggagccagactttggagactgtcatgtctcagaaagccttccttctccccaacgctcaacagagatttcaggtgggttggaagtccagggtggaaaccatttgccttagattttctaaggcagcactccattccttccagcttcttgagttgctatggagaggtccccagtcattcagattcccgatccattgtacatgacctggtttttatcagaaacttgtaaattttctccctttgcccagtgttcagaaattccacactgacctatctttgtgcggcttttcatttcttaccactcagtgcacactttcaaactacttgtgtccctcagttgtgggatgttttcttgaatggtttctttgactgtttcctcccttctcatttctctgttctttctagaaaccttaactcaggccctgttcttttttatttttcttttgtctccaatattccatttctgtgtctttctgtgagaaaatcttctcatcaaattttacatttaaccattgcattttaaatttccaggatgtcttttggaactttttttttttctttttttttgagacggagtcttgctctgtcacccaggctggagtgcagtggcgtgatctcggctcactgcaagctccgccttccgggttcacaccattctcctgcctcagccccccgagtagctgggactacaggtgcccgccaccacgcctggctaattttttatatttttagtagagacggggtttcaccatgttagccaggatggtctcgatctcctgaccttgtgatcctcctgtctcggcctcccaaagtgctgggattagaggcgtgagccaccacgcccagccggacctttttaagaataatatct

SEQ ID NO: 32010 - DNA, 1024 bp, Homo sapiens
gactttgcagaaagacggggaggggtgcggcctgaaagctgtggttgctatctctgtggggaagcttataggctggggcaggtctgaattctgtgtgcagactgcctagatctaaaccaggtgctgtcaccagagcaccgcaggagtgacaccgaccttgaaaacgatgtgggaactaggtaaggctcactgctgcccactactccccactccttttgtaaactcctctgtgcagcagaggcagttatactcccctgtgaaacattaccccagcgacctgagaaccaccttggtctctcacaggggccttagcctgccctgcacaaggagaatcagagctcaggcccacctaaccctgacccaacctggtggtatttctccacctgccctggtaacttaatacaaaagacataaacttttaggagacttgtagccccacccatcacctaagaaaccagaatacttcccctaggcaacttagggcaagctcaaatcccactgttattacggcagctggtgctcttttgaaagcaacacctcctggctggaggccaaccaacacagatcttgacaccatctctagatagaataacactgtgcccaagaaggagaaaacagctgcatgacctcggcaatcatcactgcctgcaacaccctggcaaaccaaaggtcctgagtctgtccacgtgacaagttcactactagtattaccagcattcaagaaaggcagcacactaagcctatctacaaccaaggaatctcagagtctatgtcacatcactggatcccttgcagacattccccaattcagggaacaattcaggatgactgcagccccacaggaggagcactgcccagatgcaggcttgcacaaaaggcagaatcacaattcctccctacatggaacatcaatattcctaaagaagaggtgcctgtctgatctgaacagccagaacactgggaaaacagtaaagctgtgaggtggaaagcttttctgctggcctagcagggaagctgaggtagc

SEQ ID NO: 32011 - DNA, 1082 bp, Homo sapiens
gtagagacgaggtttcaccctgttggccaggctggtctcgaactcctgacctcaggtgatccacccgccttggcctcccaaagtgctgggattacaggtgtgagccactgcgcccagccaaagtgtaggtaaaaggcatctgaagcctatgtagatggagagcttattaggtttgggagaactgaacctcttggcatagaaagtgagaagccagtgtgaaggtggtggtgaggtggggatgagaaaagtgtctgtggtaacagggtctcagggttggttgagatccagagcaggagtgggtagcatgcttcctcctcagaccagggctgaagccaggtttagatgtagaggggaccagagagcagcggagggagcttatgccagttgacctattttctgtaaaggaaaggggtgagttgtttatctgcagggtttgggggctttgggtaaccatgaaattgatgtaggtggaattaaggagagaagagttttagaattctttctgtagagaaatttattagtaccttaatttaaaatggcctggccctgaattcctctaagccctaaaagaagtcttagagaattaaaaaaaaaaacaatatccctggatccaaaacattttctaaatgttgtcagagttgagtcaggattctagaaaaatttggtttttttttttttttttttttttgagacagagtcttgctctgttgtccaggttggagtgcagtggcgcgatctcggctcactgcaagctccgcctcctgggttcatgccattctcctgcctcagcctccagagtagctgggactacaggtgcccatcaccacacccagcaaattttttgtatttttaatagagacggggtttcactgtgttagccgggatggtcttgatctccttacctcgtgatctgcccgcctcagcctcccaaagtgttgggattacaggtgtgagccaccacgcccggcctgtttttgtttttgtttttgttttcaaagaaatgggatctcactctgttgcccaggctggagtgcagtggcacaatcgtagttcaatgtagccttgaattcctgggttcaagt

SEQ ID NO: 32012 - DNA, 1025 bp, Homo sapiens
gtgtttatttatttttttgttggttttggagacagagtcttgctctgttgcccaggctggagtgcagtggcaggatcttggctcactccaacctccacctcccaggttcaagtgattcttgtgcctcagtctctgaagtagctgggattacagacacgcaccaccaagcccagctactttttgcattttttagtagagacggggttttgccatgttggccaggctggtctcgaactcctggccttgagtgatctgcccgcctcagcctctcaatgtgctgggattataggcatgaaacacggtccggcctgtatttggattattgaaaaaatatgtccttgattttaaaaatttatttttagaaataaaattaataaatgtttctgctttagaatatgcagaatcttttaaagagaaaagaaaattactcttagcattcactacgtaatatttgcaaatacacataattaatattatacttttaatcaaattcatcttttttatgaatattttcaaaacatagaaaggcacagagaatagtttaacaactgctccatcattaaccaggattggcatgttgttgtatttgcttttggctcagttctttttctgcctccccagagtcacccatcttctgaatttgaaccatattctccccactcatgtttttatactatatatatctgtgtgttcataaataataacgtcatactgctttgcatgtttttaaattataaatattttcctaagttcatctttcacagcttgctttttttacccttatattcttgagatttatatatgttgatatttatttaaaatgctgtatttctatactgcagtttattctgccattgatggctaatttagtgtttttgtttggtttttttggctattaaataaatggtatcatgaacctccttttggaggctctcttgaggatatgatgtagagcatctggtttgtagggtgtctgtgttcttacctttattggatattgccaaattgcttctaaaaatgttcat

SEQ ID NO: 32013 - DNA, 1191 bp, Homo sapiens
attccagcacttgaggaggctgaggtgggaggatcgcttgagtctaggagttcagggctgcagtgagctatgatcatgccactgcactccagcatgggcaacaaaatgagaccctgtctctacaaaaaataaaataattagctgggtgtggtggcatgtgcctgtggttctagctacttgggatgctgagacaggagggcagcttgagcctgggagattgaggctacagtgagccgtgatcaagccactgccctccagcctgggcagcaaagtgagaccctgtcttgaaataagtaaataaaataaaatctcttggccagtgagctgtgctcaaggaggtagtaggcagatgtagagttatatataataataatactatatatctctccttataggcatgctcatatactcatgaacagattgtggaaatgatggaatttttgatagaatatggcccagcgcagctatattgggaaccagctgaagttttcctcaaactttcttgtgtgcaactcttgttgcagcttatttctattgcctgcaattggaagacctattatgcaaggtgggaccagagagagatttcaaatgaagtttgatgcatctttttgttaaagttgatgttggtttgcacattgtatatgcttaacaaacatttgttgaattgaattgaaattttggacttgaatctgagaaattagattaggcatgaaaatatgatttttaatttacagcacacttgttcatatatatggtcttggtgattgtaaaatttgcataataggcaaggattagcctctgtactgtcggagaaggtacatgatttacacggccacagctgcagagctggggttaaagtcttgtcttgagcctggagtccaggattctttagtacttaaagtgtcttgctactacttgacaaccatatataatgtttatattacgttcatataaaattgtccttttactcttggaattcgacatactgttaggattttcacaaattagtttaaggcagagcaggacaaggcccagaaaagggtggctgatgtaatcaggaaactgggtaggttctatttgaagatgatataaaaagaaataaaactgttttgaaaaagatggggtcttaagagaagatagtaaaaaagtttataaacagagtgcttgaccttcttttcctattcactcact

SEQ ID NO: 32014 - DNA, 1050 bp, Homo sapiens
tagataaaagtttgagaaactttcatgtttggttttcaaagacacattagaaaaatcatgaatatatctaatttctgcctcttcaggtgtgatggtccaggtcaacttgacccaaacagatcagttgtcaatgatgtattttatgtgcaaatcttctggtttggattctctggaaaattttatgaggaacaatacttagctgttacttatttcatcaacttataggaatcaaagcaacgcatttatcaaattgttgctattacaggcgttgggctcactgcatgagtctccagttattatgtggaaataagaattattaaggattacttaatccttaataaagaggcaccccctttttctccaattatctgttgataggtggcaatagtgcttcgaagactgagggagctacagctacaggaagtggctttgcggcaggaaaacaagcgtcccagtccacggaagctctcttctgaaccccttttgcctctggatgaggaggctgtggatatggactatggtgacatggctgtagatgtagtggatggagaccaagaggaagcttctggagacatggagatctcctttcatcttgattcaggccacaagactagtagcagagtgaactcaacaaccaaacctgaggatggaggattaaagaaaaacaagtcagcaaaacagggtgacagagagaactttaggaaagccaagcaaaagttgggtttctcatcttctgatccagatcgcatgtttgttgagctgtctaatagcagttggtcagaaatgtctccctgggtgattggcaccaattataccctttatcctatgactcctgctatcgagcagcgactcattctccaatatttgacccctctaggagaatatcaggaggtaagcttattgggaagagtactgttcacacataggaattattgtgttcatttctgtggtattttatggtagtattttatacaaagatatattctaactctaccacaaacaagggtttgcatgaaactgttcaagtcttatgcaggtcattcctgatat

SEQ ID NO: 32015 - DNA, 1031 bp, Homo sapiens
ttttgtgtatggagtctttagggttttacacatataagatcacgtcatttgccaacagaggtaatcttacttcttactctctaatctggattcctttaatttccttttttatgtctaattactctcactagaacttccagtactatgtttaatagaagtggcaaaagtggacaccttgaccaggcgtggtggctcacgcctgtaacctcagtactttgggaggccgaggtgggaagatcgcttgtgctgaggagttcaagaccatcctggaaaacatagtgagaccttgtctctcaaaaaataagtggatatctttttcttgatcttaagggaaagcctttcagtctttcactgttgagtatgatattagctatgagttttcataaatggcctttattatgctgatgtttccttctagaatctagtttattgttttttcattacagggtattgacttgtcaacatttttttggtatcagttgcagtggttatgtggtatgttgaactgtctttgaattcctgagatttagtttatttagtcatgatgtataatcctcttatgctgctgaattcattttcctagtattttgttgaggatttttataactatagtcatgagtgatatattggtctatagttttgttttctcacagtgtctttagctttggtaatgctggcatcataaaatgagttaggaagtgttacctcccagtcaatttttgggaagagttatgagaaggattggtgttaattcttctttattttatttaattatttaaagagatgggtctggttttgttgcttaagtttgtctcgaactcctagccttaagtgatcctcctgcctcagcctctcaaattgttgggcttacaggcataagccgccatacccggctttaattcttctttaaatgtttcgtagaatttactagtgaagtcatcatgtcctgggtttttctgttttgggaagtttttgattattgattcaatttccttactacttataggtctatttagtttttctgtttcttt

SEQ ID NO: 32016 - DNA, 1035 bp, Homo sapiens
cagcctcccaaagtgctgggattacaggtgtgagccaccgcgcccagccttttttttgagatggggtcttactctgttgcccaggctagagtgaagtggtgagatcaccatggctcactgcagccttgacctcctgggcttaagctgttctcccacctcagcctcctgagtagctggaagtataggcatgtgtcaccatgcccggctaatttttaaatttttttgtagagacgaggtctcactgtgttgccaggctagtctcgaacttctgggctgaaaccatcttcctgccttggcctcccaaagtgctgggattacagacatgagacaccatgcctggcccatgtgtttctggaatggatttataatgtcaaactcttactcttgatgagtgatcttcccagtgataaagagctttgtatttgaggaagcctttctttcctattcttcgtggtatttattatttgtgtagctaatactagaagatctcttttgtgctgtgttttgttgtaggggcttggaatattttgttagcaacatgagagctttacattcatgtaggtgtttgggggtgggcaaacaaaaataaactgataatttcaaataagagtaagtgttaggaagacaagcaaatgttaaattgatagtgactatgcatgtatgcttcaactatcaaaaattaggggctgggtaggccgggcgtggcggctcacacctgtaaccccagcactttgggaggccgaggtgggcagatcacgaggttaggagatcgagaccatcctggctaacacagtgaaaccccgtctctactaaaaatacaaaaaattagccgggtgtggtggtgggcgcctgtagtcccagctactcgggaggctgaggcaggagaatggtgtgaacctgggaggcggagcttgcagtgagccaagattgtgccactgcactacagcctgggcgacagagcgagactccgtctcaaaaaaaacaaaacaaaacaaaaattaggggctgggcgtcgtggctcacgcctgtaatccc

SEQ ID NO: 32017 - DNA, 1002 bp, Homo sapiens
atggcacgtgcatgctttggggaggtatagcaagaggctgcagctagaaggtagcacgttattattctgcccggaaactttcctctcacccccaccaggctgccccaaagcttctggcccagaagccagacctgtctgttggtgctctggggccttgccacagcagcagggagagcctgcagaagggctggtgagcaccttcccctctctctactctcccctcacaccagcagagcccaaagctctgaaaatggcaggcaaaggagacagggagtaagacaggatggccagggagggaaaagaggaagcaggaagtggcagagagcaccccaggcaggagcctagggcattggcttggctacacaaatcggtagcttccctctggccctcaatttgcccaagtatgaaataaagggtctacagtcataccaccctgaatgcacctgatcttgtctgatctcagaagctaagcaaggtcgggtctagttagtacttggatgggagactgcctggaataccgggtgctgtaggcttttggcctatcgttccctccctctttccctctttggccaggcgcggtggctcatgcctgcaatcctagcactttgggaggtcaaggcgggtggattacttgaggtcacaagtttcagaccagcctggccaacatagtgaaaccctgtctctactacaaatacaaaaattaaccaggtgtggtgacaggtgcatgtaatcccagctacccgggaggctgaggcaggagaattgcttgaatgcgggagatggaggtgcagtgagccgagatcgcgccactgcactccagcccgggcaacagagcaaaacaagaaagaaggaaagaaggaaggaaggaaggaaggaaggaaggaaggaaggaaggaaggaaggaaggaaggacggacggaaggaaggggaagggaagggaagggaagggaggaaggaaggaaggaaggaaggaaggaaggaaggaaggaaggaaggaaggaa

SEQ ID NO: 32018 - DNA, 1093 bp, Homo sapiens
ggttctgacccttctgtgcccctgggtcagctgcttcacatggaggtctttatcctcagcagtcagtgaagaaagtactgaagtaatagtaagcctttgtggaggctgcctatagaaggcaccacgtgggcacttcctggccgcacttaatcctcaaaaccagccttggtccaacctcggacactttagaaactcctaaaggggtgctgttatgctacagctgcaggtgcagcccatggcatgtgatcccctacttctgaagtaggtattatgattatctttgtttcacgggtgagaaaatattgaagataatgaacctacgaaggggtgggggtagcatttgatctaggcagtccatgtggggccctaggaggtttcaattgcccaaccagagctggggctgctagctcttgactgtaatcctggaagtctctgggtggccaactgccccttgccaaggcatgacaggtggaggtgggtttgaaagggagcaagagcaggttctgtgttctgaaggtggtttggcccagacaggccaccaggttgatgacttccaaagtgaggtctctgtgctggtgtcctggacatggggtgtgaaggttctcctttccccagccatcctgccatgaaaaaggagtgatccctttaccaagttccggtctgaggggggaggccaggtcagggcttcagctgggcttaaggttacagccaactgctaccctcagcctccagcttgtacatggaacctgccttgtgctcaggaagcacaaattcccagttcttgagtttcaactccttcacctccaagctctgttgtctggggcaaactatattagtggaacctgtttctttttcctttttttttgagagagtctcgctctgtcgcccaggctggtatgcagtggcgtgatctcggttcactgcagcctccatcccctgggttcaagcaattctccagaatcagcctcttgaccacaggcacatggcaccatgcctggctactttttttatattttcagtagagagggggttttgccatgttgcccaagctggtcttgaactcctgagcttaggcaatccgcctgcctcagcc

SEQ ID NO: 32019 - DNA, 1099 bp, Homo sapiens
aggtgacacccgtgacagcagtcgttaacgcacatggcagtggtaggactagccatgatcacaggcattacagtagttcatgtttgttgacccctcacttggctcaggtccttatgagaccactgtgcataaataggcccattttatagatgaggaaacagacacgggtgtccagtgccttggggctaaagtgtgcagagccctctccacagcagtgctgttgacctctattccaagttgctgccctacccacactgggcttggccaggtccctcaggggtcgggcaagaccagccagccaccatgctgccctctgtgccccagccccacctgcccacccatgtgggaaggctccttgaaggaggcacctccctgacccatgccaatgtgtttcagacgaagcccgctccaagaagtgtggtgtcctggtgcactgcctggcaggcatcagccgctcagtgacggtcactgtggcctatctgatgcagaagatgaacctgtcactcaacgacgcctacgactttgtcaagaggaaaaagtccaacatctcgcccaacttcaacttcatggggcagctgctggactttgagcggacgctggggctaagcagcccgtgcgacaaccacgcgtcgagtgagcagctctacttttccacgcccaccaaccacaacctgttcccactcaatacgctggagtccacgtgaggcctggtgcacggggggcatggcaccaggcccctgctcggctctccacagggctaggtgggagagcccaagcccgccacctctggcctgaggaacccccagatgtcacctgtgcccagaggcccaggctgatcggtgtcggagcgcccctcaccatccttgggggcagggcccgcaggcaaggtctcccactgcagggcttgctggagaggcctcggctcttggacacgtggctttgggcgtccaccagggcctcatcctgtccaggacgctcctttctgctgacagcccagccagtttggctgttttttaaagacacatccacggacctgagtttactttttacttttggcaggtaaatccaagctccctggagcacaaagagtgtttgagct

SEQ ID NO: 32020 - DNA, 1027 bp, Homo sapiens
gaagggggtacatactagctcacatctgctcttagggaccctcagctcctcccagaggaatagcaaagggccatgaaacatacccaccatggcgaggccttgtgctgccaggaaggccccttctctgtgtggttctgaggttggatgtgtgcagacagggaaggcagctccagacgtgccttgtgggttcaggcctggcagttggctgatcgcgatgagaagggatggcaggaggagcagcaggcttgaggcagggcagacttgcccctgggcgttccgggtgaccagtgtggtgtggtagtggatggtgttgggtggtggacagtgactgtgatagggtgcagagcaaagatggggtgaggaggggacggggtccttggagcacccagcagggaagctaatctgggcccggatgatcagaggaggcctctgtgctcagagactgagctgggatcagaaggcaggcaaaggctgaggatgaaaactgtccaggcaggggaaatacctgtgcaaaggcctggggctgtgtgggaaggagggacagccctcagagagttcaagcatgtcccacctgcacttcccctctccctcctgaaacaagctcatccccagggacagagcttttccagcagcctctttcccactcccccaccctgcccctcagggagaccctagtgagctggacacccctcctgggagctgcaggtgagggaaggcctgaaccctaaaggcaggaaagaccacatttctaaagaggaagaatgattccaaggccttggaatcacccagggcaccaggttgctgccaagaacgaccctctcccttgagggaagcctacagctgccaggcaaggccccggacagggacagctctggtctcttgccatgtgaccataggcgagttcctgccctgctctgggccttgtaagtctgggattgagggttcttccccacagtgagaaccaagacttagggcctttcctccaacctcctccaacctgcccggtgggggcccagggtcctgctgg

SEQ ID NO: 32021 - DNA, 1073 bp, Homo sapiens
agacagaaggggccgcactgtggaagagttggaccccagcaagagggagttctgggagatgggccatctttcctggccactttgcccaggctgcccctctagcagccagagccctggactcctcaaccccttcgtcagtttccctttaccctgccccaaagccagaagccatggacgcttgtgtcaggcaaagcagtttcccttgttgacacctggcacctgacacagcctgtacctctttggggaccttctgaggggctaggaccagacctctggcccctgctcccctgtacagagcacagggtgagaggcagtgtgatcaaggaactgtttggaaggtcagcgctcatttttccttgaataaatgaaagtcgtggcttccaggccatggagtgtggacccggggaggccgcagaggtatttgcctgcagagcgctcctcctcaccctccagggcaggtgtggccttgtctccagcctggtgaggacaggcgctggtagcaggataattcccgggctggacggagcatgaggcgacgagagcagcctgcttggctgggccccgctgggagttgggccactaggcagcaggtggaaatggcagtggcctgtgtacaccgaggtagcatgtattttctgaaccctcgtatgggtatgtggggatgtgcttactttttgttgtgaaccgacaggtaaagatcatatacattctgaacaaggccacgtgatatggctccaaaccagtctgtgccaggggtactccccacacaccccttctgccacctcagatgctctcctgccctcctcccacagctcccgtgcagctggggaagcacggtggcactgtgatggcctgtcctggctgctctgggcctgtggcccagacagactccctgcaggtggcctgccagccctcctgcctgtgtgtgccaccagccctgagtgtgtctccactttgccacttggatgcccagtggggcatttccatcatgggggaaccccttccttccccttgtagagggaaggcacaccagcagcatttcagatttccatgtttcagccgggcgcaggggc

SEQ ID NO: 32022 - DNA, 1025 bp, Homo sapiens
accaggaaggtttttttttttgtttgtttgttttaattaaacaaaacaaaacaaaacaaaaacctttgtattgtggaaatttcaagctagcacaaaagatagaataatgtaacaaaccccatgtaccactcacctagcttcaacattctgctaatctcatttcatctgtttcccccacattttaaagaagagtttgagtggttttaaaaatcccagatatatcattttttactccaaataaggccatttcttagttatataatagcagtgctcttatcacatccaatgaaattaatagttccttcatatcagatatctagtccacattcacattttcccacattgtgtcattgttcaaataaggatgcggaaagctttgagaaaacccatgttctctgctcccccttccccgacccatggttctggtaggcggagtagctgagggggctttggcctggagctgtcttgggcttggggaagggggcgcgtctgggctcacaccacactcctgatgtcctccaggagagtttggtactgtgagctcctcgctccttcctggaggtgggtcaggcacaggtgggctagctactgccagctatcttgggccaggcatccgctggggggcactggctgtctttgaagcctgcagggggagggaagggaagacgtgatgtaaccttggttcataacagctgtctgcgacttcattttccaggaaaggagaggctgtttgaccccatgggacacagccttctgcaactcctccctgggaatcgtggggctgctggtggagggctctggctgatctgctctggtggttctgagggctctggtggagggctgctgcttttgcgggttgggtagagccagtcctggttatctatcttggcaggctttgctcgtgtcctgtgatgctgcacaaagtatgaattacggagcttgggagtgatgcctggggtgtggtcggtggctctaacactctccattgaactaagtgcaaggagagtttaaaatagccagccttt

SEQ ID NO: 32023 - DNA, 1032 bp, Homo sapiens
gacctcctttaggcttcatactgagttgggccctctcaatgggaggggctggcttcccagctggggaggacttgctctctggtgccctcaggatgtgtctggggggagaccctgggccccatgggaatgagttttcccagagctctggattgcagtccaaggctagcatgggaagggcctcggtcttattcccatgtgggtgtgctccttggagaactctgggccacaggctctccacctccagaccatacctcgagatgtgctctgctccatgggagacttctcacggtctgtttgtggatgccagggaagatggagctgggccagttgctccccctgcctctccaatgtcttggtggaggcttgaagcctgttagagctgtaggtcatagcatcacccactgtcctcagccagtggctccatggactcatgcctcatggtctggcacatgaagccgcagtcacgcgcctaccgcttcactggccacaaggatgccgtcacctgtgtgaacttctctccttcgggacacctgcttgcttccggctcccgagacaagactgtccgcatctgggtacccaatgtgtgagtcgtacactttgaggaggcttgttggagtctggggccctggtgccagagccatccccacccaggtcccctagcttggctctggactggtcacagtgggacttctactctgctttggaagaggtgccatcagaggctggggctgcagttggagccctcccctcagggttggaagaggagttctgggcttacccaatctatccctaaagaaatgccacctgatgctgtgttcatgtgggtggggcctagagatggtgctctgttcatataggagaggctctggctttcccttgtggagactggggtactcgggcttgactgactttgggaggggtgcttgaggagtaggagagctttgatgtgcttgtgggctctcatgtcactgttatgggtttccttactcttggatgcctgtccttgtagcaaaggtgagtccactgtgtttc

SEQ ID NO: 32024 - DNA, 2989 bp, Homo sapiens
cctctcctccctctcaattttgcctgagggatgggtcctaaagcttggcgtatcctcagatctcaatccatgtctcatttccagttgtctttgtattgcgccttgagctgttacattttccgtgaatatcctctttaggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggtatgtgaacagtaagaggtatctgctactcagggacccttcccagttggggtggtgggtgcctcaacaagcacagcaagctgtgttctacataggtacattacaagcatccaagtacatgtttctcaactggtggtttccctatttcatctcctattatttgatctctggctgggctggtcttgcctttcatttttattcttcctagaggtgatcaggaatcatctttgagttccaaggagatcataggccagtttttgctctggaccctaattttaggtccaaactacctgggctatgcttggcaatttttttgctccttaaaatactctgaaccggccttttgtggtttcagttttccattcctgttggtttacgccaaattcccagaaatttctacagttggtcataactcaccacttagaattaactccaggcccttatctcttcctagataatactaacagaacaaaggatcagtgagtctcagctccagttttcccttgtgatctcctaaacctgcctgggtattcggggatgagacatttcattactagcctacccggagcacattgccaccttgctttttttttttaaccaagaaaaaaatgttagaaaaaatacagcaaaaccatccagttccttactttttacagcccaggaaggtgggggcctgttggaggtaacctggtggattagcaatgaggacaggttacttattcacccacctcccaggcagcactcctttttttcccttcctttaaaaaaaagggggcggggggtctgctttggtggaaggtggacagtgattattggagaaaaacagaaccattttactttcacatagaggaaagagtgtttctgtctccttagagcatcggggttggttggttaggagagagggctaccagagccactggggttgggcacatttttgctgtggggtgggatgtgaagaaccgttggcagtgaggagatgcttggctttttaaagttgatttatgttctccttctaggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggct

SEQ ID NO: 32025 - DNA, 1109 bp, Homo sapiens
cctccgcctcccgggttcaagtaattctcctgcctcagcctcccaggtagctgggactacaggtgcatgccaccatgcctggctaattttttgtatttttagtagagacagggtttcaccatgttagccaggatgggtcttgatctcctgaccttgtaagccaccgtgcccggcctattctttattcttttgagacagagtcctgctcttgttgcccaggctggagtgcaatggtgcaatctcggctcactgcaatctcagcctcctgggttcaagcgatgctcttgcctcagcctcccaagtagctggtattacaggtgcccaccaacacgcccggctaatttttgtatttttagtagagttgggacttcaccatgttagtcaggctggtctcgaactcctgacctcaagtgatctgcctgcctcatcctcccaaagtgctgggattacaggtgtgaaccaccacgcccggccaggattctgtttttaaacttatttcagtggattattgatgatcatctcacattttgcagtaaggttttttttaggccggtggctacatagtggctcatgcctgtaatcccagcacttagggaggcctaggagagtggatcacttgagcacagaagttcgagattagcctgggcaacttgggaaaaccccgtctctacaaaaaatacaaaaattagccaggtgtgatgggacgcgcctgtagtcccagccacttgtaaggctgaggtgggaggattgcttgagccctggaggtctagggtgatcacaccactgcactccaacctgggtgacagagcgaggctccatctcaaaaaaacaaaaaagatttttctaatgtcattccacaaggatagcttatactgctattttggctgtgcctatctcagagcagaatgggcggaagtccttttttccatttttttttttttttaatgagactcttctgcctgtattgatttttagttaagtatgtcatttctacttttcatgcctgtatttcagaagtggttttctaaggaagcagtgtagttaatgattttggaaaagaatgtaaaaccttaggatcctgaggaaacatgtctatgtgatcatccgaa

SEQ ID NO: 32026 - DNA, 1045 bp, Homo sapiens
aatccccagatttacttttacttcccacctaaccttgccactaggtgttctaaggtggaaagcttcttcagatggctgttgcttgagcgttgttttttcccttttggaagaagttgtttctttccagtgttagaacttaccaaaaatcctcacctttgccacatcattcaagtgcttctctttatgtggagatcccagattttgatgatggagaatgttcatgattttctgtctctattttcttatcagaccaaagagaaccctgtacagtaagaaatatggtgtggacctcatcagatacactcatgcagcaaacacagttgtttacagctctaacaaaatagacggtaagcaagcctttttaggaagttaaggtcatggtttcctttgttaaatagttcatggaatctttgtgactacttctgctttgtgactactttagtttaagtattttcatataatgttagtaatgttaattgcattgttttgactgaaggaatgctggaagcaagccattggcacttttgaaggacttgggactgagtatgaaaagtcttcaattcagagtggggagtggaaaaaggaaacaactaattgtgtttatgatttgtacttcctgacacttaaaagaacgcttttaaagccgggcgtaggggctcgcgcctataatcccaacctttgggaggctgaggtgggcggatcactgaggtcaggagttcaagaccagcctggccgatatggtgaaaccttgtctctactaaaaatacagaagttagctgggcacagtggtgcacgcctataatcccagctacacaggaggctgaggcaggagaatctcttgaacccgggaggcagaggttgtggtgagccaagatcacgccattgcactccagcctgggcgacagagtgagactccatctccaaaaagaacacttttagaacaaataaaaggaaagaacacttgatacacagcaagtgataaacaacaggactttttcttttaaaatgatagagatttgagaaaagtttcacaaatgcttgaact

SEQ ID NO: 32027 - DNA, 1046 bp, Homo sapiens
cttctgatgaagattgacgccttccactacgtgcagctggggacagcctacaggtcagtcggctctgccccaaccccacccccgccccaccctacactgctgttctggctcaggactaccttggactgatggtatcttgggcctgctcaggggcctccagcctgtgccagacgaggaggtgattgagctgtatgggggtacccagcacatcccactataccagatgagtggcttctatggcaaggtactccataccccagcagccagcctgccccatggacatgtgcccatgtcccaaggcagatttggggccctcgtctccagcactgaaggggttggggtcccaaagggtgtctgagacaatggccccctccccagggtccctccattaagcagttcatggacatcttctcgctaccggagatggctctgctgtcctgtgtggtggactactttctgggccacagcctggagtttgaccaagcacatctctacaaggacgtgacggtgaggatgctgggcctgccctcggatggcaggaaagactaagtccagccacagtgggacagccccacctgggccctgctgtaccctcattgtcctccactgcccccaggacgccatccgagacgtgcatgtgaagggcctcatgtaccagtggatcgagcaggacatgggtaagtgtggacagaagccctgccgtggccggcctgagcaggtggcaggactgaccctcacagactcatctgccccattagagaagtacatcctgagaggggatgagacgtttgctgtcctgagccgcctggtggcccatgggaaacagctgttcctcatcaccaacagtcctttcagcttcgtgtgagtccagcccctgtggatggagggacagcagggccagggctctgggtggggagggcaggcacggagccgccctcagactacttgccacctgaaactcctccacacagagacaaggggatgcggcacatggtgggtcccgattggcgccagctcttcgatgtggtcattgtccaggcagacaa

SEQ ID NO: 32028 - DNA, 1116 bp, Homo sapiens
gagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtgg

SEQ ID NO: 32029 - DNA, 1050 bp, Homo sapiens
tctttttgcattttgaatgaagtaagagggattctggaattttcattgatttagggtggtttatggtcagtattgaactgctcagcttcaggaaacctggttctttcagtacattgtccattgctacatacgtgtttatttaattctctgcttctgatgattgtagcctgaagtataatgcatttttttcctttggggtttattaaacatgacttctttgcttcattagaatgtagaaattagttgtttccctaaaaccttctgaaggaggcagtcagctacttttcccttacagagttaattttcttcagctgctaaactccatgacactcgtgatgagtcctcaaatcttagtaaaattgggtacaaagaatcaggaaatatatatagtaagtaacaattgtaccaaaaattataatgggccatggaattgcttcatattgaaattataaataatctgtaatgctattaatactagaataatggtagcgcttctcatcttcagggtgcctcgtgagattaaccatggtggttatgctggtgacgtgtttacataaaacctgtgctttctgaatgtgtgttgcagtcttaacattcttgaaatctttgcagaccagttctcaagatgggataggaaagctggactctaggttaccaagtgaaatcggcccgactcctcctgtgttgagactagtcatctactgttccttccattgagacagaactgttgcctgtgtttttactagtcctgttgaatgcaatggatggtattttgaattcctgggttaaaaacagaattgaaaatctgaaatgcctttacagagcgggcagctaaagttgctgagcagcaggagagagagcgagcagcacagcaacagcagccgagtgcttctccccgagcaggcacccctgtgggggctctcatgggggtggtgccaccaccaacaccaatggggatgctcaatcagcagttgacacctgttgcaggtaaaaacaggagctaagaccatttttttccactttaagaaattccttcattttttttttctc

SEQ ID NO: 32030 - DNA, 1231 bp, Homo sapiens
tttttttttttttttttttttgagacggagtctcactctgtcgccaggctggagtgcagtggcacaatctcgactcactgcaacctccgcctcctgggttcaagcaattctcctgcctcagccccccgagtagctgggactacaggcgcgcaccaccaaacccagctaatttttatatttttagtagagacggggtttcaccatgttggccaggatggtcttgatctcttgacctcgtgatccacccgcctcggcctcccaaagtgctgggattacaggcgtgagccaccgcgcccagccacaatcctacaatttatatggaaccataaaagactcagaatagctaaagttattttgagccaaaagaaaactggaggaatcacgttacccgacttcaatttatattatagagctatatagtatctgaaacagcatggtgctggcataaaaacagacaaatataccaatggaaaagagtagagaacccagaaacaaatccatacgtctacagtgaactcatttttgacaacagtgccaagaatatacattggggaaaggacagtctcttcaataaacggtgctgggaaaactggatatcagtatacagaataatgaaattagccccgtctcttgccatgtacaaaaatcaaaatggattaaagacttaaatctaatacctgaaactatgaaactactggaataaaactggactaggcaaaaatttcttgagtaattccccacaggcacaggcaaccaaagcaaaagtagataaatgggattacatcaagttaaaaagcctctgcacagcagaggaaacaaagtgaggggacaacccacagagtgggaaaaaactatctgcaaactaaccatctcacaatggattagttaccagaatgtatgaggaactcaactccttaagagaaaatctaataatccaattaaaaagtgggcgaaagacctgaatatacatttcccaaaaggagacatacaaatggcagacaggtatatgaaaaggtgctcaacatcactgatcatcagaacaaacaatgagatatcatatcactccagttaaaatggcttttatccaaaagccagggcctgatactagtaccccagagttggggcacacagtccaggagtcctgagctgagccttggccccctaaaatcctctagaaactaagcccatcaactgaacccatcttataccacaatcaaacacccaaggtcat

SEQ ID NO: 32031 - DNA, 1054 bp, Homo sapiens
atgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggtatgttttcaaagccatttttattttgaggatatgtgctatttaatacaaaacagatgaaagaatattgctttgatgtactatttccacttacatacatgatttgtagttggtagcatgctattctgaattctaatcagccagaacttcttaagagtgagtatattctgtgggggagagaaggcacaccactaagtcatctagtttaaggccagtgaggaggaagacaaaattgaaaatctcttgaaaagcataaacttaaaatacagcctttcatagaatgtgttttttaaaaagataaatgtttctaattggaaatagtaacagcgtttttcttttaaggtttggcttcagtgcacgaatgctttaaataaaatagctctaaggtgttgtcctgaggttagactgatagaaatttgatcaccattttaagtacctcagagggtttcttttttttt

SEQ ID NO: 32032 - DNA, 1064 bp, Homo sapiens
agtactgattaggtgaaaagtgaagccttaagcatgtgaaaaaaagtctttattggggtgccagtttattttatgaataaagaaagcagtacagtttaaaaaatcttgttagcaaaataaattcagaattaacctagttcagaagtagccttaatttgttgctagctttgccagggacagaaggccccctcaccaatcattgtggctgtgtttctgtagcaaaaggtagaaggtggcagtgctggtgcaggactggcaggtgctgattccctttcagggatgccttttacagattgagggtggtggagggatcaaaatcagcttcacagtctgagtgacatcagtgcatgtggacacctatgcattgggtcagtgcttcttgagcatgaatacatttcctcagtctctgatcttgttcatgtcttttataaaaagcattcttttgcatgttacttatgatttgaaaacaacctatgtaataattgtgtagtgcttttgttttcacatttgccgtctgacattcacagagtatcagttgcttatagaacactaaactctgctcttacagtttataaaggagaacatttagtcatctcttttacctgccaggaacatataggccaaggaaagaggcaggttgaaaacaaatgaagtcatttggaagcaaggtagtaaaataattgcataaggtacactactaagcagttgtataggatcattgcatgattgcccagatagctttaggaaagattattttcctaccatactttcccttgaaagttgaatgtcttgagcttccccaaatgttactaccatatgtattccactcagtaaaattgctatgttatcattgtcatcttcctaatattttcctaaagaaaagttttcttaattaaatggtaaatttaagaaaaagaccatggattgtattctttcatatcattcataatgtatggcattgaaactaggtggtagtggaaataggaatagggggcatcactgggtagtgttacaaccctgagttctagagcctgactgcctaaattccaatcccagctgttctt

SEQ ID NO: 32033 - DNA, 1026 bp, Homo sapiens
ggcacctcattaggttcatataggttgttctagggatacaatgcctatgtccagcatcagaacattatggggtattcttgaaatttggagttaaaataagtactgcttagaagttgctttctttggccaggcacagtggctcatgcctgtaatcccagcactttgagaggccgaagtgggcagacatgaggtgaggagttcgagaccagcctggccaacatagtgaaaccccgtctctactaaaaaaataaaatttagctgggcctggtggcgcatgcctataatcccagctactcgggaggctgaggcaggagaattacttaaacccaggaggtggaggttgcagtgagctgaaattgtgccactgtactccagcctctccatctcaaaaaaaaaaaaaaaagttgctgttttgaattagctctacaattttagaagctatgtaatattcagcattttattatttctcttagaaagtacttttttctccacattaccagtcttctccagcttacttgaaggagatcctggagcagcttcttgaagccatagttgtagctacaaatccatcaggacgtctcattagcgaactttttcagaaactgccttctaaagtggtaagtgatgcagttaaaaacaggtacatgtcagtgttttgtttttagtacttcaagaattgtattaattactgataaataaagtaagttcaaaaggaagatgttgggccgggtgtggtggctcatgcctgtaatcccagcactttgggaggccgaggcaggtggatcatctgaggttgggagttcgagaccatcccgatcaacatggagaaaccccatctctactaaaaatacaaaaaattagctgggtgtggtggcgcatgcctataatcccagctactcgggagggtgaggtaggagaattgcttgaaccctggaggcagaggttgcagtgggtgagccaagattgcgccattgcactccagcctgggcaacaagagcgaaactccgtctcaaatttaaaaaaaaa

SEQ ID NO: 32034 - DNA, 1021 bp, Homo sapiens
gggtttcaccatgttggccaggatggtctcgatctcttgacctcatgatccacctgccttggcctcccaaagtgctgggattacaggcatgagccactgtgcccggtcataattacttttaatttagcaaatcatttgtcttctgcctcaagtctttctttaatgagataagacctaaataatttgatttcagaatgtctttaaaacatacacttaattttttggaagcgggatttggacccatatatgttttaatcatgaggatgttaaaatttgtaacaatttttggtctttgctgaaacaggtgctttaaaagtagcaactaatttccaatacattactaaagtgtttttttttttctctttgctaacatacagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggagtaagtgtgtagctggaacttgtgatggatgggctcttggaaggcagagagggcccctgcttgtgattccctctgggctgttgtgggcaactagaattcctgtgcaattgtattggtaactgggaggataaaaggacattcagccagagagccccactccatttttaagggatcctaggatatcctggacaacgtgtgccatgtgtggtaattttcatgaattgtacttacattaatgcatatttcctgctcagttttaaagagaatcttgatattatcaaggattagtccagtattgctacattgagacatcatgtaaggaaaggcagtgttgtgattagaagttggaatgtaatcaccttagtgaggaatatttctgtaggttagaatagttactgttcctagaacctcccaggtgtgtttctgcctctggaattttgcagttgttcttctgcatagaaagtgcttcctttgacttttcccgtgactggctctttttt

SEQ ID NO: 32035 - DNA, 1030 bp, Homo sapiens
ttccttttccagttaacctttgcaaggttctacttgccaattctggttcccagcgcaaagaaggccatatacatggatgatgatgtaattgtgcaaggtatcaaaaatgtcaccatgagtgctgttctccacccagattgggtacaattgctaaataaaacaatgggctacagtgggctgtagtggtttatttatggtcttctataaaaggtcaccatagggagaagtgggagtaacagggaactctcaaggcaacggaaatgtaaatcttaacatcttgtctatttcaggtgatattcttgccctttacaatacagcactgaagccaggacatgcagctgcattttcagaagattgtgattcagcctctactaaagttgtcatccgtggagcaggaaaccaggtaaattgcttaccaaacacccctcttcctacaatattgtttaatgggaagaggttgcaaattcagggaactcttttgctgcaatttacactccccaatcatttcatcccaaaactcaagcctgcttttctgtagacttcttcatggacttgacagcctaattgttcttgaacatctggtttattatgtcaacatctaggttcctattctaacttggaatttcaaatatttattttctaatctgaagaagtcagtttaacagctcttctctctactggctataaaattgtatctattttgtttgaagcagtaagtacatatatcctatttgtgtttttagtacaattacattggctatcttgactataaaaaggaaagaattcgtaagctttccatgaaagccagcacttgctcatttaatcctggagtttttgttgcaaacctgacggaatggaaacgacagaatataactaaccaactggaaaaatggatgaaactcaatgtagagtaagtatgtaactggcctagctgtgaaaaactgttgtatttcaattcctagagtcttgactaacaggagttagtcagtacttttcactaacaaacatttgttttctgtcccaccaagag

SEQ ID NO: 32036 - DNA, 1058 bp, Homo sapiens
atgtagagataaaagcagtaggagaaacaaatgacataatatgtcgtcataattcctgctattgttaataaccttaaggagtagttgataaattataaaattttaaaaagtcaattcagttctagaaatagatttaaagaatatgaagttctatctagtacttgagcagctgtatttcttttctacacattgatggacttttaatattttattctcatttaatataaacctcatctagggtatatacaaattaaaactgagacacattggctttgtaaatcagtatgtttttacataatggttttgttagatttatttttccatcagtgaaaacatttcttaaacacaaatttcatttccatttaagcaatttgtaagcaaagtccaggtccatttagtttttggatatatttaatgtttgtctcctgaagtttgtcttcatgtactgtaagatattagttgtctttccatgttttaaatgtatgattatatagcacatattttattagttgtttaataagaggtaatacccatctaggaaagaaattttatgaagttaaatacaagtcttgaatagtacattttcacttctgtattcgagggactctaaaaataaatattgctccagaaatgttttcaggtgttttttttttgagacagagtttcactctgtcagtcaggctggagtgcagtggcatgatctcaactcactgcaacctccacttctggggctcaagtggtattcctgcctgagcctccctagtagctgagaccacaggcgtgtgccaccacacctggctagtttttgtattttttgtagagacagggttacaccacattgcccaggctgatctcagaactcctgggctcaagcaatccactcacctcagcctcccaaagtgccaggattacaggaatgagccactgtgcccagccctgttttcagtttctataactaaaaatatatctatctttgaaaattacacacacacacaaatactctaatgaaatgttccctttacagccacttaacaatttttttttttttttaagacaca

SEQ ID NO: 32037 - DNA, 1031 bp, Homo sapiens
agtgatctcctgcctcagcctcctaagtagctgggattacaggcatgtggcaccacaccagcaaattgttatatttttggttagagacggggtttcaccatgttagccaggctggtctcgaactcctgagtgctccaccgcctcggactctcaaagtgctgggattataggtgtgagccaccgcgcctggcctaaatatgccatcttgataaagtctgtgccctatgaatattagtccaaaccactttaatacagagggataagatggctgcacatagacacctaataacgtctgctccgcaaccaaggtaaattcagcaagaagagagtatttcaggtggacgagtctgtaggaagcatgcatgccatttgttgactgtgctgctgggacaggctccgtaggcttagttatgggcaaagcatttttgggaatagaaggcagctgtttctttggcatagttcatcaaagactggtttttgcatcccctgccaatgttttcagcttcagatcgtttccatgtagagcttgtagacatgctccagaaagagtacataatgtgtactccaaacaaagaaattcagtagtatgtcatcagactcttccgtcctcagcattcaatttaccagccttccgggcattgtgcctcacctctgtgccttcaatgtagagttcccagctgcctatcacctttgtggcccagcggcatctctggccacagtgccagtcctgcccctgcttgctccctgccctgtcctggcttacttcttttcttttctgagacaggatctcaactgtgtcaaccaggctggagtgcagtggtgtgatcacggctcactgcagccttgacctcccggctcaagcaatcctcccactcaggcttccaagtagctgggactacaggcacttgccaccatgcccagctaattttttggtattttttatagaaatggggtttcgccatgttgcctaggctggtctcaaactcctgagctcaagtgctgggatgataggtgtgagccaccacacttgg

SEQ ID NO: 32038 - DNA, 1050 bp, Homo sapiens
tgttttgataatgtggttttgtggtatgttttaaaatcatgaggcatgagtcctccatctctattcttctttttcaagattgttttggctatttgggatcccttgagattccactgaattttaggatggatttttctatttttccaaagaatgtcattgggattttgatagggattagattgaatctgtagattgctctgggtaatattaatatattgacaatattaagcttttctcaaggagatgcccaaatgtaaaaagagaaaaaaagaaagaacaatgttaagtctttcaatccatgaacatgggatgtgtttccatttatttatgtcttctttaaatttctttcagcaccattttgtagatttcactatgtaagtccttctttcgccttttggttaattcctaattattttattatttttgatactattgtaaattgaattgttcttgtaatttgcttctcagattgtttattgttagtgtatagaaatgcaactgatttttgtatgttgactttgcctcttgctaccttgctcagttcgtttattagttccaacagtttctgtatgtggaatctttagggtttcctagacacaagatcatatctgcaaaaggagataattttacttcttcttttctaattttgatgccttttattttttttttccttgcctaattgctctggctagaacttctagtactatattgactagaagaggtgaaaacaggcattcttgccttgttcctgatcttagaggaaaagctttcagtctttcaccattaaatgtgatgtttactgtgggtgtttcatatatgacttttattatgttatgaatttttttttctattcgtagtttgttgaatttttttttaatcatgaaaaggtgtttttttttcacagccctgaaaatcatcacataagggtgttgatgatcatgtgttttttttccttcattctgttaatgtggtctaatagtacatatgaagcatataattcattgtccttaattagattcacagtatcatgcagccatcaccactatcttc

SEQ ID NO: 32039 - DNA, 1050 bp, Homo sapiens
ttgggaggctgaggcaggcagattgcttcagctcaggagtttgagaccagcctgggcaacatggtgaaaccctgtctctcttaaaaataaaattagctggacatggtggcatgtacctgcagtaccagctacttgggaggtagaggtgggagaatcacttgagccgaggaggcacaggttgcaacgagctgagatcacaccactgcactgcagcctgggggacagagtgagaccctgtccctgccccaccaaaaaagagaaagaaaaaaaagtgatggggaaactagacatcattaagttaactttggtcctattttaccaatgaggaaactgaaatcagaagatttaagggccttcccacccaaggccactccgtgacttcctggacaagaggggaagcccagcccactccccaccctgactactgaggttctgtgcacacgtctctaccttcctgctcaagacactgggtctttccacagcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggtactgagcccattaccggggcccaggccttcctcagaaaccagctgtgcttgggaacaggcagcgcccctcccctgcgtgtgtctcccaggcttcctctgtctctgacccttactgatccaccctttgtatctcaggccagttttaccaggaggtgctctggggatctccagcagcatcagatgacggcagacgcacgctgagggttcagggcaatgaccactctgccaccaggtgacttggcacaagcagaccgctgagcccagctggggtggggtggggactggcaggccaggagccaggctctccagggccccactcctgtccttgcccaggaactagacacagtccggtggaaggttgatgctgtagaagtgtctaagccagctttcagtgaccccacaaaagatgga

SEQ ID NO: 32040 - DNA, 1050 bp, Homo sapiens
acccacttcctcactcaggctaggaatgtctttcctgagggcagggagcaccaattctccatcttacccttggccgcggcatctagctcagggccaggcgctccatggggcgttctgaaggcttattgactggagacaagttaattctcaaaggcctcaactgagggtggccgtcgccgaggatttaggggcccctccaaagccttagacaccaagggacaagtggagagattgtgggagccagcccccagtgtgaaggagtgctgagaaaggggcacccctcctgatgagggagggagctgctgcagaactccagggggtgtgatcaggggggactccccatgcaggtcggtgtcagacctggctggggcccagctatgacctctctggtctggtcctcccaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccgggtaaggcccaggctggagcccggggcaggggttgacctttcaggctacagtggctgatgatggtaccagcaggtggcctgaggccatggacctgagaatggagcagctacactcacaggaggggcaaagagacaagagccctgccatatacccctgcagctccggagggcactgaggagttgtcccagggacctaacccaggtcactatcccatgcaggagacagtgtggtttggagctagctctgctgctaatccttgtgaccctgggcaggcagctaagtccctctgagcctcagtttcttcaccaataaccagtactaatcatcctggcccagagtcagaaggctggggggagaacccaatgagagagtgtagttgggagcactttgccgtcagatgatacagtgccccccaagcaccccacaggacagcgctgcctacatagtgacgtgatgttctgatgacaatag

SEQ ID NO: 32041 - DNA, 1092 bp, Homo sapiens
tgcattcaggcagccgcatgcagccgagcagagttggtgcagtgcgcatgagcatgtcacacacaagcaggtaagaggtgcccgtgtgcccctcctcgggggacacagacctcaaggcaaatggcacctgctaggggagtgccctgcggaagtggggatgagttggggagggtccactgcggagcagagaggaagattcccaactctcagagaccagactctagtctacctccgaattctcccagctctgagggcttccttctaggagactggtgggagcttccctgttgccacagaggccaaagtctccagaaatcaaaggacctggtcactgccctttttctgggcaaagctaagccagcatgcaaagctccctgaccccaccaggtctctcacccctgcccaaaggctgagtgtgatgcccctcccagacactggccctggcttcaccagctccaccccctgcatgcttgttcttctccaaggggtgctctgggcccctatagatcaagaaggacgtggcccctgccctgtggtgctgtagggtggggaatgaagcacactgctatctcttacctgagacaaatgttcacatatgagatgcctcactgggttcagcctgaggcctggtcagtggctcagtcagattgggagccagggtttggtctagagccagagtcagggccaactcttgaagagcgtcaccccgagctgaggtggcattgaaaccctgcaacccccttcttctttgctggtccagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgtaggtgccttcccaccctcctcccctctccacaccccccagtgctatgactccatcgctctgtgccagcaaaccctcttcttgaagtaaggcatgccagggtgtacatcttcaggagtacaccctgcacctggggccacacaggaacaggggcttgccaaaggacttatt

SEQ ID NO: 32042 - DNA, 1049 bp, Homo sapiens
tagggctcttgcaggaatcactccatcagccttggcttccagctctgtgttcgggaacctgacctgcacttgaggtgtggctgctaccctccatcagcctccgcctcaggggtgtgtggggatgaggatgtgttagaaagggtggcttatgctttcctggctctggctccatctgagcaagtcccctccatcctgcaaagcaccactaatgaagaaaggtctgtggtcctaggaccctgcctgagccactctgagcatggtgtggcttctgcaggagcagctgccaggcccacgcagggcacaactgtttccgtgggacagggtgcctggcttactgtctgtgaggtacacagagacccctccttgtttgttgcctggagataagtacccccgccaccacgtggaacagtgtaaactcccacctcccgagtcagccccagccatcctttcttccacaccccacgtccactgtcagcagagccttcagctcaacatttaagacccaaccggaatctgacctcttctcccctctcctattgccccggtcagtgccagcatgtggtcctagttactgcggggggtgaatgggagtgggtggttgtctctagtgggctccctgctgccataccatccctgtgggctgctctcagcacagcagctggagggagcctgctgggctgtggctacagctgcctggccaccacacacaggcccacgtggagctcttagcctgggttctcggtggaggtccagctgcctctcccgcacgccctgctgttctgcctgctgtcctccagccctctgcctggacggctcttcccgagaccctcgtgacttggcctgcaccttcctcgggcgtgggctctccttcatacctcctcattgacagttcagaccccacgtgccagccctcttctctcttcacctgcctctgtgtttacctccatgcttggcactgtctgccatgctccatatgttattcctctccctactagggtgtgatgaaggcaagggttttgtgcatttcatctcctgctgaatggggcttg

SEQ ID NO: 32043 - DNA, 1049 bp, Homo sapiens; identical to SEQ ID NO: 32042

SEQ ID NO: 32044 - DNA, 1049 bp, Homo sapiens; identical to SEQ ID NO: 32042

SEQ ID NO: 32045 - DNA, 1049 bp, Homo sapiens; identical to SEQ ID NO: 32042

SEQ ID NO: 32046 - DNA, 1089 bp, Homo sapiens
ctttaggccattaagttttgtagtaatttgtgacacagtggtacaaaactaacatagcaaagctgtgagagaagttaggaaacttgattcctgttctctaagagtccatagcctgcttaggaaggtagaccacttgaacaagtaactattctaggcttgtatgcaaagtgagcaaagactgattcaggtatatttatctattgggcttatcaattggatttcatcagtgagcagggctgtcggaatcccagagtggtttgtagcattgctattcctcctgagttctttcttatttatttatttagagacggagtctcactctgtcgcccgggctggagtgcagtggtgcaatctcagctcactgcaagctctgcctcctgggttcacgccattctcctgcctcagcctcccaagtagctgggatacaggcacccaccaccacgcccagctaatttctgtatttttagtagagacggggtttcaccttgttagccaggatggtctcgatctcctgacctcatgatccgcccgccttggcctccgaaagtgctgggattacaggcgtcaagccaccgcgcccagccctcctgagttcttgaagatagtttaaacaggctcagataccagcaaacctgtcatccagagtaggagttagctactttttcagtcttaaggatttcagagaggcggtttgtcatattctttttttttccacattttctattatgtttaattgcatatgtgccttacccttagcaagcctacctgattgtcaccgtttacattttttttttttttttgagacaagagtttctctcttcttgcccaggctggagtacggtggcaccatctcggctcactgcaacctttggctcactgcaatctctgcctcctgggttcaagtgattctcctgcctcagcctcccgagtagctgggattacaggcatgcccaccacatctggctaattttgtatttttagtacagacagggtttcaccatgttggtcaggctggtctcaaactcctgacctcaagtgatccacctgccttggcctcccaaagtgctgggattacaggcatgagccacc

SEQ ID NO: 32047 - DNA, 1089 bp, Homo sapiens; identical to SEQ ID NO: 32046

SEQ ID NO: 32048 - DNA, 1089 bp, Homo sapiens; identical to SEQ ID NO: 32046

SEQ ID NO: 32049 - DNA, 1089 bp, Homo sapiens; identical to SEQ ID NO: 32046

SEQ ID NO: 32050 - DNA, 1084 bp, Homo sapiens
attattcaggctcagcccgttcctagagaaaggctgactctaaatggtcaagtaagttgagtttcccttaatatttcttgcattctcctattaaggcatagtttattaggcaattgcataaagaattatatcccccagcgccgactcccgtatattatgtaagcaaggataattgggaatttagcacagggcacttttttaacttaaagtttggacttaatttacctcacaaagctgctgggactgggctagataacaatgatgttctggttactgtgatgctgaaacagatttcaagccagataatagctcaccatgttggggtaaaatgttggtatgttgcacacaggtgcaagaactttgttttttagagagaccaacttcttaaatgtgtaacagtcacattgtgaagggactgcatttgtctggatttcacctgcagctgggcccacagcctgcctgaggtcagaaaatttttcatgacccattttttaccctgaattgacaagtttagaaaacaggttaatggactacttcatcctcctggaccttgaaaagctggctgaccaatattagactactactgctcaattagtgtgctagggaaacctttttgctgcacatgcagatttttctgtgacattttgactagattttgagggcttctggggactatgctgttttcctttgtacaccatcttcatccttctcatttgaagcagagttgaagtggctaatgcagggaatgcatttatggaagcttgcacgctatctgcctttgttcagcaatgcaggtggctcctagcatttatctatgttatagatatgtgaggtcagggaagggtacttactaacctctggaaaagatgagcttcttgataaatatttattgacttatggtagaagcaaacatagaaaactagttcagaacttagccttaatatgccttttctcctggaagtaaaatattctcactgtgagagagaagacattggaccttagcttccagaggacctggatacactttacttgctctctagtaccaattcagtcacgaatgtggtacctgaatacaatttaaaag

SEQ ID NO: 32051 - DNA, 1078 bp, Homo sapiens
agtgtctctgaagagcagcaatgaagccacactagttggggaggtggaaataggagaggaggtagttgcaacctcaccttgaactgtcatagcacctattcgctgtccttgcttatcttctttgagaaactggggcaggggtcacataggatgaaatttacaatttggagccttgtcaaggcattgccacccaaagacaaaattctgatcctacctttccttaaatcctacaagccctatgtcacttgggagaatcactacagaggaggatttttaccttgttaaaatggaaagatttcttttagggatctgtgcctcttaaactatagtgcatgcagatcactgaaggatcttgttaaaatggagcttctgatgtatcaggtctgtgggtatctgggtcctgagtatctatctgcatttccaacaagttcccagatgccactgatgctattgatccaaggtccatacttagtatgacgagctttctaatcagtatttaaattacaaaatcttataagtctaaccttctagtttctatttatatttattggattgtaaactccttaagagtaggaattatcttagcttcttgtatcagactcagcacttagtttaggaaactgcaattattaggagctgagtgaaaaatactattcatgtaaatgcatatataagcacactactctgaaggaagatatgtgaggggaagatatgtggattttattgtgccttttgtctgaatttatctttcacaataatatagttgaaattagcctagaatttagaaggacagttataatttttcccagttagtaatttgaatgatgtcaaatggattcgtatcctttagaaaatttccatttttttcacaaaattgtattatattttgatattactttaatacataactcagctagaatatgtatgtttcatttctggaatgtatattctaaaatttatatgaaaatgcagaggatctagaatagctgaaacaatttggaaaaaagaataaagttggaagacttagtctctctctttttttaaccataaagttataataatcaagagtgtggcatta

SEQ ID NO: 32052 - DNA, 1068 bp, Homo sapiens
tgggagccctgaagctgatctaaccactcagagttgatcctaattcaggtgtggtggccacactttactgaccagttattggaagtaagccactgctccctccccacctcacaaggggcaaggtggccctctcctgctgagagcagtacccagttcagggtgattccagaatagacataaaactgggaactgtaagctgccaacatacccagcagcaggggtatgagtgccttaattctgaaaagaggcatttgggttgcagggttcaactggaaatgtgagcaccagcatactggccactatgatagaccatcgtttttttgttttgttttgttttgagacagggtctcgctgtgtcatccaggctggagtgcagtgcagtgatatcagctcactgcaacctccacctcctgggctcaagctgtcctcctacatcagcctcccgagtagctgggactacaggcatatgccaccacatgtggctgatttttttgtttttgtttttgtttttgttttttgtagagatggggcttcactgtgttacccaggctggtctcaaactggactcaagcgatgtgctcccccgttggcctcccaaattgctgggattacgggcatgagccacaacacctggctgtgactattcttaattaaagagaaaacattatgaactgcaggatcctatcaacaatgggcagtgtgcgcatatctttccttaacattggattaacaggcatatctattagaagagcttctctgtgctttatagcagtattttagtgtctttgaattttttacattcaacagctgacatgcctaccactatgaggggattttttaaaaacattaaattgaaggacagtattgatacagacaaatagttgaagaaaagggtctccagacccagttataccccacagtacaaaaaaaacttagagatgtggtcacagcatacttttagccctctgagaaatctcagagatgggattgctctcacaacatcaaaggctgccaacatattagtttggtggtttttaggagacaaactaattctcaataatattcaac

SEQ ID NO: 32053 - DNA, 1027 bp, Homo sapiens
gtctcacgcctataatcccagcacttcgggaggccgaggcaggcggattgcttgaggtcaggagttcgagagcagcctagacaacatggtgaaaccccatctctactaaaaatacaaaacttagccaggcatggtggtgcatgcctgtagtcccagctgcttgggagactgaggcaggagaatcacttgagcccgggaggcagaggttgcagtgagctgagatcgcgccactgcactccagcctgggcgacagaaggagacgctgtctcgaggaaaaaaaaaaaaaatacatatatagaaaatcactacctttttaaaggaaaaatattgataaattagactacaataaatttaagaacttctgtttatcaaaagacatcatagtgaaaatgagaaaaatgtttgcaacacaactgtcaaagaactgatgcccacaatatagactgaatttaaaaatgggtaaggaacttaagcatttcccaaaagaaatctaaatgactaataaatataaaggttgtcaacttgattaataatcagatcatacaaattaaaattacaataagatacatgacacaccttccaaaatggttaaaagtgaaaaaaggggctgggcgcggtggctcacgcctgtaatcccagcactttgggaggccgaggcgggcggatcacaaggtcaggagatcgagaccatcctggccaacacggtgaaacccggtctctactaaaaatacagaaaattagccgggcttggtggcgggtatctgtagtcccagctatttgggaggctgaggcaggagaatggcgtgaacctgggaggcggagcttgcagtgagcagagatgacgccactgcactccagcctgtgcgacagagtgagactttgtctcaaaaaaaaaaaaaaagtgaaaaagactgaaaatagaaaaatgttggttagagtggagcaaaaggagccaggcgtggtgactcacgcctgtaatcccagcactttaggaggctgaggcaggtggatcgcttgaggcccagag

SEQ ID NO: 32054 - DNA, 1030 bp, Homo sapiens
ttgactttttaatttaatttattttttttgagacagagtctcactctgtcacccaggctggagtgcagtggtgtgatctctgctcactgccacctccgcctcccaggttcaagagattctcctgcctcagcctcctgagtagatgggattacaggcacacgccaccacgcctggctaatttttgtatttttagtagagatggggtttcaccatgttagccaggctggtcttgaattcctgacctcaagtggtccgcctgccgcggcctcccaaagtgctgggattacaggcatgagccaccctgcccagcctgtttcttggctttttaataatcatcattctgactggcgtgagatggtatctcattgtggttttgatttgcatttctctaatcatcagtgatgttgagcttttttttatgtttgttgcccacataaatgtcttcttttgtaaggtgtctgttcatgtcctttgtccgctttttaatggggttgttgggttttttcttgtaaatttgtttaagttccttgtagattctgggtattatacctttgtcagatggagagattacagaaatgttctcccattctttaggttgtctgttcgctctggtgattgtttcttttgctatgcagaagctctttagtttaattagatcccgtttgtcaatttttgcttttgttgcaattgcttttgacgtttttgtcatgaaatctttgctcatgcctatgccttgaatgttagtgcctagattttcttctagggtttgtataattttgggttttacatttaagtctttaatgcatcttgagttaatttttgtattaggtgtaaggaaggaatcccagtttcaattttctgcttatggcttagtcagttctcccagcaccatttattaaatagggaatcctttcctcagtgcttgtttttgtcaggtttgttgaaaatcagatggttgtagatgtgcaatcttatttctgagttctctattctgttccattggtctggatgtctgtttttgtacaagtat

SEQ ID NO: 32055 - DNA, 1029 bp, Homo sapiens
tgtaatcataacactttgggaggccgaggtgggcagatcacgaggtcaggagatcgagaccatcctggctaacacggtgaaaccccgtctctactaaacaaaatacaaacaattagctgggtgtggtgacgggtgcctgtagtcccagctactcgggcaggagaatggtgtgaacccaggaggcagagcttgcagtgagccaggatcgcgccactgcactccagcctgtgcaacagagcgagactccttctcaaaaaaaaaaaaaaaaagaaactgttttgaacagacttcttttttaaaatagcattaaaattttgatgattactttctagttattttgaagtaattatgcattcacaggagtttgcaaagatagtacttactgacatatttcatgttcctttcacccagtttctctcattagttactataatatgatataaaactgaggaaattgatgttagtataaagaatgtgcaattctatgtcattttgtcacatgtgtagattcctggaaccatcccctcagtcaaaatacagaactattccatcaccacaaagagctcccacacctatcctccttcccctgactttccctaatcccaggcaactgttaatttgttctccatctctgtaattttgtcatttaaagaatgttacataaatagaataacacagtacatggctttttgagatgggctttaataatgcccttgacatccatccaagctctcgcgtatattgacagtttgttcctttttattgtggaggagcagtcatgaatgtactgcagtttggttaaccattcatctattgtagtacattttggttgtttccagtttttggctcttaccaacacataagttgctattaacaattgtgtatataatactttatttttctggggtacatacccagcagcacaatcactagatcatatttagtaaagaaaactgcaaaattatgctccagagtggctgtgccattttacattctcaccagcagtatatgagagttctagtttctcta

SEQ ID NO: 32056 - DNA, 1031 bp, Homo sapiens
tgagggttcaaatgctgcccctgctgcttcctatctacagtcatgcatggcatgatggtgtttcagtcaatggtggcctgtatatatgacggtggtcccatacagttataatggagatgaaaaattcctatggcctaatgatgatgtagtagccatcctaaagtcatagtgagatacctactcgtgtttgttgtggtactggtgtaaataaacctgcactggcagttgtataaaagcataacacatacagttatgtacagtacataatacttgatcataatatataactgtggtttatttactgtacttttaaatcattattttagagtatatgccttttatttattaaaaaaaaattaactgtaagccagcctcagacaggtccttcaggaggtattccagaaggaggcactgttatcaaggagatggcagctccatgcatgttattgctcccgaagatcttccagtgggacaggatgtggaggtggaagacaacgatattgatgatcctggtcgtgtgtagtcctaggctgttgtgttagtttttaacaaaaagttttaacaagtaaataaaaagttaatagaaaaaagttatagaataaggatataaagaaaaaatatatatattttgagatggagtctcactctttcgcccagactggagagcagtggcacgatctcggctcactgcaacctccacctcccgggttcaagcgattctcctgcctcagcctcctgagtagctggtattacaggcactcgccaccacaccctgctaattttttttttttttttgagacagagtcttgctctgtcaccaggctaaagtgcagtggcgcgatctcggttcactgcaacctccacctcccaggttaaagcgatttccctgcctcaacctcccgagtagctgggactacaggcacctgccaccatgcctgcccgactaagttttttttttgtatttttagtagagatgggattttgccatgttggccaggctggtctcaaactcctgatctcaggtcacctgc

SEQ ID NO: 32057 - DNA, 1056 bp, Homo sapiens
ttttattgttataaaaggattttctgttctttccttgatcttgtgtataaataagaaaagttacaaaattgacataaattatattgagcgcttgctattttactgttatttttttcttttgtatcttaactcttttcacaatttttgtatgggatttttttccccttttttttggctgtcagtgcatctgttttaaatactgtcacagtaactttgtagtgtttctacatagttgtacctcctactaggagttatatgtagcagatgcttagcatggtcagggccaagtgaatgaatggggtcggggatagggaaggttggtatactaattgattagcctagaattatcccttaaaggtatagaaatttactgctagcacataaagattatgtgttttataaagtaactgctgcgaatatagcaggcatttaaacagtatagcagaacagctagtctgtgccagatgtaatataggtcaaattttgaagtaatttggtttaaaatggacttttacgtgtaatataatgtataagatgtaatagctttgctacaaataaaaagtactgctcaagaaaacatgtaactaaacatgtccatttagcatatggactacacagtgcaaaaactacatgttttttatagggatttggttgaagtttataaatgttaaggcttttgcatagaaaaaaatttttcctaccctttttacctgctctatgtgctattttttgagctgcttaaaaaaaaaacaactgatacagcattatattttcagaaattgggaaatctttaaataatttggttttcttggccctcttttaaattaaaggatgagtatgataaataatgagtgctgagactccaattctatctaaatagctgccagaactactcctgatcagtttcattcagacagaagttgcaagctcaccactgtcaggcacagtgtaaaatcatagagaaagatgaaggtggggcccagaccctgaggagcaggtaggcctgaatcactccaggtgaaatgctcttctagagggtcccacaaaatgctgtgg

SEQ ID NO: 32058 - DNA, 1047 bp, Homo sapiens
tatgttgtccaggctggtctcaaactcctgggctcaagtggtcctcctgctttgtttggccttctaaagtgctaaaatttacaggcgcggccactgtgcctggctttttctacacttgtttctttccttagctagagctattagaaatgaagagctgcttgctggtgggagcacagtaaatgtgagctgccatctacttactactggatccaagatgcttgaaagcaaaactcttctgttcagggatgacctgaggatgtaagaataattaagagtgatggaactttttcttttttgaagagttggagtctcactctgtcatgcaagctaaagtgacacacgatcatggctcactgcagccttgaactcctgagctcaagcagtccttctgtctcagtctctctagtagctaggactgcagatgtgaatcaccacacctagctaactaaaagaaaatctttttttaagagacagggtctcactatgttgcccaggctgaaagaactttaatatttatgtgtacttgtttatgtagtgtagaaccttccctcccatgttgatattattaatttgggaaagaaagggggtcgatgaccacttgtaaagaattgtgcccttggaattttgtgtggttcttttttgtttttgacttgttagggagaatgtcaaacatatataaaagtagactaaacagtgagatgaacatccaaatatccattattcaaagattgcttctgtaataaactcacagccaatgcggtttcatctgtacccacacccctttcttcttttcatatattttttttcattttaagcatttgcaataacttatttacctaaccacctattggtagatatttgagtattaaaccattaaaaaatttttgtaattaataccctttcttgctttgtggtcttgtgtgagttttttaaagataaattcctagaaggggtgttgggtcaaaggacatgcattaggcatgttttagtttttgtaaatttcttccaattttgagatgtcatcacattgctttccaacaaacctgt

SEQ ID NO: 32059 - DNA, 1079 bp, Homo sapiens
acatgattctggctttttaaatgacatttgttgagggaggttgctttatgctttcattttgggggtcctccagattcatagtttctctctgctgtattaacatttatgctggctgtgtctttattcattcactcactccatcacacactgagggcctgtcctttagagtctagtcccaagagagcctaggactcacccctgtcagagactgtgacacctgattttgtgttgcgaaaataaagaatattgtaaaaatagttgtacagtttataaggtagactagatgtactactgttggtctccagagctttttatgaagatctgttatcagtaaaagctctcagataggtttcttcttgttagttgattcattgggtggtggttctagaaactgttttgttttgttttgttttgttttgttttgttttgttttgttttttttaaatacagggtctctcactctgtcacccaggcgggagtgcagtggtgtgatcacggctcactgtaaacttgacctcctgggctcaagcgattctcctgcctcagcctcccaaagtgctggcattacaggcatgagccgctgcgcctcacctaaaaactttctaagaagtgatctcaattctttcctgaattgaggctttaggacattcagtgaaatgcctaagaagaaatgatagaagatgaggaaatccattttggaaaaagccttacatgtaaatattttatttttgaatggcaggcagctcggtgtgttggcagaataacttaggttatggatttggctgtcatttactagttgtgtgatatttgataagttaaataacttctttgagtctcttatttcctgacctttaaaatgggaatatttcaaatggtggtgggatggaagaggtatcatatcacatggtgcctagtgcggtaagcactaagtgtcagctctcttcctccctgactgcaaggcagtttatttaaataaaatgattcttggccgggagcagtggctcacacctgtaatcccagcactttgggaggctgagatgggcggattacctgggatcaggagatcgagaccagcctga

SEQ ID NO: 32060 - DNA, 1117 bp, Homo sapiens
gttgcccaggctggagtgcagtgatacaatcatagctcactgcagccctctggaccttctggactcacgtgatcctcccacctcagcctccccagtagctggggctacagatacaggccaccacatccagttaattaaaaaaatttttttctgtagaaacgaagtctcactgtgttgtccaggctggtctcaagctcctgggctcaagcaatacttccacctcagcctcccaaaatgctgggattacaggtatgagtatcgataatatttatagccatgagtttgcatgacatcacctaggaagagaattccagtgtggatgggaaaaaaagaagagaacacagcaccaaaccccaaggaattccaagctttagagcttgtgattctggaggaggcagcaaaggagacaggattggctaaagaggaagaaggaaaaccaggagagtagtgtcacagtacctgagagaagaaaatcctctgagaagtggcagtttactgtgtagaatggaggggatctggtaagataagagagcaaaccattggatttagcaattggaaggtcattggtgacctggacaagagcagtaccagtgagttaggtgaggctgtagccagactggggaggaaatgaggaaatgccatatgaaggcaagcctctgagatgagacggcttgctgtgaggaggaagcagagaaatggagaagtgcttggagggcacaaaggggttttcttttactattgagatagcaacatgagagcctgtttgtgtgctgatcttatgggactgttatggtagataggggtgtagaacatggggtctaactgaaggttctaggttacagagtaaatatgggaacagggtggtgtctagagcttcagggaagggattttcctttctctgaaggatgaaaacagatccaggcaggtggtgggaaaataaaggaagttcttggccttcatattgtactgcagaactaactttttttcttgcctgcttcttgcattcttcaattttctttttcttttttttctttttgttttgttttcgagatggagtcttgctctgtcgcccaggctggagtgcagtgatgcgatctcggctcactgcaacctccac

SEQ ID NO: 32061 - DNA, 1047 bp, Homo sapiens
tattaatctatgacttcccatttttagaatataggtactatatatttgtagacaacagatttgaagaatgaatcatgaattttcctaacaagttagagtttaaggtgtcagtagatgaatcagtttcttaatgcctagaatttgctgagaaaattgaatgaaaattggtttcttaaagttaagtgaattaagaatgtgtgcgtaaagctttaacaaccttttcaatgacagcagttgacttatatatacaggatagtcagctggtttatcaaatcatttaaagtgcaacaatgaaagcaaaaacaaaaggttaactaaaaattatgtcaggtgtgattaaaaaaatcagcatgactaagatacctttttttttttattaaccctctttctaggaaggtggacttttaaatattctccactgaagcaaatgctgcaacaatttgcatttccttcaccaatgtcgtcttgtgccttttcttgttcctactgtaaaggagatgggttagatgttgtaagtgaattcttattttgttagttcctaacaaaggcttgtgttttttactgcaaagatatctgtgtgataaaagttgggaatgttctaaggcctgtggtgtagggatccatggggaatagtccacaaagttaaaaggttttcttttgtgaaatgatttcgctgaataattctgtctttcccgtgttaagctagccagccaactgactgaccagcaactaagctggatttggtcactccacccaagattcacagcctcattagccaagagagtaattgatgacttagctattattgatacattgtttctttttgtggctctttttaaatttcttgacttttatgtgatcagattgtttaatttaaaatctattacatttttaagagaagcaactaaagagatacacgagaaacaaaatacacaatgaaagggaatttcctttttttgctgttttgttgtaaactcagatttttccttttaaaaatgattgctggctaggcacagtggctcacgcctataatcccagcactttggg

SEQ ID NO: 32062 - DNA, 1048 bp, Homo sapiens
gcctgtaatcccagcactttgggaggccaaagtgggcggatcatctgaatcaggagttctagaccagcctggccaacatggtgaaaccctgtctctactaaaaatacaaattagccaggcgtggtggcatgtgcctgtaatcccagctccttggaaggctgagccgggctggtcttgaattcctaacctcaggtgatctgcccacctcagcctcccaaagtgctgggattacaggtgtgagccaccgcacctggccaaaaaaaaacttttaaaattatttagtggcttattatataagaaatacatgaatgcatttttactttaaaaacataatacacccagcagtttgggaggctgaggcaggtggatcacctgaggtcaggagttcgagaccagcctggccaacatggtggaaccttgtctctaactaaaaatacaaaaattagctgggtgtggtggcggatgcctgtaatcccagctactcgggaagctgaggcaggagaattgcttgaactcgggaggcggaggttgcgataagctgagatcgtgccactgcacttcagcctgggcgacagagtgagactccgtctcaaaaaaaaaaaaaaaaaaaaaaaaaaccataatacagggctggtcatggtggctcacacttgtaatcccagcatacttctgggctcaggcaatcctcccaccttgacctcccaaagtgctgggattacaggcgtcagccaccgcacccagcctgttttgatttttttcaagagacgaggtctcactatgttgtccacactggtcttgaactcctgggctcaagctatcctcctgcttgtgcttcccagagttttagattttcaggcatgagctatcacacccagacttattttctcctttatccccaaccactgcagttaggtttgggttgggatgggggcaggtgggagatgggggaagccaacctccaagcagggcaggaaacatctagccagccccatcttcctgaatccacagctagggtgcctcccagagagcctgctctgctgcagggcac

SEQ ID NO: 32063 - DNA, 1048 bp, Homo sapiens
agcatcttttaaaattccaatggaaacattgctttaccctctcctgaaagacgaagctgcaggtgaagaagaaacgaaaactgcttttaggcccagctggccctgcaggagctttggcgggtaagggtgtcaggcagggagactgtgcagagccaggcatctggatgtggatttgaggtgtccttagccttggaaaccccagtgactaggcccggggaagaaacgccatggctgccagcaaatgctctttcagacacacattccgcacacctccccaggacaagaagggatgctccagaagcttgttaaatgatttccaccaatttcagaaattgcctcagctagttgtttatatttcccatcagccttagattaagacagaaagaaaatggggccctggcgtcaggaaagaaggtggctttgtccagggagggacagctgctgtggcagtttctgaagaaagtggaaaggcatgaatgggccctgccatgtgttgggtggccacaggcatgagctctcctggtctcggctttccaaggcccgggccacggtggcccacgaggacacccctgcacccccacatggcctcacccaccaattgccaatgtcctcaccttgaacccactcatcacaggctgatccagaaacttgctgagttttgttttgttgcaaacactgatttgctttgttgttttttttacttcactgggatgtaggatgccaggttaagatggactggtttctcctgccagaagcagctttgaatttaggatgcccagagggtgctgtctttttcttttgacagagtcgtggtctgttgcccaggctggtgtgcagtagtgcgatctaggctcactgcaacctctgcgattctcctgcctcagcctctcaagtagctgggattacaggcgcccaccaccatgcccagctaatttttctatttttactagagacagggttttgccctgttggccagactggtctcgaactcctgacctcaggtgatccactcgtctcagcctcccaaagtgctgggattacacatgtg

SEQ ID NO: 32064 - DNA, 1034 bp, Homo sapiens
atttttttaaagtatttttattagagatggggtttcaccattttggccaggctggtcttgaactcctgacttcaagtgaccctcccaccttagcctcccaaagtgctgggattacaggcatgagccgccatgcccggccctgtgtctgtcttttgaagtacacgaacagggttttgcttcatgtgtatttcatcttctaaacggcacagcatgttgcgtccatgccttccattatacttccccacccccacccaactgcccttctcagattcgtgggtggccttgaacaagtctccccactccagcagttacagagccctgagcatgtgccgggtttgtggggagacacattttacaggtgttacctgtgagatcttcacaacagactccatctattatctatgggctacaggtgaggaaacggaggcacagagaagtgactcgattttccctgagccacacaactggggtcaacccctggactgtctgattacacagccccctttagctctgggctaatttcccccctctattattattattatcattattgttattattatttcattttactttttttgcgacagtcttgctctatcacccaggctggagtgcagtggcacgatctcagctcactgcaacctccacctcccaggttcaagcaattctcctgcctcagcctcctgagtagctgggattacaggtgtgcaccaccacactcaactaatttttgtatgtttagtagagatggggttttgcatgtggtcaggctggttttgaactcctggcctcaagcaacccacccaccttggcctcccaaagtgctagaattacaggcatgagccaccacggctggccaagttcctccctctattagagcccaggagtttgagaccagcctgggccacatagggagattctgtttctataaataataaaaaattagctgggcgtggtggctctcgcctgtggtcccagctactcaggaggctgaggcgggaagatcactggagcccgggaagtcgaggctgcaa

SEQ ID NO: 32065 - DNA, 1050 bp, Homo sapiens
gccaaaaaagtgatattttaattgcatttttaaaattctcattttttcctgaagtggattatgcctttaaggctgtagatttgtgaattctggaaagttcagcagctgcagggccctcttctagtggcagacaatggaccccatcatcagctcctctcagatggccatatcaaagaggctgtgctgtcgaatgcgtctctgcttgaattagcatgaattaactattggctttattcattattgttattttactcggagttggggaatgatggctaaaagtttgtgaatctatgacttaaactccaaggattggtatagtagacctttctgagatagtttctgaaaaacaggttacatatctctgctgctttgtggaaaagaggtcaaagtactggtctgtgatgggtcccatttgagtggcttgttctgaagttgacctttctgatcactgattagtagtgaaaaaacttcccctgtgaggtacaggctctcgtacttcattaaaagagactctctctggactgaaaagcaaataaactccctctctggaactccggatgaaagcacatctctcctgttggagtatagtattgtgtgtgagagtgtgtgtgtgtgtgtgtgtgtgtgtgtgtgtgtgcgtgtagtatttttaccacccactttgataaagcgtatctccacagcacacagcaccttggcctgaatcagccaaggacctatacctgggcatttgggggatgcagtggcttgccttcttttttctttttggtagagacatggtctcactatgttgtccaggctggtctcaaactcttggcctcaagcaattctcctgcctcaacctcccaatgtgctgggattacaagcatagttctagggtactggccaagttctaggacctcctcccacacctgcagaatcaggaactctggtggtgagggccccatatgcatttttaagtcatcattatattttgagacagggtgttgctcggttgcccaggctggagtgcagtggcatgatcatagctcaccatagccttgaactcct

SEQ ID NO: 32066 - DNA, 1035 bp, Homo sapiens
acttggagggtctgtgggtgagaggaaggtcgtggagtgaggcagcccccgtgccccaccctggctggtgcctttcagagctgcagctgtgtgtgctctgccagctccggccacctgctccagctgaagggccgacacagagccaggcagggcccggagagaactgttccctccaggaggtgagtggggtactcctcaagcaatggcagatgctgagcaaggcctgtgtgggccaagagccttggggggtttggaacctgggttctgccccaggccggagaatgaggcaggcgtaagtcactccctggcacccaggtgtgggcttcagattcctaggcctgggatggcctcacccattttaaagatgggaaaatgagactacaagtggtcagggacttgcccggggacagaggaagtctatggcacgaggggggctgatcccagggcctgggtcggcttccctgccaaatgcccctggctgcccacctgcctgctctcaggggttgtggcttgttctgcccatgtagactcaggtatatgaggatgttctgagtgggggtttggcagtgctgggaggtgtctgggagggggtggatgtcgaggaaagggctctgggatattgtcatggctttggtgctgctgcctggcactgccctctggtgttaaaaatgggcaggatctggaccacttgcagcttcttgggggctcctgctagtctttcgggctgctgggtgctacctgggagttcagtctgttcttggctctggccagactctagtgactactgaggtgacctccagggagagggatattcagccttcctggccgcacacaacaaggtgccatggggtgggcatgcctaggtgcttatagactcctctgctgctcacagatgcattgggtgaccctggaagccctgttctgggccttgggttccccttctgatggccagggtcccttccaacccagtcgacaaactgagtatttctgcagcagacacctctacctgtgtgtgaccctgcaggcggggttgtg

SEQ ID NO: 32067 - DNA, 1204 bp, Homo sapiens
ttgagatggagtcttgctctgtcacccaggctggagtgcagtggtgccatcttagctcactgcaacctccgcctcctgggttcaagtaattctcctgcctcagcttcccgagtagctgggattacagacgcgcaccaccacactcagctaatttttatatatttagtagagacggggtttcatgacgttggccaggatggtcagtctcaaactcctgacctcaggtcatctccctacttcagcctcccagagtgctgggattacaggcgtgagccactgcacacatcctgagagctggttttaatgatcacataatattctgttttatggagatgctataatccatctagccagtcctttgttgttggacacgtaaggtagtttccaaatcgttctacaacaaatgtcgaccttctgtttagggttccctctcttcaaattagttcatgaatggatgtttgcagccccccacccctaactctaacagctcaggcaataccaagcctcagggttagcccaggctcctgtaggccccttccctgttcacaaccccttccttggcatctcctcgggacctcagcacgccctctgacctgagcctgatggccctgtagggcttagccttgtccctagtctcgaagccaaagctgtgctgggcctccagtgctagcctcggttcgacttccctggaagtgggtgtgggcttggggtggcagccagttgccttccctggaatccctttctgggaagtcgagttggcttctctggctcagccccatcatgtggcccctttctggagctgctgtgccagaccagagtccctgcagggtctctgggccccctcaaaacctacaggggaaagaggaggcaaggctgggacaggatagggcctctgaagtgtgggcctgaggctttgtccttctggccatggtaccccacaggggcaccacctcctgtggtggaggccacagaagagcagtatgaggcaggagaggctgcagggagtgctcctggcctgctggcatgtggaagtgctgagtcatgctgacagctccgtggctagctgtcccagcctcttcctgctgcccctgccttggccctgcggcagggaggcctggaggcttggactgctgagcatgcagccgggttgagggccttttcctgcaggagcaggagggcagccatgtcccctctgagcccaacc

SEQ ID NO: 32068 - DNA, 1069 bp, Homo sapiens
gtgcagtggtgcgatctcggctcactgcagcctctgcctcccaggttcaagcaattctcctgccttagcctcccatgtaaagtagctgggactagtggcccgcaccaccatgcccagctaatttttgtgtttttagtagaggcggggttttgccatgttggccaggccggtcttgaactcctgacctcaggtgcctcaggtgagccaccgcccctggcctcttctaaatttttttttttttttttttttgaggctgagtttcactcttgtctcccaggctggagtgcaatggtgagatctcagctcactgcaacctctgcctcccaggttcaagcgattctcctgcctcagtctcccaagtagctgggattacaggcacccaccaccatgcccaactaattattgtatttttagtagagacggggtttcaccttgttggccaagctggtctcagactcctgacctcaggtgatccacctgtctctgtctcccaaagtgctgggattataggcgtgagccacctgaatatttaaaaaaaaaaaagtatatgcataaagaagaagataaatgatgtactcttgtcataaataatgaacctgtgtgtagctgctcccaggattaagaactagtacattacagtgatttttggaactacagtgggtccctccatcctcatcttcccttcccctgagaaagaactataccctgaattttttgtttgttatcattctattgttttccttttttttttttttgagacggagttttgctcttgttgtccaggctggagtgcaatggcgccatctcggctcacttcaacctccgcctcccgggttcaaacgattctcctgtctcagcctcccgagtagctgggattacaggcatgtgccacatgcccggctaattttgtatttttagtagagatggggtttatccgtgttggtcaagctggtctcaaactcatgacctcaggtgatctgccctcctcggcctcccaaagtgctgggattacaggcttgagccaccgcacctggcctgttttccttgtagtatatacaaaaagacttgt

SEQ ID NO: 32069 - DNA, 1014 bp, Homo sapiens
ccgcgcagctgcatggtggcgcgggggatgggctcgcgactcgccaagtaccctctagggtgatgccgggaaggccaccattactgctgttctacagaacgcggccctcttaaccctctccaccacctggctgtgtgggcgccgccgggagtgttcccccttccagatggggaaacggaggctccgagttagtcagctacccaaagttacacacagggagatctgatttgagccccagcagtccgactctagagaccctgtttttaattcctcttgcaggagactcgggggcccggccttctccccacctcagactacgctcccctacccctgtctcctgccacccctgggttgggtccgagtttggagcagggggctgctgagacgccaggcagcggcggggctgattgggggaagaggggaggagggcggtggcacgtgggtgcagaaccctgggatccattgtgaaaaggaggtctaagatttgacctggggcgggaggaggcggagggcaaggagactgagaaggctgagcgccggaaggacggagttccagggccctagcgccgggagtgacgtcctggggcagggccagccaccaggtgctgtatctcccaggcaggagctggcgtgcctaggccccaagatccttccctggccagcccttttggcccagaaggtggacacccaaggagcctcctctgtagcggagacagggataattaatgagggccaccgtgcatgcagctggaggtgtccagtggggtgggtgagggggtcagtcagtgaattacttcagagcctgcttcccgctctgtaaagcggggacagtaatggcacttaaccacgctgggtggtttcaaggactccagtgctctacttggaggctgctttgaggccacagtgccagcagtgctccgggctcatgacagggttgtgagggctgcgtgatggatgatttctcgggaccttcccaaacaagctctgtttcagacagacaagattctggcttct

SEQ ID NO: 32070 - DNA, 1037 bp, Homo sapiens
tgaagctgcagtgagtggtgactgcaccactgcactcccacctgggtgacagaatgagaccctgccttaaaaaaaaaaagacgagatggagtctttctctgtcacccaggctggagtgcaatggtgcagtctcggctcactgcaacctccacctcctgggttcaagcgattctcatgccttagcctcctgagtctgggattacaggcacacgccaccatgcccagctaatttttgtatttttagtacagacggggtttcaccatgttggccaggctggtctcgaaccccacctcggcctcccagagtgctgggattataggcatgaaccactgcgcccagccaaaacatgcagatttttaaatgagtttttgacacatgtatgtaatatcccttgggcaacccaatcaatatgtaacattttgtcactccagaaagttccctcatgtcctcttcagtcatttccccaactctcctcccaaaaagcctttacattttaaatttatcataggatttttcttactgtgcattctatactgttacttctcttacctactgtggtggttggacttggcttcccgtaatgattctaggacattcttacataaatgggctggtcatcctttagctaatggaagtttataaccagatgtcagatgttcacatgttcctactgaatgtttacctgaactcaaaatagtctgtctctgtgctccactcttctgctgcttatgcctgtttccacatggtccctattctgggcctggctactggcttctgcacttcggtacaaaatgaccattgtcactctccaggttgcaggcgccccactggttactgcaacgaccactgcagtgtcttcagtcctgctggccccaagtgttttccagcagacagttacaagatcttcggaccttgagaggaaagccagctccccttctcctctaactattggaacgccagaaagtcagagaaagccttccattattctcagcaagtctcagctccaggatacattaatacatctaataaaggtatg

SEQ ID NO: 32071 - DNA, 1053 bp, Homo sapiens
cacgttctaaaatataaagcctgatggctcatcccctggacatgttgccattgccctgtggataaagtccagatcctctaacgtgtctcagatactctgcagtctgcccgcttcttctctctttccctgtcaccctcctacccagcctctgatccagctgtgctgaagcacgtgtggctctcagtggctgtgctccccagccagctcgcctcatccctccccagtttcactcctcttcctagtgccttccttcccactgagctctgcaactctgccttgtgtgtgtgtgtgcgggggtccggtgggggggcccttaccagttgtcctggcctcttttttcacatcacagtcacagcacaatgcctggcacctgataaattcaagaatttttatcaaatggatgaaacatttgcctggacaaaactgggtttgttttcctgtagaaatgtgatcataccatagtcttataatattgatattatactaatttgcagtgtactttggggccttacagactttctgaagccttgagaatcatgtgtttcagtgaactaattttttcagtataaacagatctaaacaactaattcactcattttaggaataaaaagttgaggctgtctgtgttttcaaagtgcttaggtgtgtctcccactaaaatgtaagctctgtgagaactgttgttactcccttgctgcatcgcgtgggcccaggttagagcaagacctggcaccctgtgagtactcaggaaataaaggttattgactatggaaatactgcttaaaagtacaggaaaacacgaatgtttttcctttgaacgattatggtatcaataagccaacttactaaaatatatataaattttaaattgtcaggcttacatgctttttctgaagaattctgtgactagggactaaggcagtgggagttggggatggcccactattaaatggctagatttattttctgatatttgagacccagtctctgaggtccagtgcctagcgtttcattgagaacagtgaaagtaaaggtagaatcacctgattagca

SEQ ID NO: 32072 - DNA, 1042 bp, Homo sapiens
tgaacctgggaggaggaggttacagtgagccgaggtcacgccaccgcacttgagcctgggcgatagggctagactgtgtctcaaaaaaaaaaaaaagaccacatggtgtttatgtgattatagtttaagccaacttcaatttaatgctttttgggcaccagacattatattgagaatttaattttcacaacagtgttctgagatcattgtcacaatgtcctcgcttttcagataaggaactaaattagaaggattatgctgggctcaatggctcactacaaaaaatttaaaaataaactgatcatggtggcatgcacctgtggtcccagctacatgaaaggattgtttgagtctggaaggtcaaggctgcatgagctgtgatcacaccactgcactccagtctgactgaatgagaccctgtctcaaaaaaaagagaaagaaaaagaaagatgatgtaattttcccagttaacagctgaggtatcttttatttcagaccctaaactctacagtttttttcagaagtaaaaatatgaagaaattgaaccatataagatctttagtatttttttgtatccatggtctaaaattagatactgatgctgccttatatttgaagtgagagtctaacattagtagaatctctttattgaatatttttaaaggtgaaatggtttggtatgaagctacaacttttttacaactgtgggaggttcttgcctcttcctccacaacagttactttttactgactacattttttcagacctgccctgtccctctcacctagcagatgatgctgtcctcataccagggagagaagacagaatggcactcccttaactttctgtccttcacatgcaaacttgcctgcatgctcatcgctgctggccctctttctctgttgtctgacaggagcccctcctgacacaggatctcttgccttaagctccctctcctcatactgacttccccctactccccgaaagaactttggaagagagcactgttgagtgtctgccatgtactgatgggatctgtggt

SEQ ID NO: 32073 - DNA, 1028 bp, Homo sapiens
gaggccaaggcaggcagatcacctgaggtcaggagttcgagaccagcctggccaacatggcgaaaccccgtttctactaaaaatacaaaattagccgggtgtggtaatagacaccagtaatcccagctattcgggaagctgaggtaggagaaattgcttgaacccgggaggtggaggttgcagtgagccgtgattgcgccactgcactccagcctaggcgacagagcaaggctctggctcaaaataaataagtaaataaataaaataaaacaacccttcctcacctccatcctcttactgtactttattttctcactaaggtttctaaccagctaagatggtttctgtttttgttttttgtctgtctcctgcccaccaaaatataagcaccatgtaaaacagttttgtttttttgtttttaagctgtctcttacgggaaagaagggcagttttatgagccttgttcattgctgtatccttagcatgtagcactgtaaatatttgttgaattagttctctttataactgatagtctgataaaagaacagatatcaaataaaatccgtaggtttttaagtagactttttgttttgagataattacagatttatatgcagttgtaagaaataatgcagaaagatcctatgtacccattacccatttgcccattgataacattttgcaaaatatagtacgatatgacaaccaggatattaacacaatccacacatgttgttcagatttcctttgttgtgtgtatattcagttctgtgtaattttatctcatgtatagctttttgtatatccactaccacagtcaagatgctaaatattttcatcacccccaagatgttttgccctttcataaacacactgacttccctgtcataccctattctgcctctgcgtctacctctgcctccccgatcccgccatcgtttagccctggcaactattaatccattttccagttctataatgtcatttcaagaatattatataaatggaatcatatatataacctcttg

SEQ ID NO: 32074 - DNA, 1050 bp, Homo sapiens
ggaagtcccacctccagggtggagaaatgtacatgagagcccatgagaagtttcaagtttgtaccaaattcttcaatgtctcacagagaattaggaggaatgaatggatctatggaagttaaatttggaggagcagtcacctctctaataaattaatcgattcttaggaaaccaaatgagaactaacttcaagaatggctttctgatttagaagttaccttacattcccctcttctacccttgatgacaagcggattttctacgtacatactttgttctgtttgtagagccctttcagtgttctcataggtacctagtaagtccagggctctgtcactcatcctgagtaataactgtatcaaggtaccacacgggacagaaactgtaggtgctgcgcactaaagcagatactccagtaagtggcctggcttactcaggctgagaggttaagtagccacaacgagaaagtaggaaataagacattagctttgaacacaaaactttaaaggaactctagggtcaggtgggcaatctaaacatctgacattattttgaattatatcaatattacaaaaggaatatagatagcatgatagtttctgttttaaataaacttctttcacactatggaataaaatatcgtctatgggtagattaaaatgaaaccctttgggatttggttaaatctttgatatttactttatcatgtgttctttctgattttgaaaactgtctgcaataggtggagcttctttgaattagagttttgttctcttatctgcatttgtctatcatctcatcagatggagctggtataagcagtgacccatgaattcatgggtcttggtgtttggatgggctcccttcagctgccacattttttcagacggcccctttgtttatctttaggtgaagactcagaagattggcaatcaagggcaggggtgcaagctaggcctcagtgttgggatttaatcctgattctgagtctccgctatctgctgagtatgatataatgaacgaaatttcagacttttgaatgagcacttg

SEQ ID NO: 32075 - DNA, 1040 bp, Homo sapiens
agaatcagtgggagcctggagcttgttttcctgcatctaaacagcagttccatctggaggtgatggaagacaatgacagatcatcaggcattagattctcataaggagccacaatctagatccctcgtatgtgcagttcacagtagggctggagctcctatgagaatctattgccacagctgatctgacaagaagcagagctcaggcagtaatgctctgttgtctgccactcaccttctgctgtgcagcctggttcctaacaggccacagaccagtaccaatccgtgaccctgaggttggggacccctgatttacaccacactttggaagctgtattttaaggagctatgggtactgtgtggcagtagcagatatacatcctaacagcaaaggcaaaaccctagtgcaattcactgttttacttagggttgcccattgtttaagaataaaacttttgcaagtgggagtaatcagttgtgatattgttgggtttattttcctaattcctaaagaagttcaatggtcatttcatgtgtctaaattctgtactgagattataatgttaatgggattgtggaaggagtatttcgggttaatatattcagatttgatttaatttagacagaggcaccaaatttttaaatgataaactgaagaccttgaagagtagcattttaaaattacctgtcctaagtcttttaatcattgttcaatattcaataagtagatattacaatttaaattttagaagttggactctttctctaccatattagtgttcagtggtggtctgaaatgagtgggttttttggccaaaagggttaagctgcaaagataattgaatgacattttccagagtttcttgcggatatacaacatctcatctacctaagtgtttgtaacatgccaaaatctgttatgatcccacgtcagtcagtcttaggctccatatcctttttcctgtgtgtgtgttttctgcccctctatcctagagcctttcttgtcttctcactctttcctaaccctttgatgttcttaga

SEQ ID NO: 32076 - DNA, 1027 bp, Homo sapiens
ggagggtggatcacgaggtcaggagttcaagaccagcctgcccaagatggtgaaaacttgtctctactaaaaatacaaaaaaaaaattagccaggcatggtggcaggcgcctgtaatcccagctactcaggaggctgaggcagagaattgcctaaattcgggaggcagaggttgcagtgagccaagatcacactactgcactccagcctgggcaacagagcgagactccatctcaaaaaaaaaaaaaaaaccaaaaccctgctgctgtcagtgatgaaaattttgtctagttctgctactgacattaagttatgataaagtctgtctgaggagaaaaaagaaaaaaaaatcctacttttagcaattagagaatttacatttttttcaagtatatattagaggtttataaaaattgccacatataggccattcagccaaagaatttagggaggaaaatagggaaatctgagtaaagttgaaggaaaataaagagtagaaattaattgcaaaaagtagaaatttctttttttttttttgaaacggagtcttgctttgtcacccaggctggagtgcagtggggcgatctaggcaagctccacgacccgggttcacgccattctcctgccttagcctcccgagtggctgggactacaggcacccgccaccacacccggctaattttttggtatttttagtaaagatggggtttcactgtgttagccaggatggtctcgatctcctgacctcatgatccacccgccttggcctcccaaagtgctgggattacaggcatgagccaccgcgcccggcctagaaatttcaatagaatagagcagatcaacaaaacaaaaaactccactataacaacaaccataaaaagaacaaggggaggtacaatatgcagtattaggaataaaaatataaatgtgttccaactaaaggaagagaacatgcatttttaaaaacaagaagccactgtgaagaacttttgcctgtaaatttaaaacttggatgataaagacagttt

SEQ ID NO: 32077 - DNA, 1032 bp, Homo sapiens
atgagagcccctgtcgcagaggtcatttgggtttaaagtttaaaatccaattagtttcgattcttggaaggagggggtgggtgggtccggctttaatcgaactacacagagtttcggaaaagattccaaggcacttaggaaaagggcttccgtgttcactggatccccgaagacctttgtacaaacaagagagaccctgtaaatgtgttttgttccatctatgatgctggtgatgtcatctctgaatgctcccctcggactcagtactttctggctttcgtgcactggggagggtccgaaaagtcacattcagtgtgttcactgattcttgttagcccctgcttgaagctttgttagttgtttaaaaagcataatttcccactttcttgtaattgacccttcctaattaactcattcagctacaggctttacacttagaaagtaatacgtaaatgcttgttggattgaattcaccaatgactggagttcacatttcaataagatacgaaatccttaaactgacagaactctggaagatgaccgtagtatgtcgtttaccctataatacagttgcatagattatatttatcagtaatttatcgaaaatcatttggcatttatgaacagttaattcagatgaagagtttttataatcacgttgtttatctttgcctcctggaagagaaggagatatgggaagccacaaggaataaaattgtagattgttttttaaatgtagctattttagacattgccttagtttgaaattttatgaatcttttttcttttcttggcctatatataaattttgaaatatggattgccgacaaatggtgaagacttggggctagagttttcctagtttttcacaaaggctttcaatattttaaaattttacattgtggagttctgttttaaatatgaaatacaagctataataacctgaattgaaaaataagctgctactgtttatttggatcctggcacatagagcatgacaaaaatcttttccctctttattattttacagtg

SEQ ID NO: 32078 - DNA, 1062 bp, Homo sapiens
tagtagtgtctcactcttgttttaatttgcattttcctgatgacatatgatgtggacgatcttctcatatgcatctttgccatctgtctgtcttctttagtgaggtgtctgttaaggtctttgggccattctttaatcgggttatctgttattgagttttaagaatatatttatttgtgtatttacatagtagtcctttataaggtgtatcttttgcaaagatttacttctcgtctgtgacttgtctattaattctcttggtagtgtctttagcaaagtagaaaactcacatttgattgaagtccagcttatcaattatttctttcatggactgtgcctttggtgtcataatatataaagtcatcgtcaagcccaaggtcatctagaggttctttctcctgtgttatcttctaggagttttatagttttatattttacatttaggtctgtgatccattttgagttaatttttgtgcagggtataaggtctttgtctatatttactctgtgtgtgtgtgtgtgtgtgtgtgtgtgtgtgtgtgtctagttattccagctccctttgttgaaaagactttcttgctctattgtgctgcctttgatgacttgtcaaagatcagttggctacatttatatgggtctatttctgggctctctgttctgttccattgatctattcaccaatatgacactgttttgattactgtagctttatagtaaatcttgaagttggttagtgtcagtcctccaattttgcgcttcactttcagtattttgttggccattctgtgtcttttgcctctccatatatactttgaaccagtctgttaatatctacaaaataacttgctgtggttttgactgggactgcattgaatttgtagatgaagttgagaagaactgacatcttgacaatattgagccttccaatttgcgaacatgaaatatctctccatttatttagtttttaaatttcatcagggtttcatagttttcctcatatagatcttgcacatattttgttagatttatacctaagtatttctttgtgatgcttattta

SEQ ID NO: 32079 - DNA, 1121 bp, Homo sapiens
aaaaaaatttttttgtagacatggggtttcacaatgtttcccaagctggtcttgaactcctggcctcaagcagtcctcccacctccacctctgcctcccaaggtgctgagattacaggtgtgagccacccttaaatatttaccgttagaaatagttgaattattctcttctagttattttgaaatgtataacaggttgttaactacagtcaccatactgacctgtcaaatactagatctcatttcttctatctaactgtatattagataattcttctatctaactgtctatctttaaccctccatcctcccttcccttcctgaactctgataactacccatctactccctatcttcctgagatccacttttttagcctccgcaccatgagtgagaatgtgatttttgactttctgtgcttggcttatttcacttaacataacgacctccatttccatcagtgttgctgcaaatgacaggaactcattctttgtgatggttgaatagtactccattgtgtatatggatcacatttttaaaaaatctgtttgtccattaatgggtacttaggttgattccatgtcttggctattgggaatagtgctgcagtaaacatgaatgtgcagatatctctttgatatattgacttcctttcttctatatacccagcccagtagtgggattgttggattatatgatatttctatttttagtgttttgaggcatctccatattgttttccacagtggctgtactaatttgcattcccacaaacaatgtacaaaggttcctgaaagggtgagtttaaacaacataactgcagaatcatagtcatgtctgacaaataatgatatcttgacatcctcacatacgcactcagtgttcagatgagcagggtccagtgaagagcagcacattctcatggttggatcttgttcctctcacagcctgtaggcttcccttcctctctctcatctctctctcatttatccattctatacttggatttattgttgaagaactgtgtggggtttccctgcacttggattctgctgatgatggacctttgcaagttgctctgacctttgcgtttcttgtgagtcggtggattgatctagaagt

SEQ ID NO: 32080 - DNA, 1025 bp, Homo sapiens
ggagcacgggccgccgcggcgcgcgcctacccccgcgcacacgtgcatgcagtgagccaggtgcatcagctgcacccgccctcgggcttcgcgcgcctccgctggagcccagctagcctcgcggctccggggccgaccgggtcggaactgctgcgtccccattccggacgcagagagcgcgcggggcgccggcgccgccggttaaagtgccgcggggcaggggccgggccgcggccacccgctcctcccgctccggtcccgactgtcgggctctcggccgagtcgccccgggtgagtagccgcggaggcgccccgaccaccccgcagcagcgccgcccggccgctagcccggagaggcctgggggccggaggtttggggccgggctggacgccgagacccgggcccgctttacacaatcgccccgccgcgcgaagcgaaacgggtggaacgcagactgccgaagctcactgactcctttgagggagcgaattctttcagctacgcggggttagagcggtaggagtgcccgctgcccgaccccaggctttctggtaaatgtctgtttccaccaagtgagttcggacagcaacacctggggctcccaaagcggaagccgtcagcactggcgatttggagctgcggttctcaagtttccctggcccgggatctctagcgccgcctaaaatgagatccagacggcaggtccgggtcaggcccgggatctgcatttaacgagcctccacccacgcccccgtaattcgtgggtgggtggcccagggaccatcctttgagacacagtgggtttgggggaaagttcacaaaaatcagctgggctaacagtggagtcacagaggctggaactgctgcttcagccccctcggtttgcaaacgacagggttgtggtgaccaactcagggccatttaaacttgtaggcagaattagctccattctacagatgagaagacggaggcctagagaggggtatggaacttaggggtgtgttgtcagctggtgagaggctgt

SEQ ID NO: 32081 - DNA, 1061 bp, Homo sapiens
attcctgggcgcatcccagctctgccccaactcgggagtccaggcccgggcgccagtgcccgcttcagctccggttcactgcgcccgccggacgcgcgccggaggactccgcagccctgctcctgaccgtccccccaggcttaacccggtcgctccgctcggattcctcggctgcgctcgctcgggtggcgacttcctccccgcgccccctccccctcgccatgaaggtaggtgttcagtgcgctgccactttttttctttacttccccccaccccctgttggaagttaactgagttcccttcgcctcttcctatccctccatttccccaaccgcctgaagaagctggaactccagcgtcgctggcaggaacccctaccccttcgccctccacgccgggcgcactgcctcagtgtcccaggagatcacttctggtcgcaccacccgttctgcaaacaattttgatttttgagaaaaagtggggaagagcgatagtagacaaactgagtgcggttcactgacgactttccttttgctctgagaacatcgagtgtaatttactatgtatatttcagtaacaggataatgattcaattcaacaaatatttaccaagcgcccactgcgcgggcaccgggacggtgtgtggccggggctcgggatggggaaagggactccttggttgagagaacccgcagaggaactaggggccaactactccagagcggcgtacaccttccccgacacccccccgcaccgacggaggccagattgtaggcttgccttggccgagtaactcgagcgcttcaggcccctttgcctttaagagtgcctggcggggggccagcgcgcaccccggcgcggggagcggggtcgcgttattagcattattagccgccactgggtgagctcaggcactttgcagcagtggtgggggcggggagttgtggtggtagtggctgtaatcccgtactccgggacagcgctccccggccccctgagcggagtccgccttgtcctttagaaaacacttgggcctccgctttgggagagcaggcgggggc

SEQ ID NO: 32082 - DNA, 1002 bp, Homo sapiens
tgctcaaccaggtcaaagggagacagaagcaagaggagatgcttcttggatctcagatgaccctctcccaaatggacccccatggtttcagcaccaaggctgcctggagtttcagttttattgggagcagtgcagcagaactccaccatgactcctgtattagtttcctaggggttctgtaacaaagtaccacaaactggttggcttaaaacaacagaaatttattctttcatggttctggaggccagaagtccaaaatcaaggtgctggcagggccattccctcttcgaagcctctaggggagacccttccttgcctcttccgagcttctggtggttgctggtacccttggcattccttggtttatagatgcattgctccaccctctgcttccatcaccccatggccttctccctgtatgtattctgtgtctctgtgtccaatttttcctcttctaagaacaccagtcattggattaaggcctatcctaattcagtataaccttatcttaattcaaatatatctgcaaagaccctatttccaaacaaggtcacattcacatttactagcggttaggacttgaaaatatctttttaggggacagagttcaactgacaccacccaaggaattgttcttcccttaaggaaaggttatgtagtccccacctgcctccacccagcttccactttgccctgaagtcacacatctggccaggtcactccccttccatggtgtcccactgcctgaaggcagcatctagtctccttaatgtagccataaagtcccacgtggcctggccttgcttgcatctctgccctgactctgctactccccccttcccattccatgttgtgtccttggtgcttgaggttcactgggtcagctttggcctggctctatttcaggccttaccacatgctgctttctgctcagatggttcctctcttccctcttccactcggtagctcctactcaccacccctcacatctcaacctggaag

SEQ ID NO: 32083 - DNA, 1028 bp, Homo sapiens
tctttgtgccaggtaaacaagcagtaaatatgaagcaataaacaatactctgccctcatagattaccttctctcagggagagtcagaaattaagcagataaatgaacaaataagtaagatgattttagacagtggtaagtacaaagaaggaaatgaaggggaagagaccaagaggggaggatgttgcctcagacgaaatagtttgaagggctgatgtgagaaggtgaccctcggatgagaaggagccagcatgaagcaggccagggtggtgatcatcaagtgagatggggggagagatggtagatgaaattggagaggtgggtggtatccagtgtgcactgagccttaagtgagagtcagtagactgaatgttctaggagaactggggagccttgcgaggactctttttgcagggaacgctctatgaataaggaggcagagaagcatgacaatcaccgtggtggggtgggcgtttcagtggtggatgtggggctctctcaaatgccaagtagtcaacctgaattctgacaagcctttctctttccagtcataaatagccaggaccaaaagacaacacaatcctctgtttcacagtgaggaatcaggcttggagggttggaggcacatggccagcaagggcagtggaagggctgagccgggattcaggacctgggacccagagccttgtgcccctccctgccggcccctctgcctcctggcccacctgcatgtcttccagcgacgtggatttaaaaatccgttccccatcagacatttcagagaggcttttacagtttgtttttagaagtgtgttaaaaggcagtcaccttgaatgacttctgcttgacagaagtgtcagcattgtcaccacctattccaaggagcactggcacatgacgggggtgccctggctccatggggaaatgaggaggagggcaaagagctgttcaccagagctagcattcaggttcagcatagctcctcactgactgtgtggcctcgagagagtctcatcttcttcaccctgc

SEQ ID NO: 32084 - DNA, 1029 bp, Homo sapiens
tctgaaaatgtccttcttttaccctcatccttgattcacccaatttggggctgatagttattttctctcagtaacatgttattccactaatgtctggcttccactgttgctgtggaaaacttggctgttgggctaattttaagtggctatctttcctctgtgattctttctttctttttttttttttttgaaacgaagtcttgctctgtcacccatactatagtgcagtggcatggtcttggctcactgcaacctccgcctcccaagttcaagtgattatcctgcctcagctgcccgagtagctgggactacaggcacgtgccaccacgcctggctaattttttgtatttttagtagagacggggtttcaccatgttagccaggatggtctcgatctcctgacctcgtgatctgcccgcctcggcctccgaaagtgctgggtgctgggattacaggcatgagccactgcacccagcccctctgtgattatttctaagatcttttttctttaatgctctgtggtcttactgcaatgtattggtattaattttattttatcctgcttcacacatgtataaatttatatctttcaccagttctgtttaattattagccattatctttgcaaatatctattaccttctttctgtgtcttcagtctctctttatgggctctaattatgaatgtgctagactttccttttctgtcctccatattgcttgatgtcctattcacattttccctcccctgatctctgtgagctgcattctggctagtttctctagttttatcttctagttcactcattctctcttcacctgtgtctactatgtggctaaacccatttattattttaggttaacaattatattttttcattccccaaagtttaatttggattcttcaaatctttctagtaacttttgatagtctgttgttgcgtgctcatttttcatttaattattttatttctaatcctttttgtagaaagagcacctaaaatctactctcttagcaaaatttcaata

SEQ ID NO: 32085 - DNA, 1928 bp, Homo sapiens
agagaatgctgagaataaagcctggactctggggaggccacgtaggagcctgctccaggccagtacccactgttgtcctgttaccatgtgcattctcatcctgccaccaactcccagcatgggcttaaaaaaatcattatctagtattttttcttagagatggaagtaagttttcttcccaaggtcagagcttttccaagaatgtgccagcagtctctgcagtctctgaatttcaaacaacatctgatggggtctggattttgagcatggacttctgtctggctctccaggctatttgatgggatccagtcttgctctgtcaatcagacttggaaggcaaatacaagtcccaggggaagtcaggctagaaggcaggacaggaacttgacaggaagagaccaaatgttgccctttggttctctcgtgtgtgtgtgtgtgtgtgtgtgtgtgtgtgtgtgtgtgtgtgtgtttgaaaaagagtatctagaaacaggatggtcaggaggtttcattcagagtgctaccttgaactgatggataatgaatgttgtaaacatttaaggtgccatagggaacaactctgtgatcaattagtgatgtctgacatcattgggtagaagctgcaatggcccatatgttatatattttccaacattctctagttcagggattttagattaacagtgtgactctctaggagtggtcttggctgttatttagacactttgattctggtaaatgcatctaaaacagttgaccctggtatgaagaagatgaacacctaagtactagctctgtcttttaccacccatgaggtcttaggaagattgggaggccttcctatgtctttatcttcttcctctataaatagttacttacttcttccagttattgtaaagataaaatgacttaatacacattatttagaatggtgcctgttacacagtgaactttcaaccagtgttggtttgtgagttgaatgaaagcctttaaaagatatgtccacctggaacctcagaatggactttattcagaataagggtcttttcagatgtaattaatgtaagtatctcaagatgagaacatcctatatttggatgggccctaaatccaatgacagatgttcttatgagacagaaaagaagaagatacacagagacacagaccagaagttcgcatgaagttggaggcagagattgtggaggcagagaagtaatgcatctgtaagtcaaacaatgtcaaggattgctggccatcaccagaaattaggaaaaagcatggaatggtttctccatcagggcctccagaaggaaccaactctgctgacatcttgattttggacttctggcctccagaactgtaagatgataaacttttgttgttttaagttaccatagcggtaatttattatggcaatcctaggaaactaatacagttgggtattggcattattattgttgttgtttttaaggtgaagatcaattccttggctgtctcctaatttgggcagtcctggaatttgtggactttgatgaagtcaaacagaatctcaggctacccagaagcactgttacctctgatggtggcaagtggcttgttctttggactatttttccctcaacttagtccttggaagatttaaatttgaaatcattagaatgtaaaaattgaagaggggcatgggcatttgttgatatggaaatagaatggctgacagtagaatggacaaggcatcctcctgcgtcggtgccagctattacatccaaatttgagagaaggcagggagttgaattctagaaaaagtgagctctgggaaaaaatcttaaaatgtgcaaagaggatgttaacctggagacagacccccaagcactgacgttcttggggtgatagaagcttagagaaaccacaggtccagggtatagatgatg

SEQ ID NO: 32086 - DNA, 1046 bp, Homo sapiens
aatgcacagttgcttactactccagatttctgtttccttcttttaactctgaagttgatggcttatagtctatagcaaaaacaaaacaaaacaacaaaaaaactatgctgaacataaaacttatagtgggtaagtaaaacttaactataaagaaaataactttagaatagaggaatgttctagttagcttcaaatgcaagaatcagaaaaccccacattccagaagctcatacaagtagctttgtaatcactagggactcacgttccttctgtcttgacattttgccatttttagcatttgcttgcacctcttagtgtgagacttttgcttcagttccagctatccaatccctattccaaccagcagaaaggaggcacgagaaagaaacctccctgtcctttaagttacacatcccatccattgacatctgagtcatttcacagtttattcaatatttgctgagcatctgctatgtgcaagcactgttctaagccctaggcagttatctaagccctgttcttagtgaacagaaaggactctatgaacaaaaatcctcctgttggtggagcttatattttactagatgtgagaacaagtgtgggggaaggggcccactggccagggttttaagccacatggtcatacttagcttcaagaccaagcagggaaatatagcctttagctgcattctgggaatccagttctaaggaaggaaaggaaagaatggatattgggggcaattggcagtctctgacaacatgaataaagtgtgaagaaaaataggtcaactggtatgttatgtcacttagcagtaaaaaacaactttgcaattacacctctagtctattcctaacagacatgtatgtgtatgcatgtatgtttagtgcatatctgagttcatttctgggtaccatggttggtagactgtgaggaggcatgtagtgagtgaacaagttgaggtattcctgaaaatctctttgtgctggggatagctgacctataaggggtattaggtccagagaagtccaagaagacagatgcttct

SEQ ID NO: 32087 - DNA, 1007 bp, Homo sapiens
aaatagattgccacctggatcactacagcaaatagatttcattttgggagacagctctgattaattggtggctgccttaaccctatgttgggaaagattatgaggtcccaggggactcagtgcaaggcagtgctgtaatcgattagtgatgtctgtcagggctggtgcacagaagaaatgagatccatttgtcttaagctagaggcttctccctaaagcagtagaaaatttaaaggcatgaattgttgtgattctgtctaccacaatctagactctgatctgaggtcactaagaggagagcctctacaacccagaatccctttatttgtagcctatcctggagctgcaactgaagagacagatttataaaagctattgcttttataaataaattgaaaataattccttgtttgctattatatcttctgaaccaactttttttttattgtggcaaaatatatataacataacatttaccattttaccagtggctttaaatacattcaaagtgttgtgtaactatcactgtcatccatcccagaactgaaactctatatctgttaaacagtaactcaccaataacctcatacccctggtccctggcaacctgtgttttattttctggctttatgaatttaattactctaagtacctcaaatgagccgagtcatacaatatttttctttttatgtctggtttatttcacttaactcgatgtcttcagggttcatctgtgtgtagcatgtgtcagaattttcctttttaaggatgaataatggaatattttccattgcatgtatatatcacattttgtttattcattcatcttcaatagacacttgggttgtttctacttcctggctattgtgaatcatgctcctatgaacagtgatatatacatatctgttcaagtccctgcttttaattcttttgggcatctacccagagtggaattgatggactgtatggtaattccattcccaatattttgaggagctgccatactg

SEQ ID NO: 32088 - DNA, 1074 bp, Homo sapiens
tgtagtttttggaattcaaactatatgtggagcctgttggtttctggacatgattagtgactggaacaatttaggtaaccctatgtctgagttggaaagattcatcatatctgtcaaatctagattgcaaaggacgcaaacataaaatttactctaaattttaaaataattttatgttaattttccagaagatgtttgtaaaaccattgatcatttatctgttaaagaaatgggatttgataaaaatgtagtaggaggcttcttttatatttgacttgctcttgggagcggatgcattaaagtcagtattttctttcgtatttgtctcaatgtctgcatagtctgacagcaataaatgtaaacggaaggttcagggtgtctgttttgctatgacatgtaaagaccaccttgggacttacatcattagcatgactttgagacgtgaaacatgcatttactgaccacaccatttggtcacatttgattctacggcaattagatcctactcgttctgtaagctggccaactttaatttcctgaccagagctgactattgttaccttagtaagattatatttaccctttctgtctactgcacactttattgctatgtatagaatcaatgtgttcaaattgaaggcattgctagtagaaatttcagtgttttactcactcacattctttctctttcagtctagtttaattgacctcaaagaacatgcatcttcattagcctctgcggggctgaaaagggattccaaattaaaatctctagaaatagccattgaacaaaagaaagaggaatgtagcaaattggaagcacagttaaaaaaggtaagtgaagtctaagaaaaagaatcatgcttatttaaaaatgaatttataaaatggaacaggaagagacgtttttaaaaagaaacaaaccccttatctgttgctgtctgctgataaaagaattaattaaatactcttaactttattgctaagaagtctatcaaatctgtctgtaaacctgaaaaattatctcagatttcctgtttaagaaaaacttgaaaaatagatcaaaatagtagc

SEQ ID NO: 32089 - DNA, 1041 bp, Homo sapiens
aaatacatgaaagaaaaactattagagttgaaaggtaaaataaacgaattcacaattatagtttgggacttcaacataccactatcagcaattgaactaaataaagaaattaaatataggaaactaaatgtagaaaattagaaaaatatggaaagaactgatcaattctatcaactgattgctatttatagaatattcccaacagctgctgaaatgcattatttgcaagtacatatataatattcaccaagataaactatatcctgcattgcagaacacacctcaccaaatttgaacaaactggatttatataaggtatgttctatgatcttaatgtaataaaactggaaattgataacagacagacaaggggatctataaacacttgaaaattatatatcacactgctaagtaacccatagtcgaaagatgaagtttcaaaggaaaaacatacatgaaactgaatgaaaagaaaaacacaaaatatcaaaatgtgtgggatgcagctagagcagtgctgagaagaaaatgtaagcattggatgcttatatgaaaaaagaagaaagatcttgaatgaatactccaagttcctacctcaataacccagaagaacaaaataaaccgaaactaagtagagggaaggaaataataaaaatggagcaaaatttaataaaatcgaaaatatagaaacaacagagaaaatcaataacattaaaagctccttctttgaaaacataaataaaattgataaatctccagaaaccctgagaaaaataaagaagatgtatattgccaatgtcagaaatgaaacagaagctatcattacagttcctgtagctattagcaacctaatagaagaatactgtagacaactttatgctcataaatatgacagtttagtagaaatggaccaatttctaaaaaaccacaaagtatccaaaagtaaccaacatgaaatagatgactgaatagtcttaaaaccatgaaatacattgaaggtgtagttaaaaggctcctgaaaaagaaatttccaagccctga

SEQ ID NO: 32090 - DNA, 1085 bp, Homo sapiens
aactagtttggttagataagtctcccaattgcagtgtcagcatgcagactagtctagtccagagagaaaagcaggaggtagaaaatcacattcgaaatgcttacaaggtcaatagagaaagagcctgagacaccatccctgtgttgaattgaaggaaaaatcaagaatgtcaattttagcgattgaaattgtcttatagagcacaggaggcactaatttgctcagacatctttgggcaaacttgcatgtagaatctgctagatcctgttattatttatgtgcagtcgtgcctgcagccagagaactatctttctggacttgcttctttctaactgagaataaaggcttgaggaatataggagatgtcagtagcaacaagcaacttgaattcctcaagataaagaccatggctgggaagaattgagcaggcaagtggaggttactgactctgcattaataaaaaatttacgagagtgcagaacaaatcatgccaggccatctttatcgttttctaggtggatgtgcaagattaaagaaaggaattcaatagctgtaatatctggaattgagtaaatcatctaattcagtgtctccacaaatctttgggggcagtaggggcaggggcagaagagggggagaccctcaatgagaattggccctgagcactgtcatgtggattcaatttggctgttgtaataaattacaatggaacagggtccattgggacgatgttgggatcaatagaaggtcaggctgtaacatctccagcagtggtctggaagaatggataacatactttattaagcttggcaggccaggaggttttggaactgttgtggtcactgccaccgtcattagcctttatgaagcacctgttgggtatggggcaccctgtgggttgttagatgaaagacagaatgtgtatgattgcccaaatggtcaacctgtctaaaaatgatgataagtacaattcattaaatacttacaaggctgccatgcatagtactaaaactttctcatggattgtttcttttaatcctaatgacaacctttaaagggtgggggtttcttcccattttacagat

SEQ ID NO: 32091 - DNA, 1039 bp, Homo sapiens
accacgaataataaaacacagaagaggaaatggctgttgctgtacccacacctaacatctccagccttggttctattaccctaggaaggtaaaaagggatgaaggtttgagtaagggtgtttcgccactcttccttcattttcctttttaataaaaagaaatgtggtatttacagagaatatcatcttattctgcaaagagaatgcttccttctctagttctcacttctaatttattggattgttaggaaggtgatattttatgagagtgatacaatgaaatttctggttatatgtggtcatttccaattatttgcatttccatgcaaataattatttttataataaaatgattatattatatactatttcttgaacccttactgtataccagacactgcactaaatgatttgcatccttaggttatgcgttcttgtaacagacctaatggcttataggcactatcataatcttggtttttaaaatgagagactatggtttagagaagaactcgttcagagtgacgtggcaggaaagggatggagctattcttaaccaccacactattctggtgtttttcctagtttatgatcctgcttccctcatgagacaagtgggatcattaacttttacagattagctaaactacaatttgagcaacatacctgaggttgatatataagaacccctctttttaggacaaaaccagcagagatgcagccactaaataatgtaattttaaaaaagtagggaacgaattacatgaataaaatataacaccaggtctgtatttaaaaatatgataagttatatgtagaaaaaagaaagattgtggtggctttcaatatctgtttaatttttcttcccccagaagctctttatgtaccattctaagattgttttactgcttcatttttaaaggattgacgtgtttgctctgttggtagtttccctttcctttggttgttggcttaaaggactgagacctcaaaagatgatttgagacatgtaagcagctttcctggactagacgaaggtg

SEQ ID NO: 32092 - DNA, 1050 bp, Homo sapiens
tctaatatctattaggatattccccatgattttgtcttttcataagtgagttctgtaatctttcttaaactctgagagccagtgagtctcttcctgttctgttatggtcagccagagcctaaatggtacattcatgtacagaatagagtctgtcacattttaaaaacaaagttagattcaaaccaaattatagaggctttaccaaagagttaaaagtagagacactgcattcgttagaaactctcaggatattggtgatttgatgaatcatattattaattcatttctgtagagctcttcatggacaaggtcctggtcattggatcctcttcctcttgtagcactagctaattgacacagaaatttagaagagagctcaggagagattactaaggacccttgaatcaaaggggctgtctaggatacgtgggaataacagagagatggttatagtagcctgtcttggagcatgttctaaggattcagaagaagatttttcatttaaaatctccggctgcaaataataacaaaagcttacatttattgaacttgcttatatggaacactgtatgctgactactctgtttactcatgtaaatagtgcttgttacatgcactgtttacttacttttgaccactacctagtgagatgggcacaattattaatctaaggaattgtggaatattgaggcttatggtaagcttgcccaagatcacatagcctagataaaagtgttttttgtctttaggaatatataataaaataattaatgtaaattaagagaataagcctttttttaatttcactttttaggatgatgacaccaggtgtgagagtgaattagggaaaaatatcacacttgttcattttgtcagaagttgagactaagtgcgctcattcttgaggaataaatgacaacagttttctcagtgaatattttgggatggcacttccaatgcataagtgacaaatgaccacttttgccaatgcaaatgttttgcagaattttaaacttccctccacagccagactcaaaagtttgggaacca

SEQ ID NO: 32093 - DNA, 1048 bp, Homo sapiens
tgtatgtaacgtgcatgtttgcttactgtgcatgcaagcctccttcatgaatattcatagctctttttgcaacctgttaaatatgtatacttagccaacccatttggcatgaactcctgttttgccctgtcctcccttgaagtgcttgcttttagtttctgccagaggatacacctcttagccagcaggatggccaggctgcaggctgcaactctctacaagaaataaagctctcctctctaaatatatgaaccttatgattcttcagttgacagtaataagcctatattcacaagtgatatgtttccctgagctatgtgagcgattctagcaaatttccaaaacttaggaggggattacgggaacccctgatttataattaagtcagatggaagtgtaggtaacctggggacccactacatgcaattggcatctgaagtgggagggtggggggcagtcttgtgtgactgagtccttaacctgtgaggtctgtgctaattctgagtagatagtgtcggaattgagtttaattttaggatacccagtttgtatctgcaaagaattggagacttgcttcatgtgaaaaccccatacatttggtgtcagaagtattgtgagtatagaaagagttttcttcttttaatgtaacattctacattcctagagaacacacacacacatatacccactgcaaagtgtgtggaatttccatatgtgggcattaaatcatagagggctgctatatgaaggtattttcctacattcttgctcaacagcaagcgtgaggtatctttatggtcagcagggactgatgctccttagtgttttctgctctgaaactccattaaaaaacttgattcatcttttcagtactattcacatgactaatttcatagaagctttagagagtaatatgttccagctctttctttcatttgttgtcatcttttccttaatgtatcccatctttctatattcagtaaattaataaagaaaaattgtgttcatacatggctctgatatagaatctgatatctcttataaatta

SEQ ID NO: 32094 - DNA, 1055 bp, Homo sapiens
gctaattttttgtatttttagtagagacggggtttcaccgttttagccgggatggtctcgatctcctgacctcgtgatccgcccgcctcggcctcccaaagtgctgggattacaggcgtgagccaccgtgcccggcctgtcctctatacttttaatgtcctatagcaaatgaagtattcgatacatttagaaaatgactggggaaggaattacaatttgttacagctttttggacaacttaagaacttcttatgatttatcaaaatattcttaatgggttgtgtataagctgttcttacttagctcccctttattgagcacttaactttgtgttgggcactcaactaagtgccaagcactcattttaaatttaatcccattcaggatttattctctttttaaagataaggaaactgaggcacagagaatttgtaacttcctcagggtaacatagctgccatgctattagaatataagtattgttctttcccttactcagtcttgcctgtagaaatagtcactcctcatagcatatatcataaccatagcaatagtaacagtagtactcctgaagctaaccttttcattaaaacatgaaaactcggtagacctagttaagtatataccaagtggtgagtggcaactttgtggaaaattccatcccaagcctggacctctctcttgagcaccagcaccatacatgtaaccatctagtggacttcctgtgggttgcagaaacatattgggattagcctgtccagaatggaacttgtcttcttcccaactattctccccctgtgtccttgtcttgctgtcaccaccacgtacctcccaacccaagccagacactgggaacctcatcaatttctctttctccatcactccctgtattagttttttattgctgcggtaacaaattaccacaaacttagtggttttagacaatacaaatacatgattcttgtacagtcctggggatcagaagtgtgaagtcagtttcactgggctaagatcaagatgttgtcaggcctgcattccttctggaagctctcagg

SEQ ID NO: 32095 - DNA, 1041 bp, Homo sapiens
ctttctttccttccttccttccttccttccttccttccttccttccttccttccttctttccttccttccttccttccttccttccttccttcctttctttcattttggtggtatcttagaaaagtggtagggtaaagaatcctgtttaccttgggtttgctattatttattggagctctgtaggtggctactaataaatagtttcaatcgtcaaatctttgtcaagaaaatggactatattgggtccatttggggctggtatagagagtggtagcaaagagggcatgcaggcaggatgaggcaagtttcatttaacctgcacagagtgttcaataaaatataaccaatgtttaagaacctgcagatttcacatagaaatcttgacataaagttgtatatatttaatttataaatacataattattaaatattaaatattgtagtatatataaaattaatttatatatatttataaataaaaatatatatatttgcctcccttgaaaaattgaagatctagcatctagacagcacgcacactctgtagtccccactggccccaccacccaacatttctctctgactttgaggctgaatgtagttgcagtatgcaatcaagatatgatggtgttggaattccagaattcttgtgcctggcccagagtttttttcctggtggacatttcagtccataatctctggcctgaaaaaaggacccaaagctctcctgatgcacagcctttttggcagattggttcttgggcttttgtgatggagaattagaaggaaaggaagagggaagcaagacagaagggaaggagaagctaagggtagaaggaatttagggggatggagctttttaggtgtctggcctgggaacagctgtagtatttgagaacaacagatgggattttaagcaaaattgagaattatgtgtccactccatagtgttcaagaaatacaaacacggatttggcttatttttgaaattgctggactatgtatcagtcagggctgagttagagacagaagctacacca

SEQ ID NO: 32096 - DNA, 1047 bp, Homo sapiens
tatagtgagtaaaatatagtaagcatttaatacatgacagctattattatttctttatatatatatatatattttattatacgttaagttctagggtacatgtgcacaacgtgagggtttgttacatatgtatacatgtgccatgttggcgtgctgcacccattaactcatcatttacattaggtatacctcctaatgctatccctcccccctccccccaccccacaacaggccctggtgtgtgatgttcccctccctgtgtccaagtgttctcattgttcaattcccacctatgagtgagaacatgtggtgtttggttttttgtccttgcgatagtttgcttagaatgatggtttccagcttcatccatgtccctataaaggacatgaactcatcattttttatggctgcatagtattccatggtgtatatgtgccacattttcttaatccagtgtatcactgatggacatttgggttggttccttttgggggatatttagttttctgacactcaaattctcgaagccattactttagattttaagtgctatgagatcagaatggagagagagagaggagagcctccttgggacagcttcatgaaagagattgaactgagagggatggatgggttgtagatctatatttgcatacaattcagtatctagttgcttaggccatgggaccataggaggtaagaaagcaggtctaagggtttctaacttttggagactaaatgaaaatggatgtggtgaaacaggctctaaggacccttctaacagactctaacagaccccatgacccttgcctcctagactcatgcctttttgtgatcctctgccctgaggcaggctctgtgacttgcttctaaccagtagaatatggcaaatgtgatagtatgcacatgatcatgttacgtaagattgtaatgtctggcttggaaggagtttcttttttttgccagatttgaagaagaaagctgccacattgttagctgcctatggagagggctatgtggcaaagagggtagggtaatctccaatca

SEQ ID NO: 32097 - DNA, 1457 bp, Homo sapiens
gaggctgaggcaggagaattgcttgaatccgggaggcagaggttgcagtgagctgagattgtgccactgcactccagcctggcaaaagagcgagactccgtctcaaaaaaaaaaaaaaagtagtatccagtaggtgctcatggagatacaggacaaaaagatttatttatttatgacacaaagttacaaccggagcatctggttagctgggttacatcttcgaatctctaagagtctcctctaggtagcaagtatctgtactatcactgtaggaaatgtgttgaattcaaatgtgggactagagtctgaataatagattgtaataattagtccttttttgtggcagagagggagagtagcaaagtcataggttgatttgtttaaggtcatttgttcctataggtgtaaatggagatgccattgactgtattttcctatggtcttattgcatgagactggaattgcctggaggattttatcatggggatccagtgatagacagtgtgttcagaaatcagtaagatcaaaggagtgggtactgtttgggataatctaagaatgagtattttctgaaccaaaaattataaagaagaggaaagaacagagaaaaagttccattatgagtggacaacaactaggactctacagaagatgagaagaatgatcacgtggaggtggatgaaaaacaaaaccagaattagacagggttcttggcccgctgccttgggtagaagctgtcccctatgtgaggtcatcagctgtgtgcttctgaaagctggcgacttctagaggatctctgagaatcctcccttgaggtcctattatggagtagccttccagttctgtggaattctgcattgcttctgtagttgtgaacccaggaattgactccttagaatttcactgctatatttattgctaacagtaccggataaggtctcttccaacaagattcaaaaacaggttttttttttctgattttttttttctcaatagacaagaagattataaagatgctatttaggacgatgttgtgggaagggggccttaacctgtttttgacaagctgggcatagtacatgattccgttgtaatattttgccacatctgtgtgcagcaggacagaactactagaattcgagatgaaatccctgaacacatgggccttccaattacccattcataggaggatagccaatgtgtccttgagggagtggattgcatggccataaggactaatggtagtacttttggccaagatgaaagagctgctgttagatcagcacctttaactcttgcatgttgttgaaggttatcttctcgtctagcctgaaatctcctacagtttaatcttttgtctgttggtatgactgtattatggtcaagtctattttaaaaaacatctggggtggctttattttatatccttccaataaatggggctaaatgttttccca

SEQ ID NO: 32098 - DNA, 1072 bp, Homo sapiens
caacatggtcatttattttgttggccgtcactggtttagaatggaaaaaggaattattaactaaatgatttttcattgttaaaatttcagccctatttaaggctccctttcacagtcagctgtagatttaactaccaaaatttagcaacctttgtgaagttagatttatatagctgttgcctgttcttggactccatctagatgggcctacccttcctagttaaaggcagggcagattcctgccgggttcttcaaggtttgaacatctgtttactcagagaatgacatctatgggttctcagcctgggtttcttgatttctgggaattccttccaagcagcagaatcaaagggtagatgggttgagataatgggaccagacagttacatgatttattaactccactgactctagctgaagtcctctggggaagcagcaggccagctcccttgagatcacaggcttgacctaatgtctggtctcctccctggttctgcagcacaactcctgaaatggcactaacaagaccatgtgtggccctctcctgctgttgcaggtgggatggtctcatttcatttgcaggtggcctttctcattctcatgccactgtcatgagctggggtttccctggcagggaaacagtatttcgcatgtaactctggaaatcgtaggcactgctttgtcatgttctttctgtgacactgactcttgtggttaaaagactgcagatcattccatagtgagtctggcttttctctgcattttacactatttctctgtgaagtctgactcatgcctcaaggtctggttgactagcacgatttctccagcatttgttaattaaactccttgatatatttccctcctcccatgcaatagagtcccccaatgatcaatactttcaacctaacagctattgcttaactggcttatattttttgctttttcccatttatctacaatgtatttagatgggaaagtgagctattctttgttcatcatttcaggaagagttctataaaatatgcattacaatttttgtactctttttttttggtactcctaatactct

SEQ ID NO: 32099 - DNA, 1068 bp, Homo sapiens
ttagttattgaagagaccagattgtttgtcctatagtttccctccagcctggattttgttgattgcatccctgcagagagtttaaattgttactctgttctttgtgtttcctggaaatttctggttgaatctagaggctgaataaaaaccaagttcctttttttttcatgggagaggtttgtgctaaattttggaaagttatttcttcagggtagttctcttttagggaaataatatacattatttggaataaaaaatgtgcttagaactaaggttcttgatttctttgttgtaaaatgtacctgtaaaatcttgttatatgaaacattctgcagtactctttatctagtcttggtatatttataatcatgaagaagggatatgggaaggttctaatttattagtgaagttttaattttttaagctatatatagagaatgtaatgaaataatttattgatgtaattgagattttcagcttggttccccatgccgacattgacattatcaactactatgaagtgactgtgaatttcaaaggtgttttgagtgcttagcatatctatagtccatgcttgcatccttccctgcatgtgtaataagccagaactctggaaggacttgcctactttcagcctctgtgagtctgcattaatgtaaggctaatgttattttgaatagaagtacgcaggctctaatggttttggattgaagcatttactgtaacctctgtagagtggctggtttgttacccatgtatctatgacagaaaaattcaattcattaagcatatggcatgaatagcatgatgtttgagccctgcggtaggaaggtattttgtttgcctggggatttgtagtatgctttgttggctccacctcatttattacctgtgcccacttgacatggccatcttgtacagaggaagaactgggactaaacatcagcagatttaagttctaaacctggttctgctgtaaagttggcagatctagcaaataaaaatacaggatgcagccatgcatggtggctcatgcctataatcccagctctttgggaggctgaaatg

SEQ ID NO: 32100 - DNA, 1032 bp, Homo sapiens
tggtacttgtgaccatgaagttccatgaagaaggcccaaggaacctgctgatcacaagtttattatgcacctctggtgcgatgtggccgatgggaaattatcaaatgtagacaaaactaatgcacactgaggctgtattgaaagcagcatggtatccagcttaaagaaagtgatggtctcactttcagacctttcctgaagcacagccttcccttctgtccttttatagactggaagatgatagagaacagtgaagaattgggttgatggggatttggaatccagatcatatgatgacaggctgaggatgtttagtctggagaaatatggacttctagaatgagtgaacatttgataagtgacctcagatgtttgggtctttcggtactgtgcttctcaaactttaggatgcacactaattacctggggatctcgttaaaataaagattcggatttaataggtctgttgaggcctgggattctttatttctaagaagtttttagatgatgccgatactgccggtccgtggaccacactgtgagtggcaaggctccagaggagctctgtccaatggaacactgcagggatgggaatattctatatctgcattgtcccatgtggtaaccacctgccgcttctggctattgagcactggaaaggtgtctagtgtgactgataaaccaagtttttgattttatttaatttcatttaaatttaaatagttacatgtggctagtgtctactgtattggacaatgcaattctagaggatacaactgaaactattggaacttaaaagagtttagacttcactttcattgtatgagttttgaaacagttatagctgtttggtactgagaaggcatctagaaaattagaatagtatttaagtcaatgaccatctataaggaatacagaagaagggcacttctactgagtggggaggtggatccaagaggaggtagcatgtaattggaacggagggttaatctacttaacacagtggttcttagctagggacagttttgcttc

SEQ ID NO: 32101 - DNA, 1108 bp, Homo sapiens
ttagctcaaaccccaacttaatatagcatttcttctcttcagtaacacctcataatacaagaaaaatgtatggaagtgcaagaacaatcaccaatctggaaggtagcccttccagatcccctcgtttgccaaggtctcctcgtttgggccaccgaagaacaagtagtgggggaggtggaggaacaggcaagactctgtctatggagaatatccagtccctcaatgcagcctatgctacgtctggacccatgtatctgagtgatcatgaaggggtggcttcaacaacctacccaaagggcactatgactctgggaagggctacaaatcgagctgtatatggaggccgtgtcacagccatggggagtagtcccaatattgcttctgctggactttcccacacagatgtcctttcatacacagatcaacatggtgggctgactggctcatcccatcatcaccaccaccaggtcccctccatgttgaggcaggtaagagacagcacaatgttagatcttcaggcccagctgaaagaactgcagagagagaatgacctcctccggaaagagctagacatcaaggacagcaaattgggatcttccatgaacagtattaagactttctggagtcctgagcttaagaaggagagagtcttgaggaaagaagaggcagcgcggatgtctgtcctcaaggagcagatgagggtttcccatgaagaaaatcaggtaggtcatgactcatctcagtatttttcagccttggcttctcactgagtagttgatgctttgcagatggtaccacgacctgtgcagaagaaagtttggcatcatcaagaaggttatggcttagtatgtgtttgacttagacactatgagagagcataggaaatataccattacagcttgtaatttccttattttccgataaccttttcacatggttgcagatggggagaggggtggggtggggaggatcacttgtcattgcctaacttttgtacttggttaattttgttttctttttcagcagttgcaacagctgttcagatgtacctccttctgaatagaagaagaaaatgttaatttctgtaagaataaagactttaagagca

SEQ ID NO: 32102 - DNA, 1027 bp, Homo sapiens
tatagctggagcaagcctagcttgcatgctgcagagttcatgtgtatgaggcccgtggggtatggttgggccagaggtggggagaaagggtgttggcggaggtgtggggggcaggccttcctccggccacaatgttttggtggaattctgaggagtctaagtattctaagttcaaaattcagatctcaccttccccatctctgtattcaaggtaggaaggtagaatgtattttgtttaccagtttgttagctcagtttataactttaaatgtataggcacatggtatctgggcatccatttgtactcttgccatgggctctaagagtgttagcaccaatgtaaaaacctgggttgcagtgtaggggtttataataggagggaagagagaccccaacaaggaattgcacatattaatatgaaattctaaggtatggaagtgcttttgggtcatatacggattactggacatgagagaggctttggggatgctgataatgttctaagtcttggtctagacagtggtaacacaggtgtgctcactatataaaaattaaccggtgcaggctgggcatagtggctcacacctgtaatcctagcactttgggaggccgaggcgggtggatcacttgaggtcaggagttcgagaccagcctgaacaaaatgtcaaagccccatctgtactaaaaatacaaaaattccctgggcttggtggtgggcacctgtaatcgcagctactcgagaggctgaggcaggagaatcgcttgaactcaggaggcagaggttgcagtgagccgagatcacaccactgcactccagcctgggtggcagagcgagactctgtctcaaaaaaaaaaatcaattaacgtgtgcaattaaggtctaccttcatcatgtatatgttctgctttaataaagtttataaaaataaatgaaaagagaatatattaaaattaaatattaaatgtaaataatataatctctatattttataaatattgtaacagatatactaagattagtatatta

SEQ ID NO: 32103 - DNA, 1043 bp, Homo sapiens
ggcatgagcttaccacacctggctgttttgctatatttttaacttgtggatttagctgtgtactagataatagtttattactttaacaaaatttttaggggtttcagatccttaatttaacactttgaaataaattgatggagtctgaaatttaaataatggaaatggttaatggaaagaacagttaactaatatttgggcatgcagagcccttgccttgtagtatggaagacagtcagcctcttgactcaagtaccttgccataaaacatgagccaaggcagctgaacatgtaatcatgctaaatctacacatggaaaacagtaattataaaatgagtttgggggaactaaaggagagagtactgatgtgtggataggcgtgtttgagtttcatagagctttttggagaatgatgggaaagcaattttgaaaatctctgctgtattaagctggactttccccttactgattcacatcatggcattcacagatgaaatggtttattactgggactttgaataactatggatgcataatattgtagcctgcagatcatgggggaaggcaatgtccatttttctctctagttttagagaactggggttgatgtcttcagcacttttgaacagcagattgagtttgactccaaagtgtctgacagggctaagtttagtgaactgggagaattctatggcaactttgaggctgaaagccactgtgttatattctggtagctttgggcttgtcaaggttaacttctgttgatcattagctgtgtgctaggtattgtgctaagtactttcttatatcatctcatttaatctttcccaaatctatacgaaaagtctgatatccccattttacagatgagaaaagtgaggatgagagaagtaaaatactttgttcaagattgcgtatccagaagacagaaatatgactccagccaaatctgattttgaggctcctcttttcctttttaaaacactatgtctctcctctctggctacaattacagaattgtcctataactgccatggaagtg

SEQ ID NO: 32104 - DNA, 1363 bp, Homo sapiens
tgtagccagtgtaagttgtaagttattatagattatgcatttctacctatattgtagacagtgcatactatggagtatgcattttgtctttgaggtttttgtaagcattattggttactattgtcagcaaaggggttatattaataaaaaggtaggaaaccagatatggcgatttagcattgagctactagatttccccacatgcataaagcaatttaattgcaagatagtagagctgtcatagctttaatcttttgtgagatggcctctgctttggttccaggttctgtgtaaaatgaaagatgtacttttgtttttgatgaaaaaaagcagaaatgatcattcatttagtgctaaccaactagtttagtaatccagtgaagctagatgtcaaaaaattttattttatatttgtcttgtcaaatactgaattaccgtataactttagatgctgttttgacattaacccctttggagctgggagttgggatttcccaacattaaacgtgaacacatttcgcagaagcttttagcatcggattatctggacattcacatctagtgtgagtgttgtgactaagtgaacttgtggcagaagaccaagctttaagggattgtggacttgcagaccctgacgcgttatattgtgtgagtagtgtataattttaaaacttaaacaaactgtgtatttcaatagaggaggactttttgttttttaaatgtagctcttttagaaaacgatgaaaaggatgaagaggatatgtctctggattcaggggatgaaatctcacatatagaagtatgcagcaattttcattcagaaatatgggagaaagagaccaaaggatcacgtggaacagatcaaaaaaagaatactcaaattgagttgcaatcgtctcctgatgtgcaaaacagtttattagaagataagacttaccttgattctgaagagagaacttctattgatatagtatgctctgaaggagagaacagcaattcaacagaacaagattcatatagtaactttcaggtttatcatagtcaattaaatatgtcccatcagtttagtcattttaatgttctcactcatcagacatttttggggacaccatatgccctttcatcaagtcagtctcaagaaaatgagaattacttcttatctgcttatactgaaagcttggatagagataaatctccacctcccttaagttgggggaaaagtgattcttccaggccatattcacaagagaaataactgtagtaactttttttttaagagattgttgtggactttgtttattaacaatttatatttcattctctaaacaaaaggttcttgttctttctcaaatgttttttcttt

SEQ ID NO: 32105 - DNA, 1045 bp, Homo sapiens
ctccatttacagacacactaaagggcaccactgaggatgacgtgttgacaggtcaggtggaggagcagtgtgtgccagcagcagaggcagagccgcctgcagtgagcgaaaccacagagaggacagtgttaggagagtacaatctcttttctaggaagatagaagagattttgaagcaaaagaatgtttcatatgtcagtacagtttccacacctatcttttcaacacaagagaagatgaaacggctttccgagttcatatattctaagacttccaaagctggtgtgcaggagtttgtagatggtttgcatgagaagctaaatactattattattaaagcatcagccaagggtgggaatttgccaccagtcagtcctaacgattctggtgctaagatagcatcgaatcctctggaaaggcatgtcataccagtttcctcaagtgacttcaacaataaacatctccttgagccactgtgtagtgatcctttgaaagataccaactctgatgagcagcattccacttcggctttaactgaagtagaaatgaaccagcctcaacatgccacagagttaatggtgacttctgatcatattgtacctggtgatatggcccgggaaccagtagaagaaacaacaaaatcccccagtgatgtaaacatttctgctcaaccagctctttcaaattttataagccagttagaacctgaagtatttaatagtttggttaaaatcatgaaagacgtccagaaaaatactgtgaaattttatattcatgaagaagaagagagtgtgctctgtaaagaaataaaggtaactaaaccagaaggtaatagtaatgctgtacaaacttctcttgttggtgtgacctctataaaatggaagttttttgtatttaaatgttttgtgtttaaatgttaggccaggaatggtggctaatacctgtaatcccaaaacttgggaggctgaggcaggaggattgcttgaggccaggagttcatgacaagcctgggcaacataacaagacattgtctcttaaattaata

SEQ ID NO: 32106 - DNA, 1121 bp, Homo sapiens
tgatcttttttatattttccttcagttttgttgtatctgactcttttcagaaattaaagtgttgtttttttatttgtaagaaatgtgaaatgactacatctttgtagttatttatttcctttgggagttcccctcccccgctaattaaagttactagtttccttgaagaaaatcttcaccatctccttctaggaaaatgtggttaaaaaaaaaaagaaaccatgaacaacagatatataacatagaggaaagttcacaaatctttttttttttcccctctgatacagaatctctctctgtcacccaggctggagtgcaatggcatgatcttggttcactgcaacctctgcctcctgggttaagcgattctcctgcctcagcctcccaagtagctgggattacaggcatgtgccaccgcacccggctgatttttgtagttttagtagagacagggtttcaccttgtcggccaggctagtctcgaactcctgacctcaagtgagccactgaacctggccacagatctttattgtacagctttttgaaattttacatatgtacatgaccatcacccaaatcaagatgtagaacgtttctagcatcccagaagattttcttccacattctcctagttagtactctccttgttcccaagtaagtgctaatctgattagttttgcctgttgttgaacttaggataaatagagcctactcatgtcgtctctcgtgtttggtactttcatgcaatatcgtgtcagggagtccatgttttgcatctatcagtaattcttttctgatttcggggttttaccatgttggccaggatggtctcaatctcttgacctcgtgatctgcccaccttggcctcccaaagtgttgggattacaggtgtgagccactgtgcccggctagtagttatctttcttatgcttcagaatgttccatcagcacctgcattcctcttatttggaaataccatctttatattttgtaagctaaagtgtagacatctgaatgatggtgcctttagagaactgactactcccctttcacttaaaagttaaaatactgcaattatttaatggcaataagtttttttttaaaaaagcacggtgtctcatg

SEQ ID NO: 32107 - DNA, 1036 bp, Homo sapiens
ccctgcctttgtttaaaagttgtatgcatgtccccattctttctcgatgtcgttttgggatatttatttcaaggggaagatgatggcaggagggttattggggtatgtaaggtaggcactgaggaactaacctgtattaatattttctgatatcttttgtattttaaatcaagttgatggggggcgggggcatgggttgaacctagcacactacccatttttataactaaagttttattggagtacagctgtgtccatttgtttaggtattgcctgtgatagactagagagtctggcctgcagagcctaaaatatttaatgtttggcacttcagcacaaacgtttaccaatccctgttctaaattaacataaaattatgtttcgagggaaaagatgttttaattttgaaactagagtataactttaccatgttgattttacgcatttgtaatgtttagattgaagcacgtgaattttcagtgaaaaaacagtttattcttgacattaaaatgaattggaaataaagctattcagtgtgtactttgatttttaggatccaaatttaattagcgtgaataattttgaagattgcagtttgtgtcccagtgttcccattgaacatggatttcgtagacaacagtctaagtcaaataatgttgaagagactgaaatacattggaaactgattccaattacaggtaagaaaagtatacttggacttgtgtttgcttcattttacttagagaccagtttcctgaatgtttccatcttctgtggatttcactcttgggtcactaggtgcttcatcttaattggtgctgacatcttcagtgtcttattttgagtaatacagtgttcatcactgagtgttgctgttcttggtcagcatcagcaagcacctgcaaaatcaccttaaaaacagggatttaagacacactgtctctatggagtttagcatgcagactgctgaatgaagactgttggcagaaactgagtttttgataaggtgaggtagctgcagagataaaatggtgct

SEQ ID NO: 32108 - DNA, 1081 bp, Homo sapiens
taaattttgtccaagaaatgcacacaaggttttctgaatcagagacagattttgtgaataccccacagtaagtaaaaatgtattggccctcctttgccttagtccttaactccctagggcatgcaggcctaagccacttgtcctgagtagctgcatactacataggtaaaagatggggacaaatactttctatttgcttataaaagggaagaggcagctattccctgctatcctgaatgtgtctctttgaaatgttatgaatattaactccaactctttggtatataaataaaatcgcttcaggagccatttgtttagccctcttggaccaagagacatttccaaattcctggaaactcattctgtattgaaatgtaaatgcttagggagatctccatagtcttcttggcacctctggacttaacctaggaacctctctttgctgtaatctcttaatctaccccacttgatgctctcagggagataaaataagttttattattgtggagcagagcaattaactagataaatgactacagatctaaatcttaaggtatgcgaagagtaaaatatttgtgggggatatgaaagcaaacattcccttatctttatatcatatacatttttgtatattagaaggctaggactttttgcagtggcacgtagaaatccagggaagttttcttttcacccagggagatgatacacgaaataagattatattgacttttttttttttttttttcgagacagagccttgctctgttgctgggctggagtgcagtggcgtgatctcggctcactgcaatctctgcctcctgagttcaagtgattcccttgcctcagtctccggagtagctgggattacaggcgcctgccaccatgctcggctaatttttgtattcttagtagagatggggtttcaccatgtaggccaggctggtcttgaactcttgacctcatgatctgcctgccttggcctctgaaagtgctgagattacaggcgtgagccaccgtgcctggccatctcgccctttctttagtgtattcttttttttttttttgacggtgtttcgctctt

SEQ ID NO: 32109 - DNA, 1039 bp, Homo sapiens
gcgtggtggcacatgcctgtagtcccagctgccctggaggttgaggtgggagaatcacttgatcctaggaggttgaagctgcagtgagctgtgatcgcaccactgcactctagcctaggtgacagagtgagactgtcacaaacgaaacaaaagatctttagaataaggtgagatattcgtagatatgctcttctattttccatcaagtgtacttttttgtgtatgtgttaagattgctagagttgaaaatacagataaggcaaacatgtttttaaaattttctttcagacctgagaaattagatgttgaaacagttatgagtattgatcatctgaaacagaaaatccctccagcactgttttataaggaaacatacttaggtccaaatgaaggtaaggtaatttaattttattgaaatgcattagaagcagacttgatttggatatttactatgtatttttcttatgtcagttttgaagaatggaatgtattgcagcctttatgaagttgtggaaaagacaagaattggaagtaacatggagagtttactgcaaaaactagacagagaaaaacttgtgagtgaaaagttttttaatgtttctcattctttgttacaaatatgcatattcatgtgtgatcatattagtgtttcagtttatttttgcctctgaaagtaccatgaggtgtctgtctgttgctgctgtttagttaacagtgttttactgtggttctggtattcttttatttgggccatggtattggagcttgtgcaaaccagtctttcccatggaatatcttttttttttttttttttttgagacggagtcttgctgtctcaccaggatggagtacagtggcgtgatcttggctcactgtaatctccgccttcctgggttcaagcaattctcctgcctcagcctcctgagtagctgggattacatgtgcacaccaccacagccagctgatttttgtatttttagtagagacggggtttcaccgtgttgtccaggatggtctcaatctcctgacctcgtgatct

SEQ ID NO: 32110 - DNA, 1205 bp, Homo sapiens
gcattgagtgaacatccatccttgtaccttgaatattccatgaatgctcctgcttcagggcctctgcatttgctgttctctcactttccccagtaagctgcataattcattctacatttcttcacgtatttccttatgattgaggtttctctgttttttttttttacctctatactcttatgtctctttttatagcactgaaaaccatcatgatctgttatatatcattgttttctgtcttcctcattagatttatgtaggttggaactttgttctgtttatctctataatcctattacctagaactgtgcctggtaaataagagcttagtatgtatttactgaatgatgaattaatatatttatatattgaggctgtgtcttctaatgtcagcaaaataattgacaagagactttggtggacactgttctctcttggttaatatttttggaaaaaacaactcccttaaatttgggtaaatgtggtaatttgagcgaagtaagtacttctgttttctctaagtagacttggatttactagactttgtaatgagtaatttctttgttcttcctacctggaggaaggacttaactgtagtatgccattaaaaattgcacttatatcatcttacatgttaatttttatgattatactaatgagtaatgtttttcttttcttttaaaaaatttgtagatctaacagctttaatacagatagaaacataggtaagagatttatgtttctttagttttataaatggaaagaataagtacatatagcaaaagattaagtgctttgtattatttttataatgaatgaaaatctgcaaagtatgaaaagttataatgtagcatcagcgcatttggttgtccaagcataagatctcctttgaaaatctgctactgtgaatagactgaaaggttttagcactttaatagaaaaagataaaaaataaaacaggtttcataactcagctttttaaaagtattaaattcaccagaggtgtaggacttagaattagagaagattgaaagtagcattgacattaaactattttaaagtttctttgtttttttttcttttctgagacagagtcttactctcgcccaggctggggtgcagtggcgtgatctcggctcactgcaacctctgcctcctgggttccagcgattctccagcctcagccttctcctgagtagctagga

SEQ ID NO: 32111 - DNA, 1041 bp, Homo sapiens
gtattgaatactgagttccctgagtgaaatggataattcatatacataatgctttccctatttggatagacacagggttgtttattattactacctcaaatagtgacccataattgagatttttgacttaaatattttctttaaaaggagtgacaggatacattgatcgagatacatgtagtgttaaatgacctctgaggacataaaatagactaccagaaaatgtacattcagaacatgaacttaataaattttctgaactgctgttagcagcaagttgacttgaaatccttaaaaatagttgcaggataattttattatcttagaaattatcaccagaaaaaatgagaaattataaccggcctaacgaagccactgaggcatttgcaatacaaaataattaggatacagatatttattgttaaagctaaaatgctttttccttttcatttgcaataatttttttcctgtcagctgtcatttttagtacattggacatgacttggacattgctttagagtcaactggaaatgttaagtactttgagaataatttggatgtgaacttttatgcagattcatgatttgactaattttttacttacgattagattaatggtagaaattgtattgggtagcttaactaatgaaaatttcttttatgtagactaacatttcatagaaattggcagccatgtgatacctttttttgtgtacattttatatatctgaagtcattttgtttagaaacaaaatcgtgtaaaacccaacttttaaaatcataacccaacttttaaaatcatgcttggcccactttggttgtgaaagcctataaagacctccacatgctgctttccttgccaagtttttcacagtttaattggggacaattatcacaaagataagatgtttttgtcctacgttccataacacaggtttgaatgaagacaatatatgccttctaccctcttttctgagctttcatttgtgtttcgtatattactgaattgttgaatttgtgaaagagtcaattttaaatcac

SEQ ID NO: 32112 - DNA, 1095 bp, Homo sapiens
ctgctgcccctccccgcggaagttggaagtagctcaggtttgaagcttgtccgtaaggctgcagctcccagagaggaaagatggtgctcggcgcccctccctcccagcccctgaaagcagagaagccgttgtgtcctcctaaggatgcttctgagaagtctcgctatggaaatagcccgtggccatggattctggggctttctccaaggccattgccaatgttctgaggaccatgagtgcttctccccgtggaaattcttcagttctgtgtgtctacttgaaatgtgcttgatgtcagcgtcctcccttatttagaaatctctattagtagatgtgatccatgcacactgctgttttccatcacacttcatttccatgtagatttttcccccttgtttttgaagcgttagattaaataggtttttctctctttaaattcgaacttagtattgtttttcttatatttgaaaagaatggaaaggtaggttcttggagcagtaatttcccaatggaaaaaaactaatgagaagttaccttattctcaagagtcaccaacttggtcttctagatggtagaacttcaggttaaaaaaaagtccagtcttagtttttggaacccatatggaaacagttacattaattacttgtacttttaaaaaatcttaatgccatattgttaatatggagtcagaattcctaatggaggtcaaaattagtatcgttttttgttattggggtattattttttaactatccagtaaattttggatattctgaatttagacaacttcctttttgccctactgtatggttaggttttcattatttactttggaaaaaaataggatttgtttttttcccgtatcttttccatccatctggtacagagtcttggctgtagcattatactgactttccataagcatcaccagttccatttgcactactggaattgtttgagccttttattggaaaaatacaaataaagttcatttgtttggatggcaaagccaagaaaatacttggtgtgagaaaccatgttgacaaagatgaagttaacctttggaaattagcatgaggaatgtttctagaaata

SEQ ID NO: 32113 - DNA, 1077 bp, Homo sapiens
ttggctttaaaaaattataaattatcttcctttacatttgatatttcatgtggttttgccttcacatagaaaagaaggtttcatcataagcacgtttctgatgtgcatttctcatagctgttgacaacttgctgtgttttgctctgctctgtttgccgtagcggaatcattctcctttctaaccaatctgtgcgctgtggtagcatgttctcttctaggttgctgtttaagttttgttatgtgccttgatgatgttccctctctgtaatacaaccagaaattgaggctgcgacttcatttaaattattgtcaggttgtggaaataggcctgccatgtgctcgccatccccacagggaagtggaggagtgtctgaaatgagaaatgaaccagcttctggcaactcatgaagaatgtgtctggaaatagggatggtatgaagggagggttattgctgtgttttatataataaagggaatgattaatgggctcccagtataccacagtaaagaacaaaattgcctttgggaccttggaggctttgtttagtttgggggcttatgtttgactgaaggtctcatgttcttgacaaaagggtgacatttgctgagtaaactttgaaattttattatatgtaatataataactgaagagggggctatcaagacactctctgaggaaggtctatgttaagtggcattgatcattgcatagcttcctgatttacaggtgacttggaagatcattctaaactgtaaggtccttgaggaccttacatgtattcttttattctttcctcattctttcattgatattcacattgactgagcatctcctatagtcacgctgtgttggttggtggtaagagaataacatggtgagcaaaccaggcaaggtgctggtgacttacagtccaattatggaggcagatgttaataatcaccgtaacaagaatataataacaaatgaaaacaaaagctttgaagaaaagagagacatgttgctgttagggcatttaaccagggagcttgacctagtcatgaaaggccaaggaagccttttctggggaagtgaaagct

SEQ ID NO: 32114 - DNA, 1035 bp, Homo sapiens
gtaaggaagccctttggctgatagatatcagctaatcagtttttaaacttttttttcttcctaaaaattgtgcagaggtcagtaacccacagacaggagtttcacttttaactgacagtgtaaggaaggagacttgacagtttcttgaaaaagctgcacccagggtgtttatgtttctaagaaataaactggatgagcttatttgcaagcggcccctgtgtgcttcatgcagaaattcttcaggtggcccttgcttcttgtgttagtcaaggaggcagaaccgcagcggccaggccggtggctgcttcacagcatacatcagctttccttttttttttttgcattcacttttaaaaatagctgcccatgtatcagttgccaaaataatgtgaggaatctggttataaaagttcagatttgtttagagagaataaagacagagctcaggcgattgcttgtaacaaaaccagtaagataagcactcaagattagccatgactagcaatcgttgagacttccatgttccagcatcatttatttttagttcctgtgttgaaaccatagatgaagacttttctatttattcattcttgaccttgagcagccaggtctgctcccacattcttctcatcattttataatcttgttgagctgggatactaagcagggctctccaagagcatcaacattttcaaatgttcacagtctcttgagttgaaccaccttgagtccaataggccttggcctgggaaagtgtctggacaccgctgctccatttgtctagagttcatggtgaagcaggcagaggaattgttcaggttttacttggattaaccacccttccagctttgaggagtagataaagacattcaataaaagtgcatgactgtgagcaactctcaggctctaatttgatattctttttatttctcactggcttgctgtgctttatgcctccctgataacctagtaacacccaaattttgtttttccttagtgttacctgaatttgtttttgaatttttgtttttcctt

SEQ ID NO: 32115 - DNA, 1080 bp, Homo sapiens
ctggcctggcagggtttgtgttggcaatggtagagagatgctatcggcatctcattgtgtactgtttgcataacgggacaggacagccaactccagccattaaaaaaaatgctttggattagatgaatggttttattaaggtacctgtcagattgggaaggtgcaactgtgactgatgaggacctcctgaagaggatcccagccacagctggtgggaggggggggctggtagttgacccagactcaggaatgtggctgcactgcaatgggctggccacccaagagtgggagagggtcatcggtgagggagagcactggcaaaagcattgtcagttgcattgtcctttggggcttcaggttttttatacctcagaggatctagggctattccggaaacatcagccaagggaagctctactggattttcctcagttaatagcatctacacaaggctttccttcaagaacagtcatcctgttagctactaataaaataacatagaagtgctgaagttttgagcctggaaacaataattttaaagatacatagtgtttgagtttacttatttgctcttagaatgaagtcaccacttgtcaccgtgactatggaaacataggaaatacattttggggagttctgcttaagtcattccatgtcccctagtaaggttctcaaagtgtggtccatgggacattagtggcaacagaacccggaagcatattagatatgcagaatttcaggctccacccaagacctgaagcagtagctgcatttcattgagatccccaggtgatgtgtgggcacattaaagtttgagaaacattccgatttttagggtggtctagattcaggttgcagatactgtcgactcagtagagatttcatgtgaagctctttagtcaggatttggggtgatggaaattggcatgtaaaccgtcccttctttctgtagcagaagaaagttgggctgtgataaatttcagttaaccaggagccatgactctagccacttgggactgaaataattagtgcaaatccttctgtagttcagaatgagtagaagaggccacagtcagggtt

SEQ ID NO: 32116 - DNA, 1014 bp, Homo sapiens
cgcttgagagggagggtggcctttcttaattctggtgctgtttaaggaaggggtgcatttatctggtgcttccagaatttgcactccttggattttcccatatgggaacctgcctagcaggcagctttgcatgaagccgaggattaaatggtggtggtgggtagggtggaggggacccagtgaggagggcaaatctgcttctgtttgcctgggcacatcacctgcacccacaccctgggctgctccacggcaaattaaagcctgtttctcttgatggcctggggcagccctgtcagtctgctggggcagatctccaagctggatgggccatggtgccctgggggtggtttgtgctctagatggtctctggctttctgcttgggtactcctgctgggtgtccttctgacaggagaaggacgcacttcgattccaggcctgtgtgctggctgccttgggacagcccgagtgctctggctgtagatctaaatgcaagcatactgtgaattttatttatttatgtctttgtgtcttgccgtgttccataaaagctttaagccactttatctagagaagatgaggaaagtgtaagggttaagaatgtaggctctggctgagtggggtggctcacgcctgtaatcccagcactttgggaggctgaagtgggcagatcacttgaggtcaggagttcgagaccaccctggccaacttggtgaaaccctgtctctactaaaaatacaaaaattagccgggcatggtggtggttgcctgtaatcccagttactcgggaggctgaggcaggagaattgcttgaacccgggaggtggaggttgcagtgagccaagatcacaccactgcactccagcctgggtgacagaaggagactccgtctgaaaaagaaaagaatgtaggctctggagccagaatgcctgagttctcaggtgtgacattggatcagctaatatacaggcaccgcaggatgtgagggtgagaggcacaagaacaagcggcacgct

SEQ ID NO: 32117 - DNA, 1076 bp, Homo sapiens
gcaatcttggctcactataagctctgcctcctgggttcacgccattctcccgcctcagcctcccgagtaactgggagtacaggcgcccgccaccacgcccggctaattttgtttttgtatttttagaagagacagggtttcaccgtgttagccaggatagtctcgatctcctgaccttgtgatccacccgccttggcctcccaaagtactgggattacaggcgtgagccaccgcgcctggccgacaaatgttattctttctgggttgccatattttgtggtttttaaaaaatatatttttattcatttatctggtgacttgaaatttcatgcaagtacaggtccttacagacaatttctattggaaaatcacttattttgggtgtgtattagggtttggagagaaacagaaccaacaggatgtgtgtcaatcaatcgctcatctatctattgagaggttgatttttaggaattggctcatgtgattgtggaggccaggtgagtcaaaaatcagcaaggtagactggcaggccggagacccagggaagagttgcagtgagcccaaaggctctctgggtagaattcttcctgctctgggaggtcggtctttttctattaaggcttatagctgattggataaagcccaccacatcatggagaataatctgctttactctaagtccactgatttaaatgttaatctcatctaaaaaataccttcacagaaatgtctagaatgtttgaccaaatagctggttaccatggtctagccaagttgacacataaaattaatcatcacagtgggtaaaatactgtttgaggttgttcagaagaaaggaaaaaggcaaaagcctgggcgcggtggctcacgccaatagtcccagcactttgggaggccgaggcggatggatcacttgaggtcaggagttcaagaccagcctagccaacatggtgaaaccccgtctctactaaaaatacaaaaattaagccaggcatggtggcgggtgcctgcaatcccagctacttgggaggctgaggcaggtgaatcgcttgaacctgggaggcggaggttgcggt

SEQ ID NO: 32118 - DNA, 1004 bp, Homo sapiens
ttgagtcttcttatctctttagtatttaatgagctctgtttggaagcatgacactggtttactctgagtacagacaggaaagtcaaggtgtgtaagagcaacaggggaagattagagactcccaacttaggcctctgtggcactaacctaataccaaaagttttttgtcatggagggaagagaagtgaaaattggaagcggctggtgaccaggactcaccttcctccttcttaaataccttccatctgtattaggggcagggaatcaatttccatcttgaaatggatatgtgttttgagaccccagctccagtcttctgttttataagtgtcacttctgctctccaggccctggggtttgactcatcccatctgttcaattcttgggtcctttggattcatcctttgaagctgctgtttcattgcctctttcttccttcctcatctccccacctaccccattgccaccttggcctgtatcagagaccttttccctgtgcttctgtctgccaaatctaggcttgtgctcacatctgtaaggaccactgtatttggatcttgcctgtctccaagatgtaccacatgcaaagctgaacccacttggctatttcagccctatggtgcccatcttttcaggccagttgggggtgtctaacacagaagcaatgagggtgtgttggtcacttccagggatgtgggaagtgtttattctggatgaccaggaagactctgtgtcatccctgagaaatagcaaccatttcctgaatgcttaccatgtgttgggcactgggtggtacagttggtagcacaagctcctgggtctgtgtttgcttgaaataaacttccttcccctccgcaaccccaaagcttgacatgcctcctctgaagacacttctctggctagccttcctctgttcaattaccccttgtctgaaatcttattacacatagagctcagtggcataacttagcccattcattctaggcagtgtaaccttatctact

SEQ ID NO: 32119 - DNA, 1030 bp, Homo sapiens
ccttggctcactgcaacctctgcctcccgggttcaagcgattctcctgcctcagcctcctgagtagttgggattataggcgcccgccaccacacctggctaatttttgtatttttaatagagacaaggtttcaccatgttggccaggctggtcgaactgctgacctcaggtgatccacctgcttcagcctccagaagtgctgggattacaggtgtgagccaccgtgcctggccagcatttttctgtttttaaagagagattattaaataggtgtcttggctatagaaaagaagaaactttgggtcctggacagtggtaagacctctgggcactcaaagtaaaatattccaaagttcatctttgctcttttctatccctacttttatgagaacctagacaccactgagaattctcgtacctccctagaagaatccattggtaaccatgatagctgccttatttgattacaaccttttagaaatatatatatattttaaactatttctaatatctgagttgctagatttctgaactgttatttgcagtcttctagtactaaaatgaactcacttatttaggttatatgtgtgagatatatgacaataatatttactattctagataaagttattccctaaaatatttttagatctttatcatttatcacattctgtccattttcactggagttctaccatctcattctgggaactttgtcttaattctgaagtaattcagtttgctaaatacttgcccatttgtgtatataattagaaatacaatttgtattgtattttgactgataaaccctccttcatctatattcccttcttagttaatgataccatcattcatctggtcatctaagctagaaatattggaatcacattaactttctcctcctcccctcaacagacaagcacacacacacccctgtctctgatgggccttatgttatgttgcttttctctgaccttttcttgaaacatctctgcctcagcacatctctgaaaagcccttataataacat

SEQ ID NO: 32120 - DNA, 1052 bp, Homo sapiens
tgtttccagtgagaaatacgatgtcacccttatctttgttcctatatggttcctaagtctctttttctctgactgcttttaagatttcctctttatcactggtttcaacttatttgatagcaatacactttgatataattttctccatgtttcttgtgcttggacttagtaaagcatctatacgtgtggtttaaccaaatttgggaaaatgtgggtcattggtcattatttcttaacatatttttttctgtccctcttcccttcttttagggacttcagttacccatgtattaggctacttgaggctatttcacagctcactaatgctcttcatttttcctttttgactcttttctgtttcattttgaatagttcctatttctatgagtttaagtttattaatcttttcttctgtgtagtttaatctactgttaattccatctagtgtacttttcatctcagacattgtttttatttctagatgctcaagtcttttaaaaatatcttacatgtctttacttatttaaaataacatctctgtcagttctgtgttggtttcaattgatcaattactctcatgatggtcatgtattccttcctctttgcatgcccaataattttgtattagatgccagaattttaccttgtttgatattgtgtattttcgttttactttaaatccttgtgcggtttgttctaggatgtagttaaatgactgggaaataatttgatcttttcaggttttttataattttttaggtaggtccagagtagtactcaatttagaattaattattcttcatcagtgaggcaagacctttttgagtactctacccactgtcccacaggttatgagtttttttcaatctggctgattgatagaaccaggcattgttcccaaccaaccctggacaatgtttcctctaaccttatctgttgattttccccttggttttgggtagtttgctcagattcatgtgctaataattactctgctgaatattctaaggaaacttctgcagctctctctctttctgtgctgctctctcctc

SEQ ID NO: 32121 - DNA, 1035 bp, Homo sapiens
actgtgcctggcctagaatattttttatgatctttgctaaattttttttgaatttttacatctatgttcatgagacatactggtttgtcattttcttgttttgttttgttttgagatggagtctcgctctgtcacccaggctggagtgcagtgatgtgatcttgactcactgcaacctccgcttcccgggttcaagcaattctcctgccttagcctcttgagtagctgggactacaggcatgcaccaccatgcctagctaattttttgtattttagtagagatggagtttcaccgtgttgcccaggctggtcttgaactcctgagctcaggcaatccacctgccttggcctccgaaagtgctaggattacaggcatgagccaccacacccagctggtttgtcatttttttggtaatgtctttgtctgcttttggtatcaggcttcacagaatgagttggaagtttgtgtcaaattggtattatgtcttccttaaaagtctggtagaatttagcagttaagctatttggacgtagaattttctatgggatggtgtttaactacatttttaacttttaaaatagatacaaggctattaaggtagtctgtttcttctccttctcctcttcctcttcctcctcctcttcctccttctttcttcttccttctttctcctcctcctactcttcatcttccttctcttcctcctgctcctccctccgcctcttccgcctcttcttcttctccttctcctcctcccccctgcctcctcctcctcctcctccttttcttcttcttccttcttcttttttctttgagacaaggtgtcactttgtagcccaggctactacagtggtgcaatcatgtctcactgcagcctctctctgctgggctcaagtgattctgccacatcagcctcctgagtagctgggagtacagctgtacaccaccatacctggctaattttttgcattttttgtagagatgaggttttgccatgttgcccaggctgctctccaactactgggctcaagtga

SEQ ID NO: 32122 - DNA, 1025 bp, Homo sapiens
agtgattctcctgcctcagcctccccagtagctgggattacaggcgcctgccaccacacctggctaatttttgtatttttagtagagatggggtttcaccgtgttggccaggttggtctcgaactcctgacctcaggtgatctgcccacctcggccttcccaaagggctgggattacaggcgtgagccaccgcgcctggccgattgatctttctaataagtgctttttctttcatgcggcattcctccacttggttatctggtagtttccctttgcctgtaagataacatctaaacttcttagcatactaacatggctctaatgatcgggcaacaatattctcatttctgactattcatcctttctgcttttgctccaggaatgctaaactctgtgtagttctacagacaggccataatgtcacttcattgctttgcacatagtttgttctgcatcactcttccctctctcatccacttggcaaaaaacgcccactcatctttcacgtcttcctgtaaatattacctccttggtgaggctgtcctttaatcccctggtagacataggttctcctttgtgattattatgctttttttttttttttttttttgagacagagtctcactctgctgcccaggctggagtgcagtgatgcaatctcagctcactgcaacctccgcctcctggtttcaagcaattctcctgcctcagcctcctgagtagctgggattacaggtgcccaccagtacgcccagctaattttttgtaattttagtagagatggggtttcaccatgttggccaggttggcctcgaactcctaacctcgtgatctgcccgcctcagcctccgaaagtgctgggattacaggcgtgaatcaccgcgctcggctaattgttgtgcattttaaaccaccttcactgtcttctaattttggcatcataactgggtgtgtatatctttcttcctgtgtgctgctggaaggaccgtgtcctttcgtctttttatgtctagtgtaaaacgtgt

SEQ ID NO: 32123 - DNA, 1035 bp, Homo sapiens
gtttaaattcctcattaccaatttgcatgctctttatttctttctcttctctgattgctctggctaggactctgctgcaactttgtcccccaagctaatagttttctcatccccactgggccctgacattctacacctggcttcccttctgcatggataccctccttaccctgctcactctctgattcttcttgttggattgaccccccacccccacccccatggataccctcctgtctcattcaggttactctgtcccactagaccacatctccaggtgggtgccatcttcccctttttgggctctgactctcaacaccaggtcaagcctcacatgagtgctctccttaccctgcttgtgtgcttaccctactccagggtacttctccatggagataccctcatttctctgctctgacaccttatgccaggtggtcccacattgtgacaacctcctcaactcattctgtctttgatgctactcatcaggctacctgtctgtgcttcctgggctctgtgaactgaaaccaaataatccccacacatgtatacattgctcaccacatttgggctccagcagttccacagtaggccactatctgcatgtagatgtccaccttaccttacataagctctgacacgcctccctggtcaatacggctctctttccctcatggcagagatacctaccatgttctgctttaggactgagttgtttaggaagggaagaggaagagctcctttgccttacccatgagctgtttttttgttgttgtttgtttcttttgtggcacttatcttgtttttgaatagttaaaattaactcccctaatttccatctcataatttgttgcatatttttgcacttaattgttgtttgatttttcttttcttttttatttgcatgtgtgtcttttcaactgagtggattggttgtgattttcataaatagataagattttcccccctaatctactaggaaaattttttaccaagccaggaggaaattcctaaataagtgaaagttaccaagtg

SEQ ID NO: 32124 - DNA, 2253 bp, Homo sapiens
tttcaaaacattttataaaagtggatttgaacaatatgtgttattttgtgtttggcatcttttgctcattattatgtttgtgagtcaacattatatgcagatatattccaaaaatgtttaattacatgagggatatggaataggaaaaatagtaaagagacttaggagttaagatgcatgttttacttctggctttgcctctaaccagcaaggatggctttgagcaagtcactggaactcttaggattttctttttttcctccaaaacatgacagaatgggttaaaatgattgataggatttttttcagctctaaaattgatgaaactggataaatgttatactaagctatccttaatttatttcatttttattttcattaggttgtcttggagatacccagttttgttttagatttcgacagtcttctgggaggagggtgtcgctgcattgtctcctggatcaatttgacaaagatttaccagtttacttaaaggttggaaaagtagtcataggaaaatgtccatgtgagaggaaactttagaactcatttattcagttaccgctgacaccattcagaaatattttgcttttgttttgctactatattatatagctgaatttccaaagtgagtcttattcataaggattcagcatctgaatgaaagggactttatacagttactatgtttgaaacataatgtcactgtgatttataaaaatggattagaatgttgaggtaattttctttcatttgttaataaattcttgaattagatgtgggagtggagttgtactgtacagtaactatcatctagagttgaggtagtcatacttgataacatagttgtctctttttgatttttgaatgagccttgttttagttattatttatttaaaacattttaataattcagatgaccttacagcctagatttttttttaagtacatgaggaacgttttcatctggatgccctatcagcacatccagtgtgactttgacataatttgcctgataacagtttttacagtttacctccctggttccactaatggcagagatactacctgtgaaatgtctcttagagccatctcctccttgctgtcactactaatatattcttccaaccaatgataataatagctgttatttgttagggctttgtatgttctagatactgtattaataagcatatatcatctaattaatcctccctacagtgctccaagagagatccttttgtagatgagggaattgagggctattgagcataagaaacttacccaaggtcatcccacctcttgttttattccagcacaatataccttatacagtgttgccagctaaagtgtacatatatattatataagtaaaatctaaaatgactacaaattgtttaacgagtaaagaggtatagtactacttccttgtcctcactttttggaccttccaaaataagaacttcatcatcaaagtttcaccctcatctcctttctatgtgtgccatatatgtgccgtattttaatcaaactgaactatgtgctttttcctgagatagcatgtatttttctgtcttttgtgtttttactgaaactcctagccctttcaacttggaatgcctttgtctttgtttaagtcatattcatccttcaattcccaattcaaaaacagctgcctccatgaaatctttactttttccccttggctttcctgtaacactttgtgttttttcatggtacccatcctcctattacaataatattcatttttctacttcttttttctgagatggagtcttgctctgtcaccaggctggagtgcagtggcgtgatctcagctcactgcaacctctgcctcctgggttcaagcgattctcctgcctcagcctcctgagtagttgggattacaggcacgtgccaccacacccagctaatttttgtatttttagtagagacagggattcaccatgttggccaggatggtcttgatctcctgacctcatgatccgcccaccttggcctcccaaactgctgggattacaggcatgagccactgcacctggcctcatttttctcctttcttatccctcctaaatcatgatatccttgaggaagaactgtgtcttatgcatctttttatcttctctaacacatcaccctgttcaaagtaggtggtcaatatatatttgtttaaggaataataatcaaataaggaactgagccaaagtttactccattaagatgtaaatgctt

SEQ ID NO: 32125 - DNA, 1388 bp, Homo sapiens
aagagaaggcctttttttttttttttttttttttaaataatcttattcttttgccaggctgaagggcagtggtgtgatttcagctcactgcaacctctgcctcccaggttcaagccattcttgtgcctcagcctcctgagtagctgggattacaagtgcccaccaccatgcctggctaagttttttgtatttttagtagagacatggtttcgccatgttagccaggctgatctcgaactcctggcctcaagtgacctgcccaccccggcctcccaaagtgttaggattacaggtatgagccatggcacctggccaagaaggacttttttttttgagagagagagggtctcaccctgtcatccaggctggagtggagtggcatgatcttggctcgctgcagcctttatgtgcttggggggcctgactctcctaagacagccattagtaccaccaggtggcctttgaggcacctccggtataatgtttgaaaatcactggcctttgataattggtggcatgagagaggcattactaccaatgcacacaagatgccttctgtgactaatgtatagtgccagttgactagtcaagcactgagtgtgtaatttttgtcactttgataaatgttatgttcatctcctaaggaggtcaggttggttataacatagagtttggttggcttgtagagtgtgtgcccttgggtgtgttgtttactattgtttgttctgctggtagctgatctgacctagccctgcttccttgcaggggctgtggggcaggagtttcatcagaaggtggttgtggtcactgcagacactaaaataacctaagaaaatgcataatgatcctttaaagggaccagagagaattaggatagcctttattgtggagatggtccttgaggtttcttaaactgcagataattatttttccgtttcatttttcttttactaataactaagtagttaggatgtgtattacttgttggagtcagttgaaaaatattatttactgaagtagacgccagctgaagattattttctctttagattataggctaccaaagaagactcagtaagctttgagttattagtcaattggtaaatggttcttgataacttaatgattttaccaatcttttggagataactttaaaccaaaaactttttttacctaatgtaaatattactcaatgctcccagctttcccccttgtttcattattaaagtttgtgaactgtttctttttgttttgctttttgtcttttaacttttattttaggtttctgggtacatgtaaaagtttgttacataaacatgtacataaactcatgtctcaggggtttgttgtgcagattatttcatcacccaggtgttaagcccagtatc

SEQ ID NO: 32126 - DNA, 1049 bp, Homo sapiens
ttgatcgcctcccaaaggtttcacctcctaataccgctatcaccttggggtttttgttgttattgaagcaaggttttaaattttgatgatatccaatttatttatgtttccttttgttgtttgtgcttttggtgtcatgtctaagaaaacattgcctaattcaaggttgtgaagatgtattactgttttcttccaagagttatatagatttagctcttacatttaggcctttgatccactttgaattgactattgtatatgctgtgaattagagctgttatttttttaaactttattttgagattaggtaagagttataaaagtaacttactccacctgaagttaacttttgtgcttcaaagaacatacagtccattgttcccactgctgctgctgctcttctaacagttctagtttctcacaaatttctgtccataatcctgctcagcaccctgtaccatctctatatctcgcttttcctcccgagctgctgttaggctgtctgttgcatttgtaattcctatagttcctcaccagtagtggctgagctcccgccttcccagcctgtatttttgactcattcaaggttaaaaattctccagcagcttctttaatgtagcccacaatcccctacatagtcttctctctccttacttcttcaggctcaccttgccccacttcatcagtgagcaacaatggaccattgatgtggaaggtacaccctcatgttatggaagcagaaactgaggcatagactggctaatgatttcccacaaggacacatctaattaggaccaaaacatggttttggtaccagtactgtactttccatccttccccactgcctcttaagagtttgaagatgcagagctgtattcatttatttttgcccaaagtcaaggtgagtaaatgtgaactttaaagaaaatttgggctttaaagaaaaaattgaagtgaagaagagatgataggaagaagctgaagatttggcttaggatggtggaataagaagtaacaacaacaatgaaaaagaaagaaggcaaaatgct

SEQ ID NO: 32127 - DNA, 1047 bp, Homo sapiens
tggagtgcagtggggcaatctcgtctccctgcaagctccgcctccctgcaagctccgcctcccaggttcacgccattctcctgcctcagcctcccaagttgctgggactacaggcacccgcaccacgcccggctaattttttgtatttttaatagagacggggtttcaccgtgttagccaggatggtctcgatctcctgacagtgtgatctgcccacctcagcctcccaaagtgctgggattacaggcatgagccaccgcgcctggcctgcccagctaattttgttttttttgtttttttgttttttttagtagagacagggtttcaccatgttggccaggctggtcttgaactcctgacctcaagtgatacacctgcctcagcctcccaaagtgctgggattacaggcgtgagccaccgcacctgacttttttttttttttttccttagagacatggtctgcctcagattggagtgcagtggcatgatcataactcactacaacctcgaactcctaaactcgagggatcctcctgagtatctatgaatacagacatgcaccactacacccggctatttttaattttttttgtggggacagggtcttgctatgttgcccaggctggtctcaaacttgtagcctcaaactgtcctgctgcctctgtcttccaaagtgctgggattataggtgttgagccaccatgcccagcccttctctgatctttaaggtgagaagctaacgtttttagccacttcagtgaaaaagagtgaatctttaactcacttccaaagccagaggaagataatctggcctggtttggggcaggttcctactctgatacaattggctaaagccctgagtagaagggggagtggttcaccttgcataaaatgtcttttaaggccctgtcctaagtgaagggggttaaggaggtctttgagctaggaagaaactgaacaaggtgttgactgcagggggtgtgctgagcttcttttcccctgaagtggctctggaggcattaccacagaatcaaagtgtcctctgga

SEQ ID NO: 32128 - DNA, 1035 bp, Homo sapiens
agttctcgtaatccccatgtgttgtggtgggagagacccggtgagaggtaattgaatcatggctgcagttaccctcatgctcttcttgtgatagtaagctctcatgagatctgattgttttataagaggctttcccctctttgctcagcacttctctctcctgctgctttatgaagaagaacatgtttgcttccccttccaccatgattgtaagtttcctgaggccttgtcagccatgcagaactgtgagtcaattaaacctctttcctttataaattacccagtcttggatatttcttcatagcagcctgagaaggaactaatacacaaaccatacatttgatttcaaaaagggctataagaccatttaatagaaggagaatagtctcttcaacagatgattctgtatatccacatgcaaaaaaatgaggtggactcctaccacatatcgtatacaaaaattaactaaaaatgtttccttgacctaaatataagagctgaaactgtaaaactcttagagaaaaaaaggtaaatcttcatgaccttgcattgtcaatagtattagatatgataccaaaagcacagcaacaaagtttttaaaaatagataaattgtacttcatcaaaatgtaaaacttttgtgtatcaaagaacaccatcaagaaagtgaagagaaaacctacagcatgtgagaaaatatttgcaaatcatatatctgatacgatatgtatcctggtttatatatgaatatatagagagaaaacattctagtatattctagtacccggaatatagtcagcccaccctccatatctgcagcttccccattcacagattttcaaccaagtgcagatgaaaaatattcaggggaaaaaaattaaaaaaacaatataacaataaaagtaatacaaataaacagtgtgtataactatttcctagcattttcattgtattaggtattgtaggtaatatagagatgatttaaggtatactggaagatgtgcataggttatatgtaaatactgtgctgttttac

SEQ ID NO: 32129 - DNA, 1069 bp, Homo sapiens
cttccaccttgcagtttgatctcagactgctgtgctagcattcagtgagactccgtgggcgtaggaccctccgagccaggtgtgtgatataatctcctggtgcgccgttttttaagccccatcggaaaagcgcagtattcgggtgggagtgacccaattttccaggtgccatttgtcacccctttcttttactaggaaagggaactccctgaccccttgtgcttcccgagtgaggcaatgcctcgccctgcttcggctcgctcacagtgcgctgcacccactgtcctgcgcccactgtctgacactccctagtgagatgaacccggtacctcaggtggaaatgcagaaatcacccgtcttctgcgtcgctcacgctgggagctgtagaccggagctgttcctattcggccatcttggctgccagtcctgcttaaatttaatttaaaagaaaactttataccacttttataagtggaaaaccagtgtaattttcccaaaatacaacataaaaataaacatactgaaaacaaaacaatattttgaggtctaactgggtactgtttcttgtttaaggctctgtcctgagggctgctgtttgttaaaaagagtttatcaaggattagatacatgttcagctattctccctgtcatagttaggactgaaggaaaactgacaaagggacatttttattctgggatccagagttatttaatgccacacccatgtaccgtctaaaatcatttcacaaaaggtacatgttccactctttgggaactactgtggtggatttgaaaaggaagccattaaagcttttgggctagagaaggaccacacagtcagttctgtgctttgggaagattaatctgatagtaatatttgcagtgatttggagggtgtagaaattggaagtgaggaagttttttgcagtcatccagattagggttagtgaggactgtgggggcagtcgggggagcagtggaggaatggatgtgaagcaacatcagaaacttaaagtcagatgagctaagacatgtatgtaaacagaccttttccatacaatgtggtaca

SEQ ID NO: 32130 - DNA, 1112 bp, Homo sapiens
ctgatcaggactgcagttcagagtgtttccagggcattgtgagaacacaaaatgcattccttgtgctcctgtctttattacatgctgttcatcagtacattgcaggcacctcttaggcatttaattccattgggagtttctcttgatacaaattactttcatttactataatttttatactttatccacaggattaactcttgactcttttgaaactcttgaccaccacctttctcagaggtcatgattttttctgtttctgctatagctcatgccttgtcttgtgctttgctaataataaatcaataaatggctcatttcttgctctcatccaaatgaagccatatatggtaagcattaattttgtaataaattttcttcgtcagaatatcttactgccatttaaattttttacatagactatggaaataatttacttccaatattgaaaaataatcatctgcttgtgaagtataaactgagcctctgtttattttatctaaagcagtatacaagtcaaactttacttttttattcataagttcacttttatagatttgtttggaatgtacttatattacaaaattttatcttccttaggtagagtggaatatctaaaaaagtttattaatgaatcttgaaatctttggtcatgaactacttatagtgtcatctttgcatacttcagtgatattgaatacttcttaaaaacaggaaatgagtaatgctgtatccagtgaaactctaggaagaatttaaaatgtaatcatcattagcaaaaattctaaaaacagcatgttcttactaagtacattggcttccttgctatcttaattctgtatatttgctttctttacataagaagctctgctattagtattgcagatctagagccaatgatagaatgacctagattctgtgtgtcttatacatcatcatctggatttttcaactagtcctaattttagtaacagtaagagtaaatctctaaaagaaaaaaaggcacagtggaaatttcggattttgattgatttcagtgatgaaaggactaaaatattgacttttactcatgatttttcattatttctgccagtttatcattaattttacat

SEQ ID NO: 32131 - DNA, 1004 bp, Homo sapiens
ataaaggttgaaagcaaaagttaaattctttaaaaaagaaaaaaaaccctgaaagtgtacctcatccttacaaattttaactgatcctttgtgatccttgcatagcagtattctgaatttgaaattgtatctgaatggagtttgatgattttaacctggaattcaatacagaatttatgatgctcattccagagtttttgtcttttccttttgctctgcttcctagttgtgtggctgtggactcaacactttaatttggtgtttccgtttcctcacagtaaatggtaatgctaactcttttattttaatggctggagttaattgaagacattggtctttttctaagaattttacggagtttaggtccacgtagacctcaaagcttcctttttcatttctataatatggaaaattggacatgcttccaaacaaagctttagcctcaagccaatttaatgaaagttactcttatgttattttttccgtactgttactagtgagctagacagcggtcagaaaataaatctaatagaagtttcagagtcttctaccctattgaattttgctcctacctttccttcttcagtgacgttagagacagtaggctcctttgaaactttaaactaagtaaagtgaatatggcctcacagctgcagacctgatcttttcatatgtcatcggtcttcctcagcctctttaaagccactggagttgagagcatacctaaatttgatatctttaggtcacgatgacattagtgacagcttttgagattgtatccatgtaactatgcacaactcttcctgtggaaaatttgctttcttatctttttggtcattcattgccttcctttaaagaaaatagtggttgctttgtagctttttaagttatttgtaaaagagatgttaaccaaatgcaaagaattattatgttatccagtgaaatcttttatgtcaccaagggaatacatctctaaactatgtgttgagaactagacaacaatg

SEQ ID NO: 32132 - DNA, 1045 bp, Homo sapiens
acaagtagaattaatcagtaaacttagcaaggcctctgaatctaaggggtgtgtgtgtgtgtgtgtgtgtgtgtgtgtgtgtgtgtgtgtatatatgttttaaatttctctgtatcagctacaatggttagaaaatgaaaagttttaaagtttgcttttaacatcaaaaatcagatacctaggaataattacaggtatgtaagcttatagacaaaaaatgtaaaatattaagtcattaaagagaaattaaataaatggagaagtaaatgactcaattttattaatataaagattgaattttcctcaagttgactataaacccacagcaactcagttccaaattcccataggttttggtaaaaatcgacaagttgattctaaaatgcgtatggaaatgtagccagagacttagaaaaaacaagattagaaggattggaggggctcactctacaggatatcaagacttattacaaggctataagagttaagagagcatggtattggtacaaagataaatagactgatagaacaaaacagaggacatagaagcaaatccaggcatatatgaacacttgatttatgataaaaatgacactacagagccatgagaaaaggaagatttttttcaatagatagttcttggaaaattggatacccatgtagaaaactaatgaaaagaaaccctacctcacaccacatgcaaaagagagttccaggtagattgtagttcaaagcatgaagtgtaaaattttaaaggctttgaagatattataagaggatatcttcataatcttgctatagggaaagacttttgcaacaggacacaaaaggcactactgaaaaaaaagattgatatattggactacattcaaattaagaacttctgtttgtcaaaatacaccattgagagagagaggagacaagctgcggtggaggggaaagtacttgccacatatataatcaacaaaggactagtgtccagaagacaatataaaatgaaaaaggaagcaaagaaaaacacattatatttaataagaagtcagca

SEQ ID NO: 32133 - DNA, 1470 bp, Homo sapiens
ctccaggtcagaaaagccctgaagagccagcctttcaagcccacttcttgttcagaggcccctccgcaatatccctaccatgtggacttctagccttggcctgaattcaagcatcctaagtcattaccaagccccctttcaaaccacactcttcatcctgcaattttcattatgttaaaaaagcatctgcttccccagacactaaaggccacatattgtatgattccatttctatgaaatatccataataggcaaattgatagagacagaaagcagataagtggttgccagggactgggggggtaggggaaaggggagttaccacttaatgggtgcagggtttcccttcgggataatgaaaatgttctgaaactaggtagcggtgatgtttgcacaacactgttgaatgcactaaatgccactgaacgatatactttaaaatggctaaatggtggattttacgttatgtgtgtatgtttcaccacagacatataaattgctttcttccgatccacccactagttatctacctgctccatgaaaccaaacaagtttaattccttttccacggcccacgttgttaatgtttctttctcctgtgtttgcggaaaccatcacgcacccccaccccatatctccacttctcatgactactcaccctgtgtcccagaattgtgcatctttgaaacccctgatcctgggtaccctccaatggatatatccccttttctcattccttttctgaaattatgctgctgctgggatatactgctgccgaggaatatggacagcacatgctacagaataatcacctgctttggcctgggacttggaaggtctgggtcctgactttaactctctgtgtaacctgaatggtaaacaaatcattcagcctcagtttcttcacctgtaaaatggaagacaagagggcttccaaagccttttctgactttcagacttctaacccaccacatagctctggaccttattcttgctgatgacaccccatagtgtgttcctgtttggcatccctgctatgctactaatacccactgagctggaagttaaccaggcaggacatcttcctcactagggttaagctagatcttccgcaccccaacccgcaatgtgtgacattggatttggggctccagatggaagattgcactaggatcctgattaaatgctgccccataagatggaatacaacattccaaaatgtaatttttgatcttcattgcattatctaacctatgtatatatctcttattttgctctcatagagaaatctgtgtgtgttctcaggcaagtcccttagcagaattttggataagagagggatcacagccagagtcccatactagcccactgaagatttctattctggtgttttcctcatctccagaagtatggcaatggtcctgtttatcactgttctgtttctggaactgtctgagctgagactaaata

SEQ ID NO: 32134 - DNA, 1046 bp, Homo sapiens
acccccatcaccaccaccactctaaattgtcttccttccccaccctctgtgtgaccatagggatctttccaaagcagaggtctgcaaacatttgcaaggtacccagtgacaaatatgttaggctttgtgagtcatgagatctctgttgaaactactcagctctgccactttagcactaaagcagccaaagacaatatataaacaaacgagcattgctgtgttccaataaaactttatttataataataggtggcaggtctgatttggttcatgggatgtagtttgtcccatcctgttctaaatcgtgagacatttttctcacctacacatcagtaactcttctttgctaagggtagccaatcttagccctagctttgaatcagaatcaccatggtgccctggggcctaggcatgtgtaagttgttgtagtacctggtactaagttgttcactgtacatgcccactggtctgacagctgaggatatgttggcccaaagaggatgatcatttgccgaagattacctggacattagtagtattgttggactaaaatccaagtcctgggttctttgtacttctctaggctagattagctagtaaatgttgaaaatgaaaccttggttctcagcaaattaacaggcaaggtatatattcattgtcttagtccattcctgtttctacaataaaataccttagcctgggtaatttaaaaaagaagtttattagtcatagttctggagcctgggaagtccaagatcaaggtgccagcggattgggtttctggtgagggcttgccctctgcttctggcatggagtcttcttgttgtgtcctcacaggaagaaagagacaaacactgtgtcctcacatggtggaagggagaagggaccagagtgcttgcttcagtgtcttttatataggcactaagtccattcatgagggtagagcccccatgtcttaatcacttccccaaaggctcctcttaatactgtcacattgggtcttaagttccaacatgaattttgaagagatacattcagaccgtagc

SEQ ID NO: 32135 - DNA, 1074 bp, Homo sapiens
gccaaatttgtattagttccacaaagacatgctctccctagatgagggctccttgagggtgggtgctagcaaaagccacaaggccattatttaccttaagagagttcagtcctttccatgcctccctactccagatgtgtcagcctttgtccagccattctctgcctgctcagatgagatcattttccatttgtgaaaagtgtctgagaagttcagtgtttgacctacatcatctcatgtgcccgcatgtgaccctggaggtaatgtcagctcttatttctgaagtccattgtgagtggaggagcaaaatgcagaaaggttatgtcagttgcccaaggtcccactttgtcttgtgctctgggtctaaatccaggctgggaggaacatggaggagtgaagagggatgtcgccttgtaatgaagagatggcagtgaggactctgatggtgggcagactaggggaagacctttctgtttgttttcagcttgccccttagcatctcactatcctcattgataaaatgaagctaaggctgttttctaggtcatggaggaggattctatctgacaatgtctattaattgcctagtataatacctggcatgtcatgttcaataaatactaccagccattattattgttgtttttgcagctattattgtcactgttgttattttactaatgtcggtgagaaatcaatgtctgaacttgaaatttctgtctcttcattcattgtctggtgttgtaaggtcacatggctgcaggagaaagacagagaccataaatgacaacagtggactaaaagtaccaaaaaaagaagaaaaaaaaagattctgtagaggatatttattatctaaatgatgcagctgcttgttacattctagttcattgttgccaagcccaaatatgggactaaaattgccagatctaatatttgtttcaagaaatgttggaaatctgtttttaacattggtaagcagtgtctaccaaatacacacacacacacacacacacacacacacacaaacatacacacgcacacatatatacaaatatggtgaaatactatcaaatc

SEQ ID NO: 32136 - DNA, 1064 bp, Homo sapiens
tatagtgtattcatgtcataacacactaaaatatttaagagaaaattgctttttttctgaaaaagaaacagtcttgcttacaactcttaatggaccataaatatcttgtaggccagttgcaccagtacctgctggaaatccttcttacattagtggtaactaaggaactcatagaatattccctttgcacggaaatgtaaccttgctccaacatatattttccctctaaaaaattgtttcttctagtaagctcttcagagttattgaaagaacattgcacagttaggtcaaatctatatatgaaatttcactggcttctctgttaatcttggccctatcagttgatatgaagactgaggctgaatttccttttagcgactctaaaaaattgtttctcttagtaagctcttcagagttattgaaaggacattgcacatttaggtcaaatctatatatgaaatttcagctggcttctctggtaatcttgaccctatcagttgatattgaagactgaggctgaatttccttttcgtgacctggaataaacaactgcacttgttttcctaaattattttccatccacatgcggtgtctaccatttaccttctttccctggggcattgggctagtttcatctattggtgatctgggataaggctgaattggactccttgaaagaggctggaaacaaaattttcattagttggagatacctcaaatgtggagggagactgtgatatgataatgacattagcatactgatgagttagtagatacaatgaagtgctcatttgggcattaaggtacatttatctccatcatgtgtagaaacggaggcataggcagacttgaaaacttttctgaggacacagagagagtaagaaacagacctgagattcatacttaggctgtctggctccagagtctgggttcttttctctctgctgcctttatgaactaccagaggcatcttactcatcttcatcgtctctgcctcccggcacccaaaaaataccacttcataatagagtaggttgtcaagaaatgactgttgagctgaacct

SEQ ID NO: 32137 - DNA, 1030 bp, Homo sapiens
aaagggaaatatcaaagtaaaaaagtgacctcttatttcacaattgattattaactctcctttttgggtttaaaaggagtagaaccctgccatccacaaggtgattattgcagcagtttgatgtcctgcaggcttgagaaataatctttttctttcatcttcaaccatacagatccaaacagcctccctgacccttcatctgaagtagctctcctaaagcccctactctctgtcctggtgcatgatttgatttctctcgaggcattcttcattgtcttttgtttgtttggctatgcacctgtacctctgtcttttctctagttctttgagaaggtaagctttgtgaggacctggattttgtcattgtttatgataggtctcaggacacgctacccccaaaatatgctagctctgcatactgagtattttaaggtgaaggaaactgagaaaactacagaagcaggaacatcactctctgacctttttccatttgtctaccctcaagtgtgccataaaagaattctctgacctaacacccatgcaagtaggtcataagaccttcattccagaggagttctgccctctactcacatgccaagaagaatctgaacacacaggccttgctaagttttccccaatttattaccatcaagtcatactcttttatcatccaatcatacttctgcatgactgtccgtaaaaatacacagttgtctttaggtctttatttctaaaggctcccatggcacataaaatttatattaaatatattcgttaggctttcctctcgttaatctgtattgtgttacaggggtctgagccatgaaccgggcaatgggtaaggaaatgacacagctttttctccggtttattttctatgcctcttttgtgtggggaagagaatgatgatgataatggaactttgcttgttgcttgttggaacgaatctcataagtttctaactttagttaacatgaagtagaagacgatatgtatgtgtattccagcatgcagtcagcaatattcctgg

SEQ ID NO: 32138 - DNA, 1052 bp, Homo sapiens
ttgagaacataaatgataatgttgatgatgctaatacttgctaattaacatttactgaatgtttactatgtgttggtcactgtacccaatgcattatcccatttaaaattaattttgaaatgtttcagacatactcagaaaaagcaccaaaaacaatacaaaggatggcctgtttaccttcaaccagattcaaatgtcattcggattttgccacacttgcttcatttatccacttgagtttttgctgaaatattttaaggcaattgctagaagtattttcttagctctacacacatcagcatgtatctttaaagactacgaaaattccctaattggcaatattattatcatatttctttttctttctttcttttctttctttctctcttttttttttgggatggagtttcgttcttgttgcctaggctggagtgcaatggcgcgatcttggctcaccgcagcctctgcctcccaggttcaagcgattctcctgcctcaacctcctgagtagctgagattacaggcatgcgccaccacgcccggctgatttgtatttttagtagagacggggtttctccatgttggtcaggcttgtcttgaactcctggcctcaggtgatccccccgcctcagcctctcaaagtgctcattacaggcatgagccactgcacctggccccattatcatatttcacaaaattaataggaatttcttaatgcagtagtcaagttctttgactgttttaaaatgtctttttatcattgcttggttggatcaggatccaaaaaagatccacaccttatattaggttattatttgttttagtgctgttttaatccaatattgttatgccattgaatttttttttaactgagtcagttgtcctgtagactgttctatagtacggatttgtctgtttgcttccctttagtgttacttaacttgtttctctatcttgtgtttggtgtaaagtaagttagctctaaggtgggctccagggtagatgctagctataggtggctgattatacacttaagtaaaattagaaattca

SEQ ID NO: 32139 - DNA, 1051 bp, Homo sapiens
ttcttttcctgtgcttaacccagcacctaacatctagtagttctctatctaataaatgctgtgttgggtattattaataagcagatcaggcagaagtgttgccatgttctcagtattatctatagggaaaataatgcgctgctgttaagaggctgaaagaacttcctagctccatcattatgatagagttctggataatttgaaaaccctggtgctcattgacaagtgtgtgcttgggttgggatgggagtggtacatcagagcaatgccacttcattggcaacaggatcacagggtgcatttacatttgtcagtagaagctatgttttgttttgttttgtttttctaatctgacctcaacgctttcatttatctcacacacataaagtgttttccaggttctgtattagaagtttttaactttgtgcttgaaaatagttttacactctgtaaccgtttttctttcttttgctctcacctgtccttatttctttccagtaattgtttgcaaacttatcatttagttctctgaagaaatttgaatctaatccaaaactttaaaaaattctatgattaaaacaggaaaataattcatatgtaaagttaaactgatttttttcctatcatagctcatatttagaaatgtttttgatgattgagcaaaattattaaatttgttctcctctcaataaatatgtgtgatttttcttttccagagtaatcacttggaagaatacaatatatatggcttctgatttacatttgaagcatactctgagtagggttgtggatagatttataagcatgttgaaagaattcgcatatgtctgtctgtatatttttaagaaaatgttgtttctctattgaacgtttggagttttttaatcctgtgaacatcatgtgaggttatatgaggaaaggactctttgaaggtggtaaagtgatgagatgaagtagtaagaaatggagaggaccacaaggaggcacagccaaagtgccttaggtatgactcagatatgacttgcaggaaagcaaaaaagcgggggtgggg

SEQ ID NO: 32140 - DNA, 1077 bp, Homo sapiens
caccaaaatttctgggagaaatcttctacagaatccattccctctgtgtgtctcttaagagctgtagccaagagaaacttaaagaaataaggcagaaatattgtacactgaacccctgccctgccaaacctgactcaggaagccctatgtatggaaactgcataatgctcttggcatttgcagagctgtgctctcagataccttccagaagaatgacagtgtgtgaagggggcaggtcatgactattttttaaaggacgtaaatgagacttggttgtgcctgaagcacttccacaacttaaagctggtatttcacgtgtctggacattatccaaaatattcatcttggccagctgacaggaatgtttactgagtccttaggagccacttgtttggtaccttcgaagctgcctagaaagagtttgtgttgcgtgggagtggggagtgagtgtaagctgcagcatcagctccgagttagccttcccgttcctctaagtgctagttgtgtgactgttggcaagtcatttaacctctctgagctaaagtttgcatccctataaaatggtgaaaaatctggcccttcaacatgttggtttccaggattgaatggaatcaaaaagctttctctaaatgccttgtacactggttgccacgtggccagtgcctagaaaatgttggtttcctctcttctttcttcattgtttgcaatacagtttttcttggtgcaagtgctaaagcaattaagctctgaactgcaccatctttatgacacagaaattggctgagagcctcagaaataaatctgagaattggaaaaaaaaaaaaaaagaaagtccatcaccatacatttgtcagttggcatctccttgctttttctagttagagtctttcatagtagagtgcttatttctttttctcatccatgtatgtaggacagtgtttgacaggcatttttatgtgtgtggtagtatggggaaagtgacaaaaagaggcccactctagatgtcacttccctgtactgcaagctggagttgacaatgaaatccctcctgaagaaccccagtggtgttttggagca

SEQ ID NO: 32141 - DNA, 1139 bp, Homo sapiens
aattttaatttgtgtctgtctagggataagaacttttgatgctttgctcttcaaaggagtttaaaacataataagggagagaatacaggacatgaagttagagaagtggcatgggagaggtaataccatagaagtagaggaacaagagaaaatttccatccaacaaaggttggagaaaacttccaacctttgttccagtgaacaaaggtttaacatttgtatgggtgcatcagttaactgtttcataaaactcatgtgtaccaaactgtccccagtacttggtggattgaaataagagtcatttactctgattcttgtgtctgtgggccagcttggcttgttttgactatagggtgtgagttaagtccatgtgtctgtcaccctccaagacccagcaaaaaactaagacatctgcttctcatagtgaaagacaggaatgcacatgacattttaagcccctgctccattcacatgtcttaagccaaatcaagtctgatatcaaaggaatgtgacagtatactcctctcaggaataagaagtaaagagagagtgaatatttactgaacaacaatctaatttacttcagtgggaaatacagggttatttcgtatatctggtgaacttgttaggaagtagcagtgtttatattgtaaaatcaagctggaggttgcaggacagaggctagaattccagctgagaataatattacaaagggcaggagtggagtgattttttccagtgagtcaagggccacaggttggtcaagggaaatgggcactgaaaatacctttccagaaacacttacttagtagggtgacttcggtagatcatgagaaaatagatttggtagaagattaaaagcaggaagctgattgtttggggctgaaaacgatgaggggttagagaagcaaggtaattaatatcagcgtctcttttgaagacataaagggcagaagagaaatagggttttgaaatgagagagagcaaacgtgagacgaacataagcatgtactatgagagcctatattcattaaagaaagattctggggctgtttgttgtcccaggataatgagtaataggtgatagatacagagctgtcatccttttctctcttttaatataagatattttgtaagat

SEQ ID NO: 32142 - DNA, 1045 bp, Homo sapiens
ggctccagatcaagaaggaacactcacttttttgtattaggaattaagaattcatatatgtaaagcatttagatcaatgcctggaacacagtaagcactacataagtgatggctgttgttattgttgttgttccattcattttaattcatatatattcgttattctgtcatctctaagtgggttctatggtttgaatatttgtgtctcctccaaattgcatgttaaaacttaatccccaattcaacaatattacgagatgttgccattgggaggtgatcacttgtttcctccgaaggagctgccaacaagttaccattttggaagcagaagactaccctcatcagaaacaagatgctaggaccttgatcttggatttcccagatctgtgagaaataattttctgttctttataaatcacccattgtcaggtattttgttagagcagcgctaatggtgtaagacagtgggtaagcctttcatccagcctataatggaatgggattatttttgttgctgttgaacttgtgttattatttaggttcataacccagaagcttgtatgggtgactagctggcctctttccgtccatttatccactcaaccatccatccatcatactatatgcatatttattcatccaacatttgttgagcttcatctactctgtgctgtgtagtggatgtacaacaatggacagggaatcatggttccttcccccacagaactcatagtttattgaggataccaccaacaacaaaaaaaacccaaaaatatactaaaaagtttaataaagttagagtaagctgtggtaagtgctctaaagaaaataaatgtgtcatgaagtcaacaaatattaatcacttgtgtttgttaagacctctgattataggtcttcataagaagtgtgcttggagtgttccctccacatccaaaatcatctcctgtggaaccgtgtggaattatgcagctagctgtcaaacattccccaccaaacaagagactatgtctcataaatgatgatttctgcccttgccattagcgtt

SEQ ID NO: 32143 - DNA, 1049 bp, Homo sapiens
agcatgattttgaaaatctcttacattacctctaaagtactatgtagataaaatgttgcttcgtacttctaccatggccagcctgtccttgcaacagatcattatttcttaggttgagaaccagatgaagaagttgacttgtgttctgaggccatgtcatacaaagactgtagatctttatgtaatcaaaactcacatggtaccaagcagatataaccaaatcaatataaaccagttacaattatgaaacaagtacactgtataatcatttattctttcattcattttcattcatttaacagatgtgtgttcagtatctgcaacatactggcatagcttctgagaggggttactgttacttgattgcagatgtatctagagattattgtcgtactattccttaaaatgcctttatttgtcttctacgactcaccagtagtggagcctgtgggtagcagccaaccagggggagactcctgacttaattagcaggttggaggtactatggtgtatttgtctgttctcacattgctgtaaagaaatatctgagactgggtaatttataaagaaaagaggtttaattggctcacagttctgtatgccatacaggaagcatagcagcttcggcttctagggaggtctcagcaagcttccagtcatggcaaagggaaagggggagtgaggcatctcatgtggtgggagcaggagaagaaaggcaaggtgggaggtgccgcacacttttaaacagccagatctcatggtaacttactatcatgagaacagcaccaaggggatggtgcgaaaccattcgtgagaaaccgcccccatgatcaaatcacctctcaccgtgccccacttccaacattaaggattacaatcccacgtgaaatttgggcagggacacagattcaaaccatatcatacagtaaacccaccaaacatgccagtctcttctttataagagtggctccagagaagaatgttctgtgccagatcacatggatgacactctcttccttcctcaactccttgtcactccaggtgccaac

SEQ ID NO: 32144 - DNA, 1042 bp, Homo sapiens
tgatttggggaagtacgagaaatacatcattggtttaattttggctgctactgtgggtcagtagccaactaagaggagaaactgggctgtaaagaagaacttcacctgcagaaaggtcagatttatgcagaaagccagcaggcaaagctaagaacatgtcttccaggggcctcaagttccattttcaccttttcttcttggtaagtctcagtactataggatacttaggtacacataagccattttctgccgcatttaaggaaaccattaaccacttgcttctgttattctcttcatgtatattcagcccctttctctgttctgctttgctggacctgttgggatttggaggcctttggaacataaaccctaagggttgtgattcttctcattatttggcccaagaaatatctctatttactctctctttaggaataagccagacatggaatttttttttccgttccctaagactcacttatagagtaaaagtgggaaatatttcacttttgggattgtgttttatggagtttaataccctctgagatgcgtgagatgacatgaaaagttcaaacacaaactctgctgataaattccttgtgtgaatgacattaactgaagagctaatatttcttactgggcttttatgctgaagttagaaaatcaggcccattttaatatatgagatgggggagaaaaaacttcctggctgaaacagcattttcattttatcactgtaatctctctctctccctgcccctacccccgtccccctcttttacagcatctagagcagaattaactgtttgtgaggctcttttagttaggaagctcccagttagcaatgcagaaaccagctctgcttatctggtgtgaaaaagaaaattaccagattaacaatgagaactcaaatcttagaaaagagaaggaatggctgggcatggtggctcacgcctgtaatcctggcactttgggaggttgaagtgggcagatcacttgaggtcgggagtacgagaccagcctgaccaacatggagaaaccc

SEQ ID NO: 32145 - DNA, 1051 bp, Homo sapiens
aagggagttcagattttatttctgatgcaatgaggagtcataaaggggttttaagtgaggaagggacctatgtgattggctttgagaagagataggaaagcaagcagtgtggagaatggactgaggagggcagaggctaccaggtagaaggctgctgtctcagcagtaggggaagatgattggagtctctcctagactggcagcagtaggggatactgatgagttcaggcttggggacaggattgaaagagaaatcaaaagggccttcttaggcaaaagagaaggagacatatctgtgggtgccaccttatagcagggagaactggggggaaaggctgtagctgcccttattaggtaggaacattgttttataaaggacacagagcataggcagttttcttgacaagctgataatataatgggatcatatagtgcttacgttacttgaaagtgtgagattatatgaatctgtgcgaatatgagtattggttaaaaatggagttggacctctgtatccatgggctctgcgtgtgtgaatttcatccactgtggatcaagaatatttgggaaaaaaaccataaaaagtaatacaacaataaaaataatgcaaataaaaacaatatgttagaataactatatagcattacattgtgttaggtattataagtaatctagagatgatttaaagttaatgggaggaggtgggaaggttatatgcaaatactataccattcatatcagggaattgagcaactgctaatttttgtatatgcaggggtcttgaaaccaatccaagggatgactgtgggtttgtgtgtatatatgtgtatatatgtgtatacatacatacatgtgtatgtatgtatatatgtgtatatatacacatatgtatatatgtgtatatatacacatatgtatatatgtgtatatatgtgtatatatatacctttctactggtttattgtcacatatgtatatatataaacatatatgtatgtatacatatatgtgtatatatgtgtatgtgtgtatatacatgtatacgtgtcta

SEQ ID NO: 32146 - DNA, 1038 bp, Homo sapiens
ctttaactacggtgtggtgtaacctatatcaattcagatgcccatgtctgatggcctcctttgtgtatgcagtctggtaaatctcccttaacacatctatccaactaatatttgtgattttaaataaaagatgttaccaagactatatatgatatttgtaaaatatccaaagttaaaattctaccagaaaggtaaagtatagtttgctaggataaaaataaatactatacagattctcccaaactgtacccacacttacatttcactaggtaatgctagaaaatggttattttccctattttcaaacaattgctgcatccctgacttgtgcaaagtactatcatccagtttgaaagactattaccacatatgccatttatctatccatatggcatgtatagtatgggactctagggtttattgatatgtgtaatgtataacactgaggaaataactgccatttagcatttctttttccttttcgcctctggaattgtaggtttacatttattttcttgtgaatgtggctatctcttcatgggcagtaaatattagtattttgggaccctcctcttagtcttaccaggcaacatttgtttgctttgtttcctccattaatctagcacatcccatggaaagaataatttactattaaacccctgtgaggaaaccccttcaccagtgaaaataacttagtgataattgatttcatcagagccttccaccttgattttccactgtcctaatagtggcctggcgaagcacttgagtcccatggtgaaagaaagaaatgcacaaataggcctagacttgtttccccgaggtcgttcgacaactgcaccgttgctccatgaggcacacattcagcaattagcaggcatatgtttccagctgactgcatctagcgataaagagaagctccgggaagatagcctaactcaactcctttattcttagggggaaaaaaatttgctcagggtttcttggctgtttccttgctctttacttactcttttgttattacataaatatcagtgt

SEQ ID NO: 32147 - DNA, 1029 bp, Homo sapiens
tgactccaatatattttatacccaaggagaaattacagtaccgtattcctaacatcccattaaatgcttaaaggcaggccgggcacagtggctcatgcctgtaatcccagcactttgggaggccaaggtgggtggaccacctgaggtcaggagctcgagaccagcctgaccaatatggagaaaccccatctctactaaaaatacaaaatgagccgggcgtggggggcgcatgcctgtaatcctagctactcaggaaggctgaggcaggagaatcacttgaaccccagaggcagaggttgcagtgagctgagattgcgccactgcactccagcctgggcaacaagtagcaaaacttggtcaccaaaaaaaaaaaaaaaaaaaaaaaaggcttaaaggtttgccttttatccagcctaaccagtggtggcaggatggctgcagaagctccagcagaagacattatttctgctgtagacattacaactctttcattatagctcctgtagacatcctgagagtcaccctgattagaatggattaggtcatgtgtctatcccacagcaaatctctatgggtaggggggtaggggggtaggggcataggggagtaagatgtgcctcttagcttggcctgaggcacattcttcatgtctaaggatggaattctactgcgaccttatagactgagaggaggagatgattgaattcccaaatgatgtcagggttgttgctggaggaggaggaaaggggctatggggcaacagatgttcattgccctttgatggcaccgcagcaccttcaggctacctaccctctaaagcatcttccagataccatggagctccggaaccttaggtttaatggcagatatattttgatcaaaataccatatacttgttttctcatttgctttgtgcttacaaaggacaaagacaaaaccctagaatagaattttgcaagacaactccatagaagaattacccttttgttttcaatacagtccatcaacattgatcctgaaaaaaaaaaa

SEQ ID NO: 32148 - DNA, 1048 bp, Homo sapiens
tctgtgtcttaataaacttgtcagttgaggttacattattttctaatatccatcacggaaacgtgggatggtgcagctgggcaaagatgtcaggtcgtggtgtgtgtttttagatgggtgtgatttgacacatcccagcagtgccatggctgcatggcaatacttgaaagaacagcctcttcttttaattagggccctgctgccattttggtgggatgtcattctgacacctgtttgtgctgtgggggctgctgataacctctcaacacctttggcagaaagttctgctgatgtgttaggtgtttggttaatgtccatcctgccagggattcatttcccctgacctgaactctgctggcattattttttattcaaaaaagcttcagcagtcttccactagctacctacttaagtttatgatctcccaccaaaccttttttagggagaaattccaaaaaaaatgtttttgttggaatcctgctttgagccaggcatgcccctgaacactggacatttgagggtgagcagaagccagcactgtctctgcctttaagaaactcattttcacgtggaggagatggtcaaagaatgacagaagcacatcctgtgctctggagccagtgctctgaagataaggaaagtgattctaaagagcaatagatcagtgtttcccaactaggagtgattttgtcctctagggacttctggcaacgtctggaggcatttctggttgtcagaactgaggggtaggtgctaccagcatctagtgaatgctgctaaactttccatgatgctcggtgcagaccccacaacaaagaatcacccggccccaaatgtgaacagtgttgagggtgagaaactctgctgtaaaccatagaaatctggcctggccagggatgctggagaggcttcctccagggaggtctgaagggtgagcaggagtcagcaaggtggcagagatgggtagggaacagttttcttgacaggggaaccacatgtacaaaggaaagcacagggggccttggaggaacagaaggaggcttctgtg

SEQ ID NO: 32149 - DNA, 1032 bp, Homo sapiens
gcttctaacttggtgaacgatttgttggtgatatcctaatttttagaggaggtagaggtgttcttgttgcccttctgaaaaactgtgcatttctcattttattgtccattgtagaatatgtgtataaatgtgcacagcttttatcttctatcttacctctcctttctgaagtatgcattgtaactttgctcgtattgccatttagacttcccaaagagtcattatgttgagtaaaaataatttagtcttttctttttgtttggcttaacttttcttccctcctaccctatatcttttgtcttccaagatattataactaggaagagttagcatatataattatgctattatctcagaccctgagataccctgtaggacagattcacaacagagtcatcatttccaggctaatagcagggggttcaccctattcagcattccacattttcctctgtaggcactcacattagttttatattttaggtagcaatatgtgtagtttagctttgtgcaaacatattaggagtagacattcagtgtactgtgtcctggttatctagattctaaagcttcattttataaaaatccagctctgtggggaaagaggggtgttttattaacatgcggcattaacactgctgggctctgtggataggttgacatagtgtcatcgtcacagaagataaaattcgaaggagcatttgtggagagcatgcagtggatattagaacaatatctcaggattttatggtggtttaatcattatccacccctatcctttcgttcacacagtcaacctatattttttaaaattcactacgtgccaggcactgtgttaactgctgtagtgactcaaatgtatgattgcatttatatgagatatccagaataagtaaatccatagagacagaaagcacgttggtcatttctaggggctggggaaaaagaaaataagaaataactgctgagtgggcatggcgttttattttaggatgatgaaaatgctttggaactagatagacataattgtgc

SEQ ID NO: 32150 - DNA, 1049 bp, Homo sapiens
taggctgttgcatatttcggatttgtttttcagagcatcatgcataaggtgattgctatgatgtatcacaggtagagatatatataggagggtgtacctccatttcttttggagtcagacatgtaacaacttaataaatgctaaaatatgaaggatataactgtcagaatgagataatgtgacaatatcttgaaggctataaagagctatggaaatgaaaattaaagtcaataaatgcaaaagaaatgcattgagcttttcactttgtgagaccagatcacaaatctgtatgaagattttcaattttaattattaccaagaggctttgtgcttattaaacatgtctttactaacaacctaaactctactctggtcttctgttgatgccagtggtaatagggggtgcttctgacattagaccaggccatgaatcctagcctatagctatatatccttgggaaattcctttacctttttgaacctagatgttcccatctgtaaaatgaggataatctgtaatctggggtcaggcactgtggctcacacctgtaatcccagcactttgggaggccgaggtgggcagatcacttgaggtcaggagttcgagaccagcctggccaacatggtggaacaccgtatctactaaaaacataaaaactagccagatgtggtggtgggcacctgtaatcccagctacttgggaggctgaggtgggagaatcgcttgaacccaggaggcagaggttgtagtgagccaagattgtaccactgcactccagcctggtgacagagtgagactcagtctcaaaaaaaaaaaaaaaaaaattaaaaaaatttgtaatctgtgtaatgattgtagagagtaatagtaatattcctggtgcaactttattttgttacttctcatagctggttggtaaatggtaccatcaatgtggcagtttaactcatggtactttaaagagactgtaatttttcctactcaccttcattttaaaatagaaaatttaaaaatatccagattatcaaatataagtaaatgcttactta

SEQ ID NO: 32151 - DNA, 1043 bp, Homo sapiens
ctcatggttgaggattttaaattttgagaaatctccatttttctgagtgcagtctggtgtttacaattctaccttttaagcaaaatgtcatccctttagttttcggtcatcttaccccagtgtcatttagaatgaatgattttaagaacacagagagaatattctttcactggcagtggaagtggcagaccaatcacttcagtagaaacttgtgtcattcaaaattatgaagttcatataacctataaacaattatttgaaaaagctcttaatgtggatcgtggttacgaaaagtcaaaaccaaacatgagtcacgcagcctgtagttatcagttctgctttcacggatggtggtggaatcattttagagggtagaaagttaggactcagagtgtggggtgaaataaagatacatatccagaagttcagatcctgggcaggtaagcagcatgtagggtaaaggtgtcaaatatgagatgcaggcaactctgctaattgaacttggaaatcccatttacttctgaatgccctgtagagagcatggctcaactcaatctctgtgttgattgttcatagatcagatgcttacctctggttacgtgtccacccatacaggagaggtagagtcacagaacggaaactcctccacagccatttgggaggtagggagatgagtctctgttggctttcatgaaaggcatctgccataccccatgtctccagccacagcattcatgctgagtcctaaacctacatctgcatttgtctccttgctttagggctttcagcagccctcagtttacctttttcaaaggccattgaacttttgcctgtctatcctttaacttttttttttttttttttgagacatagtgttgctctgttgcccaggctggagtgcagtgacgtgaactcagctcactgcaacctccgcctcccgggctcgagcgattctcttgcctccgcctcctgagtagctgggattacaggcacccaccaccatgctttggtaatttttatatttttggtagagacagggtttc

SEQ ID NO: 32152 - DNA, 1028 bp, Homo sapiens
cttctaagaatacattacccctaccatgtccttaccaaccagtatcttgagttttcatgttttgtaagcctatagatttttcacacattctcatgacaatgccctaaaacatatcagaatgacctttttatagaaacaatgagtggaactcacatacgaattctataggtttctgactttttaaaaagcaaatcatagcatttttattgagtgtcacggtagtcacatacgttgttctcatcaccgccatattaaatagtatgatttgtcggcggggggactgtggggtggtgattctaaattcgctttatactcttagtgcagctggatctaagaaaaacattttaaagtttatcagaaactcagtataattcagaacaaacaggattaggtttggaaaaaaaatacagatatagtaagaaaagtgacccatatagaagcctttcgaggtctgttggaaggccattattgaaaggaaggaaaggtgtaggttgtcagtggtggctgattgctgaatgactggacacgattgttgagatggctgtcttatattttgtatatcaaaataaaactttctagaaattttcttaactaaaagtaaatattctaatttctaaatttttatattgactttttcccctctttttttctggatgtttattggtacagagacacacacacacacacgcacactgacacactccctacttatttaacacatttgaaatagcactttgctggatgaggaagtacatatggtcttcctaggagtgttctgagacttttttcaaatggtttttcctttatcccatatctctaaagatcactttcatcccacttagttgtgtatgtatgttttcacacacatatatccttttgaggtgggtctagtgggaggtatctatttttactctttaccgaggtaagggtttccatgaaacaatgcaaatatatgtgaaattaaactagaatagtaattgcaactggagcgaactaaaaagtacagtggacaccaaattaaattaata

SEQ ID NO: 32153 - DNA, 1031 bp, Homo sapiens
ccacagaaggattacgaggggcagaaacccagaatttgccagaaaaatcttcaggagcaatgaaaacccaaaataagcaaagccagatgcagtaggaaattagataatttgtgaacaaaatgagagtaatgtgggtagatagaccctgggtaaataaacaatattaacttctaaattatttgattcagccttggttaaaatggtagtaaaattcagtgatttccagtttcaccagtgcttcatgagagcctttgaagaagttctaggaaagaatattggaagaatacaaagcattgactgggtggcccttacctttgtttagaagcaggataagaaaggttaatttatatatgtatgtatatatgtatgtatgtatgtatgtatgtaggcagtatagagttaagagctcagaccctggattcaaacctcatttatgtcacttacttagctgtcagatgcagggtaagttacatatccttgggctaataataatagtaactaaggctgatttctaagctcttagaaaagtaccatatatgggtttgttgatatcacagtcatcatgactgtaattagtattgagcacatattcaccatcttgtcattgcaaaattgttagtcttctgttaagaacttttctgtaagatcgaaaggtttgttttaattatgattttcaagaatctttgccttgaaagtttaaaggccatatgtgtttgttattaaagataacatttgttagaatgctttcaaagaaaaaattgttcatttaaagctgtaaactatgtttgtcatggcaagttgaactttcttatcaactgttttataattgacacattgcttatgacctagctgtacaatcctgttataattctcttagcagtatataagaattaagcattttctttctaaggtagcaacattacttgaaagctttgtttcctacataaaatatatttaactacaattttaagtattcctaaaggatttaaaatgtagtatctcattctttcacaagccatagtttaatttct

SEQ ID NO: 32154 - DNA, 1013 bp, Homo sapiens
ctcctccccgttgaccctccgacaggccttagtttgttttgttcccgccatgtgtctatttgttctcataattcagctcccacttacaggtgagaacatttggtattcagttttctgttcctgagttagtttgctaaggatagtgacctctagtttcatccatgtcactgcaaaggacatgatctcattcctttttaatctgcatatatttttgagctaaagcatgagacatcaaagaaatttctgcttgtagcagtctactttacctccaccttccttgtcctcctcctgctcccctacttcagtgaagcaaatgttaatccctatgccatgttactactgtgaaatgtttgagaagcatgggttagggcatccacagcagctattatgttgaacactctatgaaaagccacaatccagggtgaaagagtagcatcagcagaggaagaaaactgggagagtgaaatgtgtggcacccacggagtttcttttattgtccatgcaggatgtgaatggacaagcagtgtaatatatgactgacagagtagatgatactcttagttttgaattccagggtaacgtttctggatttaattcatttggcaactggtgtccattgaaggttttagagcaaggatctgttaggagctaaacatgttagaagaacattttcagcaataggttaagtcataactctcagacagatacagaaatgaacctgtgttaaagattttatttaattcacaagggaagctgcagatgatataactggtttaaaagataatccaaacaacaggcatgtttataaaacaggaatattgaaatgtgtgtgaaaatggaggcaaagctgttttcttcctccaggtggcaggaaggaaggaggtcaaagtaaacctgtatcaaacaggaaataatttgcatgtcttaatattttgcattactattagttacctgtaatgtaacagagttgtaaaataccttgaagacactgaacagacctagacattgcgtag

SEQ ID NO: 32155 - DNA, 1050 bp, Homo sapiens
gagagacagggtttcaccatgttgaccaggctggtcttgaactcctgagctcaagagatctgcccacctttgtttcccaaagttctgggattataggtgtgagccacggagcgtggcttctgtgctaacaagctattagtgacttcaaaggtgggcagcagaagttagcccccaaatagcagcagtccactgttatgtagattcctctggtaatagtcacctggaagaaaatctcctataggtccagcataagtcctctattactgatttcggtttatctagtttgagacctttgaaagttgtcttttaatgccctttctatgacctattgcaagaagatcattgtcagtctgctgtgcactgtgttttaacagcagatatggctttctctggaaggataaaatccttgccggtgttcctccccatggttctttgtagattctttctctttttgccattaccttcttcgccccatccctctttcacacttggaaatggccaaagccgaactaatctctgaaactgaatattagagctctgcctagaatcttggcccatttttatttgagcttttttcctacctcatttttgctggaaaatccttccatttggcttttaataggggtcatttgtgaacaatatttcataaccagttacagatttcaatcttctgcatgtgtatgataatttatagtccaagtgcttttatacttgaacatcttttatgagttctactgccttttccctgaaaggaaactgctttcctcttcccatattgcaggtaaggttattgaggcaaatggactggtgaaaatgtggaatctgttttaaaaaggtagaaccatgtcactgtgcaagtaatagaaactcaaagtaactttaaccaaaatagggattgtatgtgaaggacacaaatgtgtctctcactgcagcaggaaagagagagggcaacaaagcctcactgggggaggcaagcaagaactgcagttgtggtcggagtctgtgctttggccttctttttctctgtttgctgccttctgtgctggggct

SEQ ID NO: 32156 - DNA, 1067 bp, Homo sapiens
ttgaaatttataagggaactttaaactattttcaagttccaaaatttgggctatgttcaagtgttctagaataaagccattctttaacagctgacttttaaccactcttttcataggcattcaagagactgattacttttaatctcctttgtaactaaagaagagccaaaatggcgctcacctgtctgagacttccttttggtcagggtttttgtgcaggtcttgaatgtttcatttacttctgaatcagcaaaatgtgagtgctttgtatttgccatattagagagaagtggcaaagcagtgagccaagaagcagccccaacttggttcggcttttcagattacataggagtgcacagcttgctgctgatgtaaagcatgtggagagagcccatggagaattagttttctttcatgattgaatgctaatacttggtagtatgtggaaaaacagcttcttgcttgtacaggccaacagctgttgttatctgaaaaataatcattatgatagaaagcacactttttcatgttttctgtcagatctgtcagaatatgttctgtgttaacatatgcatgtttcatctgagaaaaaaatgtaattggtaatttaatgtatttttaaaaatttttcttagtggtaacttggagcataccattttttttaagttctttaccagcactgtctaatagaaagtaggtcaccaaagtaattcttacatttaagtaaagagaaacaggcataattaatttaatatagtttatccaacccaatatatctaataaattttaaaatgtggtcaatataaaaacaagaggtttttgtgttacttttttgtgtgtgtgtgtgctgagtctttgaaatccaggacatatctaacacagcacccgatttgggctaaccctgtatcaagtacccaatgatgatgtgtggtgattggttaccctcctgaaccgcatacactgtagatgctcattcctggcatagtgtttgaatctgtatgtttgaatcatagtgtttgaatttatgtgggttgtttgcccatgtaaatgatgaactatcaaatgcc

SEQ ID NO: 32157 - DNA, 1051 bp, Homo sapiens
ttcataaacctaggatgagaatctcagaccctgtgttatatctgccacactatggaacctagcagtctattcagtgacttttaaatcctattgagtgatcagctgcctgatatgctatgcaaagagctctctctgctccttaaacattgctcatgcaattgtgtattcaataactacttactgatagatgcaggatgcagataaaaggagggtcctggagaatctctgacccaccctcacattattgggagaacagggtgaagccaggggaagttcacctcctgtgcagtggggaggagcctggcatcttcaggtcctgtgtatggcttggaattcaatgtgtgaggtgatggcctgttagcaggatcccctcttgctttgctgagagttttttttcttttttctttttcacccaataaattccaattcccttacccttcaatgtgtccacgtttctaatcctcgctggtcatgtgacaagaacctcgttttggctgaactaaggaacaaaattctgcaagattactaagacccatgccacgtacagggttctgacccaggcggtgcgaatatttccctggtagccttacacacagcctttggttacctcgcactaaaatacccatgaagacacaaaaagaaaaaagaaattcactgtaacatctgttaagttggaagtcaatctaagtgtagaatttgggaaagactgttgctaattataaagcagagagactacatagaggcatcttctcagagataagcatatagcatttcctaccttcagtctattaaaaaaaaaatcaagagggagagcaggaaaaagcaaccaatggtgtgttaccttcaaggcatggatcccaacagagcttagaacgcagtaaaaagattttctacaagtaattatgatttgtgatagaaacacatttttctcattcaatcctgcctttgtctccacgtgggcctggttctccaggcttctgtagagtttgtgtatctatgggttttaaatgcagtgcttatttgaacagattttaatttctcagtttttatt

SEQ ID NO: 32158 - DNA, 1030 bp, Homo sapiens
ggagagtatccacataggtccaagccatcatgaatacttagttctcctcctagttgaacagtgtgattgtaggtatttaacaatagcaggaattggtaaagaagcttattcctggctatgagattccttgacagtaagctgtagaccaggaaggtcagtagttctcatgctgtctctaattgatgagttagtgttacctggtgtgctgtgttggaactcactgtgaggccctgcccagcttcaacagggacctgtagtaagatccaggggaatacttgtcatggacacgtactggatgtccctaataggaggacaacatatatcatctctgttgtacacacttagtaatttgttcattaccagtatgacacaaatgatttaaaatttgtgaagtatggggaaaagggattaggatgttcctaatcttaaataaagcatatgattttcataaagtttactttaaagcaatttatagtgtttatacaaagggaaatttgctaatgacattgccttaagtaacatctgggatttgtttttaaatagttttgtgagtgatagtggaggtataaatgattcattatatcattctatgtctttgaaattttttatgataaaaagaaaaaatcttaaaatgtagacttttatgatatcttggctaataaaattctttgaagtgggtgatggactgatttgataccagtttccaaagagtgttagaatacagttttcgtgtggcttatttttcaattagaaaaaaaaatcttgaaagatacttataaatctagctttattaactttcctgacaaaccctaaaagtcaacacgttatcttctaacaagtttggaggcgtctctaaaatacagcctgtagctatttatgtagtttctcctcactgttcctcctccagtgtttgccttttatggcctcaagagagagcataatctgaaataatttctaggatgcaaacacattgctgaagatatgggctcatggaatgtgttctctgtagtactgacacgagtgacttttc

SEQ ID NO: 32159 - DNA, 1027 bp, Homo sapiens
ttttagcttcctggaccaggaacaaaggtgacatcatctttgggaaagcacaaatgcttaaacatgtgtcttatttgttctacataatggttttaaaaattgtgacgttacgtacaattttggagataatatgtagaaattgctatttgtggttccatttaatatgtatatataaaatcatgggagtttggagctctacccttctacatggcaaatattggttagagattagtagctgaaacccacttttagttgggatatgggcttgccagttcagtgccatctcccactactcagaagccaagtacacatgtacactattaccaagttttccctgcttgcttactatacctgccctggcttcttcaggcatctgagttgggagtctccaggaccctcagttccccagttgcaactgacattattattttaactgtggtgcttgatcctttcactcctgatgtaggtatgggagtgtgtactgtaataatctgttaattttatttctgcagaacctagtcattacttacagcatttctggtgagtggctcctacaccaataccaattgtcttctattgttttatcaaactaatgatctccactgccttaattttagctgttccagccagatagacaagagaatgaatcaggaaattctaactgcttgagaaaacagatgtcaacataactaggttttaccctcatggagttgacagtctggaaggggctatgtgatgttagttataaatatgataatcatatatgatttacggtaagttaccttatgaattcagcaatggaactggctttccaacatttttaaaattgtgatttctttagaaaattttgtccaagttgtgtaaaatttaaaaggaaatattgatctttgaattgctttttctcaggaagctatgtttgctgaagtccttatatatacgtttattaataaacagtttatctttggaggcttgtatatttttggagtttagtaccttctgaaaaacttagacttacaatgaatctttt

SEQ ID NO: 32160 - DNA, 1237 bp, Homo sapiens
ttaactggcattgaattcttgttctgataactactctgtatctgtttcttcagactgggttggcttggggctttttcgagaatcatcttatatcagaacctaaggagatactaaactgagtctgtttttagcagggtataggaatgtatgccttcaaatcctatgccttggattttcatttttacaaatctgatgggccacatatatgggttggaaaagtttaaaataaggataggaataataaagtaagtcactaatcagtctgcctttcacaggtaatgactaatactattaatgtgcatacttttttactatgagtttatgtatgctttaaaaataaaataattgtattttaaacaattttggtgccatttttcatttaatatgttacaagcatgtcatatgtcataaaaattaattatagcataggagtctattgtatcacataccattttttatattgccacttttttatcgtgagacatttggattctccagcccatcatcgtgatagaaaaatcctactacataagtctctggccatctcttcttgtttccttagagttctaagaagtagaatagataggataaatatataaaatttgttaaggttttggggtcatattaccaaatttctctctaaaaaagctatcagctgaacaggactgtatgaatgtcaacttctttacacacttcttataaatttttaaaaattactgcaattttgaaagtgtgtctgtctcattttaacttgatttttgcttgagattgacttttttacagatttgtttttcagccactcaaatacttctgggaattggctattctgtatcatttctaaagagttggctttatttaatgttattaatttgtaactttttctaacaaaagctctatgtttgcatagatgtttaaaaaaataaaaaatctcacttttttgtttgattaaggctactatgccaagcagtattcatgcttaatttgttgtctaaattgattagacaaagaagagtaattcaggtttagactcaccagcagaaggagatgtagggaacacctggtactgaggttcaggttctgtgtgccctgagggaaggtaagaaattccctttggcagttttcactcttaagcctttttagtagaccctctactgggcagagcacttgatatgtagtatactttgtatagtgcataataatcacctaagcagttaaacttttaccaaccaggcctggg

SEQ ID NO: 32161 - DNA, 1098 bp, Homo sapiens
gcgatcatgctcttcctcattgttggttttgttgtgctcaggagccttgaacttgggcaagtaaaaaaaccacagttgaactcaatctgttctacaatggaggatgtgcttagtatggcatgggaaactgtttcagaaggctctgctcggttacttttgcagcgttgttataggctgatacagcaaatcccaagacttggtaaatatccttcctgaacaaacacaattttaaataccactcataaatgtaacataaaattatttcatgattatgtattttagtttctaataattgtcaagttctttctctggtacagtgtgaactacagtgttctttcatggcacagtgccagttattatttttggatctctgaactcattgatacaagccctttacaatttcccttacgcttcttgagtttgggtgttgatttgataatgacccagtgattaaacaaaatcatcataaggagacaaagataaggaacaattttcactaaatggaagtatttatgtcattacctactctctaaataaggttacaaatactagacaaaggaggtacacctgtgaattacaacataaagagcttctgaattgaagagttacttcgttgacatttgtcatctatttgtcaagataaatttaaaaaaaaatttgtgacaaaaactggaagaataacctattgctgttttggaagtaatttgttctatttgtagatagctgctgctgattgtttctttgcatgtccattgagttttaaaatctatttcactttgacttcaaatttagtttttttaatagcaatttttcatttcatttaggaacattaaaaattgtatgcagccttttgaaattttttaatcatgcaatgtcattttcttgctttgcttttttttttctcaaataaagccatctgtttagtaaacatggaaaatggattgatatgcaacccaaaaagttcataatgacaactaaataacagatgacagattagataagaagaagtcattaagttggcctataaaaggacagccatctgtaccactaaaacaatcttccaattgatggcagtaataattttctgagtccatgaca

SEQ ID NO: 32162 - DNA, 1050 bp, Homo sapiens
ttattgagcatttacaacacacattatttaatataaatcttccatcaattctatgagttagttaccattattactccattttatagatgaagacagtcagaaaggagaagaataatttccccaaagacctacaactagtgaagacctgagccagattataacccagttcacctggctccaaaaccaagacttttgattgatgtgccataaatgcaggggctggcagagaaatggataagcactagaaagtatagacctaccatgttgtatctgtgttatcagccccttctttacttagcaatgtttattagcctttcactatgctctttctgaaataaagctgattttgtttatgtcagaacactatgaccttagctttttgacctaggctcacagtaatatttgctcaatgatcataattcattgtgatttacgtcttaagaatataaggaacacctgagatctttgtgccaaattcagaaggaatagagtggttttgttttcttctttgcttttttcttcctcatcttccttcattctgactgtagtccatccttggtttcaattcatggcaagttcacagaacctagcaataggttaaggaaaggaaacttctcagccaaatacatctctagtatcaaaatctccaaatagtggctggaaaggattgttctctaaaatgagttctgtctttagaatattttaatctattttatgtcacaaatatgtattaagtgcttgttatgttgagggtgctaggtgcagtgaagaataccaagctaagtgaagtgaactttgccttgaagaatgataaggtgcattgccttctttctcaaaacttatgtggttctccagacagctggaggatataataaaacacaaattgctaaggcctatctcctgagttttgattccagaggtttgggttggaggtctatagttcgaacttctaacatgttcccaggtgatgctgatgctgctgtacataatacaattatgagagtcttttatctactgggagaaggtcagttctcacctctgagccagtat

SEQ ID NO: 32163 - DNA, 1051 bp, Homo sapiens
gagtcaagggaaagttaataaaattggagttactattgaataggtgaggtgttcagctctgttcacgtaggtgataaaaatacaggacatgtatctcatgtacatgataaaaatgtatctcatgtttctcatgttgatgatttaatttgctgaatgcttaagtggcagacactgtgatgggataaagaggtaactaacacactgtccttatccacaataagcacacagctcatacctagtggtgtcatgcttgctagaaacaaaaagtgtggtgagataaattaatttgttctgaaaatgaaattaaaacaacacattttgttaaccctctccaaaaaaaaatccgaacagaaaagccttcatgtttgataagcttttagcttctaagtattgtatctcaatatcaaccagcagatatataggattactaagtttaaagatctaaaatgtataatgtgaggactggagttaataaaattgtattgtattagggatttttttaaggaagtagactttagctgctcttgtcatacacaagaaataaccatgtgagatgatatgttaatttggttcacttagtaaccatttcactatctatatatattctataacatcatgctataaacttcaaatgcacacaataaaattatttttttttaaatctcagtattaaacactgagatttaagattggtgacacccatggcagaagatgtgtgcacagtttggttgagtgacgatgtgatgctgcacatcttgagttgacttgtgtcacttgatttaagaaaggaaggagaaaactttttttgtaaatgagagctgaagtggaacagacttctggatttgactttctcatgaatggattcccgtgagatatgagatagtacagctcacttccctcaaaaagatttatcctcctttactattgccctttggtgtttgtacgagtcaggagagatatggtaagaacttttatttcaaatggtctaagttctgtgttcactgtcattgaggggtaaaatctgtctctctctctggccagtggggttctg

SEQ ID NO: 32164 - DNA, 1050 bp, Homo sapiens
taatgaagaaaacaagcagtcactggaaacagatggaagatgaccaagatattagagttaccatagctataataatattgttaaagaacttaaaggaaaacatggatgctgttcaagaacagatgaagaatcttacctaaaaactgctataaaaatcaaatagaaattctaggatcaaaaagtgccatggctgggtgtggtggctcatgcctctaattccagcactgtgtgaggctgaggtgggaggattgtttgatcctagaattcaagaccagcctgggcaacatggtgagagaccccctctacaaaaaataaaaaaattagcaaggcgtgttggtgcacacctgtgatttgagctactcaggaggctgaggtgggaggattgcttgagcctgggaggctgacactgcagtgagttctgaacatgccactgccctccagcctgggtgacagagtgagcggtctcaggaaaaaaaaacaaagagaaaagaaaagtgccatgattgaaatatactgaatggagttaacagccaactagtctctgcatgctaaaaggtcagtgaactttgagccatatcaatagaaattatctaaacaggaaaaaaaagactaagaaaaagaactattttgagatgtattacacacttaaatataaatgcaaaaactgtagaagttctataacaaattagagaaaaaatatcttacagtctcaggcagagatttcttaaagagcacacaaaaagcactagctataaaagaaaaaataagttaataaattgaacttcattaaaataaaaaccttctgattatcaaaagacccagttgagaaaataaaaaggcaagctacagactggaggaaaatacttgaaatatatatatctgacaaaagacatgtatgcagaacatatgtgtgtgtatatatgtatatatatttctaaaatgcttcataataacccaatttaaggcaacataaaaggtgaaatatttcaacagagtgcccaaagaaataaatatatttatatatatgttttttcaaatgccaataagtcc

SEQ ID NO: 32165 - DNA, 1070 bp, Homo sapiens
ggcccctttctttcttccttttaaaaacctttctctattcatgaagcacaaattagcctttggaagactctctatctagctcataaactcgttaccttcttcctcagaggcatgactcattcgcttttgtctctcgacttcttagattattccctttccttacatctcacttttcttttactgtggaaaggaatatagtaaatgattaagagtgaaggctatggattccactttttaattcataccgcctaaaagctgggtgcctttgaacaaggattttaaactttctaatcctcagtgtctgcatctataaaatggggagataatcatggcttaatgagacagtccatataaaatgctcaggacagctcctagaacatagaaagtgtccaggcagtggtatctaaaaacaatgatcatgatgatatggcttatctgtgttcctcatccccttgccttgcagaaattatcagcttcacaaagcaccaccagctgtcaaatctgcatctagcctgacctttctactcaattctatttctgccgtttcaactacttctgaatagtcccactgcagtcctctgctttcatcttaaatgtgacttctccaaaagccacattctttttgacctttgtccatgttattttattgtatcatctagcttcagattcatgcagtgatctttaaatacttctgtatagctcttttccccacatttctgcagttaccaagtcctatatagtcttccttcacaacttctttgtcatgtatttacttctatttttatggccacggctgcagatgaactctcagccactatccttctggacttaatgcagttttttaagtgatgatgatagtggtaacagtggtagtgatgctgacagcagcacagttaatgttcgtggagaccttactttgtgccaggaactattctaaacatatataatatgtatcaactcacttaattctcacagcagacctttaatgtaggtactagtatttcctccattggagatgaaaaaactgaggctcagagataataagtaaccttcagaagaccatggtgcat

SEQ ID NO: 32166 - DNA, 1048 bp, Homo sapiens
tgttacacacatataaactgacctatgttttcaaaagttacatggtgagtgctggttgaaaagacttgaggaaaattttctcagatagctttaaaatgaggcatgtgctgtcattggtagagccttcgtttagtatgcaactgatacttgaaatatgactttctctgttagtggctttaacaggttccagtaatggttgtgtgatactcttcattttattagggttcaacagttcatcaaagggaagagaaatgtaggggctcctatttgaaaaatttatgtgtgtttatttacacataaatatgtacatttgggtcaggtgcagtggctcacatttgtaatcccaacactttgggagcccaaggtgggcagatcatttgaggtcaggaatttgaggccagcctggtcaacatggtgaaaccctgtctcgactaaaaatacaaaaaatttagccaggcctggtggcacacacttgtaatcccagctatttgggaggccgagataggaggatcgcttgaactgtggaggcgggggttgcagtgagctgagatcatgccactgcactccagcttgggcaacaataaataaaaataaataaaatttaaaaaatatagtatgtacatttgcatatcctattcccattgaatattatctaaacttgcctatatttcttaactcagaagttacatgcatcctccttaacaagtgggtgagctagataaatctcaggggattaaaaaagattcaattacttatcttttggggtgaattgatgaataagaaactgtaatagcaaccctctggacctactaggcatctgtaattggtaggcttttccgacattttttccttcacagacttagcaaccgaagcacaaggtggattaaataaatgactaaataaaagagaaacagaaatatcatatcctggctccagatccatgattgtcagtagtgtgttacagtgtttttaccagtaacagttagcattgccttgattataagcaaacaaaagtagattctatttagcttaagcaaaaaaaaaaaaa

SEQ ID NO: 32167 - DNA, 1030 bp, Homo sapiens
cttgctgcaggctgatagcgccttgccagtggagttttgcaatggcccctgaacaagtctctctgcttccgttggaagtatgcattttccatactcatcacatacataccacattctatacaacaaaagctgtattttcccaattctcaacataaaaataatagaacagaatgtcctgtttcaagttttccaccttaatattttcttaacaagaaaagcaaattgatattaatagggaaaaattggagaaagttaaggtcaaacctttaatttttctgggtggtactgagattttattataataatgctttatgtaataaatatcataatacttctatagtattaaatggaatacctaacaaaataaaataatactttatagcataattgcatatatcagcatcatgattttctcctagtaaaaatgttttcagttcatggatgaaatttaatgtcagtttttagcagtgtttggaaaaataattaaaatttctgggtctcaccatctgaaatgatctgaaaacatctgtgctattggaattgaacccaagtatgctaaaatgtttatcgattgaactaaatttcaatcgataaacatgcgagtctgtgagctggaagtgccttttctaggatggggttcagaatccagggagggaatgagattagatacagtaaatcagtgaaaccagaccaaacctggcagctaaacagttgaagtggagcaaaacagaatgtggagttaaagcagcagaagtcaagccataaagcaaagatggatagaggcagtagaaataaatgggtcccaaaccactgagcaatatttccaaaatgccaatgaagaaaagcagtttttctagccatctcatcaaaactgtcttcggccaaagctttattctctctttagaaaaaaaaaaaaaaaaagtagtgggagaaatcttagttctttacagaggtaattgtgataactggtgaggaggagataaagacgagaaagttagaatttgaaagcaagagaggccaggaagagaaa

SEQ ID NO: 32168 - DNA, 1023 bp, Homo sapiens
ccaagaaataaaaatgctatttaaatgtttttaggacattataatgtgcatctgtttggtaattcttggttctagacctccttaaatatgaattgactggttggagtctcacctctactttctcaaataaatgttacccactgtgcaccagtgatgattccttcaaagtggagtaaaaacttggatgcctgcaaagcagtctaaggcacagttcttctgggcttttgtaatcatctttctcaccttgtaaagatttctccatctaatataaagccaatcactctcaccaattcgatttatctcatctttcgaaaaaagtaatggaagcaatggctctattttcttccgcatatttcatcagtctcttatattcttaaatcatgtaaatacactaaaagtatgatgggtttgggaattgatattttcctggtaaacatacaactgaggtgatggaactagattgtacagtgttctagaaggtagtctaggcaattttggtgttctgggtaccacggacatcattatgttctcaaaggaattgcagaggtttgatttaacccaacaatgtggttagttggtgatcagcatgaatgttattttcccattgtcttagtaaaaaggggattgattattaaacaggaatagttctctttaaatttgaactgtcaagttgttatttaagttaacagtgtgtaatttttgaaggctgttgtgagacctcagttcttcttagtttaaaagaaattaaacaagacacagcaaaggatatgcagcacagagtcatttactgcaaaagaaaagcatattttgaaagttaagtgcggaatagacagtacaccctgagagacagagaattcagggtgggctgcttgtaaggatgagacagcaaagactggcaatagggagttttggggagttttacatgattattcataaggaggtggaaagcagtgttactagtaagcatgttctgggtggtcgtctggacgcacatgtgcagtagctgtacatgcttgtccatgt

SEQ ID NO: 32169 - DNA, 1052 bp, Homo sapiens
cttattgtgacacttatgataatacaaaaagtaataaaaatacaattattatcattcggtagctgctgatattcactgggcatatactatgtgccagatttgcatcgtcatctcatttgaacctcacaacttgtgagggagagatcttcatggcccccattttccaggtggtgaagagattaacttagagctgaaatacttacatagagtcagggctaggatttaaaacaggactgatggtgaaacctgaaggcatagacatgacccatagctgcctttatgttttacaacttcctgttgattttcattttcctcgtttgtcagtcatctcccttgacttcccacatctatctatgttgcatcctagcctggtgcctggcctggcggaggcattggagcattggaaagaatgaatgaatgagtttagccctctggagagtgtatgctgaaaaactgttacctcgcctttaagagcttaaaagtgaagagaatgaattttgatagaaccattttttaaagtaaggaccatccttctgtgtccccagaaaattaaatagagtcagaaaatggcaaagccaagttagaagcattcaggtgtggaagttgtatagggcacttgagttaaaaaaaaaaaaaatctgctcaggcataaaataattaaactgttcatgacagcgtataattgcatcattatattcccaactctgttactgtaatttggctcataaaagagcaaagtgtcaaaatctttctaatggtatttaattttgttttagcatttcctaaaggaagtgttcattttgtactttgaacttgtaaacttttgacacatccttacattctttgctgttgcaaatcattcgtgtacactacagaaatgactaattttccatttttcataatttggagtcaggtctttatatgaactttagatatttcattgttgaagacacttacatttgcatactttcaatgtaccttgttttttaatctatcttatttggagttaatattgttagtaatataacctggaaaaataataactcaattga

SEQ ID NO: 32170 - DNA, 1003 bp, Homo sapiens
aggtggatctgaataaacagtttctaggtttataatattattgggattttttaaaactaaaaaattcgtttagttgaattatgcaatataaatccttagcaatatccccaaaaagtttttccaaagaagtaatattggttcttgatgtttcctcatggttcttttttttttaaccaatataaaagcaaattttaaaaaaaggtgttatttcccttggaaggaagctgtgattcccatggttggttattagtccaaagccgtggaacttctttccttataaacctctcattctggcaagacaggacacttggacaatgattttcctaataagtataaccaaaagactttccctaattttaatgtttcccaaaataagtcctcatcagatttgccccccgaaaggtaagtgaggaaagttcaagacaagtttgatagacatatttgttgaagacatttcttaatttcagattttttgatatgtgaatatgccagttacgaacttctgaaaagagggttgtggagaggaggactataagaagtagtgttttctgaactattttgacctttggctattttacaggacttttgggttgctgattgcaacatgagagaaggacatcttgtctggtgggcatatacatgtacatagcctttttaagagaagcttttgggtttgatatggcagtagattgccctgctcacctccccaaccccaatatatttgaacatttctgaaattgggatgcggtttacaatcattccatgtgttttcttgttttttaacttgcaggaatgctgttaatgaactgagagtgccttaaaattaattaagtaattcagcttttaattttaatttgttcatgctcagcctactgactttgcaagaagtacagtattaagtgaaaagcattgaaggagaggaaaaaggctattttgtggaaaatgtctttataatcagctttattgtttagaagatctagaatctggttaaaaagcaaaatga

SEQ ID NO: 32171 - DNA, 1050 bp, Homo sapiens
gcaaactcattttcaacaaagttgccaagaatatgcattgaggaaaacacaatctcttcagtaagtggtgctgggaaaactgaatatctatatgcagaagaataaaactagacccctatctcttgccatatacaaaaatcaaatcaaaatggattaaagacttaaatataagacctcaaactatgaaacttctacaagaagacactgggggaactctccaggacattggtcttggcaaagatttcttgagtaataccctacaaacacagttaaccaaagcaaaaatggacaaatgggatagcttaagttaaaaagcttctgcatagcaaagtaaacaaatttgaagagcaaatttgaaagcaatttgaagagacaactcacagaatgggagaaaatatttgcaaactattcatctgacaaggggttaataaccaaaatatataaggagctcaaacaattccataggaaaaaaaatctaataatctgattaaaaaatgagcagagatctggatagacatttctcaaaagaaacatacaaatggcaaatatatgaaaaggttctcaacataactgatcatcagagaaatgcaaatcaaaactacagtaatatcccagttaaaatggcttattgaagaggacacaaaataatgaaaagatatgcaaaagacaggcaataacaagtgctggagaggacgttgagaaaagtgaactctcatacattgttggtgggaatgtaaattagtacaaccactgtggaggacagtttggaggttactcaaaagactaaagagctaccatatgatccagcaaactcgctgctaggtatatacccaaaagaaaggaaatcagtgtattgaagagctatctgtacccccgtgtttattgcagcattgttcacactagccaagatttggaagcaacctaagtgtccctaacagaggaatggataaagaaaatatgatacatatacacaatggagtactattcagctataaaaaagaatgatatcttgtcatttgcaacaacctggatggaactggaggtcattgt

SEQ ID NO: 32172 - DNA, 1003 bp, Homo sapiens
aatatgcttctgaatgaccagtgggtcaatgaaaaaattaagaaaattttaaaaatatattgaaacaaatgaaaatggaaacgcaatgtatcaaaacctatgagatatggtgaaagcagtattcagaggaaagtttatagtagtaattgcctacatcaaaaagtagaaaaactaatgatacattttaaacaactagaaaagcaagtgaaaaccagacccaaaattagtagaaggaaaaataaagatcagagcagaaataaatgaaattgaaatgaaaaaatacaaaaggtaaatgaaacaaaaagttgtttttttgaaaaaagaaatcaaattgacaaatcttcagaaaaaaagagaagacccaaataaaattagagatgaaaaaggagacattacaattgatatcatagaaattcaaagatcattagaagatactgtgagctactatataccaataaattggaaaacctagaagaaatggatatgtttctagacacacacaacctaccaagattgaaccactaagaaatgcaaaacctgaacagacgaagtaatgagatcaatgccataatgaagtcgctcagcaaagaaaagcgctagatttgatggcttaactgctgaattttagcaaatgcgtaaagaaccactaataccaatgctactcaaactgtttcataaaactgatgaggaaggaatacttgcagattcattctaggaggctagtatcaccctgatacaaaaaccagacaaaggcacattaaaaaaaaaaaaaaaaaactgcaggcaagtaaccctgatgaatatagatgcaaaaatcctcaacaaaatactaacaaactgaattcagcaacacattaaaaaaagcatttatcatgaccaagcgggatttattccagttacgcaaggatggttcaacatatgcaaatcaatcaatgatacatcatatgaacacaaggacaaaaacgatatgattatttcaatttttgctgaaaaagcatttcat

SEQ ID NO: 32173 - DNA, 1602 bp, Homo sapiens
catttgtgcccacgtgctgggtacagagacagcaatgggagtgtagagcagcactttaacttgcctagtgaagtctcttactcagtcccttactagccaggttcttgcgatcaagtcaccaaacctttctgcagattgtgatgactattcgattcaatcaaacccaaagagatcagccaagagtctggcacacagaaattccttaacaaatattagttcttatgtatcctacaccttgtgtttatagcaagccagtctgcttgtggcagggttgcttagaaatcatttgacagtgtctaaacagtcactcccaaagttgttgaaaaattgacagtctgtagttgcattttgtaatgtttcttttagagcaatagggcagtggttttaactgaagcacgtttaaactgactttgttttgagaaattttagtggcattactaagaatttttggatcaaagatcacgtttattggtgagaggatatccgttgaaagataaaatatgcattataacatgtctttttgataaggagaagtgttttggctttgttcatcaaaagtacatctttgaagctgatatttgaagttattaagatttactagcatctggaatattaccttcaataattaatggaggagacatcagagcctgcccttctctgacctatagatctttagctatcagtgaaagaactgatggtatgcaatgctttctttgcctaacctgtcaggcccctttggaggtatcctaaatttgctgatggatcctaaactgactgattaatgtttgatgttaggagctttggggaattgttcaagggattatggttgtttgtagtgcacaggaaatacagactttttatgatcagttcagctctttttgtgatcctctattttatgactagataatgcttttgtgaaaaaagaatgaagtacatctgacatatggcttgatctttctcttcctctaattaaaaaacaaaaacaaaataaaattttttattggaaattctagccctgaattacctgttttctattattgtttatatactctctcattttaagtgttgtgtaaatatttactgtatcctctatcaaattgaggaaatggtgtctttttcagttcctattagagtggacagcatagattagttagtagaaataggcattgtgaggaggcttttctgtaacaggtgtgcagaagtgtcttctataatgtgccacttcatgctgatcaatatagtcttagacaaatgactattgatagggaaactgttctttgaaataaccatatctttgactccaaagtagacttttcatttattttttctctgatctcactgcaattagtaattagtaattataggttggggtctgtatatgaaaagatgaacaatccgtgggtccttaattattcaaggaatttcaaggtgtttgattctagagagttgtccatttctttatttaaaaaaaattttactttagattccaggatacacgtgcagaacatgcaggtttgttacataggtatacgtgtgccatggtggtttgctgcacctattgacctgttgtctaagttccctccccttgccccccacccccaa

SEQ ID NO: 32174 - DNA, 1030 bp, Homo sapiens
agattagtggtaccaggggttaggagtgggtagtggggaatgtagaatggctgtaatggccacagagttttcttttgggatgatgaaaacattctggaaacagatatggtgaaagttgcatgacattgtgaatgtacaaaatgccactgaattttacactttaaaatgattgatgaattttgttatgtgaatgttattacaactttatgtatttgagtatatgtcatttattaatggacaaagatacattctgtaatttgtctacctccctcttgatctgaaaaaactacaaagcatgtctcaattctaatgcaaagtcttaaccaaaatgattttttctgagctattcatatttagcttctggtgactcacaggaacctgaattttatgttccattcaacactccattatgctcttaaatgagaatctaataattttcccttggaatatttttgaaatccaattctaagtatttagaattttagacacagtcgtatctctcgtttgaatattccaaatattgaactttgttcaacattgtttcaatttgcaatatttatgggttgtcaaaacaaaagtagagatttttttctttatgtccatgtctaaaaatgtcattttggaaatggcaataaaatagagcattaaactgaaattaatatcatgatgttgaaggtgtgacctaattaaaatgcaaatgtaagcacacttctttaaaattgacattgcagcttatatattccccaatagtgggactattgcttgttgataatttgatttgacaggttctcttcacaggttcatttctttaacctcacagtgtaagcatatattggcttgcctgataagatgagaaaatttaggcagattcaggaaggttaaaatgaaatttaatgagttatgatcttccttggatataggctgattctacttattagaggaatttggaaaatgcctaccatctacagatttaagcattgttgaaagtctgtattttaaacttaaaactcacgtcataggcactttttgt

SEQ ID NO: 32175 - DNA, 1048 bp, Homo sapiens
atatctttgtatgtgtttcctagtgtactggtgagtctctctgtagaatatttacctagcagtggaatcaccatgttgtaaggtacacatttctccaacattggagagcagttctatagtcctaattaagtgcttgtgtcagttgatactccatagcattgggtgaaaacatctgtttcccatgatgtttgcattggcacactttttaagtgtttgccactctggtgggtaaaagatggtaccacattattggattaattctcatttctccaattatccagtggagtaaaacgtttgctcctggatgcaaacaggtgtccctttttgtcaattgcttgtgtgtattctttgccaattttttccattgggtcattgttttcttttgcaataattagtatttttatatattctagatttaaatcctttgtgatcatatccatcacaggacttttttttatttctcgcttggaatcttagtgggtttccatatgtgtgatggggtcgggacaggggatagtgcctttgatactaaaatgtttagtataatgaaatttaataatttccttttggtctatgcattttggctgtaccttaagaatatattcccagtgttaatatcataacagtactttcatatttttctaatgtattaatgttttcttttccatatgtgccttgatatcatctggatatcttttatatgtgatataaattatgaatctacttttcttcctatggaaaaacagtgttccattctattctttccccatggtcttgacataaatgtgtgaatctgtttcttgcctgtccactgagttcagttggtctctttgagctttaatgatacagtcctttgattactatgattaaagagtatctttatgtctagaaagacaagcattcctttcttttaatcacattttggctgttctttaccttgactctttcaaatgatttttttccgtcttgtcaaattctgtgggaaaaggccgtgaaattttttaaaggaatggcattgaatacatggattcatttatggaaatttgac

SEQ ID NO: 32176 - DNA, 1031 bp, Homo sapiens
atgggcagccaagtccaggtagaaggaaacaagaacaaaggctcaggggcagaaacaagtttgcatgctcaataatgtttaaaaaaacacagagaggccgggcgcggtggctcatgcctgtaatcccaggactttgggaggccgaggcgggcggatcacgaggtcaggagatcaaggccacggtgaaaccccgtctctactaaagatacaaaatattagccgggtgcggtggcgggcacttatagtcccagctactcgggaggctgaggcaggagagtcgcgtgaacccgggaggaggagcttaaagtgagccgagatctcgccactgccctccagcctgggcgacagagcgagactccgtttcaaaaacacgaagacctgtgggggtgaagcatggtgaggaagtgggaagatgctaggagtctggaaccagattaataaggccttctaaggacttcatttttgtgcagcaataaagctttggtgagatttaagaaaaagcagaagggtggaaggaaggaaaacaggatttttaatataaacattattttgctgcaaatcatttaagtatgcccacatcataccttgctatattcaccatcccccagccccaagggtccaggtcttgtagaggctctgtagaaacagtgaatggggagtttttatccccttcaactccttggtcactcatggaatctcgaagcaaagcaaacactatgaagcatttataggaactatagttcacatctatcacgctattgctttattcttacctttaagccaatgtcaagataacacatgaagtattccagatctttgttaaaagttcctggaatattttgttattcacaaaacattttacagcaacaaccaattaacaatacccttagaaaatcttggggctttttcttgagtttaaccacttttattttttttttaagttgagcttaaatttggtgtaaaagtgtatacagattaaatatctttgaagtaggtttttatttcacaggtcctagaatcaggtaaaatgg

SEQ ID NO: 32177 - DNA, 1029 bp, Homo sapiens
tgtgtgtgtgtgtgtgtgtgtctcaggctgactagaatgtgagctctctgagggcagggatgattctcaggtttattcatgaatgcatctcctctgcctgggcagggccaggctcataggaggtgttcagtaaatatttgttaaatgaatatttgctagatgagtgaccctggttgaccatgttggctttttagctctaaagataaaagaggacaacggtcctcatttaacaagtagaataatgtggtaagttctcacaccaggcagtatactgcaatggttaacatagtgtcaaccaggatttctatgtacctaacacacatgaacacatgcttggagacataactaatattcatcattccaaagtggcctgctttgaaagagagagaagtaacaggtggtttgagcatgaaaaatactcaacccctcccatgcccagcacaggtttcatagatttccatgtggattccagccaggctgatgaaatcagttatttcctcagctgagagaaatctaacagaagggtttgataactcgtcggctcatgagatttgatttcccaagattgtatatgccactgtcttgccttcctcaggaagtctggagcagctctgtaagcaatttcttcagtttagtcaagtttttatggctttatcatcttggcttcccatgcatacaggttgccttacataacatgcccttttgtagatctctatttctttctgatgatccctttgatgaaaccttcttctgatttattatttctataataatcaaggaaatttccattagacaattttagtttgtttattcatttatttcctagaatttttaaaacatgatttaaggtgactatgaaaaagtagagtaagatttaagtgctttaaaaaaaagcaaactacaaaattcaagaagtagtaaaaggaaagtaagatggaccaaaagtgagattagtgcatcaaatagatataaaatatttatatacttgctagagatagtgatatggtttggctgtgtgcccacccaaat

SEQ ID NO: 32178 - DNA, 1049 bp, Homo sapiens
aaattgaatgagaaaagacaatcaactgacacaaacaccaagatgaatcagatattggaattatctgacaataattttaaagcatctgtcatataaatgacctataaagcagctgcaaatttttgatacaattttttaaaatagaaaatattagaaaagaaatagaagttataaaacaactgaataaaaattctagaaataaaaaataacagaaataaaaatagtgctggatagtattaacgataggttagactatctactgttaattagagataagagagggtagaattactaaatttgaggacaaaacaatggaatccacccaatcagagcaatagaccaaaaatagactgaaaaaatgaacaggaccccagagatctgtgagacaatgacaaatggcccaacattcatgtcattggagtcccagaagaggataaagataatgggactgaaagagtatttgattagctgacagccagacatggtggctcatgcctgtaatctcagcattttgggaggctgaggtggccatattgcttgagctcaggagttcaagaccagcctaggcaaaatggtaaaaccctgtctctaccaaaaaaaaaaaaaaaaaaaaaaaaaaaaattaaccaggcatggtggtgcacacctgtagtcccagctactcaggaggctgaggtgagaggattggttgagcccaggaggcagaggttgcagtgagccttgattatgtcactgccctgtataataaagtgagactctgtctcaaaaaaaaaaaaaaagaaaagaaaagaaaaaagaaaaagataaattgggcatggtgatgcacacctgtggtcccagctactcaggaggctgaggcaggaggatttcttgcacctatgaggtcaaggctgcatgcagtgagctgtgattgtgccactatactccagcctgggtgatagagggagatcctgtctcaaacaaacaaataaacacgagtatttgaagaaatgatgactgaaaacttaactaatttggtgaaagacagaaacctacagcttcaagaagct

SEQ ID NO: 32179 - DNA, 1066 bp, Homo sapiens
ttacccacgagtttagcctctttagttaaatcttgggtaaacacagggattttcagaggctggtgagtagagaaatatctacttggtcacatcagaacatatagaaatcttgcttctactagcatcctatctagatagagagaaactttaaaaaatattgtcttttactccttccccaagggaaattactgctatacgaaattaaaatagacaggccatagtcatgcctatttaaagaaaacatttttacagttagaaaaatatgcccattttatgaaggtataatttcttaagtttgcattcacttatgagggagtgacttaggtggatcagcaccttatccaagaagggattgaagaatgaatgaaattaaattcatattggagtagtagcctctattatacctggttcaactttctataaaaatactcaagaagatatatgccaaaaagaagtcgctgccactaaaaatttgtttttatagtcaagctagtcttgattcttgtagagaattctactaatgagatgtttggtggaactagaatgaacaatttcaacaggtgattcccttatgctgtggccaaacagagggaagacctttaatcatttggctgctatctttcccctgcttcagaaacatgcaaacgctaatcagaaaagtgaacaagaattactatgcatgtaagtacttttgtgaagcatcacttttaatgaagacatcttttgcatatgcatgtgaagaatgcaaatagtggttactcaaataaatggtcatatattagttttctgtggctgctgtaataaattaacacaaactttgaggttcaaaatgacatagatttattattttacagtttgggaggtcagaagtttgaaatagatggatattagtgggctaagatgttaggctgaattcctttctgaggtctctaagggaaaatgtgtttccttgtccttcctaccttccagaagctgcctgcattccttagcttgtggccccctttcatcttcaatatcagcaatggccagtcaactctttttcctattgcattgctctgactattct

SEQ ID NO: 32180 - DNA, 1027 bp, Homo sapiens
tttctccagggagtaaattacttcatgtagcttgttctcaaacacttatctcagaagccgcacacctttctgatagaagccaaatgtcatgactgaaggtatgggacaaaagcctgatttatattcctgaaacgcctcttttatgttctagaagccaaatctgcattcttatggagtggtgtagaatgtcagtacaaatgctgtatctatgctgaacctggaaaggaaaaaaaaagccacactccacttctttatttagagtttgcattgagaacagcaagcactatttgaaaggtcatcccatttcaagtagcagatggataggaaaaaaagactctggcttttacaaataatttaattgtattctccttgccatttctgcaggcaattcaggatattttttaaagcattgatccataattatcgctcagagtggttagcattgttagacagatgtgtaattccttgtgtgtataagggagcaatacagcatccattttacctatttgattgtcttttcttttactgtgtaaacaaatgcacataaaaacgacacatcattgctttacaaaaaagaagcaaattaattttttttccagatttgtttttgacttgaaactctcctttctaaggcatgctgtatttataatggtcagcttctttgccttcctttaagtaaattagtttgggtctaggtagcatacttatgtttatagtccgctggacacaaggggtcagaaaccatgaaacacaaatgtatcatattaatagaatatgaaatgaaatgactaagacttttaagaatgcattttatctgtggtttattttcctgtcttttaaaatatatatattatttgtaatctaaccatgctattctgattggtttacaattgccagataaaattcaggatgcccagttaaatctgaatttcagagaaaaagaatgaacacctttttgagtataagtgtgtctcatgtaatagattggagagtcatctcagaatgaaacatactatttaaataaaat

SEQ ID NO: 32181 - DNA, 1032 bp, Homo sapiens
cctgtcttaaaaaaaaaaaaaaaaaagggtcttttcagttcagttgggaaatgtatgtttatctaataaaagatgctatgaaaattggcttttcatcagtaagttgtaaatgttagaccactattttttacaataaaaatctaaaaattcagatgaattaaatatatgaatgtacattaaacaatataaattttagaaaaataggaattcttagacactgatgacatacagttatataccatatttgagaaaaatggctagggatattaattggcaattcacagagggaaaatttaagtgaccaagagacatgcaactctgctcaactttactagtagttgtggaaatacaaattaaaatcacaatgaaataaatacttttccagtcaagtagttgacaaaattggaaaatattgataatatccatgcttgttaaaggtgcttagaaatggaagagtttcatatattgctaaatctggatatatttatcaaaattaatggtacacttgctctttgactctgcaaccttaattttgggagtcagtaatctctgatgtgaaaatgtatatttaaagatggctgcatttttagtagtggcaaaaaaaaatcaagacaaataacattaacataaaaacagcacatgaatagtgagattgttgaatatatttatactataaccatactgtgaaatattatggaactaataataataactaaatacatctatatgtgatgtccagcatgtccatgatatggcagcatctaatcatttgactaattggaacgatatgagaccgttggaattagaaagcaaagaatgactatatcaaaacctgtttgtatgtactggtatgaaactagaaaaagatgtagaaggataaacaagtaattgtttctattttttgttttgttttttttagttgccatgggaaaatggaattggaaatagtgctgggatagcgtattgacttattttatataccacatacatacatacctgtgtattttttttttttttttgagacagactctc

SEQ ID NO: 32182 - DNA, 1055 bp, Homo sapiens
taatagacagtggataaaacaacacccaattcaggttgggcagctcaggccacacagtcacctggtgtcctatcttgaaacattctgtctcttgttggggcgcaatagaacaagagttgcttaacaagagggaaagcctttctttgattctaatctagagcttgccaaagcctctttcttatttctgttcagaagccacagatagtctgatagccatctgatcatctatcatgtgaagacaccgaattttgttaatctgtttctctgctaatggacattttaaatcagttaacagtagattctctgggatatataactagaattgggagccactaggttttcagagtaaatagtctggattagaatctcacttccatcacttaccaggcacatgatcgtagcagacaaattaacaaattctctgaaccttgatttctttatggaggaaaatgggaaatataagttcctacttcatagaagggatgtaagaattaaataaaatattgtgagtaaagacccacaatataggcttgctgatagaaacactctgtgcatggtcatcattgtggtgtctttatcatcctctctgttcttataaactgtagtgagcaaacaaatataatctccattaagacaacatacagattcacttgccttttggttgaaatactatttactttatattaaaatgctatcattatttcttattttatctttaaaatgcctgttatttgtctgttttttaagctaatggtagaatttctgttaacatttgtaggctcaattcaagacgtaagttttgcaagccaaatgggtcagcgatgagttaaatgtgggaaatgctggagtaaagaactgaagtttatataatcatttcgcattaggatgagcatgaaaaatgtccaaaaggagattgagcatgccacattccaaaaggtatttggtccatggattatttttacaagggtcactttcattctaaggaatgcaattttagaaatactacactgaactgtgacttcttcagggataaggatcttgtcttgcttatctct

SEQ ID NO: 32183 - DNA, 1086 bp, Homo sapiens
gacatatttattggttcaactttagtttatagcagaaatctttgtcaatcattgtacaccacctttgttcttctctttccaacacttttaagaacctgtcagcagtgccagtgctaatctgctgttgcctggattgggcactcctctgagtttcctgcagaagagagccaaaattgtgtctgagattttcagcttgatgacatcttggcttaataaaaattcttgaagaagagaatgtgaatttttttaaagttccaggctggtgaaaatgaacaattttgcataagaaataaatccttagcattaagataaatgagaagcactgctgatgtgaaactaagtttgctttgacatagataagggggctaagtgggattctatgggaattgacacactggatctaaatctttttttaattactgcatcaataaatgtgctttttcacccccttctataagatgactatttaaatactttcctgtagcactttttaaatgactgtattcagtggtctcacttgccctgtgctcttaaactggaatcctgacaaggcagtgagacccccctctcaggaagtaggccatgtaggcctctgcaacgtgtctgagttacacagtcactgatcaacatgggaaatgggacaatttctggcattcttgccttctttaacatgcagaccactccgttcctgttttgaaatgactatgccagatatttaacactttggaggagttttcagaaagagtattgatatgcaaagtgtaactcaaaaaaagcagacaaaatgattgttgaacagtgggatagagagagagagagataaatattactttcaaagcataggtgtgtccagggatgtgcttccaagttgaaagctagatgaagagttaggcttttgacttagccaaagatgttgccatgttcactgacagaaaagaatatttcatacaataaataggctagccttaggctaagaaagaagattgagttggaaaaggaatgcaggtgggattctggaaataggagtcagtttcattcactgcttatggcttaaaggtaaaggagtaggttgcagattccacagaa

SEQ ID NO: 32184 - DNA, 1026 bp, Homo sapiens
ctggcaagtcaatatagttctgaaaacccaaaaagcagtttgtaacctcaaaacacttagcaaaccttgcatctgacctgcattatttagcctacctatttacattttgataatacctgcatttgaccaatagtttttaagactgtttctatttcttaaagattaaagtcatgtgaactgaaaggtaccagactttatcttccctttaaaaaatattagattcaagcacttgtctttctttaggctgtattaattagagttctcttgacaaacattacgtacagtacacacacaggcaggcagaagaaaacccagttgctgggtggggccctttaagagaaagggctaggaaaacatgcagacattgaatcttacagggttcatcctctcaaggctttgctaaacaaatccttgccacaattaccagccatgccctcaggatataaaacaagatggaggcttgatttcacaaccgaaactttgcagagaatacactgacagttgttgggggtgggtggaggctagcctagtacaacatcttctaaaagaaaaaaaaatttaagttaacttgctgatggggtagagaaggggaaagaaaagaaacagtttaaaagtgcctgaggaagaacctcatatttctttgcaagtggttcctccaccagggagacaaatttaagcttaattactgtctgatagagttacatcccttggccagggaaggggaaggctgggacagccaggagtgacggggaaccagccagcaggctgtgcaggacacttaggccatgtgtcccagccccggcatggagtgaggagcagtgggcagctgctgctcgccggtccatcccaaaaaaggaaggaaaaggccacggggatgagaagactcagaagggagagggaaaaagaattattggtttgcatctcacttaccccttctcgagtccccacgttgggcgccaaaaatattgcaggacttttccatagttcagttaaagacagggtacttgtccgtcccacagccacgaa

SEQ ID NO: 32185 - DNA, 1029 bp, Homo sapiens
caggtattgctaagtagccgagctagcatttgaaccatctccattcttaagcatattacactgcagtgcttcctgaaatccttatgagtgacttaataactttcaaaattttgttttaagatatcaactaaagcaagattataaaacttaaaagattttttcatttccataagttacttattggttatggccttttttcttagtttcttgccagaaaatgcccattgcctctccatgccatcttcccagttttataaatgagaacatttaggcaccaagtagttaagcaacttggctaagttcaagttgttaggaagaaggacgcctgggacttcagcccagggctgtctcattttttactatcaatttctaaaaattaggcttttaaaaaaatattgcttttttattctgatttcaatactaattcacactgaatgtaggaaagttagaaaacttatacacatgaataacaaaacatgcagacattggattcttctgtctttatctctgtagataatctctttgttactaatcttgaaaagtactctctctgtgtgtgtgtgtgtgtgtgtgtgtgtgtgtgtgtgtgtcttctgtttgttgcatttgagttagctttatttctagcatgaagctgtttgctcctggagggaaggaatgatttcatttaattctctgtctcctacagcacccatcttcttactaagaatatggttggttttcagcaaatacttgttgctttaagtggaattgaaatcacttactgcccaggatactctttttgccaccacaggatgcagcaatacaatcccagaggcccaagtcagacagggaatcttggttttatgtcaatttcaaattttgccccctgtgcctggggaatagctcaattgctgtctttttctctgggataaaacttagaggacaccaaggtcaactttcagacacagcagagagccaggctgcaatagtaaataaaccctctgcaagtccatggctaatatcagtacagtgaatgttggcaaaatg

SEQ ID NO: 32186 - DNA, 1031 bp, Homo sapiens
taattctatttaaaaatgaaaactggtaaaattaattttatatctgcataatggaatactgtgaagtcatcagataggatgtggaggttctgtgtatagttatggaacaatctacaaaacacatgaagtgaaaaaaaagcaagatgcagagcattgtgtctattataccgacatttgagtaaaagtgtgtgtccttgtgcatatgtgtatgtgtcatacataactaaaggaacgcaaaagcaacggattacaatgattgcatctgggggaagggactaggcagctggaagacaggtagagatacttttttactcatgcccttttgtactttttgaatttgatacacagtacatgtattacatagtcaaagaattataaaagtaaacaaaattgcccatagcacaaataaagaaaaaaactgccagtgtgtttttatgaagccaatgtaatatggattccaaagtctgagagagacagcacagaatagaaaactataaatcaaactcatttacggactcattatgaaaatttaaagttaataaacaatttatcagattattaaaatattagccccatcaaaagaggtccttattcctcaagtacgaaagtatctcattaataagcaatgtgttaatatactcttaactactatcctgcactacttctcaagtggcagagctatgtgtgaactgtcaatccatccataaatagctatatatctatctactgcattttagcaaatctaaaatgctgtcaagtataagacagcctatttcagaaatgttaaaatgtggaaaactgttttatctttaaatcaatgaagtgtagtatccatccatccatccatccatccatccatccatccatccatccatttttccttcccttccttcctctttgcatttatctgtctaatctatcatctctctatttagaatatgtatatagatctaatataatatctagaatacaagatatattctttagtgagaaaaagcaaggagtagaacagtggaacagttgtccaatct

SEQ ID NO: 32187 - DNA, 1032 bp, Homo sapiens
tcctgtccctaccacaaaagcagtgtacatctctattgtctgcagttttgcagttgccatatccacaacccacaacccttcctgacattcagattcagtcaccatttcttcaatgaaagtgggcaagagaggtgtagaaacattttcctagggcaattacatcatttggcacaagagtaagagttactggttgtgtctatgtgaggcaagcaccaaatcctgagccacagaagccctgatgtgttttctaatcacttcacttatggtgattagaaaatgcaaaatattttgcaaacaactttgaaatatgtttgtgataggaaagcccctctaaaatatgtggttcaaaatatatcaaataataaaacaatgtaatacaaacacatggcctttataagttatgaagaaattgcaggaaatttcaagaagctgaagtacaaataaagtccccattacctgattacaatgcaataaattagaaatcagttttatcaaaaccttacaatctggatattttaaaactctttgatactctgggaggccgaggtgagcagatcaccagaggtcaggagttcgagaccagcctggccaacatggtgaaacgttgtttctactaaaaatacaaacattagttgagtgtggtggcacacacctgtaatctcagctatgaaggaggctgaggcaggggaattgcttgacccaggaagcagaggttgcagtgagccaagattgtgccactgcactccagcctgggggacagaccaagactccatctcaaaacaaacaaacaaacaacaaccctctttgataaacaactcttaattcaaagaaacattttaaacccaacttgaaaaatatctagacaccattgataatgaaaatataacacatctgagctatgggctacagctaaagcctcgcttagaagaaaatgtatacagcctttaacacctgaatatttaaaaaagaataaaaataaaggaattatgcatctgacttaagaaagggacagccaaaaaactggaaaaaatg

SEQ ID NO: 32188 - DNA, 1055 bp, Homo sapiens
atttcagttgtgattcttgaaactcagccctttgcccagtaagtgctaaccggaagacttgttttcttacactttctaggtggataatctgatcaccacaaatggcaagggtgatgccatcaacagttgaaaacagaaactctcctatttatttatttatttatttatttcggtttggtttggcaaacatcccattgtctccaaataggattgcttggtattgggagagcagccttgtacataggcaagacagaagaggaattttaatcagctttacatttgttttgaagattcaggaaagatggaggctttatctcataccaacgtatctatgccatagattgctgggaaacaagagttgtcctggttactaacgtagtgtacattaagtttcctggaatttttttttttaagcctgtttatttgatgctggcacctctgttcttctgaaggcagcatattaggtttactaataaatgacacccagttcctaagagactcggcctaaaagctttcctgacagggcaggaatttgtttcttttttctttgcttttattaaaaaacaaaaaacaaaaaaacaaatattgaggcaaaatcgaggatgaaggacattttgaaaacttgagtactgtaaatagttttaaggaagatttcatttttccaaaactacacattttgcagtttctttaaatgcccatttaatattttgggtcttgccagggcaacgtgttgcttttacgaataagagccaataatgagcccatggagcctttaatttatgatgtatctgacagtatagtggtggatctgataggggatgcatgtgattatgtctgcaagctgaaaataaagtagctggtatttgttctgaaaacgttctgagaacaccctcctgttaatggcccatggcttgatccagcatctggtaaactaatagattgtcatttttaccatgaaagcataaatcattaatgattccacaaccatttgagttcttctctggtctagaatatgccaattaccatgaaattagtcctattagcaacatgattga

SEQ ID NO: 32189 - DNA, 1065 bp, Homo sapiens
actagtttttcatgataagatctttaactacacaggacctgttaaagcaaaaattataacattgtcttgtggtgtttataatgtaatatgtacagatgtaatccatatgactttatagcataaagaatggaggcagtggcaaatggatttatacagttgcaaggttttccaattttatatgagatagtataaaattaaatctaagtagactgtgaaagatcaagaatatacgttttaattcctagaaaaaccaccgaaaatccaaagataaaatagaatcctaaattaagaaaaaaatgatccaaaagttgcagagggaagaaaaagaaaaacaagaagtggaggagcaaacagaaaacatataataaacttgcagctctaaatgcaatcatatcagtaatcagactaaatgtcagtggactaatcactaattaaaatgtagcagtgtcatagcaaaattctacctgatgtacaaagaagagctggtacaattctactgaactattccaaaaaattgaagaggagcaactcctcccaaactcattctgtgcatcaccctgataccaaacctgacaaacacacaataaaaaaaaagaaatcaacaggccaatatccctgatgaacatagaggcaaaaatcctgaacataataccagcaaaccaaattcaacagcacatcaaaaggttaatttactatgatcaagtaggcttcattctggcatgcaaatttggtccaacatgagcaaatacaaatgtgattcaccacataaataggatttttaaaaagccttagaatcatctcactagatgtagaaaaagcttttgctataatccaacatcccttcatgataaaaaacttcaagaaagtaggcactgaagaacatacctctaaataataagagccatctatgataaaaccacagccaatatcatactgaatgggcaaaaactgaaagcattacccttgcgaactggaacaagacaaagatgcccactcttactactcctattcaacatagtactggaagtgctagccacagcaatcaggcaagagaaagaaataaaa

SEQ ID NO: 32190 - DNA, 1051 bp, Homo sapiens
catatttttaacaaatgaatgaaaatatgagtgcattaatttattccactaatgagcacccatcaagtgtttagtaaacctcagattgatgaatgataaggtgataaggcatactttaatacctattttcttaaaccctttcttttctgtgatatttaatgcataatggtttattagtcttctattactgtcataacaaactatgatgaatttagtgacttaaaacaacacacatttattatctggcagtcagaagcccaatacatgtctcactgggctaaaatcgaggtatcagcagcgctgtgtttcttactggagactgcagaaaaaccaacttccaaactcgttcaggttattgacagaatttggttctttgtggttgtaggactgaagtccctattttctttatgtctgttaggcagggctccacccttagctccctcaggcctctttctggtcctcacacagagcctcctacattttagaaccatcaatgattcatcttatctttttctttcttgtgtttggaatctgactttccctctgcagcatagctcctgcatcctcttctgctttctcactctgactgattcttccaccttccacttatgtttttacaacctcatgtgactagggtaggcatacccagataattcaagataaccttcctatgttaaagtcggttgactagtaaccttgatacatctgctaagtctcttcatggcagcacctaatctagtgtttaattggataaccagggacaggaatctttttttttttttttttgagagggagtttcactctgtcgcccaagctggagtgcaatggtgcagtcttggctcactgcaacctctgcctcccgggttcaagcaattctgctgccttagcctcccaagtagctgggattacaggcactcaccaccatgcctggctaagttttgtatttttagtagagacagggggtttcaccatattggccaggctggtcttcaacttctgacctcaagtgacccacctgcctcagcctcccaaagtgctggtattacaggcg

SEQ ID NO: 32191 - DNA, 1046 bp, Homo sapiens
gggagaattttttagttttttggtcaacacatgcattccctcttaggtaccttatttatttattttgggggattctgatttgagcagttggtttgttgctactgagaaattttctcaaagccaacagatagatttattccctattttattttattatgatttatttctattttattgtgaactaaggcgattcagaagctgagcagtgtctctgtggttgtggatatgaagagctttgtagatagaagacagctggattcttacatgcatctaccctttatcctcatttccatagagttaatcgaatcttttagggttttgatgcattttcaaagggtgttttctaagttgtattaataagtgtcattatacttgtgggctatacactgcgttcctaagagtgtccactaatatcccctgaaacaatgttaaaaatgatatgtgagttgctgaagatgatttaccgtatcatgctcttgaataggttcttttgatagctttagaacgaaattcaaactgctgagaggttcaagtctttcaagtcaggacaacttaggctccaacctcatctgccacccctccttgccaatacagagccctgttccagaatatgccacaccatccaccttcttcctgaatctctggctttaccaatgcagtttcttctactggctcctccttttcttgatgaaggtattcatcccaaatctcagcccttctgtgaggcctcctcacccttctgcaatgagagacagcacaatgaagtgtttaaaaccatgggctctaaagttggacctcctgtgttaaaattccagctccaccacttaccgatagtaactttaggctggtttcttcacctgcctgtacctcagcttcttaatctgcaagatggtatgaatcatgggtctgtctctgctatggtttggctgtgtccccacccaaatctcatcttgaattgtacctaccataatccccacatgtcatgggagggacccagtgggtaggaggtaattgaatcatgggggcaggtttttcccatgctgttc

SEQ ID NO: 32192 - DNA, 1073 bp, Homo sapiens
agtctaatggggattcccttaaatgtactgtgacacatttctcttgttgtttttagaattcttgctttgtctttgactttgacaattgaactataatgtgcatcagggcttgaatctattcgggaacctttgagtttcctggatctgtatatacacatctctatccagacttgtgaaattttcagctattagataattaaattaggttttttttttaatacatcttttccttctggaactgccataatatgaaaatttgttcacttaatggtgtcctataagtcttgtagtcttttttaaaaactctttttctttcttatttttttttctctctagctaagtaattttaaataacctatttttaggttcagagattgttttctatacttaagtctgttcttgaagctgcctattgtattttttattttattaattgaattattttttataatatctatctctgttgaatttctaatttatataataaattctttttctgattttgttgaattgtctatctgtattttcttgtatcttgttgagtttcttaagagtactagtttgtattccttttctggcaattcattgattttcttgtcattagggtttgttactagggagttattttgttcctttggcattgacatatttctttgctttttcatatttcttgtgtttctacatcaatgtctatgcatttggtggaaaaattgcctcttccagactttctagagtggcttttgcagagaaagactttcacctgtagttggatcttagtgtgctaattaggaaaagtgtggtgactttgtttccaggtaggttcagtggtatagtatctatgcagtttcttcagctgcattcagtgtcaacagtaactgtggatgcctgaatgacttaggctgtaaaagtgtatggtggtgctcatcatcactggccatcagagaaatgcaaatcaaaaccacaatgagataccatcttacaccagttagaatggcgatcattaaaaagtcaggaaacaacaggtgctggagaggatgtggagaaataggaacacttttacactgttggtggga

SEQ ID NO: 32193 - DNA, 1053 bp, Homo sapiens
gaggattacggatgctgagcattttttcatatgcctcttgtccatttgtatgtctccttttaagaaatgtctattcaggtcttttgcccagtttaaaactgaattattagcatttctgctattgagttgtttgagttccttatatattttggttattaatcccttgtcaaatggatagtttgcaaatattttctcccattctgtgggctgtctcttcattctgttgattgtctcctttgctgtacagatgctttttagcttgatataatcccatttgtctattttaacctttgttgcctttatatttgaggtcttatccaaaaaatctttgcccagaccaatgcccagaagcattttccccaatgttttcctcttagttttatagttcgaggccttacatttaattatttagtccattttgatttgattcttgtatatgtgagagacagaggtctagtttcattttttctgcatatggatatccagttttcccagcatcatttatgaatagactgtcctttgcacactcaatgtttttggcattttgtcaaaaatcagtttgctataattaaaggatttacttctgatttatctgttctgttccactggtctatgtgtttgtttttactccagtaacatgatgatttagttattatcactttcttgtatattttaaagtcagataatgtgctacctccagctttgttctttttgctggggattgctttggctatttggggtcttcagtggttccacataaattttaggattttttctaatcctgtgaagaatgatattggtattttgaaaaggtttacatcaaatctgtaaattgtttttggtagcattgtcattttaacaatataagttcttccaattcatgaatatgggatattttcctttttttgtaaccagatcttcaatttcttttatcagtgtcctgtcatttaattgtagagatcttttgcttccttggttagatttattcctaggtattttatattttctttctgtagctattgtaagtaaggttgctttcttgctttatttttt

SEQ ID NO: 32194 - DNA, 1065 bp, Homo sapiens
ttggagatgatcttgaagtaggagaatcaatgacagcagtacaagtcatgatagtgagcctttctgacctcacaaagtatttgtaccagtagcctgctatcttgaagctgcccccaactctttctttgtattgccatttaggtttccctgagctttgagcagattcttagctaggcaaagtagctgctggggcccaatgagtgggggatgctcaactgaggactcctgtgcccagtgcggtatgcagtgttcagagagatttcccttttctgtgtttgatttgcttttaggagcctctcatcatgttccacttttcctcagcccctaccatcctgtttctttattatcacattccatccccataagcccagctgaaatttttaaaatcctgggattatggtcagtttttggcatctcacaaagatgtatccctgagccaaggcagcctgataatcaccggctgggttttggtatcctggtggttaagccacttttgcacatattattgagtgactgttgaaagacttcttgtgaggtgaagagtctctggcacactgttggatgtgacaagagctccatgaaccccggcctttggctccagttttaggagcaggtttcctttatttgctgagcagcctttaccgttatgaatcttgcctttttgcaggaccagtggattctgcaaaggtttattaatcttgatttaatatattcatatgaaaaaatacaacagtgagagaataaagcttatgtaggcgttgcaggggtccctttgggggttcactttatattactcatagcagtgaaaagtaaaaatggcaagttatattagctaagttcgagatacaaaaggcaatattaatttcacaggaagtgtaaaaagatatgcaaatgtgatcaactccgaggaaaacattgcaatataccactccaggctttgaaattatgcagtttaataaacacttgttaagaagcttcacacaccaaatatcgaattttaaagcaagtgtttctgatcacgtactgtttttcaggaatggcattattttcctaagcttttggaac

SEQ ID NO: 32195 - DNA, 1081 bp, Homo sapiens
tctttaatccatcttgaattaatttttgtataaggtataaggaagggatccagtttcagctttctacatatggctagccaggtttccccagcaccatttattaaatagggaatcctttccccactgcttgtttttctcaggtttgtcaaagatcagatagttgtagatatgcggcattatttctgagggctctgttctgttccattggtcaatatctctgttttggtaccagtaccatgctgttttgattactgtagccttgtgtagtatagtttgaagtcaggtagcatgatgcctccagctttgttcttttggcttaggattgacttggcaatgcaggctcttttttggttccatgtgaactttaaggtagttttttccaattctgtgaaggaagtcattggtagcttgatggggatggcgttgaatctataaattgccttgggcagtatggccattttcacaatattgattcttcctacccatgagcatggaatgttcttccatttgtttgtatcgtcttttatttcattaagtagtggtttgtagttctccttgaagaggtccttcacatcccttgtaagttggattcctaggtattttattctctttgaagcaattgtgaatgggagttcactcatgatttggcgctctgtttgtcttttattggtatataagaatgcttgtgatttttgcacattgattttgtatcctgagactttgctgaagttgcctatcagcttaaggagattttgggctgagatgatggggttttctagatacacaatcatgtcatctgcgaacagggacaattggatttcctcttttcctaattgaatgccctttacttccttctcctgcctaattgccctggccataacttccaacactatgttgaataggagtggtgagagagggcatccctgtcttgtgccagttttcaaagggagtgcttccagtttttgcccattcagtatgatattggctgtgggtttgtcatagatagctcttattattttgagatatgtcccatcaatacctcatttattgagagtttttagcatgaagggttgaattttgt

SEQ ID NO: 32196 - DNA, 1049 bp, Homo sapiens
gtgcaacagctatactgcaaatcgtagactactactttgacattctggttttatatgttggtctcatgagtgtgtttaatgaagtccatctcatgagaaatggattccatactgtgtgttgagaaaaccaaggccaagggggctgaagcctggtataggggaccatgtaaagtgtggatgactttcagctgggcttctggggagaaagcctgctgcccttcctcatacagcattctacatagcacaacacagtaggaagcttaagtcttttcctatttggactctgcccctttccaactctcaagttctgcaattctttgacttttctgtcttcagcccttgcttcctctgcttttctcactgcttttgtcacctagcagaaacagtggtgagagactgctacacaagagacattgtttgctgctggtatttaactttctcctggagttttctgtggatgacattgatttatggtgcaaagggccctctgctttggagctgacctgtagagaaacagagtccctcaggccttctgtgaggctgggacccccttgttccagcgacagggattggtatttatgtgagactgtgggatatccccctagagccaggtgattcctgcagtgacaatgtgaagaaaagtagcagagggccgggcgtggtggctcacccctgtaatcccagcactttgggaggctaaggcaggcggatcacaaggtcaggagttgaagaccagcctgaacaatgtggtgaaaccccatctctactaaaaatacaaaaattagctgggcatgatggcgtgcacctgtaatcccagctactcaggaggctgaggcaggagaattgcttgaacctaggaggtggaggttgcagtgagcggagacctcaccattgcactccagcctgggtgacagagtgagactccatctcaaaaaaaaaaaaaagaaaagaaaagaaaaaagaaaaaaaaagcagtagaccacttctgcacctgagagaggcagacattctgtgagctcacatatttttctcatcagactctgaaacag

SEQ ID NO: 32197 - DNA, 1043 bp, Homo sapiens
tatagaacttcaaactccactaacagataatatacacacatagaaagtcttaatgctgatgaataaaaattatatttactaattctttatttcagaggaaaaaagcaggagattagaaactgatacttttcaaaactttatacatttggaaactcaaaactgtacctgtcaataatttgtgagtcaaagaaaaatgatgatagaaattagtacatactttaagtcttgtgggacacaaagaggtatatagagggaaatttatagactcataaatgtatacgttagaaacggaaggagacattgttagggaattaaggattcaattaaaaaggtataaataaaatagcagagtaaacccaaatacagtagagggaaggaataatacaaaaatattaccaaaaatgaaatagaatacaaagaaacagtagagaagatcaaccgagcaaaaaatgattattttaaagactaaaacagcacattctcacttgtcaaacttgatcaactacaaagagagaagaacaaagagagagagagagagagaaatacaaacagtattagaaatgaaaaatgggagctaaatatagagacaattgaaaatagaaggtcaaaagaatataccatgaataacttctttatggccatactcttgaaaatataccttctaattaacagggataccctatgtatatatatccatgatatacacattgtaagctagtgtcatgactagagattgagaaacataatgaccaggttaagtctggcttctgagaatgaaaattcattcattcactcaattaatatttgtggatacctactgtatacttttaattatgctggtgctaacatatttttatgaatgagagagacattaaacaaatcagtaaaaaaaataactacttcagcctggccaacatggtgaaaccttgtctctactaaaaaatacaaaaattagccaggcatggctgtgggcacctataatccagctactcgggaggctgaggcaggagaattgcctgaatccaggaggtggaggttgcagc

SEQ ID NO: 32198 - DNA, 1050 bp, Homo sapiens
ttggcgttgtgtttctttttgtacaaaggttgtcaaatgggagtgggaaggtggtacatctcatagctcatctgtcagaaagtattgcaggcatagcaaggttgaaaggctggcatccacgctagctaaaagcagagattgcaaagaagtttggcctccaggagagtaaaaggggaaatgctgtcacatgctcccctcctgccaccattggtgtggtatttggtagggggattactgaccccttccttcgcttgagaatagtgggtcagcaaggcaagaatagggcagagagttccggaacttgctaagaacattacctcttgtaatagggctttaagtgtcaacgctttttctactgtatgctaggagtactaattgagaagctggcccctacgcttcaactatatacaactataagtttttttttttaatgttgcaaagtaaggttaatttttatggggaatattttatgccctgctttctgttatgtgccagacaaattgagggcgatggaaaactgatgggtgatgaagacaaaagagcggtgttgaccttttggtaaatcattcatcatactgcttcatctgtaagtggttttcaggttgcagctcatatttgctaatcactacacttgactctcatttctgcaggggctgattgttttgttgtggattgccttttctcttttaaaaaaattttggttattgttatagctgtttcattactaatacttcctccaccagagggggcttgtgaatagagttgggaattaataattcagtttctgctgctcttcattctccttagtagctgagatggactttaagcaatccattcacctactctgttttgagtcttcttgtccccagtggaattcaattacaagatggctgtctttgacagtggccacagtctggaatagttaactagtgttaatggtctagcaccaggatatttttagttttcatgttgatcaaagtcccattagggaaaactaaaggggaaagcaagaataacttcttagttcaaccctgggtcacatactagaaa

SEQ ID NO: 32199 - DNA, 1049 bp, Homo sapiens
ttctactggctatttcaaataacttgatatcattaatttttaaaaagtggtaatattaactaatgtccacctgagttatcaatttaacaaatatgtagtgagccaggcatagacattaatgtctctgagcctatgaattgtgtgcatgattttgaacaagcgtctgtaatattttattaaatgattttcatcaccctggataataaacaggtgatttgacttagcagaatgcaggtgctatttttaatacttagtgctctctggaggccttccaaataataatatcatctttaaaagctttggattccccaaggagcaataaaattgtgctgagtattgtctgtgataaataacacatctcccttctccactcttccatactcctacttgagaaagcttcagatttcctgacattatctgagggttgattgcctagtgaaggtcaatacttctttgttttccattactacatgtttctttgtgatcataccaaaatgatgagaatgtgaccagcttttaaaatattaaaaatcagggaaaataaaagcatgaatacatcaacaaggagcgtaacttaagattttagtttctaaagtggaaatagcttaaattctttcctgaccagtggagttcagggctaccaacaaaggactggaggaaacaagatcccagaggaaaggagccacagagatgtaagttcaacatactgcatggaattttcccttgaggcctttttgtacactcccagggagagacaacaaaatataaagctgaaaatatctgatacaggagtaaatggcaaagcagatattgtagcagtctcagtgtctcacagagttcagggctttcaaagaagtaggaccatggaaatactcaaggtccttgaggcccctgaagaactacaacctagggtaagagcaaactggaaatataccagcctcaactggattaagatgattttcctgtactctatctgcctgccagaagaaaatcaaatcatctttggagaaagataacatcattcaaaacttgtacaatttccataaaaa

SEQ ID NO: 32200 - DNA, 1043 bp, Homo sapiens
agcaaatgatcatggtctgtcttgtgacattccttatattgttgcttcattctttacattttttgtggtgtttttcccctcttctttcttcagctacgtcagttactccttagggacagaaaagatgttgtgtttattttttttatccttcttatgctttatacagagtaaatgcacaatgattccctgttgtttgactgatagttgctgttggagatggaatgttttctaaagaatgttgctgaatttatcttgtcttagaaatgtggaaagtagggataaggaagacgctcagtgcatttcagtttaaaatatgcagcttttgagtagatgaatttgagataactctgttctggtcagcatagctcagccacagaaatggtttagtttttcatagcagtgaaacttcctttctctaaacagcagatgaggttgaatcacatgaaattgccagtattggagcaacaacatggcaatatcatgtggctcaatctaataagacagatgagctgacaataatttattcctttgactaagtccgagatggaaatgagctaatgggaaggaggcccctcttctgctgtcacagcttgcaggagagagaacagcggaatgcagatcctgggacagagggggtgatggcaggggcagcaatccctgaatgagcaatgattcttgtcatgagttggcacttctgtggttggcacatccttcctgctctgatgctgccctgagaccctttagtgtcatctaaacagaagtcatgacgggcccagaagggtcaggcatgatccataggagttataacacccatccgctgccagccctgtctgccctggagaactgccagaggaggtaggacatggcagctaatgtcactacttcacaattttcttctatttccctctttgtctctactacacccaataaagtagctcctcctcctttttccctctttattaaaccctgagttttgagcgctttgttcagtctgctgatgtgggaaggttggagaaggctggcattaactgttttttctttaa

SEQ ID NO: 32201 - DNA, 1051 bp, Homo sapiens
tcagcaatagagaaatttgaaatttgggagcataattaggtagaaagatttactgttggcagtaaggaatccagataatcctattaaccaatacctctccactttggggttttatcttcacagttttcttttctatcagcatttcagactgtttacctattcctccagtttaactgaaagatgtatttaccagtattcagaaaggagaatgtacatagaattaaagcaatttttaaaaaggccaagatctattccagcctctgcaacctcttaatctagtgggaggcagacagactaaagaataaaatactaggctggctttgatagtgatagtaattcattggttttcaaagtgtggaccctggactatcaggatcagcatcacttggtgtggtagactgaataatgacccctcaaagttgtccacatcctaatcctcaggtgaaaggactcaggcctaagttacctcttatggcaaaagggacttcacagatatgatcaagttaagggggttgagaatgagagattattctacattatctcagtaggcctaatataaccacaagggtcgttataagggggagacaggaggtaagcgttagtagtaggagttctgaggacagcagtaagaggttggagtgatgcaagagaagggccatgagccaaggaatgcaggcaacctctagaagctgagagaaccaaaaaaatggattctaccctggagcctccagaaggaacagccctgtcaacaccttgacctgttttgggcttctgaccaccagaactgtaagaagataaatttatgttgttttaagccactaagtttgtggtaatttgttacagcaacaggaggaagctaacgcacctgggaatttatttgaaatgcaaaatctcaggccataatttacatttatccaatcagaaactctgggggtggaaccaatctgtggtttagcaagtcttccaggtaattattatgctcactgtattttgagggctgctgttagaattcagagaaggaattgtacccgtctgtacatgagatagagta

SEQ ID NO: 32202 - DNA, 1027 bp, Homo sapiens
cattgtcctgctgctaagccgagctttttcatcacctgccctgcggttctttgccattgctgtggctgacattatgtgcagagctgtttaacttagaaacgggaagtagctttggaaattaactggctcctaagtagtcctgaggtcatcgttttcctgaagagagcagtcaccatttgtttatttatgtagctgactttctgatcccctgaaatacatatttttttaaattaaggtataacacatacatcagtaaaagtttataaagtatgctaatttaagtatatggtttgatgatatttttacatatgtatatccatcatgtaactgccatctagatcaagttatagagcacttttcagcaccctggcaggctcccttgtgctctttccaaatgttttccaaatacggtcccttataatgttaccactgctttgatatctaccaacagcagttagtttcacctgttcttgaacttcatctaaatggaattacacagcatgtagtctctcctgtctagctttcctcaatcaacatatttgtgagttgcatccatgatatcaagattcatgttcctgttggtgagcatctgaattatttccagtttttccagaattctgttttggtctagattctacctaatgtcttcaggacattaaagaggtgacatttgtccaagggcctggagcacagagatgctctatgctgatggaaacctccatcctgtctcccataagtctgtattctcacctgaatgatcagagtagttgctgagtgctttaccttatgcttctctttcttcttcctaattttaataataataataataataacaacaacagctattattatatgtatcaagtactaggcactaacactactctgtattatgtgttatatctcatttaattttcaccaagactctgggaagagttattattatagttttcacgtgaagactttagtaagtttgatggagtccctaagatcacatggcatattgatggcagagcaaggattcaaacct

SEQ ID NO: 32203 - DNA, 1003 bp, Homo sapiens
attacatgggattgttgagtcacataaatgaatgaatgcatgtaaagcattttgtaagagcttaatattgttagccattatgattatcagtaggtctgcaataataccctaagtggaaaatatggactaatgggctaatattggatcagttgagttaaatgtatttacagtttgatacaaatataagatcaccccagatccaataaattcaatcagttgtttaccatttactttttttttttttggtaatcaagtgtaggaatgctttgtcatcaagtatatttatagcatagacatttttggtaataattgaagatatgcgcagagataccatgcttcaggtgatgtgattattcttagaacattgaggcttgttgttatttaccatctctttctagtttcaaggtgccacttaggtagatgaaacttctggctgtatgaaagattgttaatgtaaatcttctgcactagtgactattagggtaggtctaaaatatcaccttgtcatagaattctctccaaaatagaaaagaaaccttcaagctcttttcgttatttcctaaagggtatttgtaaccacagtaactatgaaaggctacccaaatattatatttcccatttttgtcaaagattaggttaccttcatgttgtaatttcattatttatttattagaagttccatcagacaggatatgtatttttcttaataataccaaaaaggaaatgaattaatcgttaatcttggatagatgaaatattttcaaacatgtactccattctcaaatcataataaaaggagtccttggtagtgagattgttaggaagcacttctttgagtaggttgatttgggagcagtggggcaggagtaggcattattattatgtagtatctatataataactctagtatatgaatttgatctgtattataggaatatgattttacagcaaccagttaaaaaacaatttcattgactttcactaaggcatcagtttaataacc

SEQ ID NO: 32204 - DNA, 1043 bp, Homo sapiens
tgccattaaccaggacctgaagtgtaaactcatgggatctctcccttgtcatcccatagcacgttgtatctatcagtgctgtgccttttatattataggtttatgtgtttgtcctccctgctcaactgtcttggaggcaggaaggagccatatcttacttctttgtatgtctccatagtttttgtgaattgtagaaagctatcttgactttccctaagttgcgtttccatagaataaatttttctgtaataatggtggaacttgaagctatgagcctacttcatcattgtgcaggataggaattgccaacatagtatatttaaatacaatgatctaatttggtagccttacctgaagctaaaaccatttataacccaaccttagtgatttgaagatgagcctagggctctgcttaagagcttctaggttcctcttagtttaaaataatggtcaatttagtggtatgctggtaaatgtttaacagctggctctcaaggaaaaatatgtgtatgtgtgtgcatgcatgccctaatgtgcatgcttgcatgtgtgtttattattaattttactgatataaaggacatgtaacatgtaatttataaatatgaataaaataatcactactcttgattgtaaatcctggatagccagtagattctcacacactgctttggttgatttttgccaaattcttatatccatagccagtctatgtttgcaactgatgaataatcatctttctgtcatacatattgtatgatagtttataatactggaagaatgggttctccatttgtgtgtgtgtgttattcagaatataacagccacagatatggcacactttaagttaatctgcatattctccatcactctcaagtcaacgaaatgatattgagtcttgatttgtggcatttgccagtttggctgatttcaagctaccaatgtgaatttactgcaagtgaattaggaagagatacatgtagcactctattatgtagtgtttccactctacaaatacaataggtgcaaataagcttaaagag

SEQ ID NO: 32205 - DNA, 1049 bp, Homo sapiens
atgtaactttttcattgaaactaccagacctgccatatttaaaattcctgtctttccatcctcctgatccctctaaggctgctttgttttttaatttttgtccttagccttgaactgtccgtccaacataccatttaactgagtcacttatgtttattgtatctgctttcccaccactagaatctaaactttgtgagtacaaagatctttgtcttctttgttcagtgatgtgtccaatagaagtttctgtgatgattaaaatgtatatggcagacattagccacatgtgctaattgagaacttaaatgtggttagtgcaaataaatccttgaattttaattttatttaattttaactaactgaaatgttaatagtcacatttggctagtggctacataccataaatgacactgcagatctcgcaaacgtattgaatgaacgaatgaatgtctctttagagcattgcttctaatactttaaaggaattacctggggttcttgttaaaaatgcagattctggccaggcatggtggctcacgcctgtaatcccagcaatttgggaggctgaggtgggtggatggcttgaggccaggagttcaagaccagcctaggcaacatgaagaaaccctgtctctactaaaaatagaaaaattagccaggcgtggtggtacatgcctgtagtcccagctaatcgggaggctgaggtaggaggatcacctgagtctgggacgcaaaggttgcagttagctgagatagtaccactgcaccccagcctgggccacagagtgagtccctgtctcaaacaaacaaacaaacaaacaaaaatgtagattttgattcaggtctagggtggagcccaagagcctgaggttctaacaagctcctaggtgatagctctttacacttttcatagcaaggctctggaagactaatattgccttgcttttagtttgtgtgtttattaaaatagaccaagcagttcctcttttcctggacaagagggattactaagaataacctgttagactcaaataacagttggtaggccc

SEQ ID NO: 32206 - DNA, 1029 bp, Homo sapiens
tttccttattttcatattcaaacaaattcaaacattatattacatatgttccttaagtctcttaacctagagaaatcctgcctccattcccactgtagacttgttatagaagcaggatcttttgttctgtaggaagtcacacattctggtttcatatgctcttctttaatgtgttccttcaccactcttattttttcttaagggatgctgtctctaaatttgatttaacgtaaatgtttttggcaagaatgctttgcagagggtgtctttactacgtttattaggaagcatccactattcagaacctgttttattgaagctgagattcatcattggttttggcaggtaacagactgactattccattttaaagttccatattaatttttcatgtgattgtttcttcaattgatgattgttacttaaatcaattatgtcattaagtaattgcaaaaatcatgatttctaattctgttaattattttccatttgtcaactagactttttctgtaaagaactttccctgactgactaggactgtttggagcgcacttcttttccttgacttagatttgtcctacgcaataattttagtgtggtgttttagtcccttttgtgctgctataatagaatatgtgagactgggtaacttataatgaatagaaatgtatttgtctcatggtcctagaggctgggacatctaagatcaagggtctgcatttggcaaaggcctacttgatgagtcatccaatggcagaaggataaaagacatgcacacatgagtgagggaaaaaggcctaactcattcgttttatcaggaatccattctggtgataactaacccacttctctgataacataattaattcattcatgaggccagagccctcgtgacctaattgccccttgaaggacccacctctgttgcactgggaattaagtttccaacacatggactttgggtgacacattcaaaccatagcatttgatgtgctaattatatatattttaatatgctgggaattaaac

SEQ ID NO: 32207 - DNA, 1044 bp, Homo sapiens
agccttctctcaactcgtcaaattcattctccatccagctttgttcccttgctggcgagcagctgcgttcctttcgaggagaagaggcgctctgatttttagaattttcagcttttctactctggtttctccccatctttgtggttttatgtacctttggtctttgatgatggtgacgtccagatggggttttggtgtggatgtcctttctgtttgttagttttccttccaacagttaggatcctcagctgcaggtcttttggagtttgctggaggtccactccagaccctgtttgcctgggtatcacctgtggaggctgcagaacagcaaatattgcagaatggcaaatgttgctgcctgatccttcctctgaaagctttgtctcagaggggtacttggctgtgtgaggtgtcagtcggcccctactgggaggtatctcccagttaggctacttgggtctcagggacccacttgaagaggcagtctgtccattctcagatgtcaaactccatggtgggagaaccactgctctcttcaaagctgtcagacagggacgtttaagtctgcagaagtttctgctgccttttgttcagctgtgccctgcccccagaggtggagactacagaggcaggcaggcaggcctccttgagctgcggtgggctccacccagtttgagtttctgggcctctttgttttcctactcaagcctcagcaatgatggatgcccctcccccagcctcactgctgctttgcagttcgatctcagactgctgtgctaacagagagcaaggctccgtgggcgtgggaccctccgagctaggcgtgggaccctccgagctaggcgcgggatataatctcctggtgtgccatttgctaagacagttggaaaagtgctgtattagggtggggttgttatgattttccaggtaccatttgtcacagcttcccttggctaggaaacggaattccctgaccccttgcactgcctgggtgaggcaatgcctgccctgctttggctcacactccatggggtgcacccactg

SEQ ID NO: 32208 - DNA, 1024 bp, Homo sapiens
gtgtgtgtttgattgaattacttagcattttaccagatgctccagagccttattgtttttgtcatcattatcatcatgagcatcattgtcagtcatcacaatagctcttgtttatggaacactttttatgactcagcactgtattaagcactttgcatacaaaataacatttattttataattacaacaatattatcgaatggattctaccattatccccattttatagtttaggaagttgaggctgagaaccttgctggaagttatacatctggaaagtgatgtagcggtgatttaggtttgtcacactccagagaaagattatatactcttaagatctgtataataatatacaaaagtggtccccaaaggtgttacatattcttagtttgttgttctctttatgttggatgtggaagtgggatagagataacattgtggcttttggaaagttcaaactctatttctgttggcttaatttcattatcatttctttcatgtatagaatattgtttgtggggaatcaggcaggagagacacaagattagataaattgtcttgagaaggcctctttgaagaggtgacattgaaactgagatggattgacaaaagtgaggcaggcatgtgaagatcagggacagggtgttccagggagagggaagaacaaatgcaaaagcactgatttgggaattaacccaatgggattagaagaacagaaagtagatacatatggtgggagaggagtgaacaagggagtgagtggtaggagatgatggagggaaaggctatgtctgtatcactagaatcttataggacatagtacagaatatggagtttttatcagcacattagcaaattcaaggaggaagaataatatgatttagtttatatgatgactttatttagttataggatgaatttctgcttctggtaatgatagggtagctaataatccaccaagagaataactagaaaagccagccaaaataaagagaagatatttgtttgaaggtattgaagggct

SEQ ID NO: 32209 - DNA, 1044 bp, Homo sapiens
gcacattgtgcacatgtaccctagaacttaaaatataataaaaaaaagaaaagatgctcagcgttatctgtcattagggaaatagaaatcaaaaccacaatatgacaccacttcacacccactaaaccagacaacaataacaagcatcagcaaggattcgggaaccttcatacattcctggtgtaaaatttaatacttgtagaattgttcaattacttggataaaaaaagatcaaggaatccagagctgttttttgaaagaattattaataataaaatagaccactagctagactaataaagaagaaaagagagaagattcaaataagcacaatcagaaatcacaaggaggatattatcactgaccccaccgaaatacaaataactatcagagtatattataaacacctctatgcagataagctagaaaatctagaagaaatgaataaattcctagacacgttcacccacccaagactgaatcaggaagaaactgaaacctagaacagaccaatagggagctctgaaatttagacaataataaatagcctaccaaccaaaaaaagcccaggaccagatggattcacagctaaattttaccagatgtacagagaagagctggtagcattcctgctgaagctattccaaaaaattgaggagggactcctccctaactcattctatgaggccagcagcatcctgatatcaaaacctgacagagatacaacaaaaaaaaactgcaggccaatatccttgatgaatattgatgcaaaaatctttgacctaatgctagcaaaccgaatccagcaacacatcaaaaagcttactccctgtgattaagtaacctttatccctgggatgcaaagttagttcaacatatgcaaatccataaatgttattcatcacataaacataactaaagacaaaaactgcatgattatctcaatagatgtagaaaaggcttttgataaaatttaatacccatttatgttaaaaaactctcactaaactccttattggaggaacatacctcaaaataataaga

SEQ ID NO: 32210 - DNA, 1049 bp, Homo sapiens
agccttttagggttgctctgcccttcatttccctcagccctatgtgctttacttccaggaacttgtacagtagggcttgctctctcatcttcttggggtttttacaagatttccatgaggcccacaccattcaagttggaacctcctccaccacccaccctggtactctccccacgctccttccgggctttgttttctctacagcacctatcaccagctaacatgctaaatactttactagtttattttgttttattgttgatatggttcggctctgtgttcccacctaaatctgatcttgaattgtaatccttataatccccatgtgttgagggagataccagttgggaggggattggatcatgggagtggttcccccatgccattttcctgatagggagtgagttctcacaagatctgatggttttataaggcagttttccctgcccttacctgctctctctagcctgccaccatgtaagatgtgcctcttccccttccgccatgactgtaattttcctgaggcctccccaaccatgtggaactgtgagtcaattaaacctcttttctttataaattacccagtgtcaggcatttatttatagcagtatgaaaatggactaatacaattgtctttctctctcaactacaaagaagaccccaaaggcatgaagacaagttttttttttacttttgttttctgtcttgtttcctattgggccctgctgcctaggatggtgtctggctcaagtagatgcctgataaatatttgactgaaaatgagtgaaaatatagctgtcagactcatagatgccatagataccaaccagaagctgcagtatgaagtcaagtggctggggctttggaccacagaggtcccaacccagccccagctccacactgttgaagacaagacttagctaagcactggatcttggtcacttacttaataccctgagcagcaactcaccatcctgttacctatctataaaattggataggtaatacctacttcacagtgtatatggactggagaagattctatatgt

SEQ ID NO: 32211 - DNA, 1025 bp, Homo sapiens
cttatatctacttgatatgagtgaaattggatttaagaaaagaatatcaggccgagagtggtggtttatgcctataatcccagtactttgggaggcctaggtgggcgggttttattttctcctcacagttgagctcaggagctcgagaccagcctggccaacatggtgaaaacccgtctctactgaaaatacaaaaatcagccaagcttggccgcatgtgcctgtaatcccagctatggctaaagcaggagaatcacttgaacccaggagggagaggttgcaatgagccaagatcacgtcactgcactccagcctgggtggcagagtgagactccatctcaaaaaaaaaaaaaaaagaaaagaaaagaatatcacaagccattctgtgaaatgagtacaagaaatgaaagatgagaggtttgagggatactagaataaaagctaacctttggatacatattaatagtaatatacatgatgagaaaaagagggaaataaccttagttgaagtagagctaacatgctaagataaataatgcagttttgaggtagagaacataggcaagtatgccattcctggaaatgagtgggacttacttaaaagggtagctgcagagtcattccctatattatgaaaagggactgagtggtgttgaagaatcacaggaagaatacctctcatcttgaaatcatgtcttatgttgatgcatacatttggtctctagttcttaaaaagcacttcggtaggccacagggaatagggaatggattggaaaaagaagcagtaatataagaagccataaagaagttgtgtgggagacctctagggacagtttcactgtaagactgagaaacaagaagcaaatccaaagtaagtaaataattttaatcagtaattttcacagtgtagatttctcatcattgtgctacagattttttttaaaggtatgtactgtggcagtaaaatgaaatataaaaaaaatgctttccatgaatgcaatttggtggtatccttgactttcatg

SEQ ID NO: 32212 - DNA, 1027 bp, Homo sapiens
gctgtatttcttgaggtgtttaattttttgtgtgtctcacacagcaagtttcctggtggcagaacaacatctagccttgacatgtggtgtaaatctttatgctctcttcagaataaaatgattgcagcacttttctactatcagtggggcatgaattgctgatatgttatttgatggatccaagcatatcagttgtctttgtcaccaagagcctcaatggctcaaactctggagatagttattcaaggaagagtttcagtacttggccatgggatgccccacaacccagagaaacctgaaacccacgtcagcctttcgattctgtatgttcatcagttatctatttacttattgccactttgttgaatgctctgagatactgatgtttgtcaattacgatttgcttatgcaaagatgagaaaagatcttggctactgctttatctgtctacttccaaggcatgtcaaaagcccactagttttggaacttagattagttatccattgtcttaagctgtttgtgctgctgtagcaaaatatcacagacttggtcatttgtaaaccacagaaatttgtcacagttctggaggctgagaagtccaagatcaatgcaccagtaggactggtgtctgttgagggctgctctctaattccaagatggtgctttgttgctgcatcctctggagggaagtacaccatgtcctcacatggcaggagggacacatgggcaagagagtactccttttgacctcaagcccttttataagggtgctaatcccagtcatgagagcctcgccctcatgacttaatcgctacccaagggccacatctcccaatactgttgcactggggcttaagtttcaacaatttaattaattattaattaattaaatttaagtttggaagggacaccatcattcaaaccatagcacctatgttgtaaggtcaagctgagttgatagtatatgtcatgtgttcactatttaatgaagactttcctagagctcagtctggtgactttgatgggg

SEQ ID NO: 32213 - DNA, 1068 bp, Homo sapiens
cccaagtagctagggccacaggtatgcaccaccacacctggttaatttagttttttataagagacagagtctcattattgttgcccaggctggtcttgaacccctgccctcgagcaatcctctcaccttagccaccaaagtgttgggattacagatgtgggtcactgtgcctggactaattttatataataaatagaatcatacggtatgggcttctttgtgtgtggcatattttgctcaacattgtttgtgaaattcggaatgatctttttgtgtttaagaaataatgtaggcttggctgggcatggtggctcatgcctgtaatcccagcacttcgggaggccgaggtgggcagataacgaggttaggggatcaagaccattctggccaacatggtgaaaccccgtctctactaaaaatacaaaaattagccaggcatggtggcacatgtgtgtagtcccagctacttgggaggctgagacaggagaattgcttgaacaaggaggcagaggctgcagtgagccaagatcgcactgctgcattccatcctgggcaacagagtgagactctgtctcaaaaaaaaaaaaaaaaaaaagaaaaagaaaaagaaataatgtaggcttgtggatgtcaaacaaaatcacgtggtggacaaatactttggaaactttatagtgccttgcaaatctagccatggcatggctgactgagtaatctggggtgttttcatgttggggaaaaaattggtgtcattgaattattactgactgtcagccacaccatttgtttgtgcaaatttgacagtgatttataccagataactcatttatatcctaatagataaaatggtaagattttcagatactagggttccaaaggtcatcttagaaatgtactccctgaggtttattcttgtacaggttagtggacaattttttataattgactaattaaatggaggctagagtatatttgaacctaaggctatatcttaaggtttctacctttttctatttaattgcattaactgtgtgaattaacctataattacaacgtttttttcttcag

SEQ ID NO: 32214 - DNA, 1055 bp, Homo sapiens
attgaaaagtatccagtgtagatgctccaggaacagagttttgcttaaatgtgaatgactttttaagtctaaggctatctgaggtctatgtaatgatggaaaggtaataaatgaagttaaacactgaatatctggttttgccttccttataaatggattgttttaatattgcatctgcaaaacatcagtttctccccaagatgaacctctttttctcaaattcaggctattagagtttgggagaggacctgtgctattgggaacagagctatttgacttaaaatgtcatcccgttctgagaaaacatactggggccatgttagggcatccctgtgcaaatgccacattgtcagaatgtctccccctggggttagactagccatggcaccttccagtcctgttggggtggcacaatttactgcttacccattgcctgggcaccaacccagccagggtcagggagccaagctccctgagatttcatggaatttgatttgtctgtgactctatgaattttcagatgctaattattggctgattggtattctgctcctcagatgtcacctaatgattttccagagcttctgctacttggtaaatttatttttctgatgcatggcaaatatgacagcattgaatagatgtggcaagggcatgtcgtgttgtgtgtatgtgtctcaggccatagaagggtaggcttcagtagagagataacttattgttttgtgaaagcatggggtacaaattaagagaatgaatgaaaaccaagaacaaaactcaaaactaacctttccttaataatttgcaatcaattttcattcctagtaatagtgaaaacttataatattcttttattaaagaaattttacggagtatatgtgccagacagtgttctagaagatgtagatttaatatagaacaagacagatgtggtccgtattattgctgaacttatggtcaaatagaaagactttcacctacattttaacaatattgattagctccccaggtaaataacaaaagtaagaattattctggtcacctccctggactct

SEQ ID NO: 32215 - DNA, 1066 bp, Homo sapiens
tatcagcactgccctcatggagtctagtgaaggggacagataacacataggcaaacacctgtaataataatatgtcaagtacaagaaggaagattataagatactgtgatagaaagagggatgagtaacctattgagataaaatggccagacagaaagagctgagaattaagcagagacctaagtaaaggatgagagggagctggccatatgaagagctggtattaatagaatggggtcccaggcagaaggaatagcctataccaaggccttaaggtgggaaagagcttaacaccatcaaagggagaaaagaaggcccctgtggctgaaccatagagagggaaagggagactgacatcagatgaaattggctgtatagatagggcccaggccatacagggccttgaagtcaaagtatggaatttggatttttttcccatgggtaatgctcctgtccctggatctcagtattgtggttggatccatgctgtttgctgtctagacctctcttccactcatctgcttctccactacttctagactttttttttcccctccctttggccagaacatgagttacagtcctggctgatgcttccctaatgcctactatctccacaggctaatttgttacctgttaatacactctctggaccctaggttccatttgtataacccaattccttctcatttccttcactaggttctgatcagagcatctgcgatacccacttctgccccctaatgcggtatcacatccatatccctcctgatttgacttctctgccaaatggcagtgaaaatcaagaacaaagccctagcagtagtgaggcagatgaatacaatgaaagggactgacagtttgggatcttttaattggtggaaagaagaggagatacataatttttatatgttagaatcatggcttcaagagatttttaaaaagagcttgaaagaagctggttggattcatctagtctactctcctttatttgcatatttgaaaaactggctgtaaagaggaaaaatgacttggtgtgggtcacagacagtgcaattggcagaat

SEQ ID NO: 32216 - DNA, 1032 bp, Homo sapiens
atgtgacaaagggaagtggcagcgactgtggacagtggtggtggtgacatcagcagcagtagctttagtaggggaagaggaagaggagaatgatcgtaataaataatagttaatatttatacagttatataggacctgttgaatacttgcatagctcatttagtatttatgataatcccatcagatgaaaagggcctaattgaggctgttaataatgaaagaaaaagcagtcagttttaaaggaaccaatctaaagaaatgaaccggctctccgggttgcatagctgttaagtctaaggtcaggatggcgcccaggcaggctccatccactgtcctccccggcactctcgagcagcgcagcaatggcagtgcccatgttcaccagacagtgtgaggacagatgacacagagctggcacactgtgcagtgcctggcagagagctgcagcaggagtccctctctgcagcatgtaccctgaatcagaggaggggcttcataccaagtctttgtcgctgtcctttgtaaacgtcttctccttctcgtcctcattcttggtccagctgtaggagatcatgtagttcatgatgggtgggtggtagatagtctccggctggctccaggacacctgcagtgccgtctggttcagaggctgcaccttcatgtggatgggtggagagctgcaaactgaagatacacagggctcagctcagggagctttcagaacaatgcgccattcaatccgtgcccctaaggactgcagcctcaaaaagttgaaagagtaatacaggaagcacccatgctcccttctcctgggtcctcttaacattgtgtgtgtagagagagagggagaacattgttctccctctctctcacacacacgtgcacgggacacagatgcacacacacgtgtgcaagggacacagatgcacacacacgtgcacgggacacaaatgcacatacacatatgtgcacggggcacagaggcacatgcgcacacacacgtgcacgggacacagacgcacacacgcacac

SEQ ID NO: 32217 - DNA, 1026 bp, Homo sapiens
tcatttcatttctgtttcgtccccaatatatattgaagcaaatctcaggtgttttagtcataatttagtatcaaactctaaaagataagcatttaaagaaaacacactatcacacctaagcaaattaacaactttcgaatttttttttttttttttgtgacggagtatcaccctgtcgcccaggctggagtgcaatggtgcaatcttggttcactgcaacctctgcctcccaggttcaaacgattctcctgcctcagcctcccgagtagctgggattactggcgcctgccaccatgtccagctaatttttgtatttttagtagagacggggtttcgccatgttggccaggctggtcttgaactcctgacctggtgatctgcccgccttggcctcccaaagtgctgggattataggtgtgagtcaccgtgcccggccaattcttgaatgtttttaatgtagctacagatatacggtaggttttttccttcatcatatttccaaaactgtatctcttactaaactatttattgcttaaattttactatcgccttctatttgcttttaattccttgtactttttgttgatttctctggtgctttttctggcttgagctgaatgcttggtttgtttatttttaacctttctaatatgtagagtttacacaggctgtttttttttttttttttaagtacagtttggctccatttcaccaggttttgaaatgcagtgccttcatcatcatttagttttagacactgtgaaatacttattttggttacatctttgatgcatgaattatttataagcaatcctagatgtaaggatttcagtttctagttgtttctagttataaggatttgggatgttatttcactggtggtttctaatgtaagtgggttgtaatcaatgaatgtagccttgtatggtatctgttttgggggaatgtattgaaattccatttatggcctatgtatataaataaaccatttgtgtttgaagagactctaggtctctctgtgcagtc

SEQ ID NO: 32218 - DNA, 1096 bp, Homo sapiens
aaagcttattttcatgaagtgtgttccataaaagtagacttcaaaatctgccatagatatccatgcatgtacatttgagatcgcatttttctttcctttgctttgcattaaaaatatatttttacatctgtttaattcacaattttagcttgttgctttctggggtgctaaaattatgtttctgatggtatttatgagggaaaagaaaagcttgtttgattatactttgttctcatctcgtggtctcagctcgttgtgtactgtcatttctatagacttgtagagtgcaactgtttcttgtttatgaacaccatacatttatgtggtatctagcaaatagtacaaaaataacttaaagtagacctaaggagtctcatctgacttgtcagatagcttaaaaaaggaaaggatgtgatatgttttaaaaatgctttattgtagattttatatgaaataacttaatccttttgagaggactagttgatttgattctcatttcctatatatagcaatttatgctctgagtatctgtctgaatagtggattagctcatacatggcagctgatgccctgggtgaagggacttgctctccacttttgtaagccctgtgaagttgtaagaaatgttactgtcatgcataaaggtgtggaggtgcaggtcaccctactggaaactaggaccttattggacacctcagatcttggagtcagcatttgcctaaatgttcagtagaatctccaagagttcctgtgcctttagaattatttacctggactccaaactcttcatagcagttattgtttcataatgggttcttcatggatgctagtggaatatatttaagttggcaaaaggataaacactttcttttctttttaaagcaacataaaaagtcccatgttactcaaaaagtaacgtaaaagaatttatccatttatttttagagaagcttctagtagaattctataagaataaatagagttgctcacttccaagattgttgccttgcaagaataaaaggtgctggagatgctgattttttttttttttttttttttgagacagtcttgcactgtcacccaggctggggtgtag

SEQ ID NO: 32219 - DNA, 1045 bp, Homo sapiens
acattttggacacactgacatctagacagtaatttttaaaagtaggagtaaataaagtcactatactaattattattattattattattatactttaagttctagggtacatatgcacaacgtgcaggtttgttacacaggtatacatgtgccatgttggtttgctgcacacatcaactcgtcatttatattaggtatttctcctaatgctatccctcccccagcccctactctatgacaggccccagtgtgtgatgttccttgccctgtgtccaggtgttctcattcttcagttcccacctacgagtgagaacatgcggtgtttggtttcctgtccttgtgatagtttgctgagaatgatggtttccagcttcgtccatgtccctgcaaaggacatgaactcatccttttttgtggctgcatagtattccatggtgtatatgtgccatgttttcttaatccagtctatcattgatggacatttgggttggttccaagtctttgctgttgtgaatagtgctgcagtaaacatacgtgtgcatgtgtctttatagtagcatgatttataatcctttgagtatataaccagtaatgggattgctgggtcaaatggtatttctagttctagatccttgaggaatcaccacactgtcttccacaatggttaaactaatttacactgccaccaacagtgtaaaagtgttcctatttctctgcatcctctccagcatctgtttttcctgactttttaatgatcgctattctaactggtgtgagatggtatctcattgtggttttgatttgcatttctctgatgaccagtgataaccaaaacagcatggtactggtacaaaaacagatatataggccaatggaacagaacagaggcctcagaaataacaccacacatctacaaccatctgatctttgacaaaccttacaaaaacaagcaatggggaagggattccctatttaataaatggtgctgggaaaactggctatactaatattaaacataatttgagggaggctgtgtagagtagaa

SEQ ID NO: 32220 - DNA, 1015 bp, Homo sapiens
cttttaaaaaattacaaactacagaaatatataatgtataaattaaaattgtccacgattactctccccccattgactattcctttggtatttgttgttaggcatatgctgacacatagataactaaaaacaaacaaaaaaaaaagactcatgataatgttttgtaatttgttttttcacttaacgttatacaggttaggcatcccttatctgaaatgctaggggccagaagtgttttgtatttcaggttctttgtcagattttggaatacacacatacctcagagatatttcatgttcagttctaaaacacctcaatagagcagatatcacaataaagtgagtcatgcaaattttttggtttcccaatgcatataaaagttttgtttacattatactgtagtctattaagtgtgcgatactattctgtctaaaaagtgtacattaatttaaaaatactttattactagaaagtgctgttgatcctctgagccttcagtgaataatgtttttgctggtggagagtgttgcctccatattgttggctgctgactgatcagagtagtggttgctgaaggttggcttggctgtggcaatttccaaagataagacaacaatgaagtttgacacattgattgactcttcctttcacaaaagatttctctgtagtatgtgatgctgtttgatagcattttacccacagtagaacttattacaaaattggactcaatcctcttcaaccctgccactgctttatccactaggtttatgtaatattctacatcttttgttgtcatttcaacaatgttcgtagcatcttcaccaggagtagaatctatttcaagaaaccactttcttctctcatccataaaaagcaacaattcatccattcaagttcgatcatgagatggccccatcttcaggctccactcttaattctagttttcttgctatttccactatacctgcaatctagaacccctcaaagttatccatgagggttagaatcaactttg

SEQ ID NO: 32221 - DNA, 1120 bp, Homo sapiens
gtacagtctcagtggcaaatacccaactctgatgttgtaatgtgaaagcaggcattggacaataggtgaacaaatgggcatggtcatgtgacaataaaactttacttacaaaaacaggaagggggcctgatttgaaacacagacccctgatttagagaatctatctactttatattggatggctaagagaagcctctctgcagaagtgacatttgagctgggactttacatggaatgatggcttgattacccagatttggtctgcctcgtcccgtggttttcaaaacgaggttcccataccagtagcactagtatcacctgggaacttgttaaatgtagactcttgggacttgccccagaccaaataaaccagaactctgaagatggagcccaacaatctgtttcaacaaagcttttaggtgtttctcatgcatgacaaagcttgagagccattactgttggctaatggaaaagccacattgctaggaatagatgaggccacatctagactccatcacttaactctgtaaccttgggcatctcaagcatcagttttcttagctgtaacacggggatgcttctgcccaagtctaaagtagctaacagagaagaagtgaattcatctttgtaaggatcctaggacaaagcagacaccaaataggtcctcagcaaatggtagctgctgtcctcatcagaatcattatttgaatctccaagacactgaagcagatttgcgtgcagatacggatgaagggtgtgccccagaagctacccaatcccattcctgtctttttgcctttgactggcatgccctggatatcacccaaatacaaggctgattgttaaaggaaaactcaagatgcttttaaaagtctttcattggccctgtttcttcagctccctttctggcctgttaacctagagcatgcgctgataccttttactgcaggaccgtgaattatacagctgtgactcaccaccacccggctggggccacagtgccaggcgtccagctttaccgttagctttcaggctactgacagtttgctcttttatgtgagaagctatttataccaggagggacaaaggctggcagatgctgggggaagggagagaagaa

SEQ ID NO: 32222 - DNA, 1079 bp, Homo sapiens
tagggcccagtgtgtgttgttccccactatgtgtccatgtgttctcatcatttagctcccactgcatgagaacatgcagtatttggttttgtttctccattagtttgctaagggtaatggcctccaactctgtgcatgttcctccaaaggatatgatcttgtacttttttatggctgcatagtattctattgtgtgtatgagtctaatatgtagactctataaggaactcaaacaaatttacaagaaaaaccaaacaatcccattaaaaagtgggcaaaggtcatgaacagatacttaaaggaacgcttatacattgttggtgggagcgtaaatgagttcggccattgtggaagacagtgtgacaattcctcaaagacctaaaaacgttaataccatttgacccagcaatcccattactggttacatacccaaaggaatataaatcattctattgtaaagacacatgcacacgtatgttcattgcagcactattcataatagtaaagacatggcatgagcctaaatgcccatcaatgacagaccggatagagaaaattatttataataaagaagaacccaagaattcactcataacttaagagtagtgatactaatataaactcattgattagccattgctcattttcttctaattttgaagttgcaaattggcagatgaaatcagggacacggtaggatttgtttagccagcaaggtattgttttaaaatttaattagctactaatacttcaaaattagagattttttcatgtaaaagtttatgtcttgaaattttgaagatctggaatctcattcctgtaaggatataattggttggagttgagtgatggccattccttttagacaaaacaaaacttgattataccgaatcatccgagtctctacaaagtcctttttattcttttgtgttaccttcctgaaacctacaggcacttccgttttgtgatctctgttctaattctcactacaggggagaaaatgtcttagaatagaaacactcccagaaaataatctccatgagaattgaaggcaattctctgttgggttattaacagga

SEQ ID NO: 32223 - DNA, 1027 bp, Homo sapiens
tctctcccttttcccagcagctggaatgtggctatggtgctagggagccaccattgacctgtcgatgatggtaacactgtactggtgtggtgcactcgggatgaaggaggctgggttcctgaaactgtgcaatttccaaatcagccctggtctgcatatactcagctggtacacaggaaagaaattagctttctcttccttaagccactgttacttttgtctttgtgatgactaaagatcttgaaacttagacacacacaaaggtaatgccaaccctttgtgattaagggttttatttggatctataactcatgtggccagacgttgctgctgatatatcatgggagcttttggccatgtgtggcttgattcctaaggcactgtaaaaagacagaatttggaattagagaaaattggattcaagttttggctctgctacttatgagctgtgtgaccttgagcaaattaatgaacatttccgagcctcagttttcccatcagtaaaatggaatagtaatgcctaactcacagagttgtgagcatttttgtaaagcacttagccagttgcctagcatatgtgaattatcaataaatggttagatacatgtatctgatggggctatccttagcgaagaacgcagaggtggtctctgcacgactgaacaaaaatttcagatggctgtagggttttgagtgttggttgtaataatgagtcatcaggcattctttgattctttgattgttgtgatagacagaggcatgaagcacccagccacaggtctggaggaactctgcaaacggctgtctgtgttcttctttcttctttcagcccatctttgcttcgtgtggtcagcaccccaaagtcattcattaaattatgaattcctttacatattcctctggtcatgccaaagctcttctgttgtgctagaagctagggcagtacttttttaaaaaaacggaataaccccaaacatatttgaattctatcttatggatttcgttttataaaattatgattttccaa

SEQ ID NO: 32224 - DNA, 1052 bp, Homo sapiens
aaaatgaggctaatatagtaccttccacatagagcaggtgtgatgattaaatgagatgatgtgtgtacagtgctctgcacagcagctggctaatagttagtgctgatatatagcacttaatatttatatttatatatttaaaagagcaaatatttgttaaccatttatgttcattcatttagcagttgtttgatttttttatatgctaggccccttagtagacatggcataaagatgagtaagataaaattcctgtattaaaaaaatttgtggtttcttggtggagacagtcgtgggaacagacaatcaaagataatggttataatcccatgtggtccctgggattatgtggtccccagagctgtgtacagccaaaagtaatttcaaactagttcacatttctaggataccatgaaggagaagcatatgttctaccaatacttaccatcttctcttttgttctctcatcaaccatccttagcccactcagacaagcaagtcactttgtgtcatgggccttgctggactcttctggcctaccccagccatgccctcctgccaagactccctgaagatgccattctgtttcttacctcaagttctctatagccatttttctctgcccaaaagactctctttatctcactgtaacctgactaacatctaattttcctttaagactgagccggagtgtcaccttctatgataggccttgctggtcttgttagatacctctcatctcctccttgttcccccagcacccagcgcaggccaccgtgacattgtttaaccctctggtattgtaattgtcagcatccctcaaagccttcttgactgttgtgtgtggattacaagctgatcctcccgaggggacatcatgatttcctgtattccttggcaccctagcaccatatggaatggaggtaggaaagaaggaaagtggcccagaagccatgcaaggagtcctccaagtttggcagtcatctgtggggcatttctaatgtgtctccacctgtaacctgtaaatgatgatttctggtctaggttatata

SEQ ID NO: 32225 - DNA, 1021 bp, Homo sapiens
tgagattctataagttggcaatccaggacttcagatgagaggaaagagcttgatggaaaattaatatccagtgttctggtacagagaactgttaagtcacgtggcaatgcaatttcagaggaatttaaatttgtttgaattcactgttatctaaaactgtgatctatgaattttatgaagagactttacaaaaagtgttgttgagtgaatgaaaaattcacaaccacaaaatgcatatgttgcaagaaacgtaaaaaagaggtggagcccaacgtaagacgtgacttgcttattgcttacacggagttcacaattaactttgaaaaatttatctcggttgcaggtagcctctatctataaagacccaagtattggaaatttaattaatattgttattgtgaacttaattgtgattcataatgaacaggtaataaagtttttttcttttttcttctatctgtatccgaaatggcatatctaattgggatcggtacaacagattaaccataattcttctctgtatttaggatgggccttccatatcttttaatgctcagacaacattaaaaaacttttgccagtggcagcattcgaagaacagtccaggtggaatccatcatgatactgctgttctcttaacaaggtatatggatttcttattcctcagatctttcagtctcaggtcaagttgatgggatgtggtcatgcattcctaatagtcagctgctagtggagggtttctcagcttaggcactgttgacattttgggctggacaattccttctgtgcattgcaagatgtttaacagcatccctggcctctgctcactacgtattagtagtactccctcccctcaggtgtgacaaccagcaatgtctccagacattgccactgccccccgtggggagggcagaatcaccttggttgagaaccacgaacctatagataccaagtgaggaataaatgtgttaggcagacctgaaaatacatgccttatataacaggcaagggcagctgctgt

SEQ ID NO: 32226 - DNA, 1053 bp, Homo sapiens
ttttttttttttttaattgaggaagatttctgcgtggcaatgagtactctactctttttgttgtcctggtttattttccaatcaaaataaatgaaaaaaactttttttttttttttttttttttttgagacagggtctcactctgacgcccaggctggagtgcagtggcatgatcgcagctcactgcagcctcaacctcccaggttcaagtgatcctccctgctcaacctcccgagtaactgggactggaggggcatgccaccatgcccaaataatttttggtatttttatagaaatggggttttgcccttttgcccaggccggtcacaaatgcctgggctcaagcaatctgcccaactcagcctcccaaagtgctgggattacaggcatgagccaccgtgcctgtaagaaaaaattattttctcactctattaaaatggggaagaaggccttttaattatgaatagtatagtacatactattcaacaaaatactacacttaaccattgctgaggaatatgaaaccaaaatgctgtgctgtgaaaactgagacaaagtcatctctaagtctaacttcaggaggtagatgtgtgtggaattagatatactcccaagtcacactagatacgaaagttaaccattctcaagtgacctaacgttcgtgggggtggatcaggtagtgttgaataactttccagtttccttcacacagtttttggttgttcctttttatgacttagtgtttggggttttcctccagaacctaatctcctgggcgttcaaaaggcattttgttgaatagtaggccttcctccaacccatctcctttgctgtattttgctttgtcaccaggatggtaattatgaactctgctcacttccctagtatctcctttataaaagatggcatctcaaagtggtccctggcttaaccaacagttgaagctgtttgtaaagcccttatgtcatgcaagttctttgcctgccataaacagccacaccaaatgtgcagagactcaattatgccgtcaggatttttccagctgggggcaat

SEQ ID NO: 32227 - DNA, 1013 bp, Homo sapiens
aatttgttttcaaaaatcgcttggaaatagttggaattaggtctacacgctcttaggtatttttgttttttctaaatttaaaaatggcttgcattctgtgtagttacttttgccatagagaccacttaccaaaatggcagatgattgcattgaaaaaataacagcactgcccatgaattaatgggattctatgtttatatagtttgtctgcatctgcaaatcaactttcacgtagactttggtaactaaaggaggaagagaaggctgttttataacctagcactagctgccggtagcacccccgtctccccagttttaacaaccaataatgtcttcagacagggccaaatgtcctttaaagagcaaaattagatgtgcttgagaaccactgctttaaccccttcaacacccatttggttttgcttcttagaaactctgtgttctgtttgtttaggtacaaatgaaatccacttctgggttattttttgttgaatatggattgaagaaattttattggagaattccccacttcttcttagtgttgcctctgcatctcctcagtaacggagtggcagtgtagtcagctgtgagggtctccagcgtgatctctgctgtcacccagcagtgcagcctgagccagccctgggctgtgtccatgagcctccagattatcatctgaagtatgggtaggactgcacccttctcagcactgtcatgacgatggaataagaagagggcctgttacaccttcagcgctgccctgttctgatgaagagtttcttattttctggccccttgctctgtcatattgaatggagcttaagagaaaagaggtggaggagaggctgaagcagacctcctgttttcagtacctttgacttagttgtctggagtagagaaaaggttagggaaggtgaaaaggaagagcctggaaggaaaggtggtaggagatgtgttccttttggtctgtgacagcacgttccttcagtaaacaataatgagaaaaaccagga

SEQ ID NO: 32228 - DNA, 1057 bp, Homo sapiens
tgcaaattggacctgtcttgcattttagtagcttatgtctcctacaagtcaaagacttctttaaaacttgctaaatgttttttctttttgatttagaagaaaaggggggaaaacctgtctctttgtttgcaaacaagtaacatgtggagcaaaaactatgaaattaatgtctcttgatgtgcagccaaatctgaacaaaacataaactttgagtaattagcctgtatgtgtttgtgtgcatgtgcatgcctctacctcagtctggaactgtttgtggtatatgtaagccttctgccctgatgacatcattatttaaattagtgaccacatgattccttgaattaaacaaaaatctatttcaaatatttcaagtttgtagtattctatcaaagttggtcttaatagctacttctaggactaattattcactttagagtgtggtgttacataagtttgccttgactacgtgtatcagggaagctttaaaattaagttgaataactgttgttctgcctgaaaggattgtttaatgacaaaaaaaacccacaacctagtcccttctttcaccaagtaaaataatatggtgcagtgggcctttccacaacagattcttgttcagacagaactattacctgtttaataaagttttggcctttgatatgaaaccttaggaagttctgtagagcatggttgagttttcagaaaggcacatacatcccccagtgccattgtaccaccacatttaaagaaataaaatcatccgccttagatagtgagctcttagggatcaggagctgtgttactgctttcacaggttaagtgctgagaaagatgggccagcccagagatagcaattgagtgatagttgtgtgcagttcaaaaacccaactgcattttcattaggaacaaggagaagataacatgcagattttattttatttcaaggagagcaaaacaacactattgtactgaaaatgaaacattaattttcatccatttttgcttgtgtaataagatggcctaggaacaaaatgagaaaaccgtaaacatttaagat

SEQ ID NO: 32229 - DNA, 1032 bp, Homo sapiens
ctgcactagacagggcagctggcattcatcactctttgtcagtaaagagcctacgtactttacaaatattgtttggttagttgtaccatgatgctagtggtagttattactgtcattacatatgaggtaaagggggagcagagaggctgagtaacttatctgataccatgctttctaatttaaaaattgatacctttttttaaaaaaaccaagttgtgtttattgagtatgcccaatgtgtcaggaactctgttaaacacattacttacattatttccttttatcctcttaatcttttgaagtataagctattattatatccattttccaatgaagaaaattagatttatagaggctcaagtgcatacacttacagagctgagtttgatttcagtctgatagaccccaaagttattatcttaaaccactgcattttacagccatttgtactattagtttactttagcacaatggcgtatgtaatggaaaagagaaccactggaaaggcccttccagcaccttcaggccacctttcagggcccattcagcatagtacacttggactcatgccctgcccctgtgtgtcattagcgcttgtcttgttgagtctagaacattcagatgtgatgggctttcaggtgtggtggacctgagaggctggcaggttctaccacttaccagttttgttggcttgggcaggttactcatgcttcctgtgactcagtttcctcattatctttactgatgtttagaagaagtatggacgcacccagccatgagcttgatactttgtaggccctctgttaagactgatccttcttccttacccctttcccttccctttctagcatgacttcccaaacactcttttcagtttctctttaggctttgaggccttatttatatgaagattcttttttttctttaaacaagctaagttttaaaaaactgactttccggcatttgttgagtaacaacccaacactagatgccaggcaagaatatagtgaagattaataattggatgattta

SEQ ID NO: 32230 - DNA, 1051 bp, Homo sapiens
atttttggctatttgtaagtaaagttgctgtgaagattcatctacgagatttttttttttgtggacttgttttcatttctgtcatgtaaataagggtggaattgttgggtcacttggctattgaaggtatgactttctaagatattgacaaattgttttcctaagaggacgaaccattatgcctgctaaacagtatatttgagttcctgtttctctacaaccttgccaacacttgatactttcagtctttttactttttgttattcaagtagttacttagtgggatctcattgtgattttattatttttcctctaatgactaatgatgtctaacatctttttatatgcttaatagtcacatatattccattgtgaactgtctgttcaaaccttgtgctgatttttttggggggtggcttcatgtggcatgtgggtgtcttcattcagtaaatacttgatgaatgattgaatgacctaagattggtttgaatatatgtatttttcctttcggtgacttgaaacagtagatagaataccaaataaaatagctcaaattgggttttattatctatttcaaaatgagcagctgtagctggaatcttatattgaatgtgatattaaagtaaagatcagtagtttcctgccctaggtaggaaataccatcatcttaaccatcactgtcatcctcatgatttactctttttgaccatagggaagttaccatttgaaggcatgagttttgtagctcacgtgactcctgggttgctgcattgtttctctaaggctaaaaatgctcttacctaatttgtatcttgtctaaaaatggaaagacagtctcagcctagttatttttagctgtcattgaagcatctttctccattaagagtgaatgctagttaggttgatctacaagccttctgttgatcctgtagactgtaatttgtgattatgattttttcaaatgtatctcttttctatgacacatttttgtgataatataatatttttagcttttcttttgttctcttaagtgtagagaattgcaaagaaa

SEQ ID NO: 32231 - DNA, 1021 bp, Homo sapiens
ggctccttgaatttttgaattaagacctacttggtctgtgatgggtttatttttttgttctgcttttaatacactggtgaattcattgtgctgccccgttttgtgaattcatgtgagtttttctctgtgtattcttcacaagttctctaataaataattttttctgtgttctgtaatgtactattaataaaactttcaagtggtatttttctggcatttcccccgtttttaaatcaccatttatactttggcagaaattactttgagattgatgactgcagctttccaaattgatttattctaggcaagcatcttctactattcttgaaatttggaggccatggaggttctgtttttaaggctgatatgttgctgtttcaaattatacttgaaactccgaacatatggagcttttcatccacccttccatcacccacgtaaatgaatatcataattttattttcatttggcctcatgaatctcagtgcccacacattgtgattgagactgacagtgtggttgaagttttgttggggagatcagagagcatctggtcagaatgtttctcctcctctaatttctgattcctttatcttacgagatacagcagagccagccccatgaacacttggaaagtgcagctctggaatatcaatggagccctctctcctgtctgttgggaaccaggagcaaaggcaaattgggaatgcatttttcagtgtctacaggaagtttgaagtgtatttattaacacaaaatgcatctgttgggctgcagtgatgagattaatcctcatttttaaatatttgatctgtaattgattaagcccttgaagcttttgctgtagtacaaatttagactactgatgtgcctgggaagtgcaccaggttctgaattatacagcgggttgcatagtgggcaaccttcaaaccagagaacacctggggccagcaggagtgggaatactgaaaaagtgaagggcgcactggaattttttaaaatttattttggtgatgactct

SEQ ID NO: 32232 - DNA, 1084 bp, Homo sapiens
tcaggttgattctaaagattatttttcaactccaggaagtgggttacatttataggggtgattattttggtaaataggacatatgtagaactatgtccaattccatactttttgatggtgagatgcttttaaagtgtgtagacattgataccttatccaatattacctcattctttctatgtgccagttttatattcttcacacagttacagccgcaggttggattggcatggccatgactttggatttttagcgacctcctaattttattggcttgctttcctctctggttcagctatcaatatagtttaaaggttttactgagaaagaagcttgagagggtgtgtaaaatccatagttggtgaaatatctttttatctttgtggcttaataattatcttttctccagggattcttttgccaactttttttttttttttttttttgagatagggtatcactctgtcacccagtttgccgtgcagtgaccccatcatggttcactgtagcttcaacctctcaggtttaagcagtcctcccacctcagcctcccaagtagctgggcctacaggcacgcacaaccatgcctgactatttaaaaaattttttttgttagagagacagtgtctcactgtgttgcccaggatggtctcaaactcctgggctcaaacaatcacctggctcggcctcccaaagtgctgggatagggagccgctgtggctcaggccggttgccctggcactcggggaggcgaggctgcacgtccaaagtgctgggattacaggtgtgagccactgtgctcttttgccatctcaattgcatggtttgattcttgacaaagtgcttctatgtggcatagcatcaaccctgaaacatatcagtcattaaatatttaatttggaagtgtgaaatggcaggttcactttttagattacacattagagccctgccaatcagcactgaaggaaagttgcctacatctaaggtttggtcagactttgggaatagaagtttatacaacatctacagtaactacggcaaacacattcgtgtttgatcaatgagctgtcattccctgaaatct

SEQ ID NO: 32233 - DNA, 1035 bp, Homo sapiens
gcaacaattttgccaatttcttacatcagttttttttttaatctaattaaaaaacgtatttcccatggtgggagttcatatcttattggatgcatttctgattgtttgaagcagtccatgttctgcccttccaagcacctgttcactgggcctgtttgctgggttataaagactatgagactggacaattggactcactgatacacaatgtctggttttgctaaggtttccctctaactctttgtggggataaaaaagaaattcacaattactaaaagatactcttcagtgtatagaaaatactccaaggggagggaaggattgattatatttaatatttaacatgccacccctaaaactttgcttgctcctacattgaactaccctgacacctttaaatgtaagaaccacaaattaatgatgaagaagaaaaagaagctgatgatcaggattagcacttactaaaggcttgccacgtgccaggcattattctgaatgctttacatgtgttaagtcacctgttcgccactagaaccccatatggagcaggtattattaggctctccatttatggatgaggaaactgaaacttgggaggaaagtaacatgcccaacgccattcagcaaagtaagtggtagacttggaattaggcagtcggaaccttcaggaagtctgaataattgggaaacgtagtattaacttattttaaaatggtacattatttgtgtttaaataatatgcttgcttgttttatctatttttttcaacttccagacatcttctcagctgaagaatatttaaatgtaaagcgttgggtacaattattaatgtgaggggaaaatgtgcaatacactacagagttttcaaaagttgtggaaacatcagcccaaataaatattttttaaaaaacacataaatatgagttttgtttgcatattcatttaaaactacaattaactgacatgtcagctgctcttttattatgtgtagtcctcctttatctgcaggagatatcttccaagacccccagtgga

SEQ ID NO: 32234 - DNA, 1073 bp, Homo sapiens
agagcacatcgtcactgtctgtgctgggaatgctgtgtgaaacctttttacgctgctctgctgtctgtgtgtagcatagtatttcagtgtaaatgcatttcttaataacctacccatgggccctgtggaccataatcattggctgagttctcctttggaattcccaatatccaaatatttctctcagattaaatgtctgtactttagattattcacactctgagtattactctcattttcccagcgtaaatctccccttatttcctttcccttttagattacccatggagacacatcattgctgtacctcacatttcccagcagagttttagctgagaagttaattaatgttcttgtaagaggagaatgcactttaaaaaaatctgcttttacttaaaatgagatataaaaagctgagacccatgtaggtcctgtgtgcggtgcaagtcctcttgagtgacggaagagcagaatggtccccaatttgtgaggtgggtggagaatgatgttggagttctgttggtgtcgtgaaggtctcatcatgcagtgggtcccacgggtatgtaacttgtgtcagttcctgctgagagcgtgctggctgcttacattaatattgtcccttgacccataaaatcattgtgctggaagtaaatgaggctcagcagtcagaccagtttcattttatttatttacttttattttatttatttgtttttttgagacagagtcttgctctgtcatccaggctggattgcagtggcacgatttgggtgactgtaacctctgcctcccagcttcaagctattctcctgcctcagcctcctgagtagctgggattacaggagtgtgccaccatgcctgcctttttgtattttttaatagagacagggtttcaccatgttgacaagggtggtcaagaagtcctgacctcagctgggcgccatgtctcatgcctgtaatcccagcaatttgggaggccaaggcgggtggatcacctgaggttgggagtttgagaccagcctgaccaacaaggagaaaccgtgtctctactaaaaatacaaaattagctgggc

SEQ ID NO: 32235 - DNA, 1019 bp, Homo sapiens
tggaaatttttcatcactgaaagtgttttttttttggatagtcctgttctagagatttctaaaaccttgtttgttcactaagcgtcctctatgaacgtttaagttctactccaaatccttctagatggtgatttccaaccatgactctacattaaaatcacctggggagtgtttgaaaatgccaattagaatcagaattgggagggggagggggctcggacccaggcaccactatttgaaaaaatgccctcagtgattccaatcagctgccaactttcacaactaccattgtagacaataatactttattttttaatatacaaatcagtgtctcctgaacttagtacctttcttttcctttgtcctcctttgaattctgcttagagagaggcagtggagtatgttagatctctgcgttggggagtcagttctgcctcttactagctgagtagcttttggttagttatttagccagtccaggcttttgttacttcatgtgtaaaatgtggacactggtacctgccttgaaacaagtgaggattaattaagataaggtatatgaatcactggtgacagtctctggcacataagcccttaataaaaatatattttatgatataattttaatatttcaaatgtatatgacaagtaataaaatatattttaaaatattacatgtttaatagtatagaatatgctattttaaaataacattcttgctaagataatactatatgatttgacttcatggattttgctctgcctgttagggaacttttaaatattttctttaatatatccaatgacgaattaaggtgggaatttaggcactcctttcaagtgagctgggggaggggtaggtattttggcgtaggaaggcatctatagagtctgctcttatctaccagaagttgcttgctctgctttcttggttagatccttgaaactgctcagttggaatgaatgaaaatgcccttagcaggtgttttctcttgagaaacagctaaggctggtagtgc

SEQ ID NO: 32236 - DNA, 1093 bp, Homo sapiens
atgtcctcttctggaatgcttcctgaaggacctgcttgaggctgttttacagtcaattaaaaaaaaaagtcgaaggaatacattataaaataatgatataaagtataatataataaatacattaactgtaacatttatcgtaattatcaggtatgcactgtacataattgtgtgtgctgtacttttctatgtctggcagcacagtaggttttttttacatcagtatcaccacaaacacatgaatagctagaatcttatgatggctacagtatcactaggcaataggaatttttcagctccattgtaattttatgggaccaccattgtatatgtggtctgttgttgactgaaatgttatgcagtgcatgacttaataaaggactcatctagaatttataaagatgtctcagaactgaacattaaaaaccaagcaattcaattataaaatgggcaaaagacaacacagatggcaagtaagcacttaaaaagatgttcaacattactaaccattagggaaatgcaaattaagaccatgatgtgttattactacacagagaacagctgaaataaaagatagtggcaacaccaaatcctggtgaggatgcagagaagctgagtctctcatacattgttggtgggaatgtaaaatggtacaaacacactggaaaatgatatgtccatttcttaattaattaaatatacatttacaacaggaccccagtcatattcctaggcattcaccctagagaaatggaaacttatgtccacacaaaaacctgtacatgattgtccatagcagctttgtttataatgttcaacaactaaagtgtgctacaacagctgaatggtgaagcaaactgtggtacatccatgccatggaatactgttcaacaataaagaggaacaaactattgatatacacaataacttggatggatctcaaaggcattatgctgagtgacgaaaaaacaatctctaaaggtcatatattgtatgattctatttatgtaatattcttgaaatgatcaaattatagagatgaaaacataatattgccaggcatgttgtggagaggtgtgtatgcactaaagga

SEQ ID NO: 32237 - DNA, 1162 bp, Homo sapiens
tcaaccaaaatgttgaagtctcactgtgttgcccaaactggactcaaactcctggactcaaggtataccccaaccccagtctctcaagttgccgggactacaggtgtgagccaccatgcttggttccaaaactacatttaaatcccagctctgctatttctgtgacgtgagacaaattccttagttaggctgagcttcagtgtcctcacttgtaaaatagtgaagagcgtagtacccagtggaatttcatcatcaaaagcacatttaacttatacaaaatcatctctgcatccttagcataaaagaataaataaacgattgagaggatgaatgaatgatagttgaatgatgtgttggttgttccccatgatgtgtaagctcaagagtactctcgggattttaaattcatgtattttgatatttatcatacacattgataaatatatttaagaaaatgcactagagatgagactatctccatatggataaaaataaaatttgtttaatatgttagttagaattatatgaatatgaaattaaagatttcttccgtggatcactttgacaacaagaatgctgtccagatcttaattttatggcctgtgtggacttagattttagaggaaaaaaaaccaccaggtggtgccggccagaaaagaaatagaaacctagctagggtatttccatccaggatacccttaacaatttgggaattctaaagcattgagccatctgcctcagattttatgttattaagtacattgaaattcttgagctttaaatcctcatgtagaagactctgtctctgatttgtgatttgtcatgctacattcttttagctgataggatttttgtatttataagaaagaaaattgcctctagtgatcagctgttgctttttgcacagtcatttcattatgttggcagtgttttcataagtaccgaacttcagggtagtaaaaatttggtttaggaaataattgtcctaaaattggtataaacaaatgtgcttagggttttttttttttttttttttgtaagacattgctattctttgtaatctgaaaggacaagtcaatgtttctttcctttgtttgggggagtaggaccccagaggatgaaagcaccagataattatatttgtcaacccatccatcctttc

SEQ ID NO: 32238 - DNA, 1044 bp, Homo sapiens
ccatctctagaaaaaatacaaaattagctgggcgtggtggtgtgtgcctgtagttccagcttctcaggaggctgaggtggaaggatcaattgaatccgggaggcagaggttgcagtgaactgtgatcgcactactacactctgccctagatgacggagtgagactgtgtctcaaaaaaaaattttgtacttatatttatatgtgtatgagatggagtctcatctcaatttattgcccagggtggacttgaactcctgggctcaagtgatcctcccaccttggcctcccaaagtgctgggattacaggcatgagccaccatgcccggcctgaatatcttttcacacttgtaggaacatataaaagtcttagtctttcttcatttccttttcattctttcttttttttttttttcactaaaatggtaaaatcccactatgaacagtcctagttttccttcttctctaccctctttcctaccccccccaccctgcctctctcctgtctttctctgtcttccttcccttctcctctccctccctccttctctacttgatttgactctcttactgtcttcctttctgcctccctgtcttcttcccctccttccctgctctctttctcattttagtgagtcactgccttggtccattcatggagccggggccaggggatagatagaaagatgcattaagacacacccttgccctctaggtcctagagaagagatcagggtgcatggggagatcagaatgtgaatagctcattgctacacaggctttccctatcatttggacagtctttctctttcacttaatgaatgaaactgaagggttgttggaggcccaggcttccagtattgaattgacgttggatcctgggaattaaaaaaaaaaaaagtatctcagtgctcaggcagcctattaaattaagttcagtccctgcccttcctgtgtttgtttactgatcattacgcacatttgtcaacattataggctcctgtctatgatagaaataaatgctcagcatccgtgtagaacaaatcg

SEQ ID NO: 32239 - DNA, 1045 bp, Homo sapiens
acatgacccttgtgttgtgtgtgtcagtagttcatttttattggttgtataatattcacttgcatgtacatacaataaaatatttatttttctattcatatgcatctgggtagcttgtagtttggggctattttcaataaagctgctctatttattgtctgagtgttttggtagacataaacactcctttctttcatttgtttggctttagaagacactgccaataggttctgatttgtatcctcttctgttttaatctcacactcagctttatgcttagagtgtgtgtttgtggcctccagtgtgtgcaggttagggacaggaaagagaaagagaaattgatgaaggtagaatggagaaggggacaggctaatatgtattaaagaaagggaagacagtggagaggaagagttggagacaaaataattattagttgggtacataaatttttaatatggattcaaattctagctctgccatttactagctacttaatgttagaaaacttaagtcaactctaacaagcacctatattatagggactgtgagcagtatatgaagcattgcctaaaagtaacagctcacatttaccaagggctttccattgctagtcattgtgctaatgtaattatttaatttgatctttacaacaaccccatgagctatgttctgttaattttcccagttttcccagttaggaatttggaagtctgagagggtcagtccccaggttacacaactggttagtagagcgagaactctgataagttgacaccagtgtattgactgcagaagactgggaggcagacaaagagaatgtctttgcttatagacaggaacaggtggagaactgttaccgacccaggcagaatagaatagcagccagtgattcatccagggctttctgggctgctccaataagggacaatgactgcgtggggttagggagaaaggaaagttggaaattttctttttgtaatatttagccttatctgaagggcaaggttttgagtttctgtcccagcattcagtagaaaactttgca

SEQ ID NO: 32240 - DNA, 1096 bp, Homo sapiens
agccacttgggaggcttaggcaggagaattgcttgaacctgggaatcagttaaactaaaatacaggtgactgttttggtaggaaaatattttcccaccttcttcttaccttactgatttcatgtctgagagctaagacactttctccaagtgtcttagaggcatgctgtcttcttctggattcaaattgaggtcatctctggggaacctctctacgtggatacaagtggagaaaaacacattaaaatatctgtgggtgtttgagagctgctcacattttcagggaggctgccaacatttatgtttgtgccctaagtattgtataagtccatgccctgagatgttactcatcccagtttcgtgtttgttggtaaagagggagttgtaccttgtagagtttcatttcttctctcccatacattgactcatattggtgattatgtcaaaaactacttaatttgtataaaggcatctccaacagcagtttatataaatcccatatgggaaaaggtcccataagttggaccacagagtatgttgatcacagcctggaatttggactcacacttgcatttgagtcccagcttaaacttggataaggtttttgttttgtgttaatttaatttttacttaaaaattagagcataggccaggcgcagtggctcatgcctgtaatcccagcactttgggaggccgaggcgggcggatcatgaggtcaggagattgagaccatcctggctaacatggtgaaaccccgtctctactaaaaatacaaaaaattagctgggcgtggtggcaggtgcctgtagtcccagctaatcgggaggctgaggcaggagaatggcatgaacctgggaagcggagcttgcagtgagctgagattgggccactgcactccatcctgggcgacagagcaagactctgtctcaaaaaaaaaaaaaaaagcatgatacatgcagataatcttaagaaattcaaaagtactttaagatttatcacaaaaacattaatctttaatatcactgctgcccattcttcagtgtgacatcacagagggcaccacctttaactctgtaagctgttccttctggcatttc

SEQ ID NO: 32241 - DNA, 1149 bp, Homo sapiens
aggtcattatacattatatctttgtaatattatatttgttacatatgtatacatacacacatatataaatatatacataaacatacacacatatatggcatctgtatattatagaaaatacttttactcacatttttttagcgcacagataatttctggtgtacctgtagaatcccaaaccccttggaataaccattttccatctgtcagattttgtggttcatagtttttgggagcattgaattggaaggtcttgggcatcctggccagtcttctggcttttttcttttttttagaaaggagaaattaaagcttttagttctttaaactcagtatttcatttttgagtgtttaaaaaaaatcttaaagattcttaaatgtgtatgtacttgtgtatatgtgtgtgtttaagacttgtgaatccagttgctagttttaattctaaatctcctttcatttctaatgtcattaaaaattttatcccatttactacttgtataattttattttcttaacatctgccagtggtaacttgcaatgtattccaacatgtttttcttcttaacgtagcctcataggaattcttttggacataaaggtttataatgggcctcttgaatactttggttgccaatgctagacatatactaattccctgctcagtacttcccttggctctgactctgaagatgaaagacatagtcttcctttctcaacctctccttgactattcttgtgcttttgtaaagttattgagatgggttctgatgcttcatatggcttcttagattttaagtcctgtcaccattaggaaaaatctgttctaggaatgtttgaagttcagggccttcacacacaattatgtagcagctttcttaccatcaggttggatagtgggaattgttttcacagtagagagaaggtaatttcgctaatcaactgggcaccttttataaagattgggttttgctgatctcaaaaaatcttagtttggtgataggttctttatgaaacacagaatataccatattgaactaatatcaacttgaatgatacagtcagttattgagagtgtaatatacaggttctaatagttgctaacgatgaatatgatgttaatgtttgttttatgtgcatgatcatttagga

SEQ ID NO: 32242 - DNA, 1033 bp, Homo sapiens
cagttttggaaacaccccgggactaagactttgaaccttatcaggtttttctgtaggtatttttcatttcctgctgaatgcgctcttacttcattcttctgttctctcaaaatagactgatctgcttcccagagcctggctgtccacactcctagcatatacttcttcctctcaagggttcatccagactgaagctggaatctcttagttctgattgtaaataccagggagaaggattctcaatggttcataataggtcagatgtctgcacctgtggccagcgtaatggcgttctatgcgaaaatgatggctgaaagtatgtcttttgtaacctataggggtaagaaaatggctagaagactggggagacagggtattcatctggtaacctggtggtgttcaccacagttgcctttttgtgtttctttgtggggcctcttactaactccctcttcacgccaatttcaagttcatcaaaacctagtcaaatggtgagtatttatatgtgtggtgttggacagacagatatggctaagtaattctgtactagtatattatgattaagtgaacatttattgagtgcttaccatatactaagccctttttcaagtctaacactaggcaaataatacatgactcttttaatttttgctcacacctttatcacctcttcccaattataacactgtgttttctgtctacctcttacacatcatgttcattgtagtgagtgagaagttatcttgaaggttggttagtgatgttgtgacttttaccttttatgtcctgggtgatggatgggatttttaagagttaatgagtccaaggatgcctgacataggaaagacacgatgttgcgtgtgtccttgcaataacgtgcaaagcaagacgatgggtgtatactgcctatctcttgtccccaagacaaatccattagtgtagaaagctcgtttttttttttgggtccaggtaattgtaatcatgggacacatgataatgtaaaagctaatctgaaattcttttggaactttga

SEQ ID NO: 32243 - DNA, 1033 bp, Homo sapiens
cccacattgatgtctcccatccttgaattcacttcagaccatcagtctccctttcctagtttagtcctatttcgagtaatatattctttttattattagatgctaccattttcaagatgtgccttcatagtaacagtatattttcagggagaagaatgacacacttctgcattattagctaatggaaaacacatgctcaaatatagtgatgttaaagaaaccaagtgagcaaaagcaaggttatgtttttaataagagaatgccttaattgtggataaaccatcccagaaactcttttatttcggtattttaaaaacacttggagaactctttcttatatccggaaagcaccacaaaaatctgtcagatgaaaagtctgttctgatctgtgtggtgcattcctgcctagatatgtagtcatttactactgtgtagtataatttgagtagagtgcagtcctcaactaagttgttagactacattttgtcctttttctgtaacttctgagtagtgtactctaaatttgctctgtagacctgagctgaggtgcaaagtctgtttttgttaacctgtgcacaatggtataaatatagaaattgagacttagaatttagaaatgtaatagtaattggctgagtgtgtaatcctagctccttgggagactgaggtgggaggatcatttgagcccaggagttcaagactgatgtgggcgacagagtgagaccctgtctctaaaaaaataagaaaaagaatttttttttttttttaaggcaaggtcttactctgtcacccagggtgtgtacaccacaatgcccagctaattagaaaaaaaaaatatttcatagagatgaggtctcactaggttgcccaggctaagaaaaagaaatgtaattgcacaagacagttgtctatctgttgagtttaataattaaaagttgggtcttgtattttgtagggtgtgcttgtgttttttctggtcattaatttttattatcttttgatactttgggaaataagaaacagctggtccttt

SEQ ID NO: 32244 - DNA, 1068 bp, Homo sapiens
ttatcttgcttggaatccccacatccctgaaataaagcgggcagcagctaatttacattcttttctttttacatttttttaatttttggggatacagggtctcactctgtcactcagtctggagtacagtggtatgatcacagctcactgcagccttgactttttgagctcaagtgatcctcctgcatcagcctcctgaatagttgggattataggcacccaccaccacactggcctaattattattttttgagacagggtcttgctttgtcacccaggttggagtgcagtggtgtgatcacggctcactgcagcttcaacctcccaggctcaagccagtcctcccaccttggcctcccaagtaacttggactacaggcatgtgccacaacacctagctaattaaacaattttttttttttttgtagagatggggtctcaactttgttgtgcaggctgatcttgaactcctgggctcaagtgatcctcctgcttctgccttgcaaaatgttgagattacaggcatgagccaccatgcccagactatattaactccttaaaggtgggctatggaaataatgttgatactagcccttcagtgatggtgtcagtacgggaagagaaaatttatatacttgagtacattttgagggtagcttcatgaggcactgtgagcaaaggcttctggtaatgagaatactctacctggtcatagacacaccttaacttgattcccaattgtgcatggaattggcattataaaagaccatccctagaaaatgggttatttgatcacaactagaagtcattctctatattttagaaccataaatttatgacttttattaaaaaattgactcatgtcagcattacatgctgagaataagcagacttctgagtgtctgccccactgtgttgcagattgaaatgtagactatgagtggtcattatggttaatgaccaagagagtcctctaatgataaggcatgctggagagctgccccaggagtctgttagaaaggctgatccacattttccagaggggaagtcggccagggagtcctaatat

SEQ ID NO: 32245 - DNA, 1049 bp, Homo sapiens
ggaggaccagaggtcacttgcgttatcatcttggttttggtgggttttggctggcttctttaccgcaacctgtttaatcagcaaggtctttgtgacctgtttcttgtgccgaccaatctgatcctgtaacttagaatgcccaacctcctgggaatgcagcccagtaggtatcagcctcattttacctagcccctattcaagatggagttgctgtggttcaaacacctctgacaaagtgatctgcctgcctctgcctcccaaagtgctggaaccacaggtgtgagccaccgtgcctggccacaagtggacattttgataaatacgtctccatcttatttggggaagttagtagtaaagactgagacacaatggaaagaccttggtttttcctttagatacaaataacattttttttttttttttttttttttttgagacggagtcttgctctttcgcccaggctggagtgcagtggcgctatctcggctcactgcaagctccgcctcccgggttcacgtcattctcctgcctcagccccctgagtagccgggactacaggcgcccgccactgcgcccgactaattttttgtattttcagtagagacagggtttcaccgtgttagccaggatggtctcgatctcctgacctggtgatccacccgcctcggcctcccaaagtgctgggattacaggtgtgagccaacgcgcccggcctagaaatataatttttaatgtgatttgcccttctaggaaagctgtgagatacacaggggaagtattttcctctttggctgataaaggaaactgcaacttggttcaagtgacttgcccaaagtttcataactcttagtaaaagtcaaagaatggattagaccccagaatttctccccagcccactctccattccacaggcctttggtgtaactcagcttcttaccctgaattattaccatggattgatttgctctttgaggcccttttgtttgtgggcatttgttggagttttaaacttttatggcttttgtgccccgaaagggtctcaagttatt

SEQ ID NO: 32246 - DNA, 1050 bp, Homo sapiens
tagataggaaagtttaaaaacttgggaatttagatagatgtggaggtttaagtttagatcctaccagtaagtagactctccccatgtagcacttgtggtatatcttagcactttggagagaaagttgaactcttttcagccttagaaacttggaggcatgtctcatacttcagctgaatgctggacatgttgaatattatactgtgctagggcttgtgaccaacaataaaaagtacatttccttcttttgagggattgtagtcttggtaaaatgaagcagtaaacttggtcaagtctaaatgacgattgagacagaagataacatttgtcagtgaattctgttttgttttcttaagtctgcacctaacaggaacttagcaatttccagccagctagtagtaataacaacagaaatagcaattgacctttaacacctcgtccaacaatgtttagtgggtggttactctgtgttaagcattattctagaatatagggacacaaatgttggacacagcttgcacaggtttattatgcaggtgatgggaaggtttctgatatgacacgtgctctggaccaagggccttgcattttaataagtggagtgaataaaaatttatagccaaatgtcatgttggcagcaatggaagtgtgctccggaggtgacaaatgctttgaggaatatagagtgtctgacagcacaatgtgaagaaatgacagctgccatctttgcctgtctttttctctgtgctgcatttgctttgctcttgtcacctttcttaggctggttactgggcagttggaagagactgtggagaattcaattcagttgtttggcttagggacataaaattgaactgcataattcatggataggtatctgcagcatcgtcttcgtgccctgtagaatgggttgactgccaaaggattttacgattctaaaatcctaacagattttaacagttgcttaaatattatttcttggcatatatagctttttaagtctgtgggtcaaagatagatgtactcatttgagacttagtgatttgtttt

SEQ ID NO: 32247 - DNA, 1122 bp, Homo sapiens
aagtttccatttaaaatatatttaattacatgaaaataaagtggttttaaaaagggtaacgtggaatagtagaagtggtacccatatgtggcaaaagtcaggaggctgggatgcaaatgatggaagttcttttgaacactgaattaaatgatcctcggagtttgtatgtctggtctccattgacaatggatactctgggcagatggaacatttaccaaatagttgcatctgttttgaaggtactcagtggaaaaccatttatactctacatctgtttcttggctaagaaaaatatatgcagtagattctggccacttaggaaagttttagagcaaggctaattatgccttggggctttggcgaatgtgcttgtctttatgaaagagtccttggcatcatcagtacctagaagtagatatgcatatgcatatagtttccgggagagtttcttattgaaattctttccatttcttgtgtggcctggacatccacaaaaaggggactgtgtatctgttggacttgggggtggcttcctaaggctgttgaacataaaaaaggggcatcctcagggaatcccctgaaagtgaacctaggatatgcctgaggatttgcatgattcctggggattctggtcagggagacaaaggtgtgcagctgctcaaaaaatctgtctgagtggagttagtgctaaacaacctgaagtttggagaggagtggaagttaagggcgatagccctgccttgaaaagagaaccacatactcaccggtgataacttgtggacagttcatggagctatgagaatgggagcaaatgaaagagatggtggttccccccgcccccgcactacccccaagatgtataaaaggatatacctttctttctatctcaataagaaaggaaccagtgactcatgccctgttctatgaagtgttcttctctctatgactcattcactctctgacccacagatataagtccctgtttggagtgtcaaggtgatttcagatgacctttctttctcctttgtagggtctgattttgatatcagtagggaggtgatactcccacagttagggctgccatacctcagcaggtgagtggtttggcttctctcaagtctt

SEQ ID NO: 32248 - DNA, 1049 bp, Homo sapiens
tggtgatgcaaaaatcatctttctttattattttattttatttttaatttttatctatttattattttgagattgggttatgagactgtctaatttttgtatttttggtagagaggggattttgccatgttgcccaggctggtcttgaactcctaggctcgaacgatccgcccacctccaccttccaaagtgctgggattacaggcttgagccactgtgcccggcctaaaaaccatctttcaattcagacttgggtaataaggcattctagaaagtattttcttaaattttatgccttatataaaatgtcgaagaccccagcatttcaatatgctggtatgaagactagaaatgacagattattttgtggtctaaattctttttcctttaagtttggcctgtgctccataaagagacagacataattttggaaattcgctttcttggcactgatgtgtttgctgagtcaagtcttgaatttttagaatgaaaacgaactattgccatgagttgaaagttgggcaggaagaacatttcaatcatttttgggttaggaagaaaatccaagttgacatttctcatggatatttactgtttttttttttttaaatagctatttcccttttaatctttgcaacataatatgaatgatttgaataagtttttgcagctgtacaaaaataaccctgcctatggtactatgttaatttgttactggctttgcaatttagaagatttgattatttcaaactccacagcctctatgatgtcctccaatgatccctgccttcttgtatttacaccttcgtgcagtctgttcccaggtctgtgagaccaatagcctaatgatggcgtttcacttccaggataaggttataaaaatctgccttctgtcctagtcatcctttctatttccctctctcttggatctcttgctctgggagaagctatgctgtgagcagtgctgtggagaggcgcacacagtgaggaactgaagccccctgctgacagccatgcgaatgagcttggaagagtatcctttggaccag

SEQ ID NO: 32249 - DNA, 1047 bp, Homo sapiens
cagcgggcagagggagcagtgccaacaattcaccgaggcggcaaagaacgtggcaggtttgaggaagaactagcagatgaatgtggctcaagtcgggcacaaacaggagatggaggcctgtagggcctttcaggtcatggagatgaggtttcttttttttttttatttggtagtggcaggaggatggagtctcactctatcatccaggctggagtgcagtggtgtgatctcggctcactgcaacctctgccacccgggttcaagtgattcttgtgcctcagcctcctgagtatctgggactacaggtgtgtgccaccatgcccagctcatttttgtatttttagtagagacgaggtttcactatgttggccgggttggtggtgaacttgtggcctcaggtgatccacctgccttggcctcccaaagtgctgggattacaggcatgaaccaccgcgcccggccgagttttgattttattataagggtggcaggtccagctgagcggtggcgtgatctggtttcgaatacgctgttctgggacactgaaagcatacttacctgtacctaagtgtgttttcaggatgaagtcaagtggagtcctcgtaggttgagggtgacagtgacaacaaagtgatgatgttgacaacctttcacatatgccactgcgggatggtggtggggccaaaggattagactccatgatgacctatggtctcctttccaatgttgagatgcctaaagcacaagttagatggaaagaaaacctataacatcacaatcatttataagtaggtattgagcatcactaaaaagcccagggtgctttaattgacattttggtttcctggaattgggatttgaaagattacctgctgagatggtttccatttcttgttaacttgtaatatgtgcacaatttctgcttgaaaatacctgtaagagacaccactgagagtgaagctgtcatttgaggatgccttctacctgttgtaccttttgaacaaagcaagtgtgaaagcatgtaatttgaattagggcaggtaataa

SEQ ID NO: 32250 - DNA, 1023 bp, Homo sapiens
actgcacctggccgggaaattaaatttctaattctatttcattttaattcatttaattgtaattatttagatttaagtagaataaacattggacggggtaagctctacagcacatatataatctgtggctgtgcttgcactaataagcgagcattccaactctcaggccagggcctcttccacaataccaaacattaggggacctgtgtactaactagttctcttatatatacccatcatttaaccagtctgcacctcagctactgataagcaactctgtgctaagtcacaatgacttctctatcttgcctttttttttttttttgagatggagtctcagtctcttgcccaggctggagtacacagtagggcgatcttggctcgctgcaaccttcacctcctgggttcaagcgattctcctgcctcagcctctcgagtagctgggattataggcgtgcaccaccatgtgtggctaatttttgtatttgtagtagagacggtgtttcaccatgttggccaggctggtcttgaactcctgacctcaggtaatctgttcaccttggcctgccaaaatgctgggattataggcgtgagctaccacacccagccattacctgtttatttttcatatacctatgtgctatatttcaaatgatctccaaaagtatggcttagagaggctaagtaatttgtccagtgtcacacagctaataaggggcatgacccagaatttaaaacacctaactttttggccccagctttttaaaagctggaccttaaagccaccactgtttgcttgtataattaatcccaccactgttcacttgtcccaccctcatccagatgtgtcggttgcccagggacaaggccatgtgctgaaggccatgtgctcagcagcttttccgggaatgatggtcagtttgtagtgacccactctagaggccagttcctctttaatcacccgcacatactttcaagatgactctctggagtccagggtgctgcttaatattggaatattgc

SEQ ID NO: 32251 - DNA, 1097 bp, Homo sapiens
ttgcatttgttatttatgtttttgcttatctcagcacctttatggaaatgtgtttcttgttgtctgtcttcaccagggagaagccaaggctgagtgactcatcagaggatcacggttccttccgagttttctagagcctgcagtatgggcaagagttgagggtcagtggggaacagacaatgtttttgtccccgagaaacttatatgtggatggaggagctttctgtctaagaactccatgcccctcaggtttagcacctgaccacttaaccctttgtttctttcccatggttaagggaaacaatgagttaatttcctctctgcaaatgactggtctttgtggaggacagaggaaagaggaatggagccagtgattgaagtttgttcattcattgatgtgtgtaagttacagtcagctgttggctagatagcctcagtgaaacccacttcatgtgcctagagagtcccctcctgttgaaggtacacagggcttgtgcaccactttaagagtgtggtagaagtgatgatactgtgattccagctaagcaatttgagccagcacccagctgtctgagccattctagctgggaccccagatggttcaccccaacagatagctcagggagctgagacagaagatactgcattccctgttcacattctaaatgcacagagttgtaagagagatgaaatggtggttggttgttctaagccactaagttttgggtagtctgatataaaacagtagataattgaaacagatacattcaagaagtctttagtcagcacccagggtggaccgactgggttgcctgtctacctcagggggtgcttagcatatgaggaggggagatactaataagcatttctaagttgaaagtattttgaaaagggcactgagtctctcactctttgctgtgttctagagcattgcatcttggaaccactcactttcatgctttagtcatttaccagtgtttttttttttttttttgagatggagtcttgctttgtcgcccaggctggagtgcagtggtgtgatctcggctcattgcaacctctgctttccaggttcaagtgattctcatgcctcagtc

SEQ ID NO: 32252 - DNA, 1047 bp, Homo sapiens
atgatttgttgtcagttagggttagaactggccttaaggggaaggtagtatttgtctgtaggatatttatagagatggggtggaatgttattctaagtggaggcaacagtgggagcaaaggcctggaggcaggaaaattccaagtgtaccatggacccagagtgtcttaagttaacatttaagaaaatgacggaatgagatagcatgtgtcctttaccagcctggcagaatttcacaagtgtttattaactcttggtcttgaaatgatttgataaggcctctttggagagtattgagaagaacctattaaaaatggtaacattttgacctagcctttctaccactagaaacctattctttggaaatactcaaactcataaaagatatatgtggggctgtgttctctatatagcattgcttgtaaagacaaaaatttcaagttggcttatatgtgttgtgggtggttgaaaaattatatggtatctccctacagtggcttattctgtagtcagttaaaaaagtgaggtggatctctgtcctgacatgtaaacagatgatgatatattaaataaaaaagtaagagacagcatctataggatgatcccattgttatatcacagctactgctgacctggttgggtatgcttgtgtgtgccttaaaaataaaaaaagatctggaacaacaaggatatgttccctgtggctacctctgagaagggtgaccatatgtctcggtttgtttgggaaatatctggtttacacctgttgttctggtataattattaatagtaccctctttcagtgtttggtgaactgctttggatggtgaattatgtgtttaccctaccttcctctgaggattggaattggggcaagagaaatgggaaatgggctgtgacataggtgactcgttggtgtagtttacagcaagcaggtattatttttatgagggaaattgaggaagatggccctgatacattatgtagtggttcactgcggagccaccattgcatggtctttatcaggggagaagttaccttttttctt

SEQ ID NO: 32253 - DNA, 1013 bp, Homo sapiens
ttttatcttcccactccccttggaagcaggtggagtcagattttcttgatgtcctgacctcctccattctgcttttctttcttgctcagttttgcctgactttccctgggtctctccggagcaccacttacccaaagtctccagctccggtgctggggcacatattgccagagtagagccttgccagcaacgtgtcctcgtcgcttctttgcaaagggtgtgtgtattggtcagctgttcttcggtcccgccatcagctttgacccagtcgacccttccacctttctggcttggaggctgtatgctcagtaattatgtgcacaggatttgaatttcatgtagtccgggttcaaatctggtcctgctgcttccttgctatgtggccttgggtacatgtttttacttctgtgaagtagcagtaataagagcacatatcttatatgattgctacagggattcaatgaaatgatgcagtcaactctcggcatggaacacagagcaaaggcaacactgaatgactgatagttattaccatattaattttgtcagttttcctcctttgaatctgatcacttgattctaggcttgtggaggcgctgaatagacttcgtaattgactcaaaacacttctgttttaacactctgggtttttatcttctttcctggcaccactacctcctttgagattttatagagctgaatttgttggaccaaattatatggagcatatttgatagaaacacattctaagtatactgtctttatgtcctcatgttatttcctttcgatttcttgaagtctcaatttagtcaccactctgtaggaagctacaaatgatgatagagcaattaagtgatccctgagtctttagtgttctagaatgattgatgtacagatagaaagagagaaaatgcgtatagacattttccaataaactttatgtcagggtagtttcctggtttggtcaatttttctttctgttgattattccagtgtagatgggataaaaatta

SEQ ID NO: 32254 - DNA, 1028 bp, Homo sapiens
gaaagggaactccggtggaaagacagcattgactaatagaactttctgtgatgatggaatattctttatctacactgtgcaatattttattccctagccacatgtggcaattgtgtacctgtaatgtggctgaggaactgaattttacattgtactgacacacagtttaaatctatctgcttgtggctagtgtctaccgtattgaatggcacagaagacagtgcctccacaaatagtgaggacagttacagatctttggtgtcacatccagctgctccaagacacggttggagtgatacgttgggttgatgcttcttaactttgaaagcttggggtagatcatgttttagtgtcctttggcctttttctttttaatcggtacatttaccgatgacagttttcttaagctcagcatatggtagtgcgctcattgtcccaggtgaagtaggttaggggtgatgttttctcctgttgactgctctgtctccagcacctgtaatgagtgaatataatggatgactgaaaagtgatttcaacttgagtattttatgcagggtgggagactctgtgttaccccgaggttgtatagttaaactgttgtatcacttgatgcttttggttataattaatttaaaaaatgcaactcaaatggcttaggtagcaaaggagatgaactgatgcatataacttagaatttcagaaggatggagcttcaggtatggctcaatcagcgtatgggtccaatttctctgtaatttgcttcagagctgccgatagtctgtattgactacctgtgaagatacaacctacatatctgtaatggacagccttgattctctcagagctgctgttttcaccctcctcctgtcttgagcctcaaaatggctcttctttttgagatagagtctcgctctgtcaccgaggctggagtgtaatgatgtgattttggctcattgcaacctccaggttcaagcgattctcctacctctgcttcccaagtagctgggattgtaggcgtgcaccaccat

SEQ ID NO: 32255 - DNA, 1033 bp, Homo sapiens
cgcccaccttggcctcccaaagtgctgggattacaggcgtgagccaccgcgcccggctggatactgagtagtattttaaaggacaattagggagtggtggggactaggattacctggaagggcttattctgttcaatgggaaaagctgccattctgctttggcctcttgctgccatgtaggaacattggcccggtgtttctagtgtagatttttcaggttttcaagagaaccagaagcctgttctttttttttttttttttttttttaatgaactttgccagttttaaagcactggttcaaagttttcttttttttaaaaaaagggtgaaccaaacaaaacacatctgggagccatatttggtcctcagatgacaagcttgcaatgccttgtttatatatttgtctctcacttggtttctctcatacttcatctctccaaaagcagtaattgcattactctttctgtattctcagggcccaggatactgaccaactcacaaaaagggtcaggaaatgtgtgttgaaatgaatagtacattttggaagtggtctactttggcattatagtccatgtaggtttatttgaggcccagctggtgacagctttccaattcaagttatgaagagctggggagagagcatattttgacagctgatcataattcttggaatattttgtcccagggccctggtctgccgggtcttagaactgggtgcaaagtcacatcttgaaattgatgttcacgtgaatttgagttcttagtacaggaatagaatctattctctgccctgaagtgatttgattgtgaaatgtgtagctttaccaacaagaacgaatgaagtttatgtataccatttagggaggttttaaatttggcaggaaagttcctaataatacaacttgtttggacttttctatagataaattgggaccctaacctttaccccaggagtggacagtgtcagaacatgattaacctctaagaccggtagtcatctgtttttcagtgccagcattacatggtagaattt

SEQ ID NO: 32256 - DNA, 1071 bp, Homo sapiens
agaaagaaatgtgtctaccccatagcctggagccctcatgtcaatgtagagacaccggtcttaggctggcccttttgctgccagagagacatgcttggtgaccccacggaagatagtccgataaataaaaaatggtttcccaaagtgtttcctgccaaaaaacggtgtgctgctatatattttcaagcaattctgcttaattgccgccatctcctcttctctctgatcagtctcaccaacactgtccattctttcctcccgtgtgccctctctctatcctccatgcacttcattatttcaaagagtcacaatggtgccttgtaactatagttttgcccaactgtctcccatactagattatgtgtttcttgaaggcaacatccttattttatggatctttgtagtctctgccctctgtaggtactcaggaatatctgttgaattgaattctttttgagggtaatgagtaggcaaaattaaaaaaaaaattgtctgagatcttgttggctagaaaatccatgtcttatttttaaagcatattaaatatacttagccatatgtctgacttttccgtgatgatttaagatggttgtctgccagttgttgtagcattttgaactatagagaaaaatattgaattaattatgttgaaggtcttagagggcctttattctggccagatgtgtgcatctgcttgcgcctgttgcttatgtaatgtggccgtggaaggtaccaccttggcctggtttaaatagtattttaccacctggattcttggccaagcgttagaatttacatctgatagggagagcatgttcatttcctcctccatctatcagcctgtttaagtctgtgtgagttagttaagaattcagaactcaagatcaagttgttaaaaaaaaaaaagctttctccggtgttgcagcatgtgtttttttaacattttattttataaaaagcgtaggcatctagattttggtttctaatcttttaaaaacttaaatagtatcgtgaccttatatgactatcaatcactatctaaaattggtctgtgattccacagcttatgta

SEQ ID NO: 32257 - DNA, 1076 bp, Homo sapiens
tggccatctttgattttgtttgtcttttgaattttagccgtcctagtatatgcttcggaaaaatgtaattaaggaaactttgatacaggatataagatgtcgctagtatgtattaagatcttgccttagaatataataggtgcttggctaagctgatgcttcgtgggcattctctttttcagtccttacaattggactcagatgttagaagctgaggttcagagaatttgggtaacttttccaagggtcataccacagtggcagtagagctgcaacccagctctgtctgattccaaagcctgtgctcccaattcctgggacagtaggtctccaagtgaggtcctcagaccagtggcattagtatagtaacctgggaactggttagaaatccagattcctgggccccaccttagttctaccaattcagaagctttgcgggggatggggttggggttggggggtggggtaacaaccatggggtgttttaataaaccctcaagggattctgatgggcttattaagggattcaagggttcagttttaagaactactgtactagggtatagaccaaaattgagaagatgacatcagatgagacaggtgacctgggttctagaataagctctgccagtcacattcttggagcctacatttctctatgccaaaaataagtgggtgagcctcttcaggttatttgtgctcgtgaaatcctttgtttccatgaatcacccagactccaaaggtttaaaatggtatgattgtagtttcccaaagtggtgtattacaggtcatgcttacatatttttgcaggtgaattttgtggtttttcaaattacccaggaactgtaactatccctctactttttgtgtatgtgtggcagtgtggagataataaaagagatacaatttaaaagccaaaccaaaccaccaccagacccttcccctcactgtaatgagggaaattgtgatcacatatggttgaatatagttctttgtgtggttttttgttttggtattgttttgattcattggaatgtatgacaataactctcattttaaaacacagggccttgtct

SEQ ID NO: 32258 - DNA, 1024 bp, Homo sapiens
tttcagttcaatgggtgtaagttgatgggtgggagaaccaaatgggatctgctgtagcaaggtccctggggttaggtagtctcatggggatgggacattgggtcgtctttgcaaggagttaatggaagctgtttgttgaagacccaaaggggagggtgaccctaaaggaagtgaacgggttgggaggttggttgacacagcccagtcctgcctttggagaggttgaccctgcctggcggaggctgtttatcccgccactgggctgctcttgttttttatccagtctccacctgaataaacagatctggaacgtcatctgcagccaggctgagaatctgccaaaattccccagggaactggtgattcaccagcagcaggggaagagagagggaacaagcaagagagagagacctgcttattctgattctcatttcctgtccagcaaataacccaggctgggctgtttcttacgagacagcagttctttgagtaaatgatcaatttctgcaatagaacaaatgattttgattttaatttttaagaagatggatgtaaagcaggctagagggaaatggtttcaactgtcattctgagaagggagacttttattcaagttggattaggaaagctcttccgcattcacttgttcttgaaaaatgtctcatcttaattttcaagttctgtatgggcattggtcctggcacaagtgcattatcgtaagctgtggactttagcatcaacattatttcttgccaattttgagacttagaattattcttttttttttgtgatcattaggccctcacttattttaaaaaattctactggacacctgaagaagattagattgagcttggccatgttcggtggccccaggctatattcctaatgtgttttttggggaggggtcagaaaggggacatatgagggcagtggcatctgagaatgtggtcaaatgaagcagcatgaaacagggcacttggagctaatggttttcagattcatttcaaccctgggggacttg

SEQ ID NO: 32259 - DNA, 1031 bp, Homo sapiens
ttattaatgtctgggtttaactcaaatttatttgtaattaattaatggtccaacctagcttacatttaatcataataaatcaaaatattttaaaggaacatttaggcagaagacaagatctatggagcagtcaaacacacctactaaaaatgtgaatttgtaaacactgactcatctggtctttttgatgattacttgtagaaaatgcattaattaaaatgaatagtgttgctttcttaatggcaaattattttttcatggacatgaaactttgccggaagacaagttgcactgggagaaaacatgtttctgtttctatgaattcatcagtcatttcagctcctgttcctatgagaactactcagtatgcagttactaaaaagctatgtagagcaggtgctgaagacattaaatggaaaggaagtcagggaacgattacactgtggagcaaacaaggttgcaatggagactagctgaatagaacaatataatgtactgtctttcagaaacattgcacagactttgaacaccctcatgagaaggaaccaatttgagctctttgctcaatccagtaaacactgttaggaattacgatttcctcaccaaccaaatcccaattttctgaagaaagatttagatctcaggcctcttttgacttgatatatttgtaaggtctattttattttcctttattttgccattgcttagaatgagaaaacatatcacaactactgatgtcaaatactatcaatgtcaaacatctttcatccagggctgagtttcctgctgtctttgggctcctccccttggatggtggcttgtcataggtgatattttccaagtgaagaagtatatcgcataatgagatcttgtaacacaggtatattttttccaaccagcctcccttcaggcggtagacttactctacataaaattagatcatcaccaaattaaagacgctctgattttcctggtcatattaaggcatcatttctcaaccctcatttcgttctcccaaataggaagtctca

SEQ ID NO: 32260 - DNA, 1060 bp, Homo sapiens
agcggactccccattacttcagccattgacctggaggatgcagccaagaaggctgtggccagtgtggccaagaagtgatgtctttgtcctgatccaatggagaaagaaagccatttttccgtaaaaagggatggttcatcattgtgaaagaaatggttatctcattggggaagaaaaggggagggggaaggcaagaatcactgaaaaatcttaaatctgtgttttctggaataagatatctagacagcctaaatctgattttggtctttataaaaataatatcttgtgttctcatacttttctgtcactgtaagcctgcccagtaggcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcataagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgttttttttttccatgatgtccaattttgttgtgggaaaggatttggataaaatttttgtttaaattttggtagatttt

SEQ ID NO: 32261 - DNA, 1044 bp, Homo sapiens
caggcatgagccaccacgcccggcccattttcttacatgttgtagtgtgattaggacaatgttcctatttttaggagatgcatttgggagtgaagtgtcatgatgtaggccactcagtatgaaatgcttcaacaactatccatctatctatatatgtatagctacatatatctctatagagatagatatagagaggaagagagggagaaagcaaatatggcaaatcgttaaatactactaaaggtaggtagaggatacatgggtaggctgtataattatttcaccttctattttttttttatatatttgatgtttttcttagtttgaaaggtaaaaaagtattgccttgtaaccaccagtgcgaccacaaccctatcctttactctgttcctggatctcaaaccaatttttcatattatttattcaacaattactctatataccagctactgttccaaatcctggagatatataaatgggtaagatgtcgtccctcgtccctgtacttaaagagctcatgatttagaatgtttcttttgcaatttttgtgcagctctgtcaacttcttatccaacattgggaatgaacataaaaatttacatccacttaggcctaagaatattttaagcaatttatattgatataaggctgtcatcagtcagcctattaacttctaattttcttgaaaagttttatgtaagaacaataggcagtaatggaatatttaagccatttgcacacacatacacacacacaaaatgcacgacaacgacaaccttgggggtttgcccaagtacatcgtggcattctggttatatctagatatatttctggcatacacagctagaattatgtttcaactggatggtcacatttgtaactgatacacatgtgaccagtgaacacagtagttttcaagaggcattgccttcttgggagccaaaggcttgatgtggcccctctattaaggaatatcaagagtttcccactacttgaaaataactgcattggaagattgttttcttacttcctgatttgtagcct

SEQ ID NO: 32262 - DNA, 1035 bp, Homo sapiens
aagtcatccataattccttagctcagaaataacaactattaaaatttgacttatctacttccagtattttcttttcatttctgtataaatgcatatttttaaaaattaaagtctagatcatactgttttttccacttaataacatactgaagtcattttatgacatcattaaatatttttctgaaacaagatttttagtggccattttattttccattatatgattacacccttatacttttagtcatttccccatgtttaagatacttagctgccttcctgtctttttgctgtcaccatcatcttagatacgtttagtagtatacatttataaatggaatttgaagtatatcattatccccactccagcccgccttggagacatgggactacattgaatgtttgtttttttaaccctacacctacaagttggaagaattttattttttgctatccttccctaaaatagtcctctggtgaccatttagttaattaagattgattggcttctgtcatctgctgaacaatgcattttgctaaatgatcccaaatattaaataaaaacctattaacaagtataatagatatttagacattaacagatggcttcagagggtctgcatataattaaagtaaataaatctaagtgtaatagtgacagttgggtaaaaataaattattttcatcaagaatatttcattataagataacccagaaaacagccattgtgataaaatgtaaaaattatagagtaaaatccagtatatcatgtaatatgtctatgattaccagattcctaatctagatctaacacatgacactttgtggttgctacagacttcattcacatccagcatgaaaggaaacatggtcttgttttttaaaaaaatattttttaatgtacaagtcagtagtaaaatatggacatgtgaattttttagacatcaccttttccatgtatagaataaatgaacatcactgtgttaacaatgcctcaaattagagtccaagaaagaagttgtttgcttgttccta

SEQ ID NO: 32263 - DNA, 1032 bp, Homo sapiens
tccatttggagctttaacccttgaccttctaggtttcacttgctcgttaatcccaagtagcacatttctctgagagggagacaaaagtgacttagaatcttccgtgtgtcattatgatccaagagtcttggcatttgggtagcaggtgtgagagaaaacaccaaaatcacctcatatttagatgatttctgatattttctgtgttttataacctgtgatcagtagttgcatttcatgagtggagccttcttctccattaagctgaacgaccaaatagttaatccaaatgctgacagtgctgaccaaattccaaagaatagatatttggtattcaaataagaagggtgaatgaagctaaagtaaaaaaatacaaaagtatagaaacatgaagagaacttatactgaaagaacaaattctttgattcagtttttctatacaggtacttccttaaaggcactgccaattgaaagttgcaccaatttatcctacagtgtgaaataccttaaataaggtataggacggaaagtgaagccccatcagcatactatatttctcttctagtggttacagcttggtatttctgcatccagcctgcaatcaacaattctttcttccttccctccctccctctcttccttccttccttccttccttccttcttattgagatagtctcactctgtcactcaggctggagtgcagtggcatgatcttggctcactgcaacctccacctcccaggttcgagggattctcctgcctcagccttctgagtagctgggactacaggagagtgccaccatgcccagctaatttttgtattttttagtagacacagggcttcgccttgttggccaggctggtctcaaactcctgacctcaggtggtccgcccgcctcggcctcacaaagtgctgggattacaggcgtgagccaccacgccctgccaacaattatttcttgagcacctactatgtgtcaagttaggagctaatcgagaaagtaggaaaccatccgatatttgatgctattgg

SEQ ID NO: 32264 - DNA, 1025 bp, Homo sapiens
tgtactgttaatatctcaaattaaaataacagccacttctctagggtatttcttaagtgacacagtttcttgaggaaggacaaaaaagaagattaaagtgggaaggttccttgaggcaaacgaaatacctgtcactcgaacaagttaatgggatcaaaattaaggaggtgaaaatgggcattgtgtgcaccatgagagcagaactctcaaagctctgcaaactcactccctgggctgtaagagcctgaaaatgaagccatttgattcgtgtagcaagtttgtatagatttccaagtagaaatcagcttaatgctgaattaatttgactttcccactaatgtggtaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggtatgtttaaattccgggctacctgctattaattgattgttattgtagaagctgttaaatatttaatggggagtctaaggccaggagcactaaatctgtctctacaatttaaggtaagaagatgctgagccctttttctttctgggtatccagttgaaagttgggtggaatcaaggtattcagtgttcaaggactttttatctttgcttttcccacccttccttctttacttcttcctgccttttcttcctccctgattcctttccatccaatcttcctcaagaattaaccaatgggagaggactgctatattttcatttcttatggttaactctctttcatttaatattatatatgatccggaaattctctcctaggagatgaatgaattctcttttagcagatgtgaactagaaactgtcttgagttctctcagtactcttgatgtaaactagaatctttatgaagtctagattctatcagtttttttcaatccttgaaatcttgactcatttattgatattaa

SEQ ID NO: 32265 - DNA, 1049 bp, Homo sapiens
acagccaagggactgattgttattttgcaaactagtgttctgcaagcctaaggtcactcttggtagaatcagtgacagtgatttttcaggggtgcccaaacttgcctgtgcatcaaaaccctctgtggaactcttagaaacactgaactctgaatctaattcctgggattttgattcatttgctttggatttctcaattattaagatgcactacaagtgattctgatgccgctcagccatggaccatggaaaccactgatttcagtgatatatcatacagctctatatatttaaatgataaagactacagctagtttgtgttcagtttccctaatgtggttcctaaccttataacagaataaagtaagttcaaataaaaacatgaggtctgcaacttcatttggtaagcccagaaatagtgaacaaataatttgatgtcatctgtgctttttatgaaatttgttagtttatgggtctgtctccttgggctcagtgagggcactggctgttttattcaccttggtggtcaggacgtggtaggaattcaataaatgtttatggaatataaatttgaatatgaaaaggagcaaaaaggttattctcttcattagaaacatcagaacgatctctgttcatctcaaattgatgctaagagccatgttacgtctatgtaatatgtgatattagtatttcttaaaatgtcacctgagtattgtagaggtagagttgcatgcatttgatactaggaaggagattcttcctatcctttattcctcttccagtgagggagaagtctgcaaacattaagttatacttaaaagaaacatgtctagaattctagttgggagattcattgaccagacttttggaataaacactagtcatcatgctagcgacaggtggtcttgtgcatggtagaaaggcagtccaagcctatgtctctgaaacctgctctcatttctgttttctactttacgatttatgttatctcatactccccatgttgcctgttctccagtttttttacttgtgttatttccattcttcta

SEQ ID NO: 32266 - DNA, 1029 bp, Homo sapiens
ttttatttagtaactcatgtccattttggtgaatgtagagtttatacctgtggcgttttgtttctaactagtttcactaatacagtttgccatgctgacatatttccttctctgttttggtagattactttgcaggttgctgaaagtctaagtcaaggtaaagtgtgaggtaaagatcagagtgagtactattaatagcgaggggaggggggaaagctagtgagccctgtagatcagctcaacaaagtgtatatgctggaatccagtactttggagataatcttccaagtggaatgcagtccaaaaaatggacactattacttcctgtgctggcagccgctctgtttacagaaggaaagagtatgttcgattggtcaaattacattgctgttgcagatacacttgatttttctagtaggaaaaattataatattcttaatgtttttctctttttatccctctccctctattctttcacagatatcacttaattggcaaaagagagcttcagggacaactagtacttcttttctttttcttttttctttttttttttttttttttgagacagagtctcactctgttgtccaggctggagtgcagcagcgagatctccgctcactgcaagctcgcctctcgggttcacgccattctcctgcctcagcctcctgagtagctgggactacgggcacctgccatcactcccagctaattttttttgtatttttagtaaagacggggtttcaccgtgttaaccaggatggtctcgatctcctgaccttgtgatctgcccgccttggcctcccaaagtgctgggattacagacatgagccaccgcgcccggccaactagtagtacttcttttctagcatatgctaaagttcagttgcaggctccttaagaagttaagtgagccccattcagcctaaaagggagcatattgtacattgtgttctgtactttgccattttttcactgaacaatattttagaggtcagtgtatagggaacagcttcattcttttcaaac

SEQ ID NO: 32267 - DNA, 1022 bp, Homo sapiens
atcttggaagaaatgccagctctttttcaacattcatttgtcacttttaaggtttcactgaattagccaggctgaatgcagaacgaaaagaaatgccacggttattatgctgactgcagacgcaatatgggaattctgtatgataggccctcactcatgtcttaatactttatttattccaatgtgcttagcaagccagcttggccttgtttgtctccaggtagatcagacggctagaaacagtcctacctattttcatttgggaagcttaaatatttttaagatgagtgataatgccaggcaaacagagccgagtgtcaccagttctgtctcagcctctcagtcaccgagggaagctaggagacgtaatcatttttagctcagttccccattctgtaaaatgagttttatgacattttcttccctagttcactggaatagcattagaaaaatgaatggatgtggtgactgtttattggatgacatttgctgaatgtggctttttggtgttcaagactggatacattaataacagttttaattgttatctataacatggctgtctgatagtgatgatgatgatgaggaggagcaggaggaggatagtcgtggtggtgatgggtgaacagtaacagtaaatgggaggcagcttagggtactgactaagcccataggagtcagactatcttggttgagatccctttcatgtcaattactacttgtgtgaccttgaacaagttacttaaatctctgaacatagtaaatgtcacatttggaattggaacctccacctgtcccagtctgtgttcctaaccaccatactgtgctgctttaagccaaaagcaacgaactttggtctagagcatttcaaaaggtcatccaacagaacatataaaaatagaagaagccagcaacatccttaatcttctttatttagaatacttactttacttacttttaaaaaataccccataggatcatgaacatcagaccaattgggaagggtagattaattgactgcc

SEQ ID NO: 32268 - DNA, 1102 bp, Homo sapiens
atcaaagatttgaggtgagggaacacttaaagaattggcagtagccacagcatgaaccaacggccaactggacatgactttcactgtgtgcttagcacaaactactgccctcagcgtttcaagaatgctggagaaattgtgaaatgtcattgcctttgcagagtgggctttgggggatggtgttggaggatggagtttcctggtattctgggttcagactttgaccagtgtactgagtatggtcagcttttaccctttctagaaatgattccaaaagaataggacttaggcagtagccataaatgcatagatttctaacatttacctttgaattttatttttattttaaaattcgagggatttgacataatatatgaattgttaatggagacatggcaaagcacaaggcatggtttgtgtaagtttgggtcctgtgggttggagtggggggactagcatcttttttctgctcccatccatttctccctgtgcttgctgtatttccatttgtgggctgtcttagtcccagagttgtgacttgagagccctaaggaggttcaggagggctgccttgtagagtttacggtgagaaatgaggccagagacaagagcaaggacaagatcgctgatcctggtaggcctggtaatgaagctaagcttgttcttgaggagggcaatagggagccattgaagggttttagacagtgaagtggcaagggcagtttaatgcgtagagtactctttctggatatagtgtggagagggttggagaaatgcaagaatggagatcatttgggcgactttggcatcgattcaatgctgtgagtcattatgccaggatactagacgtacaccgtgagtggaatcagactgcccgggtttaactcttgccttcagcactccatagctttgtgatcttgtgacaattacttatatttctttgtaagataccttttttttttctttttcacatttcagtgtctctgaaagctgaatttatttatttttatttatattttttcagacagagtctcactctcttgcccaggcttgagtgcagtggtgagatcttggctcactgcaccctccatcttccaggttc

SEQ ID NO: 32269 - DNA, 1052 bp, Homo sapiens
aggctggtctcgaactctgggttcaagaaatcctcccaccttgcctcccaaagtgctgggattacaggtgtgagccaccacgcatggccctgaactttctctttttaggaataccaaagttttcaactttttcagctttagaatttgtaaatatttttgtagaatatcatatgactgtaattccagagtgttccaacttgtttatgatatatttgggtaaatttacaactgttcttttatttgccataatctggttataacactgtttgtggtaggaaaggaaaacatgcaaaacatacacacacacacacacacacacacacacacgcagagttgtgattctcagtaccaagctataggaccatgttatagatcagcgtttagtcacctccaggttatatgcatcgagaacctgaataaatcatgccactatattaatttatattacatgtttcatatttaaatcatgttttcctaaaatgtagcaactacatgtgataaaagcaaattagaacattctgtaggactgtcttgcataccttctgtctggtttccactgattccttcttagccatggagagcatttgtgattaattaatttatatatgaaataatggtttccattttatgcgagtatttgtaactgcatataccagtgcgtgtgcgtctacctctgtcagcatgaaagtattccagtctttaatttcaaaaacttcaaattagcctcatgaagagaatttttccctgtgaaaagtaagaccaagaaaaaacaaactaaagacatgtgacttattcaatgaaagtgaaaaagaagctctaaaacagtgtcattgattaaaaagaatatctggaatgtagccccactctttgagtgggattcatttcttactgcttatgaactttcaatttagtagtcagaaaccatggatttattttactgcacaatgtgaagtttacattttattaacacttgagtagtctgatttagagactagttacttctattttttaaaataatggagtaacaaattacagaatagctaaataatttt

SEQ ID NO: 32270 - DNA, 1055 bp, Homo sapiens
aagttttcatcttacatctttatttttgagtccttatcacttcaaaattctgttatgcttattagtatgtcaatttgaaaggaatattttcttacattaacatgtatcttcacctcctttgcagatagatgtgccaaaaaaactaaatgttatggtttttcttgtatcagaatttgtttttacatgtttacattatttgtagcaaatattaaatgataatttaagattttaattattggtgcttttctgttattagtattttcattcatatataaggagtatatatccttatattgcttcagtttgttttctgcttatgttatttttgagatctcctattgatagctatatttcacatgaacgagaaagagaaatgtctaaggaacaaaagcattgcttaggagggacagattgcttctacctaatacatgtgaaaggaaagtgatataaattctttgacattaagtcctagttttggtttttactgtgacttttagatatacaaatttagttggatctggtatctttaatagacttctgagatgtaggatgtcttgaagaaatgtcctgtaagtgccatgtattgaattacttaattttttaaaaaagtgccagattctgttaatcaggttaaatattcacaaacaaaatgctgtgcaataatatttcaattagtaatagctatatactgtaagatatataataggagtttgaattcttagaaaccagcactaattactatcagatatttttgaatttcagtgtatttaagaaggtaagtgatttctaagttcatctaaaccaaactcaggtaagactatttttttgagtccaaaaaggaacccttcctactccttttatactcaagtttatcaccatttgagtaggacctaaggaattagacattccaagcattactttttgtttagctttatactgatacattatggagatttaaaaattcttatgggttttctaaaattacttttagtgtggatggatgtatgtatgaatgagacagggtctctctctattgtccaggctagcgtgcagtg

SEQ ID NO: 32271 - DNA, 1031 bp, Homo sapiens
acttgattggcttttcacctaggttactgaggctgatgcattgagaatagactaagggaagagcagagagggggaagaaacagagagactaattagattattatagtcctctagacaagagacaacgtgacttgaaacaggatggtagcattggatgtggtgacaggtggtcagattatggatatattttgaagatggaatcaacaggattagctgatggattggtggtgtgctgtgagagaaaggaatcgaggatgatacaacaaggtttttgctctaggggcgggcacctggaaagatggagttactgcaatgaggaagttactgcaatgaggaagatctggaaaagaacagatttggttgttgtgagcaagggtgatcaagtttggttttggaaactgttaagtctgagatgtctgctagatggtctatatcttacaagatggtctgagatcaccagaacaaagcacaaggctactccgaattctggccagtaaagtaggaagaaaactgaatgaactggaaaccaatttttaaaaagtgtttaaattctcatgagtgtggtgaccaactgaagaacatgttttagggtggaggaagtgacccacccagcctaatacctcagaaaggtaaggtcagatagattgagaattggtcattggagttagcaacacggaggttattggtgaacttgacaagtacagtttctgtggagtttgagaacagtcaggactttgaaagcacaaatatggataagtcttgaagatctcttggtatatagggggacagaaaaatgaggaaattattgtcaagttatttgatcatcgaagtaaactgaccaagaccagaaaagttagttattgagacttatttttttcagttttttgcatctgctgctaaatttgaatgtggttgtactgttcagaatgcatggcattattatggaaacctaacaggttttttgttttttgcctttccctgctttttaaattgcatgctcttgattcaatatcttttaagatactcctttt

SEQ ID NO: 32272 - DNA, 1049 bp, Homo sapiens
ttggctcttaaaagatctggaaagaggttgttgacttcaaacagcctatttatcccttttactacacaccctatttcttatcagatgcttaattctatgctggtgagacagatttaatcgaagtgttttctaacctggccagcgccacataatttactcccctccctgcctgggcagggaaaaaatactcttgcattggttatggtgagtttgtaaatttccgtgccgattcccagtagcagtgctttgatctttatgtgtgtccctcagttgaatttcagctgcaagaggaccgggatgacaaacttaatttcacattctttcctgccttttatttccctcccacttttacatgaaatcacaattaaacattgcttaccatatcccacgtactgtactgagtcttctgtgtgattatctatatcctcatggctgaaagaagtagctatgaacggcctgcagatgaggtttatgtctattaagtaatctgctcaaggtcacagtgctgttaattgtggaacccaacacaactctgacatcaaaacgtatggtttttattgctaggcaatacttcttggtcccttttgtaaaaattggatattactaatatatttgacggtagaaactgtggagttataggaaattagaaaattaaaaataatcacaaccaaacgtgaatcttaactaagtataaaatagatgaattttgtagaggagtcccaccttattctgttgtatgttctaaaaggtttgtagatgtctatctgtggcgtaattgtaatctgaaactttgtgtttagtggcaagaaaagccgtcccacagcattaagagattctttaaaaaattaagacctctgccaggttcggtggctcatgcctgtaatcccagcactttgggaggccgaggtggacggattacttgagctcaggagtttcagaccagcctgtgcaacatggcgaaacccgtctctactaaaaatacaaaaattggctgggtatggtggcatgtacctgtaggcacagctacttgggaggctgaggcaggagaa

SEQ ID NO: 32273 - DNA, 1049 bp, Homo sapiens
gggaagcagaggttgcagtgagctgagatggtgccactgcactccagcctgggtgacagagtgagactccatctcaaaaaaataaaaataaaaataaaaaaataaagaatcaacaaatagatggcaaaatggaaacattttagaatgtgaaatcaacaagacttagccatctcccctgcttaacatcttagccagccccctgccagctacggaggaggtgcataatggggtggtggggagtctggccttagctctatactgggcatcgtacttacatttttaagcctttgtttcatcaactttaaagtggaaataagaagtttctacctcaatggatgagttaatatatatgcaaactatataaaagagtgtctgacagactccattttgctatttatatttttgctattgttaccactgctattgtatagtaagccccttgacaggacatgcaagccctggcttatcactctaggctctttgcacactcaccctgcggtcatactgaaataactcctccttccctgatgatgcatcctagtctttctcaagcctccatgcctttttgatatacttgtctttctgctgaatgccttcctatctccctttactttcctttggcaaatttccactcatccttttgaattcagctctagtctctgccccttaagaaattcttttttttttttttccttgtctaccaccaccatttcctacagggagttaaattctttcaacctccaaaacaccctttaaatacttcttctaattcttcctattatgttgaattcttcctttatgcatcagtcactcctcgcaactgcactacctcttaagacccaggttcatctttatctccccaaacactggcacagaacctggcatgcactataggcccttagtaaatacttgtcaagtgagcaaaataaatgtagtttacactggtaactaaattgatcaaattttgcaaaatagacttgtgaaaagatcaagccaaattaaaaatcaattctgagtaacaatcataaaattagacattttcagctttc

SEQ ID NO: 32274 - DNA, 1038 bp, Homo sapiens
aggctgggaggctaggccagtcttgtcttttcacatttttctgcctgctttatattctggccacagcggcagctgatcagatggtgcccacccacatcacgggtgggtctgcctttcccagcccactgacttaaatgttaatctcctttggcaataccctcagaggcacacccaggatcaatacttggcatccttcaatccaatcaagttgacactaagtattaaccatcacatgggggtagagtgattttattggtcagtcttgaatcacatattcatcttctttatatggggatatggggttcccccctacccccagttatttggatggtgtccccaaagaaaagcggggatcctgtttcctaattttttttcttttttgagatggaatcttgcttgctctgtcacccaggctggagtgcagtggtgtgatctcagctcactgcaacctccggctcccaggttgaagcaattctcctgcttcagcctcccgagtagctgggaatacaggtgccggccaccacacctggctaatttttgtatttgtagtagagatggggttacgccatgttggccaggctggtctcaaaccccttacctcaggtgatctgccaacctcagcctcccaaagtgctgagattacaggtgtgagacactgtgcccggcctcctaattttaatactcctggtagactccatctctatgtgttctcacaccataacctgagcttacccagcctcccccctaatttggtctgtcaaccttcatctggccctcaagctgccctggcctcctggttttagccttgcctaatctagcccaacttgctgctgaaactggctatcaacattccgattgtccttcaacagtgaaaacatttttaccatacaatcagaaatgtcccactagttctctcagtcgactctccaacccagtaagaaaaggtaccatgtattgagtttttactgttatatattaacaaatagaaggttctgtcaaataaagtaatacaataattccccaccttccaaacaagaa

SEQ ID NO: 32275 - DNA, 1043 bp, Homo sapiens
tcccttcaatgacttcccaactctgagaaacaacctggccttactatctctacaaggcccctgtgtgtctgtgtgatcagtattccttctacctaggctcctcccaactcctgcctcagttccagcaaacacacccaaactctggtcttaactcccagcacccttcccctctttaacgcttctccagcaaccctggcctccttgctgtccctcaaacctgccaagcacattccagcctcagagttgtagcccacagaatgttgtctgcctggaatctcattcctgagaagtctacatgatgcttaccccatcacttcctgtaggtctcttcaaatgtcaccccaaccagggaggtgactcccaaccatgtcttagcctgctttatttttcactgtaatccttttcaccacaccacctgactctatgaatatatttgttcatatgctcatttcccctgccagaacgttattcatagctgaaggcatgcaggggacttcactgttagaatcctcagtgcctggaacagcacctggaaccaaaaatgtgcttcagaaatacttgttgattaaatgaacaaatgaatctactttacactttaagaagcctgctccagccactctagggagaatgacttaaaaggcataagagcggtcaggaggccatttcagatctccagctgagagacgatggggacccgggcaagggtagaggcagcacatgatatgagaagacaccaagcatttggaggaggagaaagcagcattagcagaactctgcccgaaggcaacgtttgcattccgtgaagctttagaaacctcatgtggggaaaaagccatgtatgttgaaatacatttgtatgtgtgggtttattctttttcattattgaaaatagcccacgccagtgtaagctgattgagaatacattcgtttggcttctctaacgaccatttcatcagaaaagcattgctttagatagcagagtagcttatttcctctaaccctggtgccagtgggctccctcaaggacaccagcttgtgtgtac

SEQ ID NO: 32276 - DNA, 1032 bp, Homo sapiens
caggagttcaagaccagtctgagcaacatagtgagaccccatctctacaaaaaatttaaaaatcagccaggtatagcgtcatgaacctgtggttctctctgctcaagacgttgaggcaggaggatcacttgagcccaggagttcaatgctgcagtgagccataattgtcccactgcacttcagcctaagtgacagagggagacctcctctaaaaaattaattaattaaaatatttaaagcattggctatcccaataaccctgctttgattatatgaatgtgtcacattatcacatgtacccccgaactatgtacatctaatatgtatcaatgaaaataaataacaaaggcttttatgaatacagaatcagaagaaaatgatctctaagtttaatatttcctgtgcttttgcaaaaataagattttcaaaaatattttcagcctttgaatattcttaattgtgcaacataatcctttgcaaaggaagatcattttttaatgcttttcaaatattaagtgaaaaagtagtgacttaattgtgtagaactaaaagacagtaactgcaagttaaatagacaagggagttaatccagtctttgcctatgtatgaccgtgggtaagttaatcttactatacttcagcttcatcatttataaaatgagaaattaatagtactaatcacagagattgataaaagaattaattgacgtgagatatttagcacgctgcctggagtttagaaagcatccaataaatgttatcttttccatgagttaggattttttttattataatagaaaacccaattcaaacttgcctacagagtaaaaagaaatgacttttgtcacagctgaaaagtctagcagtagaatgaactttaggtattgtttgatcagggtaccatgctttcagacctggtcttgctgatgtgttggctttatcttcagctggtttcttccctcacaatagcagataatcacagcagtttcaggccttatatccacacatccagaaagaaagaatttctcatatc

SEQ ID NO: 32277 - DNA, 1024 bp, Homo sapiens
tgagtctgtaaggacatacacttggaggtgcctttggttgtggttttatacccttttgtgatagcacactcaacagaatgaatgacacgtgtaaaggaacacaccagagaaaatgaatgaactgtgtaaaagaagcaatggcaagagcaaggagaaagaaaacattcttggcatctacaaggtctgtttgaccctgcctattccctagtttgtcatatgagccaataaattccaggttgcttaaattagttataattatgtttccatcattcgcgagcaaagagctctgatgaagactttatagcccctgtatagttggcacctcacatttctcttctaggctattggaccaagtttttaatctctttcattcctgcctgttatttgcaagcactgtgataagccctgaggacacagttgtgaggaagacaatcaggatccctgccctcctggtaaccatacctgagtataacaagatctcttgcatcctctttccattcctgtggagtctggggttctgaaccatctgactgtcacccttctcagtgtcttcttgattggtgtcctcattccaagctgctcacatgaacttgctttctgtttgtcttgacctacttcatttatgcccaactccacccagtaccaagcacgaaactcacagttctgcctggattattgacctctggatacttcagagtctgaacctaacccatcaactcccttaacctaagtttcagctttaccataatagaagtaataataataaagtaaaatagaggccataataatactttatttcataggtcattgtgaaaattaaatgattaatggctgtttcatgaaaacaaatcaacaaaaagtagctgaagttattatttgatgcttctaactctaataatcacatctcaaagccagagttacattttctatccttaatattcaagaaagtaatactatgaaagaatcctctggatcagaaagcctgtgcatttatttaattttattttttctgaattctgttatt

SEQ ID NO: 32278 - DNA, 1048 bp, Homo sapiens
atatgttctccaagtgctggtgggttattggattaagtgttctgtggagacggctttacttttcaacaagggctttctggagaaagcgtcaattggcggaactttcagactagcaagatgatgcctttgggggcacttggctcttgaaccacacttgataggcagcagcctcttggttgcatgtggaggagcttatgattgcattacagactattaattgaaaagaacctttcaggcctcatgacttcaggattcttcatcacttcagaagggagttttcaggtttgctcctaaattcctttctagaaacaaattttcccctgatttcaccttcccatttcatctatgcattaattcctacccatctctctcacgatctagattggggttggccatggcctgttttgtaaataaagttttattggcacgcagctgtgccatttgagtatgcattgtctcggctgctttcccactgcaacagcagagttaagtagctacaattgagactgtatttttaaaaagtgtgctgagccggatgacctaggtcagtaaacgccacagacgcttttccgtgaccccctaactcctttttcccccacatggccaggaataaaaacctcagctagccctggctccacgaggaaaaaaaatcaaatgcctaatatttggaaaggaaaaacacaatacaaccctcatttccctctcaatgaaagaaatgggtgacacttctgcagccgcgtctgggcctatggcagatattgctgatcaatcatagcactctttcccactgggccttagaatccttctcgaagcaatgcccaggcagccactaccaatcaactggacttggcattcaagtggaaaactactttccatccctggcccagtggacaccatcagatcagaaaatcacaaagacaaaaatcctgtgtaataagtaacccctgaacatcgtttgggttgccatgtcagacattgcacctcttgttaagtccggagttgaaacttaattcactgtttctgtttcttagattaagcaccagataaa

SEQ ID NO: 32279 - DNA, 1067 bp, Homo sapiens
gctgtgtttgcttgaagttgattaatgatagaacctcgcttggggtcgtcctctggagagttctttcacaggttctgcatgttaactagcaaagcagaacacacagcaagccatgattagcccagcctcctctgctcagtggtccccacaaactgccgttgcattacagattcttatttcgtgtaattatttgaagatgggtattcatccacccaggatgccactacgggacctgttatctggtactcagtgtggttctaggaccaccggcatcacttgggggcttgttagagatgcagagtctcaggccccaccccagacctgaatcacacactgcatttcaacaaggcccacaggtgactgcagcgtgtgttaaagtatgagaaatgccaccagggaggagaggcccacaccagtccagagactagtgattcagagcatcactacccaagagaactttacgcagtgatgcaaatgttccgtctgtctctgtgctggccagaattaaccgctagtcacatggggcctttgaacataaatgtggctagcacaactcagaaactgaatattaaatgtagtaagatttcgttcatttcaatttaaagagccacgtgtggctaatggtaacaatactggacagagttctagttctagagtgcggcttttctgttgccccaaacttttcagtgcacctgagctgcaatgggctgggaagtaccctcactgaacctctgcatattttttccaggcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttg

SEQ ID NO: 32280 - DNA, 1107 bp, Homo sapiens
gtgttttttaaaggaatcatcatcagcataactaattcttcctaaaagaatgtagggtattttagcagagctggttcacaggtgtgtgacatgcagtcacataggatctcatgcctaaaaggacactgcacttgattttatgtgcttttattacctttttatttagagataggggtcttactgtatcacccaggctggactcgaactcctgggctcaagtgatcatcctaccttagcctcccaagtaacttggactacaggcacacaccaccatgcctggcatgtacttgctttaatgccatttttgtcttgaaattttaatttttgagccaaagaccccagattgtcattttgcactgggcttccaaaattatgcagccagtcctaattcttactgctgaaacactaatacagccattaaaaaaaaaaatccccatccgtaatgcttaatacagactgctgggagggtgactccccatgcagccttccttgcactgatgtacaactgttccttttaaataaaaatatccggcgagccatggtgtctcacgcctgtaatcccagcagtttgggaggccaaggcgggtggatcacttgaggtcaggagttcaagaccagcctcaccaatatggtgaaacctcatctgtactaaaaatacaaaaattagccaggtgtggtggtgggcccctgtaatctcagctacttgggaggctgagccagaagaattacttgagcctgggggttggaggttgcagtgagccgagatcctgccactgcactccagcctgggtgacagagcacgactatgtctcaataaataaataaataaataaaatagctggagagccatacataaaatgtaatgtaatgcaactttgctacattttgttttgcaaagtttttaagaataaagaaattatttttttagcagccgggcgcagtggctcacgcctgtaatcccagcactttgggaggccaaggcgggcggatcacgaggtcaggagatcgagaccacggtgaaacctcttctctactaaaaatacaaaaaaatttagccgggcgcggtggcaggtgcctatagtcccagcttactcaggaggctgaggc

SEQ ID NO: 32281 - DNA, 1070 bp, Homo sapiens
tatttttacaagttgtttttctacctttttttctttttcttttcctttttttttattctaagacctattttctgtggtagggcaaaatagcttgttattatctttaaattatattagatttccagcaaaattattcagaagtcatagggagacgtaatgatctttgatcaggtgtagttctgtgtgtctgtgtgtttactttttatgctccttggtttgtgttcataatacacttactgtgggttgtgttataagtcagggacaaatggcatttgtgtacatatgctctatgaatgtaaattgataaaatacatgaatatacatcctgatggcaatatgaaatgaaatacaggcctcttgtgtgtatgcatgtgtgtgtgtgtgtgtgtgtgtgtgtgtgtgtgttcttgtaatcatcattcattgtgcttgaagttcaaagtcaggcagagacagtcgagtaagttgcaaaatagcccttcccgggaagggaatgcacttgagtacgaaacagaactctcaatgttagctttacatttctatctgatggaatttaaggttatggaaacaactgtaaaaataatttgtctgaaagaagtctggatgcagaaatataatagagaaaatatttgagaatatggttcatcggtgagtgcaacagatactcttccccgagcaccacatggtgcggatcaaagcatcccatgacttggatccgtgtggccagatcattacgtattgattggaaccccactggaggattaaccccttcgtgttcatgccaaattttctctcactgttggtgttaggaattttaggaatataatcttcttgccattattagcttttttaaaaaaaacacgaatcatctgcttggatacatttgtcttcctaaattattttggtattattccaaattatttaattgtactcctctttgctggataaaattaacttgggaaaaaatatgtgattatatgaaagcagtttctgggggaagggaagaggagaaaatggataatattccttgtagatgtagcaagaaaatctcaaaatcaagtacagatttt

SEQ ID NO: 32282 - DNA, 1047 bp, Homo sapiens
actcctactctcctctttaatttgtcttacacaaggaaaattataattaaatcattcagggtaaacccttgagtgtagagaagggaaaaaacacactttggtaaagattgccaatagaaacccacttccctgttgcgcagggtagagacatttatcaatattcagcactattacgggaggagcggcccatgtgatttgtgaggcggatgccagcgttcaaatcaaggcttgttaagatcctgtccctgtgtaatcatggacattcagcatcattagaattcagtactggcaccatgcttcgtgctttgattttctccgacaatttaataatgtttattgtgctgattgtatataaattcattggtgcaataaacatgcctgtgttgtcagtgcctgagaaaagtgtggtggggatcaagttcaatggcgcagctaagggggagcagcaagaggaagcaggtgcattcaagcctcttgctgtcattttattccatagggacagagagtctcgacttcttagggaaacagacaaaactcaggcctgggataccggtacatatgaagatactgtcttgtttccctgtctaattgtcttgctttagaaaattccaggttttggtgtgggtaaacagaatcaacagaatgcaaatgaaacatctattaaaatgctaaatttagtaaagccctttgagcttcttggatcaaagcagctatgtaaatactaatagcaattactacttaagtaattgcctaaattaaaatttgaaatatcacattacattatggtgcactagggaaagggacaagaactcacatttaatcagttccttctctgtgccaagcactggctagacttttgcatatggagtgatgtctcattttatccacctgaccactcaggaagcagtaaggatgattatacccattttacagatgaggaaatcgaataatagaaattaaataactaacccagggtcatagaactggtggttagtggcatatccaagatccaaattcagatctgtgttttagtctgcaaaatagtac

SEQ ID NO: 32283 - DNA, 1044 bp, Homo sapiens
aagtgttgttcagaagaagacagcaaacttgaattaaggttttggcctctgatcacacagttgatttttcaccccatgctcgtatcctttctctagttatttccaagcagcttctggcaaagcaggcctttcgttggaactgaggaccacgtgggccagggaccattgctgtatctgcctcaccacagggccattcatcagtgtatggaataatgtcctgaggagacgctcctcctgactcttcctttaatacatcttatctccattctcagctctgaatgggcagtaaaacctttcactttcttctgtgttcaaagctaaggctcagcagaaccaaatataatacatgattttagtcccaggtgtgttatttggtggttagagtttggtgtgggatcatagtaatctgttcttaagtgcacagccagctgcacaatggactcatttagcaactgacaggtttcttaatatgtggtgtttgaacaagagctgtatctgttgtgggtgttaggatgtgggcatcaaaaatatttttaaagtatggtatttagcatttcctttactcttccttaaacgttggcttacccctcgatatcccctcccccccaccacaggtattcattttatattattatggctttttttttttataattatccagtatctgcttcctcttggaagcctgtagtatatattttttttttattttattttttattttttaagacagtttcttgctctgttgcctaggctggagtgcagtggtgcgatcacagcttgctgcagccttgaacttctggtctccaagtgatcctgccacctcagtctcccaagttgttgggactataggcatgcaccatcacacgtggctaattgtgtgtgtgtgtgtgtgtgtgtgtgtgtgtgtatttttggagacggagtcccactgtgttgcccagggtggtctcaaacctcaaagcagtcttcctgccttggcctcccaaagtgctgggattatgagtatgagccactgcacctggccatgtttaattcttgggagaa

SEQ ID NO: 32284 - DNA, 1046 bp, Homo sapiens
ttattgaaaatgcgccgacatgctctccccggagagtgagcaaaagaaggcaagatgcccaacagtaatacaggttgttctcttaggtgagctaaaatatcgagtttggcactcccctgctgtgagcgaggaggcaatagagtagacgaatgtgcatttttacattaaaagtgccatatttcactaggggtgtccccctttctccccccattttgtttaaatgtcttaatttatatattccagttaatagttcattacatgtcctttctctgtctggctttaaaagttgtcttttgaataagttgaagtagtcaaaatttcctaatcctggcaggcttgccagcagagggcaggcgtaaagaaggttttgacatgagggtgtgtcaacctagggtcagaggagggtggtgttgcatgggaggaagatgtgtgagcattgttctgagggcaggatgggacacgctccctttgcctctttgcaggcctgctgcacaccacagatctctggaaaagctgactgtactaaataaaggtggtcagttgcctttatctgatattcagcgatttctacataagtaaacgttaaaaaaattaaaatgtaatttcattccccaagagccgtcttttctttccccttcagtgccccatttctggttatgcttaaaaatcgagggtttgcctgtgggtgggccaaaaatactgtcactcttcgggagggaaataacaaattacacttggtggtggtggtggcagtgatgttttccccccgatatctgaagggtacagcactttgggacatgctctactgccccaaaacatgtaccttttcaagaactttgcacacttcagtgtaatctgttctaaccccatggcagaagcagtccattaacaaattttacattatgttaaaacaggggattatagtttcatcataaatgagagagggtaatttattactgtcaaatgcagagttaggaaaggatgttgtcatttttcttttctgtcatgattttgtttacctctgatgcttatgaatgcttttagag

SEQ ID NO: 32285 - DNA, 1028 bp, Homo sapiens
atcaagaacaaaaaataaactatcagattcaggaaaaatgagaaacaaacccatgggtgaggaatcagtgaatcattgtagagtttgtttttgggggaaaaaaaaaaaccacacacactgaaagaattttgagtgaaaacccactggactgagaactcttaatagtatggtcatcataagactttgaggggatttctttattttttttagagggtgaaaatgtcttgaagaaattcccagggcttggtgaatagaagatactttactgaatttcaaagtgatgttgcaggcatacccttgaaagaaatttgtgaattggggtgatcgaaagaaaaatgcacaggtggtgaactgaaacctggtgaatggtgcatggctgggacaggccgtgtacagttggggttgacttggggaatccctcccagaatggcatcagatgaaccaagatttgcaactgcaatggtgtgccttgtaatttggggtttccctcaggcagtgcttttctaggttgtttggaagtgttacactatgaccacttcctaatcttcttgtggaaggaggtacctgtattagtcaagactttttcccatgcaaatgtcaaaacccagctcagactggcaagtgatgaggggttggggtgagagagtgtgtacgctcacagagcttaaaagttcaagggttagcctggcctcagacccagctggaaccaggcactcaggtaacgtcatcaggaagggtctgttccaattgttctgttctgttctgtttctttcctattggctccgttctttgtcaagtttttcccttgctgaggccagagggcttctgagagtccctgcttcacatacttacagcttagcaacccctcagaaagagagtatctcttgctcagtaattccagcgaaatcccttgaatcaattgagtgacttgggtcacttatctatacatgaaccagtcactgtggagaagggaggagatgtgctgattggtaagtgtgttaggctgttcttgtgtcactataaagaaa

SEQ ID NO: 32286 - DNA, 1034 bp, Homo sapiens
tggcaaaagaaaaaaaactgaaatgtaatctcattactcaaaagttctgttagacactcctaagaagtgattcttcttaacgaaaaaaataaaagcagcagcaacagcagcagaagggcggcttcttcttggataggctgtgatcccacaatgaggtcttgctatcaagcctattggttgccttgaagggagaaaagagcttcttggtttcccatggcagtgaatcacccagcaaagatggctcgagtttccttaagttgtttaaaattggttttagtgttctgttaatgtaagcaaataatcatgattttagtcttgagtgactttcaggcctgggcgagtcaggcttgctcagtattctccagtgcaatgggagtatagacgatgatgcgccccgccaatagagaccactacatcattatccccaaagtggtaaaatactcttcctggaattttgagtctttttcctgtgtgaatcttctgagcaaaatctcagaaccaaaatagtgatcatcaagtctaatgtagaaaattaaagcctctctctttttttggggggggaacatcttaagttgatttagaatttttgtacacaatattcgtctgtggttgaaagggggcacgctgaggtcaagtgatgtagtgttttccatttttccatatgagtctcacagtgtgcgataaaagcaaactcctttattttgtaagtctgcaagaatttctgctgaagtgcagaggtcacgttccctgtcaatttgagtagccagcattttttaactactgttttttcttttggtgtgtcttttcttccctccccccaccttgctataaaccgtggcacttttctgacacatgcacagtgaggtcctccaatctgaaactcattagcacacagcattggaccctgtccagtggttagaaaatttcctggagcctagaataacagcatttggtgcaataccatggaccagaagtgacaatggaggtagtcgcactcccctggcaccctgcccggtcaggaaagccagctgacc

SEQ ID NO: 32287 - DNA, 1050 bp, Homo sapiens
tgcctgtttacgggattgcatttgttagcacgctctcttcagatattgttcccccaggaatagcgaaaatatgtgcagcgcgaacaatgatttaacatctgaaaatggtacttaaagagtttctgtctggtagtaatgtgatggaggcttctgaagggaacctggggacttcatttcttctatttatctatatgtctctctggttttagtgagcggtaattgcatatttaacccctcaaatagctttaaccctcacgatgccaactttttaccctgtataaaatgtacttttatcccagcaaaggcagactcagaaattccctagccaaaaaattatttaaattaaaaaaaaaaaaaagtgagtgtgtatttgtatgaatggatggaaggctggatggatggatggctgaaaagaagttatagcagcattttgcagttagttttaggtgaagaatcatgcccgccttcctggtttggaagaagaccagttaaagtacagatattataaagagtgaaaactcaaacaaaaagaagaaaagaaagacggactaaaacaactgtgtttttattttgaattcattgtggctggagctcagagaggaaagagacggccccatggaaggaagttgtagatggacgctgaatcaagagtataaatttgccgcatgcctcagcaatatggttttctcaattagtggtcgttctgggaggcctgcttaacagcttatgcgaaacaaatattaacacaaattgtataattacatcaaaatcccaaattcctcaaagatgcaaaatggttttcagctaagaatacgcgagcaataaaacatcctatagtcaaaagaagcacactccaaggaaaccatgaagactggatccgagcgactttcacagtttattttcatggtatttaaattatgataccagtgggtatttttaattagtgtgcacttgtctacataagccatgttggcaaatttgactcattcatacagtagttgctgtaaaagaggccagcacagcctgcaggaattaaaattaaaagtttct

SEQ ID NO: 32288 - DNA, 1028 bp, Homo sapiens
tttgccacgggtcatttagcaaaatgtttgtatatgtaagcccaggttcttctttttaaaaaaggaagggtggagggcggggattggattttgctgaaatccaggtggcgtttcagtttatatttaattttaattggaaatcaaatacaggcaagggagaaaaaaatctaccatgttttctttactaagagtatcctttggggagaggaaggacactgccagccagattttaagaagcagcttttttattggcatgtctatttttttttcttgctaaattcttgtgcctgcatttttttttaaaacatctacgattttacacgtggcaaagactttcatgtctcaatgttccttgctgccgtctttctatattttccatgggattagtacctagaaccaagacagcaaataattatatactacatataatcagtagcttcctaggctgttacctggtgagtctcttttttaggttctagtctgaaataatacatgattcttgtggcccgtgttgatttctggaaggctgaggaagtttctaaagaatcaagaacaagaaaaacaaaaaggtgggttttttttttaagcaagaactttagaaggtcttccgatttctgagtataagtagctgtaggtgcatcttgtaaaactcccataaaatattggcagagagactatggcataattagagaatggttgctgagtgtgctggaagaggtggcgagacagtcacttcactccaccagtgcctacaaaatatcccatgtgccagagctgagtgaaatcctcagcactggctctgtgtaatgcttgggtgcaattcagatgttttcaattggaaattgaatagcaaataattttgaattttcaacggcacaattaatgacacattcgttgtagaaaaattagaagatgcaactaagaaagcaaacagagaaaaaagctatatcgcttgcaatcctgtttaatggaggtaacaactgttaacatttcagtggataccctgttttccctttcttgtaaaaatc

SEQ ID NO: 32289 - DNA, 1047 bp, Homo sapiens
aaaaacatgaaagacaacacactagttactttgtgactttaggtttgcagaacaaagattagataattcaagcaaggcctggaaacaagagcagctagagaaggttgaggagtttattcacagtggaactccggagggggatatctgttgtgggggttggggcagaccaacacaatttttgttactttctttttagacagagtggaaaattccaataacctgattgttaatcatgtaattgccagaatccacttaggtgtatctttatttttttaatatccttttctcatttccatattttgctttggatatccagcagacagtgttttgctgcactttgcactgacatcacgcagaatttaaaaaaattagctaactgattataagtgtaagatatagataaattaccaaactgtttttcagtatgttttgcttattaaattttaagtaatggaaggaggtttttcacatgtatcaaaattaaattaatggtgttaaagtatctgtaaaatagattgaaactaatgttttaattgccgattgtgtttctaaatatagtatctctgataaggcatgataactttcttgtaacacacagtaagctgctttatgtggtagtgcacatcagggaaatttttagagattaaacgtttcttcttaacacttttgttagggacacaccgaacttattgttcattctgggctttgaagagctaagattttattgataagctgacagaatgaacccctgagtggttacatgggacatcaactgattattttattttttgatattttgtaaggaaaacatcataaactgatatagttggatttttgcagagtagttgagaatgctctgcatctgtttgtgggcccactgggcttaaaggtatcttagaatagaagcttgatatgaggagactggagcattaaggttttccttctggatgaaacattaaagattcgaatctgtgtttgacccatatatttcattgataaaagaagatgagcccaagaaatgaatgcagagttactgaagcatgaaaa

SEQ ID NO: 32290 - DNA, 1056 bp, Homo sapiens
tgtttttctctgtgttataccagtttgctcaattttatgttttttttttaaatttaaatatatgaaaataatacaagaattggctttagttccagattgcagaactggaaactaaagttaaaaaaaatctaatttttttattaatgtatttgatattatgttgaaaacttagtgataatttactaaaagtggcattatttatatcgatttattaaatagagaatatagcccaaaccttaatgtgctggaagataattacttagaatatccgacagctttgcgagaggcctgtattactttaaaaggtataaatgataggttgtgtaataccctacattcttatcttgaactatattatcgggggctctttctgttttaccttaatgtgcccaggggactcctgcttagcttaataggacacccaaaaggaggaaatgcagagttaatggtttaacaaattctaaactttattagcaatttgcatttaggagaagggcagatggtgtgtggtcgaaagctcatgggactgtgaattggtagactttttttaaaatccagcttttgcccctaacttttggtctcggagacctctgttctttaataactagaactgtaggccgggcgtgggggctcatgcctgtaatcccagcactttggtagggtgaggcgggcggatcacaaggtcaggagttcgagaccagcctggcccagcatagtgaaaccctgtctctagtaaaaatacaaaaattagccaggcatggtgacgtgcgcctgtagtctcagctacttggaaggctggggcaggagaattgcttgaacctgggagacggaggttgcagtgagcccagatcaccccgttgcactccagcctgggcgacagagaaaaacaaaaatccttctcaggaaaaaaaaaaaaaaattaaaggaaattgctctaaatatgatacagaaataattaaattacttattgcatgccattttaggaacatgtgaatgtttaacagacttcatcgtaaagtgtaaagcactaccatgtgaaatagttggcaaaaatga

SEQ ID NO: 32291 - DNA, 1049 bp, Homo sapiens
tagcgtttcttcctgatgaataagccttaaatgaggagaagaccttgccatccagcaatggacaaaaaaatcagcatcatctttcacactgcaagaagcatgtagacttcagatgccaggagcttctcagtaaataccacgcctcaaatttgaaacctgggaattattaagagtcagtatagatgcacagaaatatgcctacaaaggtactatgggaataactgattatatacataaaagtcgccaggcaaattcagaaaaccaaatgaagccattttgaaaatttggattctatggtctgaagagtcataaataacagtcatcatactcgggagtgatataacaattttcttccaactagatctgagtgctttacaaaatggatctggttgctggcattcctaagaggtagctggcaattctcataatccccactttacagactggaaaaacggtcccgttgatgataaatagtttacccaaggtcatccagaatgtcaagatggaaactaaagagggatgcactggtcacaattatacagatgtcattctattatggttgccttggtttggtgatctaataaaggtttctgtggcattttttcctgcctcccctcaccattgacaatttacccacatgcatttgcttaaaattcaaatccaatttgtaaaattcatcatcttatattcaattctgaatggcattgagagttgaagataatcatcaaggccatatagattacaattaaaatggttagttttaaacattaggcatctccaagcttcacattttgtgtattggttcagttttttttttaaagtcaggttatttgagagaaaactaaaaaacaatcaaaaggaagttgaatcattgcaattttccccccactccatccctaatttaaggtgttttatgttagatgaaggaactataaatgcatccttgtagataacattcattgtgtcttacctattataaattatttcttggtgaaaaataaagctaaaatgctattcagttatttgaaatataagttcctttaaaagtg

SEQ ID NO: 32292 - DNA, 1046 bp, Homo sapiens
attgaagtggggaaaattcaaaagatgctagtttgtgtgtcaaaatcaacttttgcattctaactgcattgtgtaaatttgctgtgcaggaaacataagtgaagccatttggttttgtggcattggtgtgggttggctcagggggtggggataaggttgaggcattgatatagtaagaggagagccagatggttgtattacacatcttttgtgttcttgtttgcttcttaaagcagttgcagaattttgcccttggcgatattttcttcgtgcctgtgtgttctgctatgaatttacttttgtcagagtactttgaaagaaaagccttgctcagaaaaaaaaaaaaaattacgttataaacttgtgaagtcaacagtgtgttcataaaaatattttttaaatgttaagtatgttagtaaatagttgagagaatcagcttttcttttttcttagcgcagtgatttcgaccatattttatattaattcagggaaagaatttttgcaaaattatgaatgtgcaattggtgatggatggatggatcgagatggatagatgaggagacagacacatggaacagatacattgttattccagtaaggatgaggcctatctgattagagatttaactttttccattacttacagcaagccctcaggttgtggttaacctcttgtgttttatcagcaagcgtaacttggtagtaagttgagtgagagtgggttagggtaggttggtgagttttcgttgacatttggtagaattgctgttacaccaccattgaaatttatatttattccctactaaaaggaaattctattttgcagtcaccagtggcaagggatatttaagatgttctaatgcatgtaaggggtgatattttatcaccgaatgcttttaataaagagttgctttggagctgtcccccctcacccacacacacacacacacacacacacacacacacacacacacacacacacacacacacattgtggtagaatgcttcataataatttaatgtcctttttacagttccagtttatt

SEQ ID NO: 32293 - DNA, 1087 bp, Homo sapiens
gtgccatacactattctaagtacttatgacatgtcaatgcatttattctacaaaagcaaataatgcactgtaatgaagcccattttatggatgagaacactgagggacagagagcttaggcaatttgcctaagctcacaaggtcagtcagcaccagagctaataagaacttgggcacttgaatccatgcttgtaaattctgaactattctagtctaaagtatactgtatagtactatattctgtaatacttagttttaggtgaggcagcccaaggatgcattaagaaatacagatactcgaccgggcacggtggctcatgcctgtaatcccagcactttgggaggccgaggtgggcggatcacgaggtcaggagatcgagaccatcctggctaacacggtgaaaccccgtctctactaaaaatacaaaaaattagccgggcatggtggctggtgcctgtagtcccagctaatcgggaggctgaggcaggagaatggcgggaacccgggaggcggagcttgcagtgagcagagatagcgccactgcactccagcctgggcgagagtgcgagactgtctcaaaaaaaaaaagaaaaagaaatgcagatactcgatctgtacaacctcagccttgcctttataaaaattctttcctaactttcaaaacttgtttgtttttgttgtttttgatagcctgttttcagccaatgaataggtagataacaatcacttgcagcctgttgtactgctttttaaataattagcttggccgggcgcagtggctcacgcctgtaatcccagcactttgggaggcagaggcggacggatcatgaggtcaggagatcgagaccatcctggctaacacagtgaaaccccgtctctactaaaaataccaaaaattagctgggcgtggtggcgggcgcctgtattcctagctactcgggaggctgaggcaggagaatggcatgaatccgggaggcggagcttgcagtgagccgagattgcgccactgcactccagtgtgggtggcacagcgagactccatctcaaaaaaaaaaaaaaaaaaaagaattaaagtttcattgtgat

SEQ ID NO: 32294 - DNA, 1033 bp, Homo sapiens
tcaagggaacggaagagtttttgttcaaattatatctcagtcattcacataaatatcagctgtgacacatttcttatatcttcagaggtatgaacaaatactatgcagacttgatttgcttggccgcgtgttgctgaaccattgtagtagggagaggaacaaagatggagaagagctgattttatgaaggaaccaaagaaggaaaaattgttgccgttaacgttgtttactgaaattcatcagcttttactttattcattcaagatttattaagtgccttttgtagactgggatagagcttagcaagagaaatgattgattaaatagaccattataataaaatggagtcatgcctgtattaggacaagtactgtgtacaaagggaatagataacagggacattgatctaaagggaggttagggaggacttcttggaggaagtggtatttgtgcctgagttatatgggatgtgtgggatttcttaggtgaaagagggcagagcaatacggtggtaggctagatctgtgcagcggcttagagacaagactgtacagggtgtgtatgtgagtgtctgtccgtggtagaatggtggttccagagccgcaaaaaaagtgcaagcagaggaccaagcagcggctaacatccagcacagccttttgaatacctctagatgcttccccttggccttccgggccttagaaagctaagaaattgttcagctgggatgggatgtgcgtgggtaagcatgcaacgttaagcatccatgtcaatgttgagatgcgtcctaatgtcaaaaatattaaggtgtgactggggaagctgtctgggaattgatggaacgttgtacattcacattttgcaagatgagtttgtcttccccgtgggtaggtttgaggagagcaaaaccaaaggcaggaaagagccttcacaagggaattgcagagtcgtgggaggcacccttgtgtgggccggcaagtgttggtcagggtgaaggaaagagaatggagtggatgtcattgttggatgtggtgga

SEQ ID NO: 32295 - DNA, 1029 bp, Homo sapiens
ttctttatttttgttcattcctatggtcaatatcgatgcatttcaaactcaaatgtgtggactgtcatcttctcaaaggatgtttttttctgacatgacgctttaattatatgaaaagttttataaaaacatagaagtgacttacaatattttatatgtaatgaattgtttatattgataagattaaaatcacaagaaagtagaaatgctcttaaaaatgtgggatcattgtgccttagagttaagaaaacctttgcccaatgaagaaaaagtagaaagcaaaggagaatgttaaagtacatatcacacagcattttatgctggttttatgtcagcctgagaagtgatattgtgtgcttcagctttgaagcatagcaggaggaagagttatacatgttattacatgtataagttcatgttttttcttttcttttctttctgcttttcttttgaaacaggttctccctgtgttgcctaggctagtctcaaactcctaggctcaagagatcttcccaccctgcagccttctgagtagctgggattacaggcacaagccactatgtctggcatgttattttctttgaaaggattgtgtcttgtcaaatgaacactcgcatgttaataaaaatcatcttattctgatatcaaatattaacattgttcttgattgtagatactgttttggaacatgtatgctgcgaattcttccagcggtaatgttatcaaaattacacctagacatttccctgtaactcttctcagtgctgtactatagaaagtattaggcctcaaaccatgatcaaattctgatagttgttcttctcatctcacccacctgcaaatgtgtttattgctggctgttttctcccagtgctttaggggaagatcctgtctttttttttttttttcaacattttgctctctgatgccctgggacaaccctgtgttgtgagatttaagaggtctagactttgtggccgggcgcggtggcttatgcctgtaatcccagcactttgggaggctgagacg

SEQ ID NO: 32296 - DNA, 1037 bp, Homo sapiens
tgtggaggccacgtggcaaactccaggtgcatctgtcatacagaaattgcttttccccccaaaatacagaaatgtgaaataaaccaatttgggcacaagtagtgtatgctagatttacttagtatctgtcaaacatctccatacactcaatgtattaggacaaatcaaagagttataactgtctagtttctgcacaaatacatatatagtttctacttagacactgatgctactgattgattatttttgctaacagtgctatggccaaacacttaatttgttccttttcagcagtattgtaaatttgttctagacatatgtcagtgggaaaataggggggcagggggttatctacgcaagcacccatgcacacacacaggtacatacacatatgcatcaaaagatacttcctcacttaaagatgtttaaaagggtatttactttgacatgaaataattcttcagcctttttattattgttaaacatcttttggtgtttatgagcaataaaatagtttagccacgactgtatattcactatgaatgaaacatggtttttcagaagagattttacatgtatgttaaagccattttcttttcttgtcatttatgtgaatggtccatagattggattgctagtggaagaagccatgtgattctgtatcttaactttctctcagagaggaattatcgtctttgtcattttgtttcaatgtgctacctccctacctgctgggtttcccaacagccgtcagctaactattcttgtaccatactgctaccagcattcctggttcacaaatatgaagtaaacagaaaatcttgctaatttgagcccagtaggaaccttaacgctgtaatgagggactaattttgaaagcagagagacatctcttacaaaattagagcccaattttttaatgatcttaaataactaattgagagtaagaatggtatttaagaaagagtgagacactgatacgctgaagagttacaacaaggagaggagactcctccaggagccctagtaattataca

SEQ ID NO: 32297 - DNA, 1030 bp, Homo sapiens
ggttactaatatccttttaggaaaggaaaagatgaaatccagtaagtttcagtcaaagtaagtgaataaatcagaaaaaaaaacattggttagactcatgataaccctcagagtggctaacacccagattttttgcatctctaaaaatatataacacccctgtctccaaatatcacttcagaaactaaaataataattcgtgaaaggggaaacagatccgtgtaatatgagacttgatcaggcagtttacgcgggatgcttgagggcctagatcagcccttgtgctgccctcttctcaataccctggtgcctgaggagcagcggggaagattaggagctttctgagggtttttactttaatgctttgaaattttgctgcatcgtctgagtccaatttggttcagcagtctctcagtgccaggtgactctggctaagatgctctagggctgaattttttaatgccagctttcccaggggatcagtaaaggttttgccctgggtattccaaccaggagagcctgtgtcctgtctttgtccacatctgtccccagtcattaatggtgacacaaaatagtctcccactcctgactcacttcctaaacctggcagtttctttgggattctactcctagaataattggtgcttagaccttcttaggtttatctgtatgtatgtacctagaagaacttgcatttcgtgctgtcaccaatattctgcatgcttaaaaagtagggagaggtggaagtagaattttctaaactcatgaaaaatctaaccctaaaaaatctcaataaacagcagttttttaagagaaacattctagcttttgaaaggtctaccctataatagctacctttactgtctgtatgccagacatgattctaagcctttgatatttattaactcatagtaactctgtgaagtaatcatcattctaaaaattcattttacaggtgaggaagctgaagaatagtgagttaaatgactcacccagagccctctgcttatatggagcaaagtaggatctg

SEQ ID NO: 32298 - DNA, 1030 bp, Homo sapiens
gctacattaattaccttacttgtcaagagtaacaggtaattactacatcaactcaccctcctgcagtatatagaaacagaactttatttgaaaagattcagcaaaccccagtgtatagccactccacacctttgtctttgctacaagaagacagctgtcagagcatttgttttatcattagcagggtagaggtgagttcacccttttctttgtgtctttccacctaagatgcgtgtccagaaacattcataggctcaacaagcatgtggactagcaagaaactttgagatgatcgagttcattaaaccttctcctgataatgtgtttcagagagggtgcatgacttttccaaagccacacaagaagtaaattaatgtccaaaccaggactggcaccagtgtcacctcactatgctgctttttgtgaagcttagtgcattttaatgatttttttataactatagaaaaatcatttggtatagtatactttgaatattcattcacttcatcctcctcacttgaacttctaaccaatgctttggctgccttacaaagagtattgatcctatattctgttgaactgccaggtacaactcatgtcatttggtttcctctccagtgtactagtgtcagcttttatgacaagttgtgttaaaattctactttaacatgttttttttttgtaaaggcgaacattttggagcatataggatgctcttagcaaaatcatgcagcattaactctcctggttgccatggcatagaaagaaaagattttgtcagcttttaggtgtggtccggaatatacacaatgacataatatgggtgtactatcttaaaaggctttgtcccctttttagtcaaacacctgtgacaaaattacgaactgtggttaacatagaatacttacaagtggtttttcggagtcgtccagggtagaggagctcagcgtgcagacaattttagtacctacttttcttcttgcacctggcactgggagtgagtgacattaaaaagaagttcaagaagtca

SEQ ID NO: 32299 - DNA, 1044 bp, Homo sapiens
tgcagtccagtagcatccttggggacatgggcatttctagtctcatctcaacgctatcctagggtgaggctttgtggcgttctgacattatagagcttgagaggaatgtaaaaaaacttgtagtccgtgatttcattcactgggcatagggctcaccagacatgggttaagacaggaggtagaactcacatggtagcctgggcaacatagcaagactctgtctctaccaaaaaattagccgggcatggtggcaggtacatgtagtcctaggtactaaggaggcttaggtgagagaattgcttgagcccaggagttcaaggctacagtgagccttgattgcttcattgcattgcggcctgggtgacagagtgagaccctgtctcaaaaaaaaaaagaaaaaaaaggatagaaactcagatgcttaaggtcaggcaggaaaagcgactttattcataatccttttgcttgctttgctgatccacttgggcagggtctggttgttttacatacatatatgtagaatgtgtgactatgtttgtgtatatgtttataggtgcgtgtatctgtatgtgtttatgtgtatgcatagaatttttttcaccattttaaggagtcccatgataggaacatttgggatgcacagacttcatcttctacacagctgaggacactgatgctcagagaggtgaagtggcccctgtagcatcctgatggaattagaaatcatgccaccttcctgctacttgccctaatattagtctcatcaccttccatgtcactctttgtgtggctagaccattgcttgtcaaactccacaccctcatttttgcctcctctttatacatttgtagtataatatacctaatatttttcctgtaaattgctttttaagttttcatcattagttattttaacatttttcataagaggaaacttcagaatttggctgtaaatggaaaactaatatgatggtgggccagaaaagaaagaacactataaaaataaatacctggtcgggcgcagtggctcccaacactttgggag

SEQ ID NO: 32300 - DNA, 1004 bp, Homo sapiens
tgggttggtcttgggagtgggagcctggagccttctcactttggatgcacgcttggtcttgctctgcgatgcgcttggcaagttgccacaattcttatgtctctctctgcttcctcatctgtgaaatgggcttaatagcacctagggaaggaagaacttgtaggtgctgtgtggattcataaattcaccctcagtgagagctttgaagatgtgaaattgtctctggggacttggaggtgttctaaacctgttgaaccagagacattggcatcttactgggttgcctgtagcagctggagagttggaggcctcagatattgggctgggtgttgggcttcaggcagctctttcctggctcctgaatgagttttagttttctccaaggaaatcttgacttgtcttagcttacacatgggggtttgtattggagttttggtttgtgttttctccatatgaaagaaggggtgtgtgagtgtgtgtgtgtgtgcgcgcttgtgtgtgtgtgtacccagaaatggtaggtaactcttactgagatgaaagaatttcaaggcttacacagccaagagagagggcattcacccctttttttcttccattggttaagtttgtcccctagatccttctctgaagtgtgggagctgtacagcactaccagtgagttccttctctgtttaattggaaggacttgttgcagcttgggcgattattctttttggctttcttttcgattatttccccacacttcagattcatttgaaacaagttttcagccttgttcaggtggaaacctgttttcagttgtgggctctcctgacctcactggaagggtgagaagagaggtgaggacgtgggggagggaccccatgccctcactgctcaaagtgtggtcctcaaacgagcagccgcggcatcacctgagttcttattagaaatgcagggtctcaggccccaccccagaccgactgaatcagtcttttgccaagatggccaggtgattcacg

SEQ ID NO: 32301 - DNA, 1877 bp, Homo sapiens
tctaaatgctttgttgcagtaaaatcaaagtggtggggtagaatgtctaggaaagtgtttcatataaattggaggggcccattggtacaggtgccatatttcccggtggttgtggctactgcgttgctctaaagtcagtgacctgtaaggccttcccctgtggccattcttgccatagaaacatgggcctgccccccgccgcctcccctcccccaacagcccatgagtttgggtgacagacaccataaggcagagtttaagcctcttttccaacgtggcagaatgagatgctttctctctttattttcctagaatctgggcaggtagtttcctcttttagggataagtctgggagcttgaagtatagaagaccctgagattgaaaatttaaaattcaatgttgttttaaatcaaagcaggttaaataaggaaccaaataatttctagaataaatggtaaagaatggaccctactgtaagtgaagtaacatgcggatgactcctgttttttttttttctttctttcctcttgaacttgggatccctgcatatcacagacaagcatcaaaacccaagattcaaatctgttactgaatccattccagaaaagtggggaaaagctaccaatttgtcatctgttataaaatttcataacctttctttttctgatattttgtactattattcattcggcttgcaatactgcaccagatttgcgcctgctcattttactgtgtgtgcatggctgtggtctttattttataagtaaggaccgtcggattgagttagcaatgccgaaatcgctcacgctgcaaagtcctcgagtcaggctttccgtggtatgggctggctattttggggtatggtcaggagggagcctgtaaaaaacctgaattgtctcattcccagggtggtctttctctgtcgaggttgtggtcattgtagcaaggcaatttgagaaaacctctcgtatcacttcctgtgtgagcttggatggaggaaaaaggaatcttcatttccgaaagttgccagtttttctagcttcccagtagagcagaagtagcttggaaagattttgaattttgtttttcactggatatgcaaatatgtttgaggaatgctggtaatgggcttgtcttgaggttttagagtgaggaataaaccacacatcatttttgattgtatttaataaagtgaatgaaaaaagccaccaaccaggtgagtgagatcaggcaccgtggggtgatttagctgtctttcaatgacggtgattcttgaagacgagttcctcggaaagtcttattttgagggtttcaccaaattttagctcaatatttagttaacacagacgaatcattatggaacatgttaattctgtttttccatttttatacaatcagtctaacatttccttttcaaatacaatactctttcaggttttgctcctaagctttttctaactttctatttctatttcaatattttctgccacccagacatcaacagatggacagggacgtttcagtaccccccctcccgcccccccacccccaagttctcacgagcagcacacacaagtgctgagttccgcctcgctgcctgcttcttggcacaggcctttgattcctgaaatgctcagagcaaaccaagaaaaaaaaagtgtttctcaggtgagcctgtccaagaagtttttttccttaaagaataatttcttttcctgctgttcttcctccccacacttcaccaaaaagggtgaagacagacagaacccagaccctcccatagttttccttcagtgtccccttgggaatgatgtcaccttggtctggttgcccccacccatgggcgaggttgtgggtgataactccatgggccatg

SEQ ID NO: 32302 - DNA, 1066 bp, Homo sapiens
cttggccatcaactgctggggggtataaatgaggtccaaaagacccaagggagaggcagtctcaatgtttggagaccaaaattatgtgagtggaggggagcctggagaaggtggccgtaagtcgaaatccctactgtgctaggatgctaaatccttttgtgagccagagtttcctctgctgatggccaggaggatggagagtcagccgagataatggaatgcacaggaactcatgccacagcaggttactcttaaaggtggataaagaagtggaaataggattagtcttgctgttttcacatttttgaaagcaatccaaaaacaccagtactttccggccgatgtagctcatattaaacgaggctgccagaaaatgaagaataagggacaacattcattcattcattcattcagaaatagattttaagagccaagaattcagtgctgagcaaaaccagacacagtgttcttaaagagtctacatgttattccattcctgtaattcctgtgcgtaactgaacatgttagatgcctacattttcctgaaggtaataaattgttcaattattttgtttgcttttatcccattactttcatataactagtagagatagattccagtggtagaatcacataaatacatttcttctggaaataagtcactgttattgtttcaatccatgttaattttctacccctcccatcagcagatccgtgggctctctttgactcaatttcgtgtacacagcttttcttcacctcctggaaccaagcttttctttttgtctgcaagtgcgggtggggccctgtcctcttgaggcagcttgtttttcacctgatcatttttttggtttgggtctcttacgccccagccagaggaacaggctcttaattcctgtccagcagggtttctttttattcccaaaggcattatgatgatcacagactcggaagttcatgctcctccaccctttgggcttgcgttttatgctgggtggagagagaggatggtggagccattgctgagtgtctgtgataccttcttctttggggaacactcagagag

SEQ ID NO: 32303 - DNA, 1047 bp, Homo sapiens
cacacctgtaattcccagcactttgggaggccaaggtgggcggatcacctgacggcaggagtttgagaccagactggccaatatggtgaaaccccatctctactaaaaatacaaaattagctggggttgggtcacgtgcctgtaatccgcagctacttgggaggccgaggcaggagaatcacttgaacccaggaggcgggggttgcagtgagctgagattgcgccactgcactccagcctgggcaacaagagtgaaactccatctcaaaaaaaaaaaaaaaggtataaatatctattgatagatatttatatctattattaatatgccaggcattgttaatttcaatactgtgtaaaaacagacttggggcatacataacacagaaacaaatgggaaatttgaattatagggaattcaacaaagaaaggccctttatatagggcaaattgacttggttgaaagccatggagttcatactaccttagaatcttagaacttcttgagaagctctggacagagctcatttttattttccagaacctttgggaggcagtatattccatggttaaaatgtggacttcagcatcagccccattccggttcaggcaaaacactgctgagctgccatttacattgctggagatgtgtgtggcactcgtttcagttgtgcagtacacctccttcccagctgttcacagcagccctgatttaggcaaaactgagtttgaattcctgcttttgccacttacggtttgtgaagcagcctgtgtttctgtagccctcccacacttggcctcctcattggtaaaatgggggttatggctcttccctcacaggtaccatggagaacactaaggactaaaggtatgttgaagctatttatgtcatgcctgccacgtggtctgcactccagaagtacttgctattgctgttattgaaatgaaagatctcccttgcacatcttcccctgcccggccacattgtgcactttgaaaaggatatccttcacattcgttttccagaaaattgaggtcactgacttattt

SEQ ID NO: 32304 - DNA, 1013 bp, Homo sapiens
acatttaagagttttcattatttgttttatgcagtttgtatcaaaagcagtcttttcttaaacatttaaatttaggacccctttgagagctagtttccaagttttctttaattaaaagggaagggtgtttaatgactaaaagctaacatataatgggttatttattgctgcttgttaaattagttggagttggtttggtcctagacaaagtgaatattagatttaaggagggtgctttccgtctttagctggtctgtttttgtttgaagttgtctatacgtagggatgtactctcagatgtatgcctctgtatttcagacggcgggggggatgtgtgctcgtgtggctatttccacgtccgcctgtcattttctatgaagagtttagcactgaaagcatgtgtgaatgcatgtgttaccgagaatgcacacatttccttttaaaaaactgactatttgtaaagagatgtatatcattcataagaattccagaacactgcccccgcctcattcactttagggcatatacaaagctatgacatggtttttgaagtttttgcagattattcagttaccaaatgtcgatcagtttaacagtatattgaaaccagctccagaagcagcacagaggagatgcacatttgaagttgctcagtggttttcagactggtgtgggccctaggactacctgagtgccagtgattctaattcagtgggtctgagagagatggcgctcagaaagcagttttttttttgtttttttttttaaagaaaacaagttgctttgatgattcgaatccacgtattccacagacttttacatatgttctgaaagttagggaactttcgctaccatctccccatcaagagcagctgcatcatagttcttctagagcacagtcctcctcataccttgaggtgcatggaggtcaagctgcagatcttgtcaaaatgcagattcttgttcagtatgtctaaggtagaggctgggaccctgcatctttgataatgttc

SEQ ID NO: 32305 - DNA, 1045 bp, Homo sapiens
gggtggatctacttttccaagtccattcagctaagaagagttttggtagatcatgaatagacttgtaacatattggaatctgtggaaccttgtagattgtcaggattggtggctcacaaagcacggtccctgtactgcagcatcagcatcatctggaaatttggtagaagtgcgttcatgggtcctattccagacctcctgaatcagaaactcaaagagggagatccaacgatctttgttttaacaagtctttcagtatgagaattactgggctccaccatccctcatttacttagaagattagcatagtaatataaagttttgggctaattggcagtctttgtcattgttgccatggtgaccaattaacctggctcaggaaaaggaaagtttttttagccacaggctacccccaactatcttataaagacgttttcttcctttaatacaagagctgtcgtggcatggctgaggacacaccttgaacaatagtaaggaggaagtccctggataaagggccgccgtgtcttagaataatgtattaaaatcattttcatcagtcatttctttttggggagattccatttgtccaccacccacccacctacccatgtatccttctattaacttgtcttttcatccatctacccatccaatcatccaacaattctttgctgaaatcctacttcgttccaggtactgtgtggtgaatgaagcagaaggaagaaatttatcatcctctgaacgttactggtatataggtatatatgtgtgtgtatgtatatatgtatgtgtatatatatgtatgtgcataggcataagtatgtatgcatgtacgtgtatgtatatatacgtgtatgtttgttatatacacatacatacacacacacgtacacacacatataataatgtttcctttttctcaagctcgcaacatctgtggtgcccaaagcccaagtacccagtcacctccttcagcatttttttctttttgtttttctggccttgggctggctccccaacccactaaattctcctgcagtaa

SEQ ID NO: 32306 - DNA, 1050 bp, Homo sapiens
gagcacaccataaatggcagctgcagagctagacatatcttggggagtttgaataagtggggttaatatgtagactagttttctctgttctcactttgggggaaaaaccaactagcgtttccattattctaatctacttctcttatggactagaatagttaaaattaacaaaatgccttgttaggagtaaaatgggagcttggattctctttattatttgttttctggactggggtttcctgttggagttctgggctggtttcaaagtcccagatgctgggcagaataagaagaggtcttccctcagggttggcatcatttacttcattgaagtgaaatagcgtgtatcagagcaagtggaaccgacacccaaaatatgacttgaagaatgtaatttaaaatgtagcatagaaaaaaaaaaaggaaaagtatgattttacatattttcagaacttctactgaatcctctcggacccataagatttttcattttttggtcaatcatttttgtatggtttgtgtcgagtgtttattgggtatgaacagttctgtaccttctgtcttgaaagtctaaatctttattccttaccaagaatgatggaacacagttaaataggggaattcacataatccagggtgagagtggtcctgaggaggtaaaaacaaacaccctgacaaaaaggtatgtcctctgcaaaataagaattccttacttataactcctcccccaacaaaaatatgaccctaaaggcaatgaagcacacaaaacataatgaaaaactataaaacgtaccttctagcatcgacttttagtgactcactgacttcataataaaatgtaaatgtaattacatttggccatcttctaccattaggcaaactggaggaagaagtacagggaacctctcccagtagggctgtagaacaaattcagataaatctttaaacctgggagtcacctggtgttatgctgccgggtctttcttggtctgctcagatggaaccactttgaatcatcagaacatggagttatcattttattcacctggg

SEQ ID NO: 32307 - DNA, 1033 bp, Homo sapiens
tgtaatcttttcagataattcctgcggtgatctgaggatttataaaaggcataataggacataggataacttcctctgttggcttgtttgttttaatcatactctgaaggatggactatctcagttttggtccatgtgcaacgttgaatgagtaattgtttttttggtcccattacaacttggtgataacatgagccaccaagaaataagacaacaattttttcatcttgagttttaggggaaatttgagtctaatttgttccttgagagagtcctatcccaaactttttgtatgatcaggacttatgagaaagccaaaggattggaaacttgggattttcaaagattttttgaaagacttctggaaatttttttgtatcataatttacctcattaggttattcattgactttttagggggaggttagaaaggacatgatgatatttttctctaagtgtgttttccatccatcctgttcctcagcaatcaatgactcccctgtagtaatgaacactgtgacttgtcattagcagagacaatgattggttgaggccaggcattttgggtgacaactctgacatcatttgtggtagccttgccattggatgaggtcagtttcatggagaaccttatcatttcagggtttgtattgaatagcatttaattggtaagaccctcatctttttctgtcttagtgcagtagtattggaagcaaattctaaataatggagagaagtgtagtgaagcagaaagggcactgtattgggagttgggaggcttaatagtaacctggcatggggcaaattaggctctctctttgattttttttcttttttttttttggagacggagtttcccaattgttccaggctggagtgcagtggcgcgatctcggctcactgcaacctccgcctcccaggttcaagcaatttttctgcctcggcctcccaagtagctgagattacaggcgcccgccaccatgcctggctaatttttgtacttttaggagagacagggtttcaccacattggc

SEQ ID NO: 32308 - DNA, 1091 bp, Homo sapiens
taagattcagaaagaatggagatactggtccacatagcagctttccataccgcgttgtgtgaagcattttggttcgatgcagagggtatgggatagatggcatgaatactatagccatggttatatattcaacagaaaggcctgttttggttatgagagggtctagaaatgccagtttgtaacgaagagaatggaggtctgtcgtaaaattcacaaactaaactttttgagttaaacttgaaagcagatagcctggctatctttatgctgtttaattaaaattttgacttctataaaaaatggtagttttagtatttttcttttgaagttgcctgctgtgagtctaattaatttttatttaataataggtttgcatctttgaactgtttttcttgtcttagggctgggtatcttgttagtgagtggaaaggaatgttggaagaggagcgataaaggatgtttcagtcccttactgggcgtggtgtgagatgaattctgaggttgtgactgggcccagtgggcgagagcattgagctgctcacctgggtcggctccacatgcaggtcacagaactgtggtgtacgtgctgggtatttgctgagcttagacaggtctgttttttcaacttgtatgaaggagaaaaaaggaggtgaagagaacatacccttcccaacaggggggagagccttcacagaatgtccactcctggattcattcatctattcaattgttcagtcaacagatatttaccaagtgcctgttttgtacatgacactgttccaggcatgtgggataaatcaatgaacaaaacagacaaagatcctggccttgtgggcactcattctggggagagaaaggatgcagacagacagacataataagtagattagttaggaggttagaaggggtgtgcaggagaagaaaaaccagggaatgaggttggcagttctgtggagtgagagtgggctgtgcttttgattgtgacgccaagtagttctttttaaaggtgctgtttgagtaaggacttgaaggaggtgaatgagttagacttgtagaacattccaggcagagggaacagttaatcaaagacc

SEQ ID NO: 32309 - DNA, 1021 bp, Homo sapiens
cactctcctctgtgtgtctgccacacttctgctctccatttcatcaactgcagatgtggcacacagccgtcttagaaaagtcatgaactgtgtcgtctgtgcggcttaacagccaacatctgctgcagcaggctgaaggaagaggcagggaaatcattttcgggaatgcactcaagtgcctcaacttagcctctactttggcctgtgcagacaattattttacactaattgcatcaagatagcagctataaaaacgagatttcgatcgctctgctcccccacccctcttgtgaaagttgcagttacaaaggggtagttcttttttctttttattgtggtttgtttcttgttctcaaaagcttattacattgggtgcaaacaacaacaaaaatgccataaaaaggcaagaatcgtaatatgcttaagagctaaaaagacctatggtgttggtttaaccaatgaaaatattcctgcaggtattgtaaaatttatgtgccatatgaaaaacattaagggtgttgtttttttcacagaggaaaatgttcattgttgagccattttgtaaattattttaatgctgcatttctgcttaaacctcatgattttgatatataagccagtttaatgttttctatacagaccctggcttttcttaaattttatatattggaaagcccatgtttgtattggaaactgctggtttctttcatactgaaaatctgtctcgcgcggcgtgatgccatgtggcaaaggagtagtttgaccagagtcaaacctcgagtgttgacttttgagtcctaaaaactaggcaagaccgtctgaataaataatctagaaggtgtttttttgtttgttttaaaaccaggagtcttttgacagcaataagaatagcatctctgcagtacagtatggactttctaatgcattggtctgtttcaacttttcatcttcttgtaacagaggcaacattgtgttcagtatctgagccttaactttttttttttaatgctctcggagtaaa

SEQ ID NO: 32310 - DNA, 1026 bp, Homo sapiens
tgtgttcacattcttctctgccttgggccccaagaacagcaagttgccttctaatgtcatagaaggaagaaaatacatgcattgccccttaagtgtggctctgagtggcccttgctgggtgacattggttccctagtggtattcagagccctttaaaaagaggtcaaacggggcccaaaggagcacagcaatccgtggagaccatctgggcctcgccctagaggccccacctctaccttctttttggataaggcctgatatggttgtttacctgccaagccctcctttcctcaaagaagagcgttcttgctgggtttccacaaacctgctgtctagtcctgcactgtttgttccttgatctggtggttggggctgcactggttgcattttggtaggcaggcagacccctcacagtgttaaaatgaaggggaggaaagggtaacctttcctaaactacctaagaagaatgctaatcccaactgtttcagaaacctgtaatttttagtttatgtaaaactcagatagattgaattcccccttgaacctttttgtatttcataagagttttatttcctaaaactgacagcagtgacagttgtgttagaattcagccctgagtatttatttctagatttcacaatttgttttgtcttcgtagcaagcaattgccttccttcctttctctcttcctctctgtgtctctgtctctctccccttcctttctttgcaatttccttcttttctcaagctcatgatgaaaattgacccttcagttttattttcagatgaaagctcaagcaacaagccagcgcttgcctccattagtggctctgggtagtccttgcaggagaaatcaccatcagcaaatcatcgtccgtttagagtgggctgcagaggctaggcagctccctgacttcactgtccaggagcctcttagaaatgagcaaggagtggcactggtgctagtgccattcagcaaggctttggaggtgtgcttcgctgcattggggtacctgatgaacagca

SEQ ID NO: 32311 - DNA, 1030 bp, Homo sapiens
cccgagttcaagcgattctcctgcctcagcctcccgagtagctggaactacaggcacctgccaccacgcccggctaattttttgtgtttttagtagagacagagtttcaccatgttagccaggatggtctcgatctcctgacctcgtgatctgctcacgtcggcctcccaaagtgctgggattacaggcgtgagctttttatttttgacagttttcaaggtgaaagatggtatagaattctggaaatgtgctttctttaataactaatgaaattgtccttttcacaccctttggtttctggccatttgcagtgcttttgtgatttacctatttgtattatatacagggtttttatatgtgatgtttgatttattagaagtctttttacgttatagactttaatacatattacatatatagtgtgtttgcggaaaattaccccaatttttatgttttccttcctttcatttatgccttataacattctgtaagacagatttttctacccatcccatttattttcttataattgtttaattttttttccttttcttccttctcttcctcctcctcttctttctcttcctcctcttttttctttttccttttttagtatttaactctatcttaattgtatttcagtgtatggtatgaggtaagagtttgatttgattattaaaaaatcgcagttctagaattattaaataatacttctctataatggattttaaaagctgtagtatacgctaaattttaatgtagggcttatttccatgcacttttttcggtttcactgagaagcaatattaagtgttgattatatgcatggaccctggaacacgttccacccactgtaaacatctaaaggcaacattttcttacatgaaaatgtggattatagtagaaccatctaatgggggtgccatgggcagtaaatgagataattatataaagaagtgactatttatgtcagtttatctgggacagtgactcctgggttagcattgtctcagatttttcattttatgct

SEQ ID NO: 32312 - DNA, 1067 bp, Homo sapiens
agttttgattctcaaagtggaaatacccatccctttgggtccaggaaaagaaaactcagctcacagtttcagaaatttggactgtttttttcccccctctgtctttctatttgaaacgtctcacaattaaagagcaagaaaaatataaaaaaggaactcaactagttaccattcaaaaggtgtcagctaaaatctcactgcaaagggaaaaaaaaaggtttaacatcttgccactggctgcatcccccaccccccttagactttggattagtcattgtatgagagagagggagaaaaaaaaaatcactttttttttttttttggaaaagtaaagtaaacagcctccaactgctgaaccttgacaacccaaattaaggaagcaggagagatcaaacagaactgctgctgggtggttgtcaggagctgctacacggagaaccctggactattcgatcaagcagcaaggctatatgttcacttatgcagaaatggaccattgcagatgctaatctttgttgtgcaagcgaaggctcacttggaaggaaatactcagcccctctctgggcagcatttgagttccttatggatgccgagtcgcgaaacaagttattttttttaatgtatccttctttatgaggagaatgctacccaaaaatgtattaaaggaatattaagtcgtccagagactgtcttgctaccaagaactgtgcaatggaattctttttaccaacattagactcctacactagagttagataacgttttctcacattgagtttagaagatctgccttgtcagggaagccaaggttttgtatgtgagagtttaaatctgatgtgaagctcaaaaaaaaaaaaaaaaagaaaaaagaaaaaaaagaaaaaaaaaatctctggtgatgaagttttgtgtcagcccactcttggaatttaaaaaggcgagagagagcagtctccagattagacaacctctttttttagattgacattcaacatgaccacgttgctacttttattcaagttctctgtaacttgtccttgcttgttgtctaggaaaatttaactact

SEQ ID NO: 32313 - DNA, 1048 bp, Homo sapiens
ttgtgatgtatttttaaaaatatatagcaggattttattagctaatattttgctgaggatttttacagctacattcactagggtagttttgtactgactttgtctggttttggcctcaggttaacgatggcctcatagaatgagttgggaagtattcccacctcttttattttctggaaaagattgtttagaattggttttgtttcatctttaaatgttgggtagagtttgccagtaaaatcatctgaaactggaggagtttttgtttgtttgtttggctttttttgtggcgaagggaagacttctaactatgaattcaattcaaaaaaataaatgtaagattactctggttacttttttcttcttgggtgaattttgacagtttgctgcttttaagaaattggtccattatgtctaagtttttaaattcatgtgcaaataattgtcatagtattttttattagaattttagtatctgtaaagtctgtagtgataacaccttttatttctgatattggtaatttgtgtcttttctctgcttttgtttgtcagtctggctagtggtttataaattttattgatcttctcaaagaaccagcttttgttttatcgatttttttctgttttctgttttcagaaaacagaattatttcatttattaggtatttcttctgtttgctttgggattatttgctcttatttttgttgtttcttacgttggaggctaaattgctgatttgagacctctttttctaataaacatttaatactataaatttccatccaagcattcctatcgctgtatccaacacatgttgatgtgttgtattttatttttatccaattcaaaatatttaaaaatttcccttgggacacagttataatgacttttaaggttttcatctgataattcttacatctgtgtcatttcagagttggttttgatttttctcaatttaggtcctattttcttgcttctttacatgcctggtaatttttgataggatgccagacactgaattttaccttgttgggttctggatatttt

SEQ ID NO: 32314 - DNA, 1069 bp, Homo sapiens
tactttcagtggcttctcatggttcttagaataaaatccaagcccctgatcctagcccagacagctttccgtggcccggcctttgcacatctttctcctttatcttataccaccctcttcattgtcctctctgcttcacccactctgatctcctttcccatccttggatgtacaagcaggcctttgcctgtgctgttctttctgcctggagcactcttcctcccccctcaaatcctcatgtgtttggcttattctccaggttccagctcagatgtcacctcctcagagtcctttcctgaccactttacctaaaatggcctttctcaatttctttatctcatcaccctgtttatttctctcgtaaaactcgtctctacaggttatgatactgttgatgtatttgtctacctttcccctttagagtataagcttcttgagggttgggaccaggcctatcttgttcacttctgcttccctagcatctaaaatatctaggttcttggtaatattgctgaatgaatgaataaggtacgtgtgtgtgtgtgtgtgtgtgtgtgtgtgtttgtgtaatcaaatagacatgggcggtgaaagagagggagtcagcgatttctaacttcgtcattttgtcccacttaagcagaccctggtagaaggatgcctgcatttgggaagtgacaccaggaaacagtggtagagtagtggaaaagtgagtaaggctagggaagtcaatgaattatcaagcttgctaccttgtggataactgggaagaccacttaggaaccctgggcagcagaatagaatgtgtgcttcagaatgactccccccgaccctcgtgatgcccctgtcccctgggggctgggggagctgcagtacatatctaccaaatctttctttctttcttttttttttctttttgagatggagtctcactctgttgcccaggctggagtgcaatggcacaatcacggctcactgcagcatcaacctcccaggctcaagtgatcctcccacctaagcctcctgagtagctgggactacaggcatgtgctaccatgcctggctgatt

SEQ ID NO: 32315 - DNA, 1036 bp, Homo sapiens
aatgactacccttgactaagaggaggacgttggggagcctgcctttctgcggtaacatcagcctccttttcgggatgatgtttctccccaccaccctaatgaagaaaatagaacatcaggcaactgagaatactggtcaaagtccaatcagaaatgggcctggaggtgtggtagtctggaatgcccatgcaagggtaatatgatcttggaagcctgcagagcctgacttctatttgacacaaaaaaaggcaggttatctccggagtgggttaagcctcaatttgcaggcttggctagtgttttcggcaagccacaagccagagtctctaatgaccagtcttactgtagcaagtagacttgaggatggttgcagcttctcacctccccttgtgagatcactgtggtgtagagatgtctttttcttggtatgtaaggaacattaagaggaggtttgtctggggacggggaaaagagaagtgacttgcttcctaataaacttgtgttctctgctttctgttggcaaaaaaaaaataaaaataaaaatagtgaaatcacatgcctgctttgttcctgcagctactggtttgagaatactgaattactccccccaccaaatattgcttattgtcttcatagatgttctttagaaaatactgttttagacttctccttgtttcccaacagggtactttttccccctctcaaatggcgaaagtgataccttcgtttataagtatgtgaaagttgctgtttaagagtcccagacttttacctttggggccagaatttagaattttataaaggtactatggtgcatagactgtatattatgtaccccatagcctatgcgttaatatttctgcagcaaaatgtgtgaacattcacactaagtgggctaactagactctataaagagccccacatcagctcaggtcttgccaacgttgagttagtttttaaaaataaaactttgtgccttagaacctgtgaatttcaaaattgtgaataagggactgtgaatctgtatttatattgt

SEQ ID NO: 32316 - DNA, 1031 bp, Homo sapiens
aatcaaggcagtgagctggttacctctggtttgcagatgagttggccgagagaaaggtgcagagacttgcccagcatcacttagctggtcggtgagtggcagaccacagccctgtgtgattccagagggaatacttccagctaagagacgcttctttcaatttattggtggaaagtggttctatactgagacactctcccctccaccttgcccttacagtatgaagtaatctccttccttggaggtggaggccagtgtttgtggtttcttaagacaaaatggaaacaagaaattaagcaataattataatatgattaatgataacatttatcaagcatggaccctgtgccagactcttttacaaattacatgtattcgcttgcttaatcctctaggaacttttcttatctagcgaggcaaagtgacttgtccaaggtgacttagctggaaagtggtgagccaggattcaaatacggacactttgaccccaggctcctcctcttaaccactttctgtatacttattgagcacctactcaatgccagactcgtgttaagcattatctcaccatccaccatttgacaaatgaggaaacagaggctcagagtggttaagtgacctgttgaaagtgataggacttaaaaagtgctggaactaagatctgaatcaggatgtctatcatgcctgtccttggactctcttgctccatgtcatgccaaagtgtgccatttccactgcaaagcctaaaacagcctcatgcataaaactgcaaggagcccattgcggttggattccagagggtttgctaccctgaaggagaggccttggatcttttctatgccacattccattaagatatcctctttatttgacgcatgggaaatggaggcccaaggaggctaaatgacttgcacaaagtcatgacttcctgagaggtgacagcaagatctgaatactagtgcttttcacatagggtactggcctaagcagttgcacactttggatgataataaacttggaaattgaggacc

SEQ ID NO: 32317 - DNA, 1046 bp, Homo sapiens
taaagaagctaatactgttttgagatagaaggaaatattttgtggggcatgtgacttttgtgttaaggcagtttacccatcttggctgatgtggggaaagtgcaaacttccagtagaatcccggtcttttcatccaagtgcttgcaggggcagccttgtagtctgcaaagaaccatgcagaaaccaaagagcttgcttttttgtctttgtaattccttagggtctgtgatatatgccaggaaatctgattgaaactaatatgctttttattctcccattattccctaaattgttatatcacaggcacttgcctacattgggaaagtaaggacaaataatacccatttaaagtaacttgcctatattttgactgtctttcgtaagcacttgctgaactgctgacttaactcagttttaagatttcctctttccccccaacttttccacatttcttaaatgagggtgtaatttactgcaaacatgtacatttaatataatattgctgttagattcgtggtacactttatgaagcaaaaacatgaaaaggaaaccacaactctaataaactttaaattaaagattaagatgactctttctcacccctcttcttgagtttagcccatgtctacaccatgcacacagtcacaagactttatagcttagaaactttaggtataattgggtcctatagacataatatacaatccaccaactgagccttggccgaacttgtcccttgttaaagacgtagggctagccagccacagagctgggtattgaagtcggcaagttgtatcccggtgcaggcgtccttaaatggagagtactcagaatctgccagccttaacctgcccactagccaccctaatcaagcattaaatatctgatccaatctggccactggtgtaactccgtaatcagacatcctgtttgtaaacagctcctccttctctccctctccctctcagagacagaagtggtgctggggtttggagtttgaaaataaccttcctatgacaggaagtgggcttttgctattagttgcc

SEQ ID NO: 32318 - DNA, 1033 bp, Homo sapiens
gtggacgtggaaaacactaattgcactctgtaaagaattctttgtcctttgctgattggttttggaaacggtcttaacaggagggagagtgaagagaagacttgccgaagccgatgctggtcaatttagagtgggtttctgtccttgcagatgggcaattaggactcaaagtggcaggtggggtggggggagattgtgtgggtttctaccgtcacattacttgctttttaaaaaaaacacacacaaaaaactttttttttggctttctaaattctctgttcttttcactctgatttttttttttttttgccgtttaaaattccttattcagcctaattattgttttctacactcccctttcattgaggcacaagaaatgggtttccctttaagtagctctgctgtacctagttaatgagaatatgcataatcgtgacaatactgcttttgaataccacactgtacaaggaggaacactagcttggagaaatctgtcttctgattatttgttgtgacacattcctatgtactgtgagctgggcattgtttttttctgtcccagggaaaagaaaaaccatacttaatgtgattttgcactgacagcacacaaatctttaattttcctttttaaaacatttttttttagtgataaaaggaaaataatagttggattgcataacatgaaaactataatcacaattcagtatcaggatataaatcaagctctaagtctttggaccctctgtggaaacatttctaacccgaattttaatttggccttttcaaccaaaggcttagagtggtagcaagggatttcttccaataggaaacctgatgtttctgatttaaagagaaggtgatattttaattgtttgaattaagctccttgcaaagttcgggtgtgtttacccacttagggctttctttcccagtcaacgctaacacattttgttaaatgatccctttccctgctcacattgtgtgtcatttctcatcatcagtagtcctccagcctgggcagctgtccccaccc

SEQ ID NO: 32319 - DNA, 1049 bp, Homo sapiens
gctgcagtgagccgagtagcatgatgctactgcactccaacctgggtgacagagcagcaagacccagtcttaaaaaacaaaaagaaaaataaaacagaactggaaggggcttaaaaggtgaaatgggccagcccatctgcctccctagaaccccattcactgctaagtgtgggtagcgtgttggggatcaaagcacccagagtcctgaatcaccccacctttatcagacgttgcttcctggtaatggttaaccagatccgggaggtagattgtcacactcagtcttttgccttagagaaaatgttatgtatttcgtaggtctccctgtggcatcttctactttaaaaaacgttaagtgtttgaaaatatttttggtagcataatttttttaaattcctgagttccggctgggcctggtggctcacgcctataatcccactactttgggaggctgaggcaggtggttcacttgaggtcaggagttccagaccagcctgtccaacatggtgagacccccatctctaccaaaaatacaaaaattagctggacgtggtggcacacgcctgtatcccagctactccagaggctgaggctggagaattgcttgaacctgggaggcagaggaggttgcagtgagccaagattgcgccactgcactccagcctgggctacagagcaaaactacgtctcaaaaaaatatatatatattctagagttcctaattaaaattagtaattttgcaagccagatgataggtctgaatatctattggcagggggaaacttgatttggaaaaataaaacttagcaattttatgaaacttcatttcccatggagagtgttgagaggtagggagcaggggcacctagatataattgctgtcaccctggtgtggttctttgttttgttttatttttagtttatttttaaagataggcttgtaagcggctctgtcttgggttgtgtcaggcaccccctctccccaccccctgcaatgcattttgtggggcacattttcccctgcggcatttgcttgcagcccaacatac

SEQ ID NO: 32320 - DNA, 1028 bp, Homo sapiens
cgtgattgaatgttctactgaaatgctaatacttcctcattatgaatgactatgacacagaactgagggagaattcacgcctagtggtgaaatgttaacagtatgaataggtgtgtggacccattgttttccatcatgattcattttcattgcttttgtgtgctcttttgaaaaagtcttctttttcataatgaaaacatcttagtgctattaaaccaatgtttggtagatcagactgcaggtcacacatttaacagagttagagaaaaggacgacagccctacacatgtatgataaatttcctatatccaaaactgttcctggagtcagtaacccattttttaactaccgtatttcattgaatctaagatgctcttgaagataaaatgctccattattttagtattactgaaaaagaaaaataaaaggctcccaattaaactgtaacacattattggtaccagaggtcttcaaatatatgtgtggtagttgtgaggagtgcgtcttagaattgctgaaatacatttcattattgcttcactttttccaactctttgccaaaaaaggataaaaaaatcaaattttgttttgtgagtatcctagtatgacaggggatattaacactaaggcctccctgtaaggaatcatataattacaggccaaatgacctagatgttaagcagtgggactgatctggcactacagatattctgaattttaaatggaagtttaaaagagacagaaaaatggcactgcagaagttgcttattggctgcgtggtgtagaagttgccaatttgccgatgccatttttattctttagggatactttaattgtattttcaccccagatattaattgaaaggtcatcaagggttttttctttttttttatttcacaagactagcagaaactctatagacggaagtgtatttcattggcatttatgtatggggctaaaacattttttcccacctttgaaccagctccacacttgactctaaagaggagaacaccaatttggggtcg

SEQ ID NO: 32321 - DNA, 1029 bp, Homo sapiens
agtgggatcacttaaggccaagagtttgagaccagcctgggcaacatagtaagaccctccctctacaaaaaatacaaaaattagctggctgtggtgacatgcacctgtagtcccagctacttggaaggctgaggcagaaggattgcttgagcccaggaggtcgagaatacagtgagctatgattatgccactgcactccagcctgggcaacagagtgagaccttttcccaaaaacaaacaaacaaaaaaattgggattcagcaaaaatggtggacttgatgaaaacataccaagagaatcaactgtaaaactccacttaaaaaaggcaagtgtgtatatggcttgaatgggcagctcagcagtgagggatgaagagcaggaaatcacaaatgggtcacctgtattcaaatcacatatttgtggctatgggcaagttcccaaacctctctaagtaccagcctgctcacctgtaatggtgataaataatattgacagctgcataaataggattgcagggattcagtgcttcaacggaggtcagaggctcagcacactagcaagaattcggcacttacatgttagtcactgacactggtgtgttacactaataagtacttcctagttgttattttattctagagtccttttagggcctctggaaacgtgatttcttcaaaaaacctggataatgaaactgaggggacctatgtaacttggtacaattatctcctgcactggaatacaagtaaagaccagactgtggagacggaggcatttaaaaagaaccatatatagcaaattttcatcagtgctttttttttttttttttttggtctaggttaaatggtattatcctcacattgtgtttgcttaaaattgacataatactgtatgaagcaaacatttgcattatactcattataaacctttcaaattgaagtgaactttaaaaattagttaaaaaaatttttttgaaatacagttttttgaatgaaaaaagaatgcaaagtatatttcctccctttgagc

SEQ ID NO: 32322 - DNA, 1044 bp, Homo sapiens
gttgcttctaggccccggctgaaaaacgtggacaggagcactgcacagcagttggcagtaactgtgggcaacgtcaccgtcattatcacagactttaaggaaaagactcgctcctcatcgacatcctcatccacagtgacctccagtgcagggtcagaacagcagaaccagagcagctcggggtcagagagcacagacaagggctcctcccgttcctccacgccaaagggcgacatgtcagcagtcaatgatgaatctttctgaaattgcacatggaattgtgaaaactatgaatcagggtatgaaattcaaaacctccacctgcccatgctgcttgcatccctggagaatcttctgtggacatcgacctcttagtgatgctgccaggataatttctgcttgccatgggcatctggccaccaaggaatttcgcaccctgacgattactcttgacacttttatgtattccattgttttatatgattttcctaacaatcatttataattggatgtgctcctgaatctactttttataaaaaaaaaaaaatctgctgtgcacaattttccatgtacattacaactggttttttgtttttgttttgttgccggtggggagggctgggagggggagggaacttttatttattgtgttcacaaactccatcctttcagcatatccttttaagtttagttctttcttccagttatactatgtactatcagttttgatataactatatatatataaatataaaattatatataaagggttatttgaaaccaatccatggcaacgctggtgcttgatacactgtgaagtgaatacaacattgaacagttacagatctgggacagtcccttctatgaaagtgctgaaatttaattaaaatcagtcttatatgaagtatgttccaatccatgtgggaacttgactctctcatctgtctaaagagtactggacgatataaaaatatatattttttaaacaatgtgatctcaaatttaaagactgctccagatagcctgcatttgcaatggaataac

SEQ ID NO: 32323 - DNA, 1041 bp, Homo sapiens
tggcccagattcaccttagttctttgagagaactaatttttctcattgtggcaattgtaattggccctcggaatggatctgtttttaaaatagtgaagtgaacattacattgcattttttacttttgagataaattttggtaaacaagtcttgatttttttcatgcgtaaaactgcctgcttaatggttaaagtctccttatgctttaatgtaaacgtttgttatcaaagatgtgcaacagcctgatagcaaaaacagatgcacagataagctcaagtaaccagtgaaatctaaaactattcataaggtgagtttagttttgaattattatatacactaacctgtgtatataaccagtattgggggcagagtcctattggtacagataattaacactggctatcaattttcctatataacaaagcacaggctttttatccaaggtgtctctatttgtatttaggcaattttaatagctaaggagttgacctatacgtgacttgcatttgaattcttaactgtaatatgccagtaactttagtagttttgaatgcagctcctctcttcgagcctcttgggacactgcgtctgtccttgtctgtcagattctcaaaaactttacctgggacacacacaagtaaacctgggttcagtagtttccctttccttttttcctttcttgagagtggggagaagcttctttgttggacagaaatcactcatctcattttttttctggcactttatggattttacaccatctcctacagaatagagttttgattagagtattcaagaccaaattgcttactttcagggtagctttattattccagcccaatactgcactccctactgcatttttgatacaaacttgctcatttgaaagggtgtgaaaagaatgatgtggttcctgagatttagctactcagggagtaggaggagacagcaggagttgggttaaatctaggaggaatgaggtgggggaatgtctagtgttttgaggaagggctgtgagaaacaaaatgctattttctgaga

SEQ ID NO: 32324 - DNA, 1052 bp, Homo sapiens
tttccagtttcttctctagttaaaatatggaggaagtcacaggacatccagtttgttcttgggtactatgggacaaaatatatgacagtaaactatcagctcatcttggcaagtacttttggtgtggaccactgaagcatatttgtaggaagggagttacattttggtgctcaggatgggagtgatgatagtttcaaagatttctattttggaagagggatctcaaatgcctagggtttctgaaaaatttcactgtatacagtttctgctactgcaattacgttataaataaatgctttaattataagatacaactttatatgtgtaaagatgtgtatactaggttaagatttaaaaccgtgggttgcaattaaaataaaagattccctgaaattcatggaactggacgatgtctttcctttccttctttatgtttttttaaagacagggtctcgctctgttgcccaggctagagggcaggagcatgctcataggccactgcagccttgaacttctgggcttaaacaatcttcccatttcagcgtctcaagtagctaggactacaggcttgtgccaccaggcacaatttaatttggttaaatttttttttttttttgtaaagatgaagtcttgatatgttgcacaggctggtcttgaactcctggcctcaagtgatccttctgtcttgacctcccaaagtgttgggattacaggcatgaaccactgagcctggccagaactagatgatgtctatgtcttttccagttctaaaatactgtgttatgtcagtttgggcaatttgtcatacagtaagatgactcttaaaattttacagtgccaagttacttgtctacaaatatatagagaagataatttgtcatttattctcccccaatgtgttgtatagatattcatgcgttttgtgacgacttttctttctttctttctttctttctttctttctttctttctttctttctttctttctttctttctttctttcctttctttcctttctttctttctctctttctctctttctctctttctct

SEQ ID NO: 32325 - DNA, 1035 bp, Homo sapiens
tggaaaatagtttggcagtttcttacaaaatgaaacatatacttaccatatgacctagcagttgcctcctgagcatttatgccagagaaatgaaagctaatgttcacaaaaaaaacctgtccacagctttatatgtaatagcccaaaactagaaaaaactcacacgttcttcagtaggtgaatggtacattcatactatggaatactattcagcaacaaaaaggaacaaactatggatacatagaataacttgggtggactcctggggctttatgctgagtgaaaaaagccaatcttaaaaggtctcgtactataggataatttcaagaattaacattcttgaaatgacaaaattacagagataagagaacacattagtggttgccaggagttaggactagtggcaggagggagggagatggatgtaactgtaaaagggtagcaagaggaagatctttgtggtgatgaagtaggtttgcatcttgattgtagtggtaattacatgaatctaaacgtgataaagtggcatagaactatatgcatacctaccagtgtcattgtgttatcaagaaggtgcacatgttgggaaactgggtggagattacatgggacctctgtgtaccatttttgcaacttcctgtgaatttataattattttcaaaatagttaaaaatgttgagaatatgtgatgataaaggaaaaggttcataatcagaaaaacaagttacaaaatgataaaattacatgaaactaatatttcataccattcatactaatacatatacctggaaggaatgactgataaaaaccttaactctgagatgatggattcttttttgcatttctgtagtgtatgtgtggatgagtcagtatcacttttatagttggaagaaagcagttttcctaataggaaatttttagaattaatctggtttggaatatttaagtgacaatgtgtttttacattaagggattaaaatttttatcaggcacactactaacttagtattaaaacagctgttaagattggaaagt

SEQ ID NO: 32326 - DNA, 1034 bp, Homo sapiens
aagtgagtttgacaggttttcatcctatcctgtcttgtgtgttaactgttggttaatccctttgtgatactggttactgccatgtttttttcttggccctcttgtattttttttgtacctcaaaagtttgagtatgaacttgacattttctatcttgtgtagttttaatcagacttggtatagattgatggcagtagaaaacttgtgttttggatgctgggtaataggcaatatttgtgatttttagaataatttgtttcgtggcacagaaattgtattttattgctctgagctggtgttatgtattttaacaattctagctagttggctagccggtggttattttgcagtttttgatcattctcatcactgtcaccttcatctaccagtcaaccaaggaaaccacctatgacttagtggtaggccagtatgatagagaactatatttgccctttgagggtagaattgatattgctgatgtgattgggaaaatactgccattcgtctgaagaacacttattaaattcgtaggatatgaaagatgctgctgaagggattggagagaggagaggggagtgttaaaatgttgataagccgtgtatgggaatgaccataattccaattataaaggctgtacggaagcaggggtctggcttagggaatcagttagaaggattccttcttctccacttcttttggacaaggagaattaaaaaatcacctgtcaccttttcactattaccatgtacgtcagatatttttagttctgcaggtggaattgttaaggtgattgagaatgaggtcttttttttctttttggagcagcaatagagcagaatgaaaggtgagatggtcttaaggaatctgttaagggaagaaggtggcctaggctgtgtggaggttcaggggcagcaggagagatctatattttagatgtattatcagtatgtgttgggtgtctttggttttttgataaacttgtttttctaactagactgtccactctttgtgccttttctggttatatatatatc

SEQ ID NO: 32327 - DNA, 1052 bp, Homo sapiens
tacaaaaaaaaaaaaaaaaattgcgggcaaggtggtgtgcacctgtaatcccagctacttgggaggctgaggcacaagaatctcttgaatccgggaggcagaggttgctgtgagctgagatcacacccgggcactccaacctgggtgacagacagaaactctgtctcaaaaagaaaaacccaaacaaacaacaacaaaacaacttaatatatgctgaataaaagcaattccatgcttgtgcacttaatctaagagaaatgagcgtggatgtctacccaaaaacaggtacggaaatatccatagcagctttattaataatatcccccaaacagaaacaacacagaaactgtggtgtgttcatgtatggagtactactgagtaatgaaagagaatgaaatactgaaatatacagtaacatggccgaatgtcacagatacatcaatacaaaagaaaacattcagggtgattctatttagttgaagtttagaaacaggtgaactgaatctatgataatagaggtcattttggagggtgttgattttgagggggatagagtaggagagagccatctggagtgcagggaatgttgataccttcactggggtagtgattacatgagtaaaacttgagtatttagccgaatgtaaattatacatagtagaaaactaaacattttacaaagaatttctttccactggtaacgttgtcttgaggggctgcagaatgggacatcccaatgactgtgcttgatagcagcaatctggggtcggttgtgtcctcaaccccattctacaatggtcaattgcatatgctcttgcccacctgtgctgggcaacaatcaccaatcagccaaggctctgtcaatgcctgtgcattaagccagtgccctcaggactgcttccacctggaggacaaaggctgaggccacacaagctctaggacagcggacagcttttctcaaacttcagtgtgtaaaataatcacctggtgatgttataaaaatactgattctgatctaataggtcctggggtggggatgtcctcaaatgtat

SEQ ID NO: 32328 - DNA, 1060 bp, Homo sapiens
gtcaactacgtttataaagtggaagaattggagtagatgacttctgtgctcccttaaagaatgaaatttcagtggatctctctagcatagccacttatatgtgtcatgcaggaagtcctttctgaatattcattgagtttctgcacttagaaagttacaaagaaacgcgatggtagtcaaacctcacaaaaattcactaatgagcaagcctcttaataaatttcatccacattctagtatatcatttccttcccagcatctttcccatccatcttgccagtatttttattgtttgacttactgttgatcattgatattgtacagtgcaaataaattgcaagtcaaccaaaagatcaaggatttcacgaaaacattggaagtgatatgggggatgtgcttgaaccacatggaaccactcaccatagtaaacaattgaagaagaaaactctacaataatagtgaaattagtggaaagtccttattttgaatattaaaggattgattaaaagattgatttgagcatcacatgattgagaggcccttgaggaaactgatgatacccttgatttttttctgtaagaattaccttctctgattctgctacaaaaagaccaacatgaagtgatgaatgttagatggtgctgtaatataattttgttagaacaattacaaatacaattaatatttggttcattctttgctgtttttgagaattagtacatggttgcagttttaacctacatattgttaacattgttaaatatttcatcaatttatttttgtagtttgtagttttgtttcaaggtgaagtatttggtttttgttgttgtttttttgacacaagagtctccctctgttgctgaggctggagtgtagtgctgcagtctctgctcactacaacctccgcctcccaggtacaagtgattctcctgcctcagcctcctgagtagctgggattacaggcacctgctaccacacccggctaatttttatatttttagtagagacaggatttccccatgttggccaggctggtctcgaactcctgacctcaagtgat

SEQ ID NO: 32329 - DNA, 1075 bp, Homo sapiens
aggcacagtggctcatgcctgtaatcctagaactttgggaggccaaggcaggcagatcacctgaggtcaggagttcgagaccaacctggccaacatggcgaaaccccgtctctactaaaatacaaaaattagctgggtgtagtggcacgtgcctgtaatcccagccactcaggaggctggggcacaagaactgcttgaatctgggaggcggaggttgcagtgagccgagattgcaccactgcacgccagcctgggtgacagagtgagactgtctcaaaaaaaaaaaaaaaatatatatatatatatatatatatatatgtcatgtgaatctgggaggcagaggttgcagtgtgctgagatcgtgccactgcattccagcctgggcgacagaaggaaactgtctttaaaaaaaaaaaaaaatgaatcagtgaaaaatgcagccctgatgcactgtttcagtgcagtctggaggtagagctactcttgggaggctagtgccatagaaggaagtaacaggtagaggtctgaggagacaggcaagtggtggcatctgaatggacagaaatgggttcaggggcaggcatgtggaccgtaacttcaggcaaggtccctgtgaaagttgaagatcttgtacaagaaggcagctaatgggcagaaagcccagctttgcagagtcagggttttgagataaaatgtttctgagtctgggcctcaggaccagtctgacctagaaggggggctaaggaaagaactcttgagcaatggaaccattagagtagggccccatgcatctttttacttaaagccaagattggtgagtaaatgcaaggtggagattcatcctcatgctctgggtgtaagagggatgggacagagtcaggctgccctgtacacaatgtgtgaagtcagcaatgcctcaccacaacagttgacccaggaacagggggaacctcccaccattcccatcccactgtttgatcagatccaagaatccacaatattgagagtgaatgaaaagtgtcagctggtaatgatgacttcaacatagtcagaactctttggggtgttccaaaca

SEQ ID NO: 32330 - DNA, 1044 bp, Homo sapiens
tcaagaccagcctgggcaacatagtgagaccctgtctgtattaaaaaaaaaacaaaacaaaaaacctataaagggaactcttaattggaatgactcctaggtgctatagaaaatgatagctacaatgtcaattgtgacttagaagaaaaatagtcttgatatttttgctaccgccatgattgataaataaatgctttagtgtggattttaatgtctgttttgaatgagccattatatgggatttattttttatttctcttcatgggggagcaattatattgcagaatgaaatatgaaaaaacttgaggctatacctgttgtacagaaaatgcttagggattgctcaagataatgcctaataacatacagcaggtggtgtcagcatttgtgttggaaatctagatttcgccagatggaaaattgaatgtttaacccctgaggtcataatggcatgtcatcacttcatttgatcctcctgctaattgagcttatcaaataccctgctgccatttcctgttgttactttcattttcataataaaattaaatggggatagtctatttgtgtgggttttggtttttcttttttttaggaatgatgattttgtaaacatgtaatgaatattgaggtatgtaccaggatctcatttctgtgagtgcctgtttctctctttgtgatattctttattagctagagagaagtttatttttcattaaagaagaaagatataggctgccaagtagatgtagggattatcagaccttccctgaaaaaactttttctcttggttttatgttgtgggaaatgaagtgaaattcttaggttctttgtaattgttgtgctaatagtacttttaaaaaatgggataatgtattggggagtgaggtaggagagagaaaccagcaggaactcttcaaattactttgcaaaagttgttttttcaactttaccaatttgaacataactttcttttccctaaacaggcgtgttgctttcagtttgtatgttaaattttaactgtagcccagctatttttttctctct

SEQ ID NO: 32331 - DNA, 1074 bp, Homo sapiens
atctaataaaaattatgatgcatttagatattcatttggtttagaaaactttcctgcctttcatttaattgacctagttgtatttcatagcattttaatgataaccacaactagtcagctgtaacaacagaatataaagattatatgtaattcttttttttttttttttttcgagatggagtctttctctgtcgcccaggctggagtgcagtggcgcgatcttggctcacggcaagctccacctccccagttcacgccgttctcctgcctcagcctcccgagtagctgggactataggtgcctgtcaccacgcctggctaattttttgtatttttagtagagacagggtttcaccgtgttagccaggatggtctcgatctcctgacctcgtgatctgcccgcctcggcctcccaaagtgctggaattacaggtgtgagccactgtgcctggccaaagattgtatgtaattcttaaggaaatcagtaaaggggtttggacctaataggactcataaatttttttgcatttaaaaatgttcttaagaaatgatcaggattctgagctgctttagatatattacctctcagggtctgaatttctttttcttaaggataattttatgttttttcaattttctttaggtaaaagtgcagttttaaagtgtctcctggatattcacaaaatttttcaggaaaatgacccagcgtacatactgaatgatctctacatctcagactactgtgtgtggattcagaaagtcaagtaagttttcatagagttacttacgaatttttagatgttcacattgctgaaatacctatttacccaggaggaagaaaacgaaataacctgaggagtaagttgtgtttttttttttttttttttttttttttgagatggaggtttgcccttgtcacccaggctggagtgcattggtgtgatctcagctactgcaacctccgtctcccaagttcaagtgattcttgtgcctctgcctcccgagtagctgggattacaggcgtgtgccaccacgcctagctaattttttatttttagtagagacggggtttcac

SEQ ID NO: 32332 - DNA, 1071 bp, Homo sapiens
tctaagatattttttgaattgctaaaagtaccttggaaaatcaatctactataaatgactgtgtgagcctcagttacacgtcacaattcatttcttttttaagtcatgctagattatctgggcattattcatggacttaaaccagtgagaatgcagtttgcgattatcctgttatatcatggcttccagatggagaattggcaaaacctccacatgcctgtttgcacacacactcacacactctcactctcactcacatatacagactattgcttgttactttttattctgggaagtaatctagttcttttgactttcattggaaaagtaatcagtactatgattgcataaccaaaaataaattcgattgccttgacttacacaggaatcaattacccagttttagtaggtcagaattgaaattgagacttaatttttattcattatcactctgacaagaaatagttttatcagctgtgttatgatagtaacataaaacttgaagtaacacactggaggcctctgctaaaaatgaacctgaaccctctatgtaccatgtacagtgtgttctgtgactaatttgggttgtggctagttagtgctaaaactgagggctgggttgtctagaatttgtgccagaagctgtagagatgacatgttctggatgagaatcgtcacctgtctttgtacaggtggatggcacggggatgccattattgccgctgaagaggctcatttgtttgaacaccccataatttaaataaaggtagctctggtttggcatttagtgttttccaagaatgaattcatgcctacttataattcaaaatgcagtcagtgttcacactttttattataaaggtcagtatagtgttccatagttgaaagtaatgaataaccctggctccaaagaaggattgatcttaaatggaatgagctttcaaaaccaatgtaggaatgcttcagaaactacagaatatttcattataactgattgactaagatctgagttttcaaagagccaggaatttgcctcatgtgacttcacagtagcctttacaaggattcttt

SEQ ID NO: 32333 - DNA, 1055 bp, Homo sapiens
taggtggataaattacttgagtgaatgctagcccgccctaacaaaagggtttgttcactgcttcacttgcttcaagtttgctaacattgatacagaagaaattaaacaagtctgcaactcttcttaagtgttatttgaggccacacaggaataaagattcaagatgctacataatgtcaaataggtctctgttaaggtttaaaatatttagaggacaccaggttgccaacagagttctacttcccattttccttttattaagggtgatagaaaatacagaaaacactaacttgtataatatatttatattttggggaaaacacttttatatttcaatggggtttcaaaaaatataacagcatttttgaaagctgattttatggaataaggtaaaaagacacctgatgttgacaggtaagcccttgggtaccatcaaaaggtcacccaggaaaaatcgaacattttatccaatttcatggctaactgttgtgtaatctatgctgtcctaccaatacttctgaagttgaattgttcagtggcagtaggttctgtgcaaggacagaagcagtcaaatagtagaaaacagctatgttcctcaacttaaagttaccaagagttctcattccaagacagaagttaaaaatcaataattgtgtgcaaacgatgacttcactgatggttagccagatacagtcaaatcaaaggacttgttgccagtggcatgactgactctgtgccagttttcagaaatttaaaattttccctaaatgcacctggtctaaacagcaatggccagtattctcactataaaaacttgactgtttctgcttgctgtcagccacttaccaaagcgcttgccatttaacaattgttccagaaaatgtagttttgtcattttcaaaaatcaggattctgcctcttatttagtgtcctatcaccccagcttcagggctgtttggtgaagcagccgtgactccttcaggacacttgttccttaatttgttatgtatgttccttccaaagggggttcataatgaaatacatttgggaaatgc

SEQ ID NO: 32334 - DNA, 1031 bp, Homo sapiens
gacattgtcttctgaagtgagatgtcaagactgtttctgccatcctattggattcctcctgacttgcagtttacaggtcaggattggcggtgacggtaggtttccccaatggcctgaaaactccaaatagaggtgggtgtgggtgaaatttgagatgtgccagcttttttttttttaaagagcatgagaaatattccaaatcatcctagaataattatcagcggaagaacttttttgattgttgattctgcaggtctcatccagagggtgaaaagaattaaggcttctgatgggcagcaccagccagtctgccttttcagttctgatctttcaaaggcaggtgtgatgcagagatagtaatggtgctgttggatggttttcctcctcttcctactctagttagcagaaatgcaaaaatgccttttggaatttaaacttgtaccctaaaccagtttgaccacattttttgctcaatttggaaaatcacacaagctatttggaatgtatgtatgtatttattacaagtgggctattcctttattaaaaatatactgattagatgtatagcatgtcctccctgctaaaaagaaaatgaatcgtgacttattaatgtgcctgattacgtgataggcctcgatatctattggctgcactgatcagcttgagcctagctcttaccacaccttttgtattttgtgtgtgtattgattatgatgccaatctgcacatccatgagcaatgtcacccatttttaaatataacttggagaatagctaagtagtatgtttaacaagggcttgagaatgtttagtacgctctatagggtaaggaagaattgctactgagaaggcatatgggatcagtggcatgtcaatgtagaacacagtaatgtagaatggactggcatcatgagagggaagcctctctcacattaaatataaaaatatcttaggaaacattttccaaaaaccaatgctgttagaacttgcagtggaactgggctgacttattttcttccttcagaggtcttt

SEQ ID NO: 32335 - DNA, 1078 bp, Homo sapiens
ataaaatataaaaactgcagactgatacaagtaattcatattaggtacaactattgaagaacaaattatgtcatctctaaataatgagaattgtttctctctttcaaatatctcttcgttttggccaggcatggtggcttatgcctataatcccagcactttgggaggccaagagcaaatcttctgtaaagtgaaatattcctccaaaaacaaagaggaaaattattgcagttccatttatcaggtgcttccaagaggtcagataccaggttcagaggtaaaaactcactgtatttgattctcacatcaaatttctgaggtcttaccattgtgccccttttactgccaaggagactaaggcctagaatgtaagtaacttgttagacattgtcatagcatggcgataaatgcagacccttctgaggagcacacagcctgctcactttatagcactagcatgttttgatgcttatggccccaaggtaagttaaaatgtctttcatttttatgtcagtaactggaaagtctaaaagttaaattaaaaagaattccacttgtgaggaagatcatatctggatgtctatctcatgtgtatctccacatttagtgttactgtcgatcaggggccagcatacttctttaaagggccagagagtcaatattttagactttgtgggttatgctgtctctgtcggaactactcagcactactgacgtggcatgaaagcggccgtcgacaagatgaaagtgaatgggtgtggctgtgtttcaataaaacttgatttatggacagtgaaatttgaatttcatataattttcacatgtcataaaatattattatttcaaccactgaaaagcttataagccttacagaaacagcccatgggccagatttggctcacaggctgtagtttgtcaaccctgctcactacactgaagtcttagaactttgacaaaacagagagggagaggtgcatgcaaccactgcttctacaactcgtccttccccatgacaacaggtatttaacaaacatttctgagggcctgctactgcatgacagccccaatttgggcagga

SEQ ID NO: 32336 - DNA, 1044 bp, Homo sapiens
tcttgatttataaatgaaattgtataaaatagtagccatagaaagtagacttctgattccaaattatcagcaaagtcatgcagaaaacaggcaactttttaaaaaatataaggttttagtctgtgtaaaggtgattataagaggaatattccttctacgggtctgcttagctttctcctaaccactgcttttgatttatccagttcatcatcttttttttaaatagaaaatataatttggcggctgggcacagtggctcacacctgtagtcccagcactttggggggccgaggcgggcggatcacgaggtcaggagatcgagaccatcctggctaacacggtgaaaccccatctctactaaaaacacaaaacaacaacaacaaaaaaaaaatagccgggcgtggtggcgggcacctgtattcccagctactcgggaggctgaggcaggagaatggcgtgaacctgggaggcggagcttgcagtgagcagagatcgtgccacagcactccagcctgagcaactgaactagactctgtctcaaaaaaaaaaaaaaaaaaaaaaatatatatatatatatatatatatatatataatttgccaacttgcagcccatggttaaataagtaccaccagaaagtctgaaaatgtattttccattcatagaaaaaaggattaagctgacttagaaatgttttatgttgacagtatcacttaaaggagatatacttcattcttaatgtgagaagtgcatcttggaatcatttctggtaaagaattctcttgccctttccccaaattaaaaagaggaagaaaagcaaatgaagtacaaaagccttaaatttcagtgaatagacagctgtgctctctattcgggctttgatggtgggatgggggtgaatccattgtaccccaaattatgtaagcttcagaagcatttgcactacctgaagtcccggaaatgtagatggcatgcatttaacggggctgaccttggtaaatataggtttgtgattgggaggatggttttgtgacacaacttctcca

SEQ ID NO: 32337 - DNA, 1057 bp, Homo sapiens
caagattgtctctcctttggctaatctgcttctcagacccaatcactgtggccagggtggtggaggaggtggaaggatattgacatgcaggctgggaccacatgccccagccccagatcagggtggggagtggccagtcgcacacatgccctggggcactagtgactccttggtggaaaatcgggaactgtcgttagagaggagcgatggaagaaaggctgacacactgcgatgtatctcctgcaccagcctgggcctcgatgtcttgagaatggcggtttgcagtctgatgacccagtactcagtccagggcaaccccaactccatctgtggggctgcccacagtacatggaccccctcactggatttgctgaccacacgtgcaaacagccatctcccagccccactccccgcagtccctctgaaccctgtcgaaattcccctcagttcccaccaagaagaaaagcaattctgagggtgagtggcttattctgctagtttaaatctctcgattccttccctctccagaactctgtacttactgctctgtcactggtaatgacaatgaacattttcacagtctcagtttttattgcaaagtgattgaggaccagttagaataagttatgctacagaaactaaagaaatcccgtcaagcaaatggtgtgtaatagaaagtcttagggcagccgtgtatattttctcccccaatgaatcaattgaaaatgagaggctcttaccactatgttccgggcagaagctatcaaaagcgtaagccatgatagtataatttgatcattttacatccgtcaaatggatatggcccaggggtgaaaagtggatgctctgcaactagatgatggtcaagagttataaaaatgaggtcctctctgttcaacatttctcctttcttgaaggaatactcaatgtcatgctcagggcctctaatggccagaaataaagttcctcctagtttcagagcacaccagggcaaccccaaaaccagagcaactgcttatagccatgtagactatgtactgtgcaattcctggggtgg

SEQ ID NO: 32338 - DNA, 1051 bp, Homo sapiens
ggaaatgaaggaaatttccaaagagatgatgctcctgcatctgttcattctgaaattactgatggcgacaaaggtcagaagatgttgaaaaagatgtgttgaaaacaggagaaggtctggggaaggatggtgggagaataaaaactccaatacagcttcagctccggcaaacacatgcaggattggagacagacaaaccgtcttcaattaaagagactcaccttctccaaaacaagaacaacaacaacaagaacaacaactgggacaaagcacaggagaggtttgctgaaaactttcaacaacaacaacaacaacaacaactgggacaaagcacaggagaggtttgctgaaaactttccagaaactaaacttcaaaaagatgacctaggaaccattccttgggtaaaagggactgaggagtgaaggttaatcacaaaagaaaactcaagcttttttataaatagagtttggaaactcttattgcagaatgtctctccccaaaaaagtcagtggcacaagaaagctgtgtcacagtttaccccttcctgattcagaaatgtgtaataaagtgtggtttgcagcttttaaaaaacacttcttaaactaattattagtgactgaattaagttatacagtaagtgaactaaagttcacagggcacagataagtttatcaaactttactattttatcttgtcatttacaacatccatataagcaattagccatataagcaaaattcatgtaaccacttaaatgctcatttgtccttgtctccatatattcatagtagtatgcacagaaaatacagcaaaagaaacatctaaagtctataaaaataaatctgacaatatacattcttgtttatgcccttcaggacctagataaaaaatattgagacaacatgaatagtgatgcatacattttcttatatttggaatagtctaaatcatattaaagaactaatgaacaggtgacatgtcacagaaaatttgtcttttattgttttcttcggtgaagaatctgaatttgttgatatatactatacattc

SEQ ID NO: 32339 - DNA, 1047 bp, Homo sapiens
atatgcagaagattgaagttggactgcttccttataccatacacaaaaatcaactcaagatggattaaatgcttaaatgtaaaacccaaaactataaaaagccctggaagacaacataggcaataccatcctggacatagaaacaggcaaagatttcatgataaagacaccaaaaacaacaaatgcaactattgacaagtgggatctaattaaacttaaaatcttctgctcagcaaaagaaattatcaatagagtgaacagacaacctgtagaatgagaaaaaatatttacaaactatgtatctgacaaagatctaatattcaatataaggaacttaaatttacaagagaaaaacaaacaaccctattaaaaagtggccaaagaattgtctattcatgtccttagcctactttttgatgggattgtttgtttttttcttgctaatttgtttgagctcgttgtagattctggatgttagttctttgtcagatatacagattgtgaagattttctcccattctgtggattttctgttaactctgctgactgttccttttgccgcgaaaaagctctttagtttaattaaatcccaactatttatctttgtttttcttgcatttgctgttgggttcttggtcatgaaatccatgctaagccaatgtctagaagggtgtttttgatgtcatcttctagaatttttatactttcaggtcctagatttaagtccttgatccatcttgagttgatttttgtataaggtgagagataaagatccagtttcattctcctacttgtggcttgccaattatcccagcaccatttgttgggtagggtgttctttccccactttgtttttgtttgctttgtcaaagatcagttgattgtaaatatttgtgttaatttctgggttctccattatgttccatttgtctatgtgcctgtttttataccagaaccatgctgttttggtgactatggtcttacgatatagtttgaaatcaggtaatgtgacgccttctgatttgttctttttgtttagtattgctt

SEQ ID NO: 32340 - DNA, 1100 bp, Homo sapiens
cactcccttagctgcttcagctgctgtctcagtagaccccatcctccccaccctccacattccactggctctgagcccagctaggagtatgacttgcctaataattgaagtccttgtggcttagactgcccctttagttctcttagaatccaatagcatgtcaactaatgatggcaagacttgtaaaaactcaagctcccaacactaggatgggagattatcctcttgctagggccaatacaacgctccctccattggcagatgtcagctgagtacagtctggttctgcttttcactgtgagggggtagtactgagtttattgcaaagcctcacaaactatgctctccctctcccaaacatactatctctgcaccatgtagccactactggtggttgaaaaaaaggtggcatccgtgcttctagaccgtctttttttttttttttttttttttgccttctccaatgtctctttcagtgatatgaagtcaataccaggtactgtgatcgctcacccaatgtttggtccctttgacagtgcttcttgaatgtagtgagttgtgaaaatttggtgtttttgtgtgggggatgagagtgtaggcttctattctgcccttttactctgtctctgccttaaattttttagattcagggagtatatttgcaggcttgttacatggatatattgtgtgatgctgagctatctgggatattattgatcccatcaccaaggtagtgagcatatattgtgggatataattgatcccatcacctaggcagtaagcatagcacccacagtttctcatgccctgccctcctccttccctccttcatctagtagttctcagtgtctattgttgtcatctttatattcatgagtaccccatgtttagattctacttataggcaagagcatgtggtatttggttttctgttcctgtattaatttccttaagataatggcctccagacgtatgcatgttgctgcacaggacatgactgtattctttttaatgtgtgcatagtattttatggtgtatatgtggcacatatttctatccaatttattgattcacacataagttaattccataccttccct

SEQ ID NO: 32341 - DNA, 1770 bp, Homo sapiens
gcaaagtctctctctctgatgtttggtcttctatttacaactcctaaaatatctaaatgtgccctccctctcagggcacacagcccaatgctattttctcccagatgataggaaagaaagaatcacataacaaatgcctagtgatcttcattgtgaagagcacacggtcaaaacttattttaaaatcctattttgaagtccagttatgcaaagaattaataaataatgacacgaattgatgaaagagtagctatcttactgagtctagcgtaagaacacagatgggtttcataatgagccacaaagccatctgagtctagatcagaatgtcaaggtcttgagaaaaggcccaactgggagcaaattatgaaatctgcatgagtctcttaaggacgacttagggaaggcttggcctttggtccttattatgagactgatatggtttggctgtgtcctcacccaaatctcgaattgttgttcccataattcccacatattgtgggaggaacctggggggaggtaattgaatcatgaggactgtgttgttcttatgatagtgaataagtctcatgagatctgatggttgtatggagggaagttcccctacacatgctctctcttgtctgctgccgtgtaagacctgatctttgccttctgccatgattgtgaggtctccccagccatgtggaactgtgagtccattaaacttatttttctttataaattacccagccttgggcatgtccatattagcagcatgagaatagactaatacggagacttattatgagtttgacaggaaggtgcagaaacagagttctggagtcagattatgggtgatggctacataatcttttttattcaggaaaattgaaagattttgtatatgagtggaacttagcttctgttcagggttgatgtgggaaaaagtggttagatttgtgaacaggagctgaatcattagaagtcttcaagtccttgctaaagagtgagaacctaagttttaagctgttgttaagtgcttttaagtccttgaggaacacagttacctgtttagagatatagtctggaagcgaacaagataacgggaagtgagaggagtgcaggctgatggaaacatgatggaaaatggaaatatttcagatgagagagagtgagggtttcactgagtcgaggagtgcaggctgatggaaacatggaaaatggaaatatttcagatgagagggagggagggtttcactgagtcgaggagtgcaggctgatgggaacatgatggaaaatggaaatatttcagatgagagagtgtgagggtttcactgagtcataaagttgtggagaggaagcagtgagtagaagaatacttaagaagtagaattaataaaactttgtgccagaacaggtgtgatgggtctgggagagagctatacctggaacagtggatctcagagtgctccatgaaaataatactctttctatcataatacagatatgttacttgtctttttcgcttgtttttgttctctgctttggtgcaaatgcaatagtaagtaaaaccgtagcacaaaacaagacagtggctccaaacaatagtagcagttctattatttacactcacgtggttgcttaaataaacatgccaattttattttcatgttacttaagaatatccttgatgaagcagtaaaaaatataattttcattaaatctagatccccaagtatgtcttttcagtattctgtttgataaaatggtaagaactcatagagcact

SEQ ID NO: 32342 - DNA, 1071 bp, Homo sapiens
tcttaaccatgctgtaacagaagtcctatcatgcaggctttgttgttcccatttttacagcacactttgcactttaatgtcacagatatggctgttttcctagaagctcatataccaacctctgccagcttcaaacatttcttctgcaacttcctcacctctcttctcctccatagaattgaagagagttagggcctttctcaggattaggctttgtctcaagggaatgttggggctggtttgatcttctatgtggaccactcagactttctctgtgtcagtaaaaagcctgttttgttttttaaaaatcattcatgtgttctctggagtagcacctataacatccttcaagaactttttctttgcattcacaacttgagtagctgatgcaagaagcttagctttggcctgtcttagcttccaacatgctttcttcactaagctcgatgatttctaccttttgatttgaagtgacaggtgtgcacacttcttttcaattgaacacatggtggccactgcagagtgaagtggcctaatttcattgttgtatcttggggaatggggagctagaagagagaaacagagacagggaaatgactagtcaatgaagcagtcaaacacaacatttttccatcacgtttgctatcttccatagagttccagcacgctgagacaattccattagtaacatcagaaatcactgatcacagatcataacagatgtgataactaaaatctttgaaagattgggattgccaaaagatgtgacagagatgtgaagtgagcccatggtgttggaaaaatggtgctggtcaggcttgctgagcacttcgtggccacaaatctttaatttgttaaaaaggtgatgttgccaagcaaaataaagtgaagctcaaagtgagatgtgcctctattttgatgggctctaacaatttgtcttttctgggtgcatttagaccattgacattcaaagtgattatacagttggattaattttgccatatcattttccattaactcctattattctttgatcttgctttgtcctccactctttttctgccttttatg

SEQ ID NO: 32343 - DNA, 1887 bp, Homo sapiens
atgtggctgtgcacttcacctgggaggagtggcaggacgtggatgatgcttagaggaccctgtacaggaacgtgatgctggagacctacaacagcctggtatcattacaggagttggtgtcctttgaggaggtagctgtgcacttcacctgggaggagtggcaggacctggatgatgctcagaggaccctgtacagggacgtgatgctggagacctacagcagcctggtatcattgggtgagtgaaacttgccagtaactcccaggattgtattttgttgctggtaaatataggaacccttttaaggtataataatatttacttgtaagcttccagttgatgaaaaatgtgtcactactctaatgaaatgttcaaattggctccttcattgcacagtccctgaagcccagctgtcgtcattctgaaaaggatttgacttagtggtttgacaaagtcttccattgtttctcattaccagggcattacattaccaaacctgagatgatcttcaagctagagcaaggagcagagccatggatagtagaagaaaccccaaacctgagactttcaggtcagtcagtgaataccaggcagggaggcctggaggagtaatgcccagcaaatttttgtagtgttatcttgttttcaccacttttttccctaggtcttcgacctgaaggctgttggtctgcattaaatgtgcattatatagtccccaggggtaactctcatgcatatatcccagtctcttatttttctgagtatcttcttctatttaccccaaatccaatccctgccatcctctccttaggcctttttctctgctatttattttctctgtttcccccttttcctctattctgatgtagtatcttaaaaatttttttagacattcatgcatttatttatcctttgaatgtatcttaagtgatttttaagaatcagtcattataacgatgatgaaaatggtgtttctttttaagctatagctttattcttgttttattttttattaaacagatgattctcactctatttctcagactgaagtgcagtggcatgattatagttcactgtaatgatgaactcctgggctcaagtgttcctcacaccctagcctcccaagtagctaggactacaggtgtgtgccaccacacctggctaattttttattgtttgtggagatgaggtcttgttctattgcccaggctggtctcgaacttctggccttaaatgatcctcgtagacaaccacctacaaaaaaaaaaaaaaaaaatagctgagtacggtgacaagggtttgtaatcccagtttttatacttgggaggctgagatggaaggattgcttgagctcaggagtttcaagcttcagtgagctatgatagcaacactgcactccagcctcagtaacagagtaagatcctgtctcggaaggaaattatgaagctgaggaggacccatcataggggcctggataggggtggtgctggacttgggaggagaaccagaagattctgggtctcaagtccaaagaaactaattatttcctgttgaagggctcagatttctgtttgagagtggagtttgtagttaccattggaagatgagaaatgtacaggaaacttcatttttatataaaactgtgtgacatctgaaactccaaaacacaaaataaaacccttcaaaaatggtgaattatcaagcagcgattggtgagtggagaggggcacggctgtggatctcagaaggaaccagaaatacacttttcgaagatgacgggcacagcctgagttgcagaaccaatccttcagatcaccagtgtggttttttgactggagcttctgtgcctattatggttctgggaagcaggggatgtcatgtttaagt

SEQ ID NO: 32344 - DNA, 1050 bp, Homo sapiens
ttgagtgtttttattatgaaaggtgttcatcccgctgtggaaccagataaatgttgacctgatagaatggattggaatgtcccctcctggtttttgaacattttttgaatattttgcagagcattggcattaattcttcttgaaatgtttggtaaaattctccagtgaagttatctggacctggaattttcttttttggggggtttttgattactggttgaatcttcttactagttacaggtctctttggattttttatttctccatgatgcagtatggtggtttgtgtttctaggaatttataaatttattctaagttgcccagttttgtggcatatggtttgctcacattagtctcttgtaatctttttcatttctgtggcatctgttgtactgtcacctcttttatatatgattttagtatttgagatttctctttttttcttaatatggctgtgagttttaaaatttttattgatctttaaaaaaacaaactcagtgtttttttttcctttcttttttctggtcttattctgcttatctctgctctaatctgttattttcttccttttgcttggtttgtcattagtttttttttcccttcaggtgtaatgttaggttattgatttgagatctttcttctttttaatttaagcacctgcagctataagcttccctttagcatgggtttgagatctcgcttcttttcaatttaagcatctgcagctgtaagcttccctttagcatgggtttgagatctttcttctttttaatttaagcatctgcagctgtaagcttccctttagcactgcctttgttgcctcctcctgagtttgggtatgtcatgattttgttttcatttgcctaaacatttttttgtcctattgtaatataattgcgttgtttttaataaaggtgattaatgaaacacataatgaattgtgcttctgtttttataatattttaagcattcttaactcagaaatgtaaactttagaaaaaaattccaggccaggcacagtggctcacacctgcaatcccagcactttg

SEQ ID NO: 32345 - DNA, 1083 bp, Homo sapiens
gtattaattcaccagctataattgtggattgtcaacttcctgctttcgttctgttgtttttgattcacgtactttgaggttttgtgtgtgtgtgtactttgtgtgcactttgaggcacaatttataattttaatatcatcctctctgattcttttacttttatgaaagtaccctgtttatttctggtgatatattttgttttgaagcctctttcatctagtgttaacatctccattgaagctttttatgattagtgtctggataccatctttttatgattagtgtctgcatagcatattttttctcatagtttgtttgtgtctttgtgtttaaattgtgtctctgtggatgccatattgtgggtcttgctttcctctcaggtctggcagtctctgtcttaagtagagtatttgtccagttacattgtaactaatcattactaaggttggatttaggtctgccatttttctacttattttctatttgtttgtttatttttttttaagacagggtcttgctctgtcacccagactgtagtgcaatggtgcaatcttggctcactgcaacctctgcctcccaggcccaaccagtcctcacttcagccccctgagtagctgggactacaggtgcatggcaccatacctggctaatttttatattttttgtagagatagggttttgccattttgcacaggctggtcttgaactcctgagctcaagcaatctacgcaccttggcctcccaaagtgttgggattacaggcatgagccaccatgcctggccttcgtctgtcttttgatcttctatatattctttcctaacttcttttgggttaattaaatatttgtaaatattccagttcggttaatcttttggctttttcaaataattttttataggctgggcatggtggctcatgctcgtaatctcagctctgtgggaagccaggggaggtggattgcttgagcccaggaggtggagaccagcctgcaacatggcaaaaccctgtctacaaaaaaaccaaaccaaaaattagcctgacatcgtggtgtgcacctgtagtcccaactattcgggaggctg

SEQ ID NO: 32346 - DNA, 1021 bp, Homo sapiens
tctttgtttctcagatttgcattcttctacatatttggcttctacttatggtttgcttttatgattacaacatggcagcagctgtttctcatattccctcacgaaagagcacaaaagtgtctgctttttcctaggaattccattaattcctacatatcattggttctgcatggatttttttccccaacacaatatccagcagtctcagttccattaaaaacaatagactaagagcaggtaagtggccatttcccaggcataagttggaataagcttaccaatggatggctttcaaattcctccctaatgagcatgcagttgtggtaaccatcatattgccatcatcgttgagattgccataatggaattttggtgaccaatttagaggagagagaaaagggtgtgcacctgagaaagtctacacgctattcaattatttctgctttgtaacatacagaataaaaggaaagacattcaaacgggaaataagtacatagaacaagccataggaggtgtagaattttgggacaggagggaacatttcagatgctggttctatcagggaattggtgaaagacaaaaagtgctctatgaatctaaactcagatgttgacctacatatttttgaaatctaaaagcttagtaagtttctacacttaaatttaaaatgcaaaaatcacaaactagtctagcaaaaagtgtattttttttccttcccatgctgttgctaaaaaacaaaacaaaaacaaaaacttatctagttctcatgatgaacagtggtcaatctcaaagactcccagtgcaactttggaataacagaatttttgtcaaccttaactctcattttaaaaatattatcattttatttcctgatcttaatacttttccaaatgctctaaactttgcagtatttatatccttatgcccactattcatatgacttttatacttgtgtcttctactgctatcaatttttaatgatttatatatctctaccttaatctcagatctttctcttggg

SEQ ID NO: 32347 - DNA, 1208 bp, Homo sapiens
taaatttcttctggtagtgtcagttcaactttcagaagtgccacttaaggaagtttgatttttgtttttgtaatgcactgtttttaatctctctctctttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaatacatctttctttcttgtgttgatttcttttttcattgtgtgctgatcaaatttattccatttaatcacaaagtcgttctgtcttaacatttcacccctgtattatcagatgagtgaaaattctcaattagttgtatgaataaccaggctttactgtaagcaaaattttacctaagtcctctgaaattaaaaatgtaagatcagtcaagacctagaagtgaataattggatcagagactaagtcttctttaatattaagggtatattatttttgtttatgtatgtgtatctgagtttcagttaatctatttcatctatttctaaaataattgggattcaactagataaatgtgatttgtaaagtttgagccacctatgttctgtca

SEQ ID NO: 32348 - DNA, 1122 bp, Homo sapiens
ataaaataccacagtggtgaaagttgaatgtaaaccaagcgaggaaaaaagggatcttgcaatatgttttttgtgggttagaataaaagccagcctgtatggagttggaaagtgaatggaaattttggaagggaggtgatgagcacaagtaagctctttctggaagtttgggatgaggaggaaatcttgggatagagtttgacagaaaggccaaatcagtggaaatgttttaggattgtggatttgaacattattatagactaaagagaagaaaccatgtaggaggaagaaacacaagaaatggaagattattagttgaggaatcagcaaagagtgataggggaatgaaacttaaaaacctacaggggcacttaactactgtattttaatagatatattgtggtaagatctgacctcagtgtattgttgtatttattatggacatctggtcattagctaacttcttttcaacacagagggcagtttctctttgttctgtgactgcagcatgaactcctaatccaggcatagactcacaagtgaggtgataaataaagctgtgcatttcaggctgatgcctctattgtgtgaccacaatgtccttgataatatcaccacaatccaaagcttgaaaaacttacttatttttctcagttaacccaaagttgatctggctctgaacttttgactcagtgtgactcgactccaaatagtgattcataaatagaatgtgatgatgtaaattgcgaggtttatatctggccagaaagtatggagcaattcctgcttataagaaggcttcattaaaagttggctgggtgtggtggctcacgcctgtaatcccagcactttgggaggccaaggtgggtggatcacaaggtcaggagtttgagaccagcctggccaacatggtgaaaccccatctctactaaaaataaaaaaattagctgggtgtggttgtgtgcacctgtaatcccagctactcgggaggctgaggcaggagaattgcttgaacccgggaggaggagattgcagtgagccaagatcatgccattatactccaggtctgggcgacagagcaagaatctgtcttggaaaataataaataaataaataaataaa

SEQ ID NO: 32349 - DNA, 1476 bp, Homo sapiens
ctgctagggtatgaatttcagctctgccactcactcactttaagtaaccatgcacaaacttcttaacctctcttagacgtcccatttcctcatctttaaaatctggataacagtacctcccttgtaaaattgtcgtgatgaccacatgagttcatccctgtttaaaaacaaacaaacaaacaaacaaacaaacggaacaatgcctcacacattataagcaaagggtaaatatttatttttattatataactatatgtacccacatatgcatacaaaaatgaatcacaagtccatagcctttgtttagaatggattacttctcaaccatcatttgcatactaaattttactcagtagactatgtgctagaataagaaccatggaaggtgaaatatcagatttcttgcttcccaggtaaataagaaacataattattgcattttaacatagaaaataaaaccaccaagaaaatctttgcagagtctgtaatgccagtctgtttattgtgaatgggacgtcacctcttttgctgaatggaggtaagtatgaagtcggtgctggaaaaggaaatgaagaatcccactcttcaactccagtttgagtccctggctctgttggtccaaggctcccattaataatcgctgatgtacttggcattcccaatgcacagtaaaagaggaatagcatcttctgccaaaaaataacaaaatgaacactaatattctttttagtggacatctctgttttatcagatttaattcatcagctttcctttgcttatgttgggatttatgacattttacattgtcaccatcagaaaatgttgacaagcttacagaactatgctctgaaacattgatgaggatctgtgtaaaatgtcacagagccccaaactcattaagtatgaaacatggttttggagaaaaatacgccagtacatttaatttgaagaatctattgtctgagtaaagaggcttgtttcattttttaatgaagttgtaaggagtcacaattttttaatgggtcaaaatgaagaagtgccaactatctgaactagggtatttttttaaaccactaaaagactcaaaaatatgttcatattccatgtttgatttttaaccattatgactaaaggcagagtagaacattgcaaatgatacgagattttaggtctgatgcataactcttcccgtgtacagttatggctatgtaaatggaggcacatcccagaaccttatattacagttgcctgtgtgtagaataaaagggataataatgtcattcagcatagttcatcagatgatttgtgagcataacaagatgaggaatttattggaattttaaatagaaaatattactctctattcatataacatttgctttaatattttttttttatttaggcctggacttctcaacatcagtgaacctgccgcgcagccatggctggcagacacgtggcctaatactggcaaca

SEQ ID NO: 32350 - DNA, 1280 bp, Homo sapiens
ctataaactctagtcctgccctgacggggctttggagaatttggttgtgggtgttcactttgtgcctttcacaggatgctttttaatcctggcagacagcataacacctgtgttcaacccatgaccaggtgtccctcacacaggaaactagtttatactggcagacgcccctgtggctcttatctgacctgcgtccagcttattcctgtcaacatgccccctcctaggagagccttgactgggaggaaggttaaaacctcccagtgtgttgcttagatgagactcagaggaggcaacacaacaaaaacacgtgaaataacggaagcagtttattactcacagacccatgagacagagggagtgccgacaagggcagatgagaaggccaccagggcaatttgctcaaccagcaggtgggaatccaggtggggaagacctaggctctgaggactttttgctgttgaaggtattacccaggcaggtttcctttggggagttcctactggtgggttcttagagcaaatggcacaagttccaggaggtcacattctgtctgagaatggtcactggcatatctgcacagtccatgaggggtgtggggtcactggggtgagtcaagtaagttgtatctacatatcccacagggaggtggccaccgtaagtcagtcatgtaaggcagatgtctggattgaccatgttgaggaactggagggaggcagggaactggagggaggcagggaactggaaattgtcaagggtgtcaaaacccagattctgctatgagaaggttaaacttagattcaaaatcaatgctgaggccaaatgaaattataagaactcatgacgacaatatgtatcagactcaaatgatttaataattgtaagaaagcaccaatcctaatgaaatgggccaacaccttcttgtttcaccagatgtggtgggggaagaacatcaaaattgcagacagaggtgggaattctgcacagtgggcaccctcagggttgatatcactcaatgccaacagaattggatattgctttgatgatacagcctccagttctctacagcaactttgcaggccccttgtgtggctgggtgttatggtgggcttgaaaaaaactcagtagacttaaaacataaatgtaaactaagttaattttattacccatatattcatcaatttttaaataatgaatcaaaatggccagcagaaaacatgagcccttttgactattcataacccttgatattataattcttttacatatttaacattatt

SEQ ID NO: 32351 - DNA, 1029 bp, Homo sapiens
agtgggtaaggaagagatggaaaggtgacaatcaagtgtttactccgtagaggctgtgataatagttatcctgagggcaggtcctaaccaaaaatattggtaaaggaagatgaagtatgggatgccagaattatcccagttgtttttttttcatcttgcttatttatcagcttaatttctaggttaagtataaaaacaaccaaacaatatgtaagagtgtttgatatcaatctcgatgtcatctcttccacttgcctagcttccctggacttcatccgagatacttagcgatctcattcttagtattcctgcttttgctttctacccaagatcaattgtttgacggtatttaatgattcattaaactaaaattctcattttaatttttttatgtaatggggaatcatctggaatgtaggtgccaaaatacaattctttgagaaagagaattctgaagtccaaaaaacattttcttcacttcctcccatgtattccctgttactattataaacaaagcaaaacatctgtgtttagaaaaccgcttcagaaatgggcaaatgtttttttgagtgtagactttaagaagcttataaaaaaaaattaacattagtagccacttcattcttactgtgttcttagtttccttcctgaaattttggggcttttgagattaagaactctttattaaaccttctttactatgatacaataactaaactaaaggatcatcaattaaataaacgttaagtacttttttctcatgagtctaatcagctttattttattttacttccttgctggcatctgtatcacctccattgtagccactaacttaccatataccttccatgagaaaatatccaagttcatcttaaaagctgtaaagtatctgccttctttctgttcttggttttcactaaccatatctcctttctttccattgcttagccactctgctacaatttcagtctcttttctgtcttgcatagttaggatcactacagaaggttttcacaaactcagggaatt

SEQ ID NO: 32352 - DNA, 1058 bp, Homo sapiens
ctaccgagaccctcccgtgacacatggggattaggagaactacagttcaagatgagatttgggtgaggacacagccaaaccacatcactctaagtataatgaatccttgttaactggaatactggaaatatagagaaacaggcatacagttgtgaaatcaaagactttttttttttaaatttcagctcctcaatccactagctgtgtgaccttgagcaagctagtcagcccttctgagtttcctcacctataaaatggggctaaacatacccattcctcgggattggacaaagaatacattaaccaatcaatatataagtatataagattcagatttgttttctgttttatcccataaaatctgttattggacttgtatttcttttagtgtcaggactaaaagtaaaggaagttcataaaatttgtggatgtcgtaaaactgagaaagacagctagtatgccaaataagagaatcagaattaaatataactcaacagattggactgatgggagagtgctaactattaaagttaatagagcaaattaaaaagtctggtacttgaacttgggtttaaaaaattagctgtaaaaggatagactaaagacagcaggcttacgggaagtatatgtgagtgtgtcagggctttcggagtgatctgactttaaaataaaacacccatctgaaccgactgacggatacagttgccaagagaacaaatgtagtcttagctggcactagaattatgcctggatcaagtaatttttctctttttacttagaactattcagttcatgaatggagtaatgtgtttgttctggagactacattttcagatggacttttaagaggaggacagtagggatagtcgatgaggccgcatgaaaggctgaaaatcacatcatatgaaaagacattcaaggatctaggtatgattaggccagaaaataataacatcagagcagacatgacatcttttccttaacattttaagagactgccgtatggaagagttatgcttattctagctcgaggcaacagaaaagggcccatgagaaga

SEQ ID NO: 32353 - DNA, 1031 bp, Homo sapiens
tcatctgtagtgtgaaattgtaacagcctactaattccatcctgtttctggtcttctccccaaattacattttcttactgttgctagaatactgtttctctagaccactcttattttcccgattacgtaaactgaagtataatacgcatgccgtgaagtaagtaaactaatgcagcttgatgaatttattcatgtcgtgaccactccgatcaagatatggaacatttccaagaccatagaaggcttccattgactctcttctagtcaacaagcctctcactagcagagataataacttttctgacttttatcatcattgattccttttatctattcttaaaatccagctaaatgaaatcatacagtagatagacttttgtgtatatttttgcctcaaaataatgtcagtaaaatacacttaggttcttttttgttgctgtgtagtattccatctcataaatagaccacaatttatttatgtattctcatattgatggagtattttcagctttggatttttgttagtaaagctcattattcctgtacatgtccattgttgggcaggtgcactcagttatcttggtttgcctttagtggacatacatactaatttctttttgttttcccatgtatttgaaatacaagtcttcatcagatatgtatattggaaatatttcttcctggtcattctcttaatgatggttttagggattaagtaattaattttgctgaaaaccattttttttttatgattagtgtgtttactcttctgtcctaccttgaggccttgaaaatattcttctatgtcttcttctagaagctttattatttacacctttgatattttgtgatgcaaattttttttatctaccttgagttaatttttgtgtatggtatgagttcaaagtcaaaattcttttcatttcccccatatgaaaactaataattccagcataatttattggaaagattatcctttctccactgaattgcagtggcatcttattacaattccaataaacatagatttg

SEQ ID NO: 32354 - DNA, 1030 bp, Homo sapiens
tatgtatttgaatatgtcttaaaattgtccttaaagccttacattttatagtagataaaaaacattgaacacttactcactcttaaaacaaagagaatgttaaattatgtgtttgtttcctcttattttggtatatcttttatgtatcattgtacaattctttcagcaatgaacttgtctcctaaatatccagagacttcaaggttagattctgaggcataagaagaggctcggcgtgctatccaaagttatagaactaataaagaaacatctagctacacctcagctcacttaacttccatttcagatattggatttttcatcttcctcttttcctgtaataattttgtttccttaggatttttggaaatgcttatgcgagtgttccaaaatcagcgcatgaaaggttacaaaagttcttaggaagattttgataagatgatactcaaattgttctggacctcaagaactcaagttttttaaactcaagtttattaagcagtaattaagataataaggatgtgagctgtgcatttattttcatttgtacaactcgtatagccaaagacacatatcttttttttttaattatactttaagttttagggtgcatgtgcacaacctgcaggtttgttacatatgtatacatgtgccatgttggtgtgctgcacccatcaactcatcatttacgttaggtatatctcctaatgctatgcctccaccgccccccccccaaccccacaacaggtcccagtgtgtgatgttccgcttcctgtgtccaagtgttctcattgttcagttcccacctatgagtgagaacatgtggtgtttggttttttgttcttgtgatactttgctgagaatgatggtttccagcttcatccacgtccctacaaaggacatgaactcatccttttttatggctgcatagtattccatggtgtatatatgccacattttcttaatccagtctatcattgatggacatttgggttggttccaagtctttactattgtgaatagtgccata

SEQ ID NO: 32355 - DNA, 1034 bp, Homo sapiens
atgccaaaatatgtaatttattatagaatcttcatttacttttgctgtctaaggggatgctgtcctctaattaaagagcaccagttcccccacgccatcagtagcttctagtcaatgtaagaaccacctacaacaaggaatcaaacagtttaaagttgtaaaaacctatgactatgaaatgatgccaagatgttaatatataaataacttttaaatcatttacatgctgccaaaatgatgatccatgatggtgttccatatgctaggaagttgtaacatctgaaacttttactatttctaagaccatctgtgtgttttgtataaattatgactgtggaactgataaaacactggaggtaaaaagcacatttatacatttgggaaaaggaatacattaaaaatcagcagtttgggttcaaaatcactgatcttatgtagatcataattgtttttgttttattttcttcctttaggcaaaactgaaattgaataattaaaacaaaaacttagaacataaacagaatacatgacattatttccagttttttttttaatagtgaaaataaattcttaaaacatgttggttattagtcattgtacgtgattcttctttcctaagctttgtattcaaatgagtgttttcatctctgttgttaatgtactttgccaaatgtgctgagtgcagatgaacagaagattaaagcacataatatcgttatgaaagacaattgaagattgcatgcttattgctacagttttggttataggaatttctagagttctttaatgtggtggctttctttgttgaaaatttaaagtacacctctcccagctgtgagaacaaagacacaccctacaaaaaggggaaatatgtagttgaattatagctgcacctgtattttttttaagttcttaattcatttcttcttacattgacctggattctgagccaaattttagatcctggatgattataaaccaggaatatataaataacattttcttattctcttacatgataggagagtctttta

SEQ ID NO: 32356 - DNA, 1075 bp, Homo sapiens
agacacatgcaaatcaaactcaggtgacagaaacttttattaatcttactttcaaaaggataaaagtgtagcagagaaagtaggtggaagtcatggaatcaatttcaaacccagaagtctggttaaaggacttctgatcttatgtatttctctttactaattttatgtttttcaaaataaaggtagttcacattaatttaatttatagactcttgatggattgagagttttataataacaactagctgtttttattggtaccttagaaatattggttctgattttgatttagcaaattcacctgttaaaatacaacagccctctttggactgctgcttgttgtgaactgtagtgagctaagaagaaagctaaataaaatatccatgatttgaagagggtgtttaaatactaataataacttgcaaaacaaaactaaatgaatgcaagtacacaaaggataattatgcaccattatattactctactacaatgaaaacgtacggtggacagatgtaggaattactaggaagaaaaaattgtaggaataattggaatcatgtgaatcttgaaccagcatgtaagagggaaggtactaataagtgaggaaggattttatttatcttcagttaagaaggaattgaatcatagccagaatttgtaaggagatttgtctgcttggcaagtatacaagacaggtatgtatgagtagtagtaggaataagaagacaaaaacagtaaaaaagaaaaatccatcaaataagcagcctacagtttagtgttttgaaagcagtgaagcagtaaaataataaatgatagcgattttgtatgggtaggtagtaagttgagagctaggagcctgacaaagagagactgtccactttacagagggttaagatccccactgcactgaagttttcaaaatgaaagggaataagtacagaaactaaagaaaaagactcagaagagtgttctaattgttttacagattaaaagaatgagtcatataccttaagagtgagttcactgcaatgtgttcatcatgcatctctctttaacacaggattataatcttaga

SEQ ID NO: 32357 - DNA, 1102 bp, Homo sapiens
aaaaaaaaaaaaaaagagaaggggtctaactctgtggccaggctcaaatgcaatggtgtgatcatagctcactgcagctcactgctcaagtgatcctctcacttgtgtagctgggtttacaggctcacaacactgtatcagattttttgttttttggagagacggggtctcattttgttgcctgtgctcgtctcgaaatcctggcttctggcttcaagtgatccccctgccttggtctcccaaagtgctggattataggcattagccaccgcacctgaccagagtgatcttttccactgtaatttttaaactagctgtggtattatatgtaagtctaataggtaaaacccgcacataggtgatagcttgttttactgaaatttttacttacaacgtggatcacaagacccaagataaaacacattaaagtgaaagtacttatggttattatgtaccctggatgaactcattctctttaataaatcatcgacatcttgcttccaacagttagtatgggataataaaaaaaaattctgatttgcttcaaaaacataaacagtatttgaatttcactatgtaaaatactgctttttatgtcctaaatcacataaatactataacatcatgaatagttatattattaatacaacaattttgaaatactggtatatgcctatataattactgattagtgttattatagattactgaattaaacagtcaaaacagtatgtttaataatttaggccagtgatcctcaaagtatggttccttggctatgcatcatcaatatcacctgggaacttattctcagaaatcaaattctcaggtcctacactagcgtaactgaatcaaaaacttggggttggggcccagcaatctgtgttttatcaaagccatctaggtgatcctgctatgaactgaaggtggagaaccactagtttaggaggtccagccctggagttgcatacaactaagtttgaatgctggctcgttgactcattaactgtcattttgagtgagctgcttaccttctctaagacatggagttcacatttgtaaaatggtaaaatgatgtattagtccattttcatactgctat

SEQ ID NO: 32358 - DNA, 1095 bp, Homo sapiens
atctataggagagaggaggatcttagaaaccatgaaaattataatacttctgattctctcctaaccctatagtgtacctatgacaacaacacgtaggaagcaagcatggcaataggaaaatgaatattgccaaaaaagtagagaagtagacacttctggttgtctgtctgccaggaattctctttgttctcactggcagggcctcaggtttgatctggtctttctgtgtctcctccacgagactgagggaagatccatcctctcgctagctctagggtaaatccctatttgtgttatcctatttccttaacaataactggtttcaaaagtgatgcttgaccccttccttgcaatgaaatatgaagacaagtctgatggggggactactttataaggttaaatggcattttccttccctgccccatcccttggaattaggtctacatatgtgacctagaattacagcagctgtctgtcaaccataaaagggaatcaaatgcaaaatgtgaatattggacagtggaaatatgaaggaacttgggtcctaaaggacatggctgacttggagaatggacaagtcttggagcttccttaccttgggactttctgttttatgagataatacctttttcttagtagggagtgttggcaatctggagctgaatgtctttactgatacaaatattaaaagcaatgaaccagggagatggttaatggtacaaaaaattgttagtaagcatgagtaagacctagtatttgatagcaccacagggtgatggtattgaataataattcaattgtacgttcaaaaataactaagagagtataactggattgtttgtaacacaaaggataaatgcttgaagtgatgaatatctcatgtactctaatgtaattattatacattgtatgcctgtatcaaaatatataatatactccataaatatatatatatgtacctactatgtatccacaaaaattaaaaaataaaaaataatgaaagcaatggaccaaaagttctaagctgcacaggaaaagctgtaagtctaggagataaatgataaaagcaaaggtggggtggagtgaggtctaaga

SEQ ID NO: 32359 - DNA, 1053 bp, Homo sapiens
gtaggtctcaacaatgggcccataatagtaaaccattctataaacagatgtactgtcatccatgttttgtttcatttatggaacacagaatagctttatcataattcataatgtccctaggatttttattaatggtaaatgaacattggcttcaacttaaaatcaccagctgcattatctcctgccaagaaaatcagcctgtcctttgaagcttttaagccaggcactgtcatctctacaacaatgaaagtcttggatggcaactttttaaaatagaatgctgttttgtcaacactgaaaatttgttgcttactgtagccaccttcatcggttatcttagctaggtcttctggataactggaaacatatatagtaactgtgtatctctatatgcattatcaacattaccaggagtttggaagaaatttatttcaaccctcatgaatgacactgacgggtttaaaacttcattggaggaagtaattgcagatgtggtggaaataacaagagaagtagaattacaagtggaggctgatgatgtgactgaattgctgcaatctcattaaaaaaattaaacagatgaggagttgcttcttatggatgagcaaagaaagtggttcctcgagatgaaatctactcctagtgaaggtgctgtgaacatgcttgctgtctcaccttgctctcaagttctagagactgcttattttcttaaatgccatgaaccaacctctgctagcttcccacttttcttctgaagctttcctcatctccctcaaccttcatagaatgggagacaattgggcctttgccctagattaggttttggcttaaaggcgtattgcagttggtttgactttctatgtagatcactagaactttttccatatcagtaaaaaggctgcttcattttcttatcatttgtgtgtttactagaatagcactcctaatctctttcaagtacttttcctttgtattcacagcttggcaaactgtttggcataagaagcctagattttggtctagctcagctttcaacatgccttcctcagtgat

SEQ ID NO: 32360 - DNA, 1028 bp, Homo sapiens
tttttccctgtcccccttctttctctctgcccccatttctctcctctttattgggactttttgaaagtttgatatatcctaattattttagtacaattaaatatattttcattgttttgtataattaaatatctttcattgttatttgttttatacaattaagattggtttcatacaattaattttaaaaagattaaatctctttttcttcagtattttttatatctgttgtgagtgcaaccacgtatctggcccactaagctaaaaacgaaataatccttgacttttccctgactgcacttctgtcctattccccacctctaattaactgtgaaacacggcttactttatgaactagttttatgaatgatttctaaccttttttttcatccttatttttcattgccgtgcattgagcccttatgatctctcatgtggactattctaacagtgccttcactgatatccctttgaaatcaatcctgcagagagtggccaccgtgatctatctagaatggaaatctgaccacatcatttacttgtttaaacatttggcttctaattacctacaggataaagtccaagatccttagcatgcgatgtgaggccctccgttatcgtgctcctgccagatcaatggcctcctctctagtcatcctatactttctagcttattgtatattaaaactaaactgttaatggtttgctgaatacagcaccttgtttctctgctctgtgcttctacttgggttgtgctctataccaagagtgcctcctctcacctttgtatttccttttggacttttcactgttatcctcaagaagtacctctaaggtgttcttcctacctagcctagttttttctaccaacctagttcacctagtttcctgcctaacctcgttagatatcactcttcgctgcttcaagaatactaaagcaacactcctgatattaacctactactcagttttgtgtggcaaaacagagatcacatcctatttgtctttgtgtctctggctgttagcac

SEQ ID NO: 32361 - DNA, 1047 bp, Homo sapiens
ctcctgcctcagcctcccaagtagctgggactacaggcgcccaccaccacgcccagctaattttttgtattttttcagtagagatggggtttcaccatgttagccaggatggtctcgatcttctgacctcatgatcctcctgcctcagcctcccaaagtgctgggattacaggtgtgagccaccgcactcggcctataacttacttttgataatttcattagtagaattagaaagcttgctcttgttctgtttgcaacagcataaatagaaattgactttctatgttaactgtagtttaatattcacttgaactaagtgtttcaatcttattactgaaaggattgaggtttgatagtagagtgagtcagttattagccgtgtaaccttgcacgattattaggtacatggcttgcaaatgcgacctcttgccttggctttctcatctttaaaatgtgaatatgagtactcttctcagaagattgttgtaagaaatgaatgaattaacaactatagagcatttatactcatgcatggcactttattgagggctcagtaaattttaattattttaaaaatattattactcttgtccctattatgaaatccagattcagataatttgatagagggtgagtataagtggtagactggctataatctatggactgtttgtttcatatgaaggtgcagttttattcactttcagatattaccaaatcgcagcattttgtttttaaacctctgagaccatatctatttcctttggatgatcaggacagctgaacatctaatccattcattttggccctcattgtgattgaaacagctgaattcatcatacaatgatgtgctttgatcattaagacagccaaaatgaaagcattggccatgctgcctaaggtccatttattttggaaataacttttgacaggtaagacacagtcccgtattgccttcctgacatttcattgatgtcttctgcagcttctggtagcatattcatcatttagttaatacgctttttgttatcatttgttcactgttat

SEQ ID NO: 32362 - DNA, 1051 bp, Homo sapiens
gatgggcattaggcttagcttctagtgacctattcttgaacctgtgccattcaaagacagcatttgcttgtgtattatttagaggggccttttaaaaaattctgtatgctttatgaaaatattttctataatttattcaatttctttccagtaaatatttttcttttcattaggaaatatatgtgtgtctgtataaacacacacgtagatatcacacactaaagtgtatacatataaaatacaagagaaatatactgtaagctacaaatatgagccacatgtgtaattttaaatcatagcaacaataaaaggaaaaggaaaaaggtacaatcactttaaagaatatcatttaacccagtataatgtgagcactttaaggtgtaaacaatttaaaaatgttaatgagatctacacttttttcatattaaatctctaaaatctgtgcacattttatacttacacacatctgaattcatgagagatctacacttttttcatattaaatctctaaaacctgtgcacattttatacttacacacatctgaattcatgatattcacagtagttagtggctacttattaggcagcaaaaggataggatacatgcacactcaaagacttattttgtaataagtcttaaggtagaacttgaggaattctaaccaaatcaaattgtgaacatttttttcttcaatctacaagactaaagttgatatcagagtgatctttaatttaacataattaccttagttatagacatatgtcttcaaatccacaaatgttaggcacatgcttatttggtggtgcacttaatcctacaccctcattttctagagactgctttggaggaatttcaaggttttacctacactcaaatggaagcaggattcactaattattgaaccatgaggccatcctaacgtccatattattcacagaatgtatactttcttgaaaatatatgtaaaaatttgcatttaaaatattttcagtgttagattttgactttaaacttgtattttgttatatttatgtttatattgaggatcaa

SEQ ID NO: 32363 - DNA, 1026 bp, Homo sapiens
actatcatcagtgctcgtgccttcctatcttgaggttatctcatcacatggcctgttcttattctcataaccctcctccatgtaacagtttctatgggatttttgttccctaaaacccacagatatttttgttataatctgtattacatatttgctccagtattctacctatgacatttattactgagcagcagaagaggataacataaaataagttattattttgttatgtttttcttgtttataaccattattttctgtgtgactgctttatccctttgttattaaacttgttatctggttttaaagttaatattaaaattgctgagaaattttaaaatatagactagtattacttcctttcttttattcaaaaaattattgtccttatttagctactctgaaataaagcttattaacacacatttgaaattctgtagccaaaaacaatgctcaatgccatcccagaggggtaatttatagtcatgtatcacttagtgacagggatacattctgacaaaggtgtcatccagtgatgttgtggttttctgaatattctagaatgtgcttatacaaacctaggtgatatagcctggaacacatcaaggctttatgatatgacctgttgctctaggccacagacctgtacagcatgttactgtatggaacaccgtaggtaattgtaacacaatggtaagtatatgtttatctgaacatatctaaacacagaaaaggtatagtaaactacgttataatattttgagaccacagttgtatatgtggtctgtcattgactaaaacattgttatgcagtgcatgactataagagtgtgtgtgtgtgtgtgtgtgtgtgtgtgtgtgtgtgtgtaatgggagagagagactgactgtaaacaaaaacatgaaaggcctattctagtcttatctgtctgaaagatatttgaaaatcatgaattaaacagtaaaggttagatgttactccgagaacatgctttgaacctcctgtcaaatctctttactcttaca

SEQ ID NO: 32364 - DNA, 1016 bp, Homo sapiens
ggaggttagaattctatagtaggaggcagtgaagcttttaaaccccaggaaataatgataaaagtcatgtcctagaaaattaaagtctagtgtcaatgtgggagatgactggcaggcaggactggttggaaggctgttgtgcagaaggcgtattagaagctaggattgtgccggtagacatggaaagaggcaattatgttataaaacacgttcaggatgttgaattgaatgtgcagaaaggtaaatgtagagtcaagatatgacgctttctagcctcagcaactgggaaaggtgaggccattattccaagattatggagatgtgatgaatagattttctgagtgagaagataaggagtttggatctgtgcatttaatacagatgttcatggaatgtccaaaagtaaaaatttgagaaggaaattgaaagagtttcaggccagatatatctataggaaattcattagcataaatatgatagttgagacaaaagaatgggtaaggtcatttaatgaaaaagttaagaacaagaagcctgaaaactcatattgagactaagtaaggctaaaccacatatgaaaatgaggtagaagaaatttagtgggtaagagcaatccagatgaaaccatctgggatacctgagaaaaactcccacagtgagacttcataactgaagatagaatttcgggtgaaggtgggaaagtttcctctctaggaaaaggtagcatttgctggagtgagtgcagctgcaagtagtagtggacagctaaagattatacctcaagggttctggaaggttctcgcatgggctaaaaatgtacctctggtggagccgaagcccacatgggatgccacatgggatctgggcaaggaaaatgaatcagggctgacggcccagtactggtttcagccatgtcaatctgtggttagactagttacttacattgaggaatctttcctctttaagctcatttacttctatccttgtattattatgatgattttgttttggtcatc

SEQ ID NO: 32365 - DNA, 1045 bp, Homo sapiens
cttattttgggcaaggcatccctttttaggcactggtgatccgagggacacccatgggaaatgctgtcctgtatgaattttttcactcacacaaatattagtatttataaacaatgaaatagttttctaaatgctctattgcttttgattgacaaatgattgttattcatctataataattttgtaatattgttgtcttttattcccttttcctgttttaaatttaattataagcagactgacaattacaagtatacaaatattcatataaaatacaaagaaaataagtatgtttattttccatcatgcacaatattttgagtttgcttgatgaacatgagacagattttccaagaaatatctttgttacagttgaatttggctgaatccatctgttacatatagatattgatacagatattaggagatctatatgtatatcctctattcgagagctatgtccagtgtttgaatgtaaggctaaatatactttatattggaatgttggtttgtcaactaaggagtcttgtccttttgagttagcaaagtgtaactctaatgagctgtaaatgtataactgtattatacaagacaatatgttatatgtatagtaaaaaagagttcatccatggccaggcacggtggctcatgcctgtaatctcagccctttgggaggccaaggcaggaggatcacgaggtcaggagatcaagaccatcctggctaacacggtgaaaccccgtctctactaaaaatgcaaaaaattagctgggtgtggtggcaggcacctgtaatcccagctactcgggaggctgaggcaggagaatcgcttgaacctgggaggcggagcttgcagtgagccaagattgtgccactgcactccagcctgggcgacacaacgagactccatctcaaaaaaaaaaaaaaaaagcgttcatcaagccatgaagtttttgtgagacattcttaggttaaaactagaacaacagatttatgtaaccccaaatgagtaaagcatatggtggtgagaaaatattttatcatttt

SEQ ID NO: 32366 - DNA, 1050 bp, Homo sapiens
ttctgtgctctgatcttttcagtacattactgaaataggaatatggtattatcacatcttggcagctccatgtgctccctttcctcatgcccttaattctctccatataccttacgtcagtagtaattgggtaattaggcagaaatgctgtcgcctgagtaagggtgtaagaaatgtctcattgaacagaataatctttctttgtactcatgattcatttttgatatgctacaactctatcagcagggaaactttcctccctgtcgagattctaacaggcctttaagacaagaatagacggagaggttctgttattagtctcaattctgaggcaaattgtgttattcttctatagtcacattttctgccccacagtatgagattttcggagatggcagaaaagtcttctgttgagggttttatgaatcacaagataagggttctattgtgggccacttgaagaaaatttgtagctgatttggcttttaaaaaagctggaaggcatttctggaagtctgaagagctcactgggttatttggtttcaactccattttgatgcagtgtatagatatccggagcaaaatgcccttccgtggagaaaattctgtttctggctatcagttgcatcatgattcccaagcaaatagctgagtaaaagaaaacatcccttaaagactctactgcattcttgtaataaatcacaaaaacattggtatcagctttcttagtcattctgtgagactatagttaagaatatttccagatgtgtcttactgaaaagaaggtaattttctttcatgcacaagagatcctttcttaacatagaaggggaaaaaaaatcaaacactttttagtcctctgcaggtgacaaaatttcaatttcctgtattcttagactgctagcattttgctcttatcccatgagaatgaaaggagatataatcataagtcaacaaatacttctaaggtaatagaaatgaaggaggcagttttccagtttcctgacaaggtagcttcatggaacaataatctgaagaaaagaatgcaca

SEQ ID NO: 32367 - DNA, 1607 bp, Homo sapiens
acctaaagcataagatgaaaatctaaagctcagtgtattctaaattacataataaaaatgaaactgactcacatgaaaaaccacagaccttcctaatgactggctctgagaaatgtgggctcatatgtagggttacaaaggtaaaccaggctttatgacacttccctgtgccgctctccatccctctccaaacattcacactcgcatgggcatcagtgtcttcacatggctttgggtttgctttctttcagaaggtgactcttggaatcaaacaagcaagtgcaggttttcttaacagaggtgatgcagcatctcgtatttttgatagcaccctaacagctaacgagaaatgtaatttactgggtgctttctatattccaggaatagacctagtactttacatataatatattacttgccctttaaaataattttatgaagcatgtgtggttatttttattcctattttgcatatctggaaacaggttaacaaaggaaagaaaatttcatcgaggccatgtagctaagttaagtagagggccaggtccaaagattcaggtactgttggcttgtgacacttctcggtctctgctcaatggtttttcttgctaacagtattttgaaattacctcaaaagccttgtgttcactcccagaggataagtcctgattggctcagcaattttcgcaatccttttaaaatccttgccattgatgatgggctcagccatgattcctgtttacagaggaagtttgttctagtgcttctgggaaacatttccttttggtaaggcagtgcaagggaaagccttttattcctaccaatttctgtccttttgaggacattcttgtgtaagaatcatttcttccctgtaaggcaatgcaagagaatgcttttttactcttaacctcttctgtccttctgagaatactgtgtgagaatgagatgcttcaatctgcaggattcatcttttgcttacaagaggaaacatggaaaacacacttgcatgtagaagtcgtaagtgagagtctgggagcttgaagatagtattgagtatcagaacaaaccctaatatcagcaacctctggaattattactaacttaacttcattacggtattctgtcacttttaggcaaatggacggggttgggtcaggacctctaaggcaaatcaagtgaacaaaccatgagagagacaaaggtggtatacagatttggtgcagatgaaaaataacagtgaatacaaatgaaagacaaaaatgctccttaaaaataagattgttctttgctttaagtttgtgacctatattttccataagattttgttttctgttgccatggtatcaacttatttccaaaagctatagaaaggccaggtgtggtggttctttgaaaaccatattataaaatgcaatccaagttttttaaagttaaggaagaatttgaggtgaaagttaatcttaattgtaacaatcaccaataatttctagtgcttactatgtgtcaggcactggtttacatttattaatttactaaatccacagaacaattcagtgaagaaggtattactaatattctctctttgagattatgaaactggggctgag

SEQ ID NO: 32368 - DNA, 1028 bp, Homo sapiens
atgaactcagtttcattaattgagcttctagaataaatagacccaaaattaccatggtgctttaataggtattacaggttctattttacatattatgtagggtcatgtatacattatatatcactgtggagtaatgattgtctttcatttattttctttcagaccaatttagaattattaatttttctattattggtatcaaatctaggaaacaatggtccctacagtgttgcagactttagatacaagtcttctgtaaaatgctgtttgaacttatttaaacctaattcatgtgatgccaagtttatcctaaggcttgtgctggggcaggcatgcacatcaaggaaaaacaagagccagttcccaaagggagtgcagacagctaaattctgtggggttagttaacgctaggagtcaatgcggaatccagagggatgcttccgactacgtttttattgttctttttttttttccctgaaatggtcaaaggggcatgtgcttgaacatgtgagccagcaaagcgtctgcggttctaatcccctaattaggctatcatacacagatggtatttagttcttttttttttttaaatgaatgaaagcatgtggtaatgatgttcatgaatttttataagataaaaaatgctacttcagttttgcttatatttgcctaacctcgtatataggtcaagccatgagtggaaatatgtgaaatttaatataaatagatgatgtcattatgtgcagtcagcttgtaggcatgatatatgtgtagacatacacatgctccctgtcacacatatatcaactcagatccagtatacacgatttaaaatttgagttattttggtagagaaatgagactttctcatgtcttcaaccctgcgtgtaatatcattgtgttataaatatctgcatccagtttttagttatatgctttattaatatttattaagtccaacttagcataaatcaaaaaatttgttacacataccatttagtttagtttaaaatgttttaggcagaagt

SEQ ID NO: 32369 - DNA, 1050 bp, Homo sapiens
ctatgtatttttttccatttgatctattaaggccatgtccattaaaagtataatattaaattagtaattcttatacaaaattgaataactctgatcttattggatgcacataagctaatttaaaaggaatttctagtgaaacaactggaaagtatttctctttccatccttgcctctccctttcctttgagtgttgctgtatcaggccacgggcctgatgcagtcgataataaaatctgccagtttttatttctgtggaggaagaattatcaataggaagtaagagaagaatatgaaaaatagtggctcttgttgggaaattagctcatcatagttaaattcaataaaacaaagtacttatataagatgctgagtgtctaaaaataaccatactcttcaaaattagccaatgaaagaaaaatgcttttaattgttgctgtttgcaatttttgtggcatttttattgttttcttcaaattttttagtgccagatataaatatctccatacatgagactaaccattttcactgtaaacagagaacaaagaactgaatgtttgttgtgaaaagcgcagtctatgaggtgaatgccctaaggggaatgcggacttaagaggggctccgtaacacactttcccaccaacttggagatgctaaaatgagttggtgaaatttccagcagtctcttctccttcgtacagctcagaatcctctcatcaatatttcttcccactattagagaaacaaataaaactcatctctgctgggattaatttgctgcagcctgaagcattgagcctctactggcaaccactactgagctgaataagcagcatccccgcatctgttgacaatatgaaattgttgcggcagccaatattcataagaaatggcctccagaatccaaagagaatacgctagtccataactatcagggtctgaccactgaaagaatagcatgtaattccagattttctaagctatatttaaatgagggcttcttttctctttggatcagaatgtggagaaattgtgtagacccaattttac

SEQ ID NO: 32370 - DNA, 1070 bp, Homo sapiens
ggcagttgagtggatatgagatatctctcaccgtggtttaatttgtgtttccatgatgcttcatgatgttgaattttttttaaatgtgcgtattggccattcttatatcttttgcgaaatgtctgtccaagattttccttctccgaaggttgtagcctctccatttcttttgcctattgtttttagtcactctccagtgccttctaagagtttttgtattttttccattgtatataatcattacttgcaggtggggtggtctaatttaagctactcagaccttactgaaactgtaatgtaatcacatctctttgactcattctttatagttgtgtcaacctgtccctgccttgttttctcctaacattcttgtgtaataaaactttatttctcagggtggaaattactgttttaatataaaaaaggaaagatcggaaggctgagatggaggacttgcttgaggccagcctgagcaacataacaagactccatgtctaaaaaaacattagttgggcgtggtggtacacacctgtaatcttagctactctggaggctgaggcacggggatcacttgagcctaggaggtcaagactgcagtgagttatgattgtgctatagcactccagtctgggtgacatagtgagatcctagctctaattaaataaattaagtcaataaacaaataaaaacacgaaatgaagccacttatttagattgcacaggaacataaccatctttaatataaatgtattcaacatgtaaagtattccgataattaaaaatacaactaaaaaagtaagttcaaagtatgtcttaatggacaaaaaaatatccttttgctatttcccagtttaccattttcaccagtgagagtttgtgctgatcagtttgggctcctataacaaattgtcatagactgggcagcttaaacaaccaacgtttacttctcaaggttctgaagtctagaagtcgggttccagcgtggtcagattcttgatgatggccctcttcctggttatgtcctcaccttcctttggtgcatacaagcagagagagaaatcacttctctt

SEQ ID NO: 32371 - DNA, 1652 bp, Homo sapiens
tgacaaaagcattcagaattttatcttgagatgtcaagaacaaatctcctagtacgctgtgcttaccacagtgtgatggcaatgggatgggagaagggagaggtctttcctcctgccagtatgaggttgcactttcctgaaatccaggggactaaagtgggagaaagaacaaaggtcagcagtggttacctgatggaggagaggaccaggagtcctgaattttaaggaaatgggcgatatttatcttttgagagtggaatgggaaaaggaattcctgtgactatgtagttgattttatataaatgatatcaggcaaatcaatgatatgaagccaactagaaatggcttgatatatctagattgaccctttaggcataaaaattaagagaactaaactgttcagaaacatgaactaagtatttcttcactgatccacctaccaaaaatattgcagccttttatcccaactgatttaaagtgagactctttagcctttcatttggaactctgaatggtgatgatgatgatgatgatgataaacacttcttgagctattattactcttaacactcactgtgctaaacactttgtaaagatccctacaattactctacacatcacaatgcagcatatattatttccatttcagatgctgcttacagtgattacatcacttgcccaaggtgataatctggccaatcagggctgggcttttcacaccaggtatttcttccagagtccgtgctctaacccggaggtccccaacctttttggcatcagggaccagtttcatgaaagacaacttttccacagatggggtgggaaaattagattctcacaaggaggatgcaacctaagtccctcacatgtgcacttcacaatagggtttgcacttctatgagaatctaatgctaatttttgtattttttgtagagacagggttttgccatgttgcccagggtggtctcaaactcctgagctcaagcgatctgcctgcctcagcctctcaaagtgctgggattacaggcgtgcacggcccgcattttttattgaggtaaaatttacatacaatggagtatctaatccaatgactattggtgaatatactcacaaacccgtgtaaccacaagtcaagaaatagaacatgtccatcattccaaaatttcctcattagtttttccagtcaatccctatcttgagaggcaaccactgtttagacatctatcacagcagattagttttgccttttctttagcttcatatgaatgtgatcactagtttatgctattttgatgtggcttctttgacttaacacgttttgaaattcatctatgagtttacacacatcaatagttcattcattttttattgctgagtggaattctatgtgtatgaatatatcacaatttgtttattcattcttgtacgaacggacacttggattattttcagtttcagctattatgaatatgttgctaacacattatcatacaagcatttttatggacatatgtttttatttcttttgggtagttttgagtggaattgctaactcgtgtcttaagtatatgtttagctttataaaagaccagccagacagttttccaaagtgattgtaccatttctaccagcagtggaagagggttgtttct

SEQ ID NO: 32372 - DNA, 1040 bp, Homo sapiens
cagacattttgaggattgcttctaagtgtacaacaaaagtataattcttattttctaggagagtcccaattcagtaaaatttacttctcttgccaagtaggtcatctgaaatacatcaaatgttgtgtccagatttttgttttaaaatgtgtgattgttacttctaaaaatggcttttggtccaaaagaaattatgttgagaattaaaatgacaaccacaacacaaccactgtttcctgttcagtgacttcacttgatcaacttttgtgatagcaatgccaaatcttgccaaagaacaaatcatttttcttccaaggaaaatgttgcttttcaaagaaactactatgtttatgtttggtcatccagttaaataagaggatatttaattagtgcaatggagtgattttaacatttatgcttaattttacattggatttataatttctggcacttgacaaggcaatggccaggtacagttttctttccaatgatagcatttcaaaatatattctataagcaaggatttagttcaaaaacttaaataattttgaaaaacaacaaggccttttaaaattgattacaacctgctcccccttgaattttactttttttctctttctttctctcttttcttcccttttcttttctatttatgtttaaagcttctgcatttattctttgaccaaaataatacatttggtcttcaacgaaagcctggatatttgtaaccctaattgtcagcagcagtatctttctgaccgctgaagggaactgatttgtgtctgcattagcacccttcacactccaaattatacttccccttccccctccagtggcagtttccaaactctcaacttgtttcatgtcaaatgcatgttgggctctgtaataaatcactgatgaacagccaactctctgttttggaggtgcagcctctgaacattgattaatgtgattcttcaagaatggaacaatggccagtgtgcatatgcacaagaaaagctcatccactgcaatagatagctttgttccgtgtgctc

SEQ ID NO: 32373 - DNA, 1027 bp, Homo sapiens
gaaaaatactgatgcttgtgttccttccccagagcctgtgaactaattgagtggaggtgtggcctgagctttgaaattctgaaaaggtcccaggtgattgtattgctcagccaagtttttgaatcactggtctagactgtgaaggtacagaataaggagggtgagatactgttcactgtcaggacaccaaattgtttccttacagaaacatagctatagagagatggcaaagcctaatgtgtgtggaattgtgtgtgcatgcatgcacattcatacacagctgatatgagtaaatcatacagttttgttgcattttctcacctcttgctatcctgcctccgttgattgtgaactaagaattatttctgtgtaggcagatgtgttcattgttaggattagtggtgtatgcagcagatactttagagcccaaggaattcctctttcttgtcccaccctacccccaccttttttacctatatgaacacaagatgaacaaatacaagaaactggctagaaaagcattttcaaagcgctgatgaaattatcacatttatcaatattttaaaatttagacacatggcaatatttattaggcacttcttaaaataactcttcttttttttttttttttttttttgtgagcaacaaggctgtttattttacttgggtgcaggcgggctgagtccgaaaagagagtcagcaaagggtagtgggattatcgttagttcttataggtttggggatagtcggtggagttaggagcaatgttttgtgggcagggggtggatctcacaaagtacattctcaagggtggggagagttacaaataatcttcttaagggtgggggagattacaaagtacattgatcagttagggtggggcagaagcaaattacaatggtggaatgtcatcagttaaggctattttcacgtcttttgtggatcttcagttgcttcaggccatctggatgtataggtgcaggtcactggggatatgatggcttagcttgttgagtgttgttactat

SEQ ID NO: 32374 - DNA, 1057 bp, Homo sapiens
tcaagtgtggcataaccatgcatcctcttattgaatattgaattgcaaagaaataactatttaccatgatttaaaaacatataaccatttaatagcagtcacttctattaattgcctaatcagattataatagtttgttttctttgcaatgaaatttccccacaattttaatggctgtgaggtacatgaagtcacacagcatgacatttttataggagccgaggtttccacttcacaaaatgcacttacttatttaagttgtccctcagcctctaattgctttatctttcaaaaaaagtggtatgtttttattctgtgacaatatagatccaaaaataccattttaacattgagccagttaatgactccaaaatttgataaacactagggtaccagtcctagcacaggacattggaaataaatcaagttgtaggtgagaggaaagaacaaatacactgactcagggggatgcctggagtttggggatgcgctatatacacggttggtacctctgggctttctagtctctctttgccaacacctggatcctacccacttcaccctttggtttcttcattctgtttacaaactaactgaaaacagacatgacatgttataagaagaaagaaaaatcactttacatatatatacacaaaatttatgtatggacttccatgtataccaaatttaaatatatgtggacttccatatttattttcatatatgccaaatttaaatatatacagacttccatagatatataaaaatatatgttttagggccaggtgcggtggctcactcctgtaatcccagcactttgggaggccgaggtgggcagatcacgaggtcaggagatcgagaccatcctggctaacacggtgaaaccccgtctctactgaaaaatacaaaaaaattagccgggcatggtggtgggcgcctgtagtcccagctacttgggaggccgaggcaggagaattgcgtgaacccaggagacggaggttgcagtgagccgagatcacgccactgcactccagcctgggcgacagagcaagactcc

SEQ ID NO: 32375 - DNA, 1047 bp, Homo sapiens
aaagtatcagaatgtttaatgttcctttgttagaataatgatgtactacatgtactcatacatatttggtccaggagagttgcttatcttaagaaaaatgagtctaaacctcctgatttttaaggatcccttcagttttcacatttgattcatcataagacagcttacaggtgcagacatgtttacttaactgggcaaacatggagagaagctgcatcataaaggccaagtcagtggctgtcaggatggttttaattaacagtaaggcaccattggtcccattttgtgtgcacttcaaaatgttagttgtccattgaggtggctcacagatgaggcactacttgagcctagttgaaatgcagctgtgacatatgctttttaaagaagacaggagagaggagtttggggcacacgattccgtgtgaattagaagctgttttatgagagatggaggacagctggtctgttcataataaatgttagagaaagtctaatatggcaggaaaaatcgtaggattctgaaataagaatgttgttagcaatagcaatatatataaaacaaaaatgaaaaacaacaaaaaagtattcacatttataacattcttagacttttattagagttatgttgttttgtatgctctaccatcatacctcaccttgacagtcatgctgttagctgcagaagacaatctgtcatagtggtttaaacactggctttaaagtcagacgtacttagatccaaatcctgcccccgccacttaatgattgttttaatgttagcaagttacttcactgaggcttcatctcttcatcaaaaaatgagtaatcgtacttcctttaaagatttattgtgaatattaaagcacatttaagtatgaaatatagcaccttgtttatagtgagtgcttaattatattattatatgtgaatgtgtatatatacacattttttccaggtatagtcatctatcagtttgtttagtatttgatatcaacagtagagtttttgtgtgtgtgtgtttgtcttgctctgtcatccaaactgtag

SEQ ID NO: 32376 - DNA, 1034 bp, Homo sapiens
caaaactttctggacgtttgcctctgttatgtatataaaagatgaatttataaagtggcttgaaatgtgaatttaacagcagctttattttataggaacacgcaggatccttaagaaacatataatgctaagtattttatatattgaagattattcattttcagctgcaaaattattatccatcatttgttcttgcattcaaaataaagaaatcctttatccttaagtaatataatgttaagattcaggaatattttaatacccatattcatcttcttaatgtctttatgaaatgtgtctacggaggtctgactttacattaattaaattttgaagaatttcagggttgaataatttcattcttttattacagcatcattgatttttatagctggagatattagaatcaatttagtataccaaacagttaatcagcaaaaatattcatggttattaaaattatcttttatatcatttcagttgcataattcatgatcataaaattaaataactgttttactaaaatacactggtggtgtaaaaaaaagacttttttccctagatttttctcttggaattgctcttttatctttgacatcatgtacataaatatcaagtgattacatttttcaaaagaaaaatgaaataaaaatagtaattgattagttttcaggttgatgatttatttattaggaaaccaaaatattcaccaccacaaataaattattttgttgccaggaaatcaaattataatcagaaggtttcttgcaaaaatgtagttagataaaagatgcttgttatgcttgaaacacgtcatcgagtttaatgtatattccttttacccccagaaaaataacctttgtgtttgcaactcttgggcaagactctcatgctattaacagtagaagactcacattggctacatattcctttctgaccaactaaatacatacttctaaacaataggaaaattatgacataatacttgatgtggacataaaaattattattgtatatatatgcaatttttgttt

SEQ ID NO: 32377 - DNA, 1123 bp, Homo sapiens
caaaaaatcatatcaaaaaatctgtgcttctttacatatactatttctgttgagtgcattcaacaatataattgttttgtttaagtgaggaggagaaaattggacgttcaagagggcagtaaccagcagaaacacttcttgtgactcatacacaattctacatttttattcttcaaactaaagataacattctttttgttaaacatctgatgtttactcacagattatgtatgtgatcatttgaaaattaatgttttttaaaaagggtaacctaggttttaatttattgtgacatacagcctgaactttctacggctttgaaaataaactcacagttttctatttgcacatggatgcttcactatttagctaaaattgatgatattatcacaaatactatagcttgtgcaaggtttcaagaacaaggaaggaagtttaataaaacagaggctgagactcagctttaacaccctgtctcccatgctaatctcctgtttacaataatccattacgaatatttaatggtaggcagcatgcagaccagaattaaaggacatatgggtacagttatcctggttaaaatggccaacgtgccttgtattgtgtatggaagataacaggacaggtggtaatctgtcttcacggagtggagacagctggtattttctgtaagccgaagccatctttttcaatgtagtctcacctcgcagctgatatgttgcttattagtataatttaaaacatatattgatgttaaaaaccatgctctctttctgtccagtataaaaatgcagctcgtggcacagcataaacagatgaaaaatatgtatgtatattccagtatttgtaattaaaatcattctgcttaatttaactgttttttaactgtaaaatcaatattatctttaggctcatctataaagtattttttctttaagctgtgtaagggaactttcttccctgtgttgcatattctccagacttacgaagttattgggggaattattagttcattaccatcaaaatatttttgttaaatttcattttaaaaaatatttcttctctcttgtttaaactacagtatgtttcatttcttatactaaagaaagactcactggacatg

SEQ ID NO: 32378 - DNA, 1034 bp, Homo sapiens
atagctgattattcatgatggaatttcagattttacaaaattaattatttctagatgcaaaactagtgagtttaccatgttcaacaaattacatttatatttaagatggcctcacagtcaaaatagcctaaatttgtataatttagcttaatttttcataattatttcaaaaacgtttgttatttttctaaaagatgatgtccctgttaataaaatactttatatttttaaaataagtaaatagtcatttaaaaacaaactctgactagtggatcacaaggtcaggaggtcgagaccatcctggacaacatggtgaaaccccatctctactacaagtgccaaaattaactgggtgtggtggcgggcacctataatcttggctacttaggaggctgaggcaggagaatcgcttgaacccgggaggcagaggttgcaatgagccgagattgtgcctctgcactccagcctggtgacagaacaagactccatctcaaaaaaaaaaaaaaaacgaaaaacaaaaaaacaactctgactatactgacattaaccattattaagtgggaataagaatttaataatttagcttgagagctcataatgaaatattttaatttcagacttatctgatttgctaatgcttaagtcatttctttactcaacctacacttacatagtaaagttgtgggtgaaagttttcctggtctcactcgttcaaagaagatggttatgacagtttttagccaccatatgggcttcttttgttttcttcaaaaatagaatacctgaattcacacagtaatgtctatccagacccttacccacgtgaactaagctagatagtaatttccagaaactacattatttaaccagactaaagaatgtaaatcgaatgattataataccatacttaaagtcaaaatcacaactataattttgcagaaagcttccagttttgattagatataaggtaagaaatattgataaaagattacataaataaaaaaacagtattgcttactaattccatttttttc

SEQ ID NO: 32379 - DNA, 1019 bp, Homo sapiens
gagctgttgctccactgaagctcctggaagggtagaggccagaggacctcctatggggacagatttctcgggcagcttgagttgatgagctggagaggtggcttgaggaaggagtaacttcttctggaatgagaagtttctcacttcttcctcttctttccagtcacatcatttctttcttcccttagcggcatttcaattttctagaaaagcggagactactatagagtagcattacacacaccatttaaagctttttctctgattcagctgaagtctctggaatctgtctggtggcaatctacaattctatggacagtcactctggtcctggggaaagggaagatattaatcagtccctttccactttagaaaatgacttgcaaaaaataaatgaaacaaaccagggatgggatcatgtgaataagatatttttgcttaccattgagtttccttcatgaaatgtcagttccatgaggataaggaccttgtaactcctaataactgctgatctagaacagtacctggcacagaaaaagtctcaaaaatgtttagtgaatgaatgtactctgagcttaactcttgaagctgattttctggggctgaaaggtaaggacctgatagtatctctggaactctgtgacttcattttcttgtctataagagggcaatgctatatgttatcttgcttaataattgcataattggataactattggaaaataatttgcactagtcagagataggcattatccagataagagataattatctttattaaatagtcaatgatgtccttagaacttctgatatttctaatggttttgcaaaactgcagtcttagtgcctgaaagaaaatcagacaatgagtccagatgcgatagctcacacctgtaatgccagcactttgggaggcagaggcgggtggatcccttgaggtcaggagttcgagactatggtgaaaccccatctctactaaaaatacaaaagttagccaggcgttgtggtgcatgcctgta

SEQ ID NO: 32380 - DNA, 1033 bp, Homo sapiens
atataaatatttccatgtaaatgtaaaacaatttacagatattaaatatttaagactctaaatatttaattatttttggaacactctgcttttgtttaaagtgagacacaaaattcagaaactagaatgtcacagcctttgccattgcagcttgcttcctttgactgagatgtgctgatagtaaccattttctaagctataatgattaatgctacttaggggaggtaggaaaaaagttaatttaactggagtcgttcagttttaaagggattttattgaacacagaaagtatacacaaacacacacacacactgaagaaatattttaatatgcctgttacagatgcagttacagctcttttttgtttttcagtgtttttagaatgtcagatccaaatattttttattttttaaaaataaagttgaaacatatgatttattcatgaaatttcagagggggaaaatatgaacaaaggaatccctctccctctaaccttgccctgaaatgctacaatgactgtgataattagctccatgttattatagattatttttcttataaataatttatatttcagtttgctttagttctttaaaaaggcaaagcatgaaattgattagatataattgtacgtttgattaatatttaatttgaaattattttgcagcttcaagtttagatgtaactgtcacattttagaatactaagtgtatattagatagcttggtataaatgtcttcctaattattcacttttttattattcaaaagcaccatttctcatagctatacatcatgttttataatgtgtgtatgtgtatgtatacatacttatacatgtatgtgtgtatatgtatttatatatgtgtattttttttttcttttgttggataacagagttgactcaatttagacatcaccttttttttcttccctaaggagttcaggtcataattcaataatactacatatataacaagtactgttataaatgcaagtattaaccaatttgaaaacatagctcattcattcca

SEQ ID NO: 32381 - DNA, 1117 bp, Homo sapiens
tctttataaatgaataaaatggaaaggtgcatctggttatctggggcctaatttttaattcagtatatctgatgtttaagtctaatctcagtctcttagtctctaaagtgaaaattgtaacttcagtcgcattttaaattgtgttgtatttaacccagggtttaaattgaagttttaatagtgcaaatgacattttacatttgtcaggagaaataaaagtttatgatcaagttatttagtatgcctgaatgagaacattttaaatcttatccagtaaattatggagcaaattcagaataaaagctaaaaagttaaagagaaaatgggcaaagacaccacctccacgaaagtatttatatatctcaatctctccccctccccgactctgtacatatttaccaggtaatactgtcctgtatgtagatttagtcacattaagttactcttttatcagattttcatctcagtcaggcaccagaaaaatggattaagagccagcatttaatgtagaaggacctttagaacattttaattatgtaattcagcacttgtcatagcttatgagagtgttctcaaatggaagtgtagtacaggttgcaatctcgttgactcttgcttaaaggcattcttggaaaatatgatttagaatattttcctttgggaccacccctgggaagaaaccagtaaagagtcaataactgatgaaagaggaacaatatttatatgaccagtggatcgagaatctgtggatatttgcttttctctctgcttgtcacttttgcttaaatcacgcaaagtagccctaaaattctgtgtttggactctaacattggtagacaataaggtcaatttcttaacatttttctttttcttttcttcttttctttttaaaaagtaattaacacttaggtcactgcattgtctcccattaaatgagttctttctggaccatgttggtaataattcttaaagcctccctcagagttctaatcaatacatttcttatgaactgttctagaaggcgttttgttctgttttagtttaatgggttttcttaaccctatccaatgactcctttctgtagtggacattgtggatactctttttagttacagac

SEQ ID NO: 32382 - DNA, 1032 bp, Homo sapiens
ccatctgtgattggttgattccacagttgcaaagcccatgaatatagaggaccaactgcatgttttgataaagtcatatttcaaaagttacgatattactatcaagttatgatattaaactatcacccccaagtaaaaacattaacgaaaagtgtcttgaggcaacacaggtttcatagcgcagttgttggtaatgctttcaaaacattttcatgtgttttatttgcctttaaaccaagttttacagctgtaacaacaactgtatttcttggttcctaacaattgtcaacctctcaaacattgaaaaaaaattaatatagaatgccatttaaaacctttatttctgtatagaaataatatttttgtctattgtgccttaaatatttatttaagttgaagtaatgcaccaaagttattctatttatcagttatttgggggattatttatttttattttcatttatatcccagttataacaagggtagacctcagtgcagatattggttaatgttttgctgctgttctttgctgtgtagttaaaaactgtaaacctttttctcaaaaacagtattgatgcagttaaagttatctcacacaattataaagtcaaaaaattggaatgctaggaaatgtatagtagtttttatctctaacatttttacttgtaagtatttgaagtttgattttataaaagaaaacaatttttatgcacaaatgtgattttaaaatttattttttattgattatttttctttgcaaaccaataatcatgtcttgatgagaatatgaaattatttaatttagaatactttgctgtttttaagacataaaaactcactatttgtctaattcaatttcaaacccaactttctaagaaggtcttacgagttgtattttcttgcttgttttggatcagctctatttaaaactttattaggaaaatagtttgtgggtctattctcctgtaaccaatatcaccaatgattaaacttagaactccatgttatgcctgtcacaaattgataacacag

SEQ ID NO: 32383 - DNA, 1921 bp, Homo sapiens
cgtgtgcttgtgcttgtgcatgcacccttgagcatcttattgttaaaattaatctttttatcatatccatccacccacacatgtctgattccagaacatgtcagattcacaagtgtgaactaattttacattatttggcttgaatgcagtcctcttgtgttcagagttgatttcctttgatgatttaaaattgagttagattctataaatggtgggattatgagaggagaattgagaaagtctggctcagtgttgtgaaatacttagagaaaatattgttcagcttttctgccactccatggccaactagatatatgtattcgcatctcctacgaaaatcttggcgtgttcttttgtccttactgctgcttcagcttctggtaaatagaagaatctgatccacctcagagctttccttgaacaagggttttgttgctctggaaaacactaggtgtacacagacatgcttgaatttcatgaatgtcttctagtgtgaaacaatgtgtgataatattgtgtttctagactctttttttacttgtcttggtcttgattttaaatgcctttaagacaaagttgacacaggccacaactccaagggtatttgtattctgtttaaacagtggctttgggattgtgtagcttttactagcaagccacagcacaccttgactcacactgttttaaacagtaagtaaatgtattatgtcatacaagtaataattcaagtgacacaaactgctcacaaatgtcatcaagcactgcatatttcctgccattgccagggtctgcttctactcaggactacttttccttgtttaggcaaaattgttgctagtggtgactagggatccttctttcactttcagcaatagtgagaggaaaccctcctccagcttaacaatgtaagcccttcccatcagtcttattgagccaccttcagataaatactacctttgcaccaataaacgtaccaaggaaatgacatgtggaggttggcttagcgagatgatatctacaccaggatccaggattggtatcactttcacctgaaacatgttgggtagccatggatgcctaaacaatatgaaatccattaggaaggcatatggcaccacgttctttgtcaaataattgtattcagtcttacacttattagtagaaattattatcctggagcattctatcattacattataatctggactgttttctttgtaggcctgtgacacagttttcattttaaattttagccataatttaaaatgtagtcatacttttaatttctacaagtatgtgctagttctctattcatttttcatagcattttggtttttttttgtagatagaatatcttcctaaatatttcagagtttattgtctagtatttttttccataatttcttctatgatgcctgagttagctccatttcctctggtgtcaatgtttagcttcttaaatttggcccttccatctcatcctgctgctttttctcgtatgtctgataatccttcctatggaataagcaactgtatcgttaatcaaagtcctctgtttttgtgttacaactgattcccatgtggaattatcacttagaattctgtttaagaaaatgtgagacttttgctttactgggatcagcaaggaagccaggaagccagctgtcaggatacaggatcactcaaatcaaatagtgagcattataccaggtttcacctggtagtttgttcagtttcactgggaaagggtcagctatttttgctggaggtaaatgccagctgcctgatttttgcctgcatttggggaggggatgacaagtgaaagatttgtccttatacagaccttcaattaatctgtgtcttcagttcctttttcacatccatcttccaaagttcctgctgactttggatcttggtttcc

SEQ ID NO: 32384 - DNA, 1029 bp, Homo sapiens
gtgtccgcggtcctgctgctgtctccagtaccctccgcatcccccaagtgatgggaacaagggcccgcccaggcagccgctgtcgccgcaccgccccctcgctcgctctctgcgcgcggagtcacccagtcacactcccggcaccccgagcccttcctccggagctgctgcttctactttggctgctatcgccgccgccgcgggtggcccgctgctgactgggctcgccgggagacggagaagcactttttggccctccctcagcagctctcacaccccaactttgccgccgccgccgcgcctgccctcgcagcggcgctcggccgcacattgtgggggcgcacgccgggaggctccgcaagaccgtggaggcaggaaacggcactactgcgcttctgcctcggctctttgttgttcgctttggatggttcttgaaagtgtctgagcctcctcggaaatcctggggccggagaagacaaaccttggaattcttcctctgcaaaagtctctgagatactgacaagcgtccggaaaggtcgacgagtaattgccctgaaaactcttggctaattgacccacgttgcttatattaagcctttgtgtgtggtgtgtggcttcatacatttggggaccctatttccactccctcctcttggcatgagactgtatacaggatccacccgaggacaatgattgcggagcccgctcacttttacctgtttggattaatatgtctctgttcaggtaaccccgcgtcttctttcttcacccttgatcctccctgttcgccccctctccactttgcacgatcaaacccagaagtgtattttggttacccctccctcctaaggccggaggggctcgattcctgctagacttttaggcgaaaatgttcctagttcgcatttggggttgtctctttttccccactccccaaaacctcccctccacccctgaacctcctcaagactctttgcagatctcggccttttgccaagttcagggcacgcccagattactctgggcaaa

SEQ ID NO: 32385 - DNA, 1050 bp, Homo sapiens
tattattttgacaaacccctttgatgttctgtgcttaagttcagtcatttttatagagaaagctaaccagtaaagtagatatggaaagtctttgagtttgtgctgacttgaataaacctggaatcatgtatccatgtcaactaagaattatataaaatgtttctcttcaaggctcataccaatcagaatagttaacttgagaattaattgcttccaactaacatgcatttattataaattatccaaaatgaaggatttttatattataaatattctgttataaatttataaagaatatgaaatcttttaaaatgtctaagttaaactttatagataatgaaatggaattgtgatagaagttatatttatacagatcttacatgttaactctgtgaaacaaagggaaaaattcaagtttggtctttgatgaccaaagtagtatgaaattatttctcaaagtttagcaaaaacatgcatagattaaaaattaaaacccaaggaggagactgcaaaggaaaataatgaaaagacactcactcaaatgccagattctaatctaggtcctatatggcagagaaaaaaaaggaatttcttatatagattgtattttaatagtgagagacaaaaattcaactgataagaacagatactacacttgatcttagccaaaaggctgagaagcaaaaatgtaataattaaatttataatatgttaaaagctgataatactatggtgaaaaatcaaggcaggtgcaggagagtgtgtgtaggtatttaattttcaggtaggattgtcaccaaaagctctctcagtatttctcataaacttgagaagtaccttcttttttataaaaaaaaaaaaaaaaagacaaaccctaaaatttaaaaaaagactctagtcctcaaagagttctatgtactgtatgattaaactttaatgtaaaaatttttaaatagcaaattctagtgagaacaaagacacagagaaagaggaatagaaataaagatcataaaggaagaagaggccaagtcaagtataaaaagtaaaata

SEQ ID NO: 32386 - DNA, 1029 bp, Homo sapiens
agaggtttatatagtaagaaataaatgtaacaatgtgtaagaaaacagaactagagaggggtaaggaagcaatcatgaggaatgaccggtctggcatctcattgcatgccatgatttggtgagcttcagttctttgatacttttttttgagaagacttgagggacaaatgtaggtttcaagcttttcaaaaggattcaattctatgtttatccaaaaaaatatgtctatgggatgtttgggtttcatgattaccatatgtttttcttagcagattctatttcctaaaacaacattgggactggatacagaacatgccttaatattttcttgagaaaattcatcttgatctttaataccagtccatcaccagtcattcttgacagtttggtctttcaaaactcttttcagaaggcattgtgtctgtaattctagttcctaatatggtgcctgatatttaatgcatatttatccaatcctgtctgtggaaatatgacttatattttgataaatagaatgattgaaatggcttcttttctactgatcttttttctactttataaaccatgaagaactatgcagaaataagattactggcaaacattttattttcttatggatgtattctaccatataatatatttacttataccttccttccataagaaaaaaaaaaaaagaagcatttgacctgagtcttagagagcctatggtatgtgatagtcttttataggaagtaagggtcataatctaaggaagactttgggcattgacagatgcagaaaagctcgtaacaagtacatgcaagagggaatatttcaaagtggccgaagtacttagtaattaaaatgaaatagtaggaaataatggtggaaagatgtctttccatttcactttctgtgcactttagttaatgatcacaactacatcacatggtcatttcataattatgtttgtgtgtatttaggtcctagtttattaatctttgaaagtcagatattatgtcttatcttttaatccctcagagcacc

SEQ ID NO: 32387 - DNA, 1050 bp, Homo sapiens
attgcttatgtgtgtttgcttccttttaatgatcataaactgacaaacttgtattgagaagcgacctgaccaaaattaccctcatctttaatcaggtgtcactgaaaggtacaagcaatgaaaatttttacacatattataggttatcgaaagcatggaaacaaactgtcagttttcttatttatgagatctcattttaagctttgacaaaccctaaactttaggaagccaggcaaaaatttgtgatatatatgggaatttattctcaagtaggtgcctcatgttaaggttttttcttttcagtttttgattttcatatttttctgtcgtgtcacattattgatttatattccaaatatttcttcatatgaatctgtatgaatgtatatgttcatgtatactgcataactgtagtggttatcattttaatttgacttatcattttaatttgattttttatttttaaaaatttcatttcttggccagatgtggtagctaatgtttgtaatcccagtactttgggaggctgaggtggttggactgaatgagcccaggagttttgagaccagcctgggcaatacagtgagatcccatctgtccaaaaataaaaattagccaggtatggtggcgagcacctgtagtcctagctacttgggaggctgaggtgtgaggattgcttgagcctgggaagtcaatgctgcagtgagctaagattgtgccactgcactccccctgggtaacagagcaagaccctgtctcagaaaaaaaaacttaaaacgttttatattttagtctcagaaccctctcatttcacagtatcagtcttcacttctacattatgaaaacgattgcctttatttatatacattgaagtacagagaaaaaacaaacacctattactttaaaaataagtttcattcattttgtctgtttatttgacttaaatgacaagtaaatctaatattttgtgttataattttatttgtaagaatgaattggttaaatcttaactaatgtcagtattttacaaaattagtttcttttatctaa

SEQ ID NO: 32388 - DNA, 1409 bp, Homo sapiens
aatattgaagatacgtactttttccatcaaattttaattgaggttctgctgtatactagactctatgttcttgattttgttcttactagttaagtgaagtaagtattaacaaatgtaattattaattttaatgggaaaaggaaacaagtattagagaagtaagactttgcatatcttaacaccttttggaaaacggaggtatacatgcattacaaaataactttgaactgtatattttggctttacaatttaatgtcattgttgcttttagttgtatttggtctggtttttttttgtggtttttcctcagaacaattttggaaactatattcatcttcatatagaattatggcagtttataggcccacctgtttgaaaaaactttatccacagttgtgttcctaaaatcagttgtcccagaattgtgacaggaaagaagctcttttgaacttgaatgcatatctaagttagatgagattaatacaatttatatcctgaatgtaatttatatcctaaatgttgaactgtgattaggtttccctaaataatggtgacatctgggatagtttgagttctttctttatagtctaatttacttgaatttcgtaaaaatcaaggaatggacctgattgcgactggttagtaacttgttctagttttgccttcccttatatatttcaggtaagttaagattaatagacacacagtctactaatttgaattaagttttttgaagtatttgaagtgtttatatactgccttttattgttcattacttccagaatgaactgttgttataatactcatctttgtttcttttgtcttgaaagaaccatatttatttagagtcagaatggagcgatttgtagtaacagcaccacctgctcgaaaccgttctaagactgctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttat

SEQ ID NO: 32389 - DNA, 1047 bp, Homo sapiens
tctaataaatgacacatggttcctcacactaagcttaccttgattatcccactcataacaggatggctcaaattctgtagttcctcctttttaaataaattatttggaaatactgttactaaatactttatgtgctcttaataatttatgattcataaagaaaggaacatgaatgatttcctaatcatgagcatggaaaattataaaattatttattatttagcaatcctaaagtagtacaagtgacaaatccctctaaatcttagatcttaattcatctagcagatcctcaagtgtaactacctaaagttgtttttttaatagtttttgcttttaatcaaaacaaatcactaatagactaaaattataaaatgtaaacatgagaatatatatgcttttaaaattatataagacctaaatattacaaaattacacatttatagcacaatcaccatactccataacctgacgtttttataaatttgactactacaaattttaaaatatcaacagaccaaaaaacgtaaaaccaatcaaaagcaaactgatacactgaaaaatattctttgatgatttccttaatttaaatgcttctagaagttaggttaaaaaagtcaataacctagtagaaaactgcaagagaatatttcgcagaaagtaaatgcaagtggatttgttttccaatagaaaaacatgctcttattcattattaggccaaaattataaagattaaatgccatttctcctctcatatttatgaaaataaaagagatgatgtattctatgatggctttggtgtatagaaacaggacctgataatcttgttggagggaatgtaaatgttcctatactcatcacaatttaaaatgtacacataccatttgacctagcagttctacttatagaaatttcatcctcgaaatatacatatataagctcaaagacagaaacaacaatatacattacaaatggtttatagaagcaaaaaactggaaatattcagaatgtctaccatagggtactaggtaaattaaatatatccataca

SEQ ID NO: 32390 - DNA, 1045 bp, Homo sapiens
ttatgctggtatgaatctgtatgaaagatgtatggagaagaaccactgcggagctagggtttgcacttaacttgcacagtataatttatgaaaaatatttcaaaaagttacatttggggttgtcactgaattagtcacttatcactattggtcactattatcagtgtcagtcaaaagcctggagaattcataagcttggaaaatacaaggttttagggaggtatacatgatggactacatgttggcccttcctgagttcctaagggcacaggcctgggaagcacccacagcataagctcaggtcagcaaatgaaggatgtttctctaggtaaagataacatgacagcaaaaggtgaaacctatcctagaagataggagttagaggctcaaggaaattcagagtaggaagaagccacagtaacaaaagtggcagaaatggcagagatttttaaaaggctgggggaggcaggtagtatatggaaattagaatcagccaggattagagagtgtcaaaggatcagagcaggagatagaaaagtatgcaaaaccgctaacttttccttgagaaatttattattttgataactgaatgggcaccctgcttacaagggaaaaaataaaggatatatcccttcacaaatgttatgtttttcatacatttaaagtggaagttaaatattgtccctcatctactccaaacatttcagtggttcccattatcagtggtcagccaacatctctatgaggtatttctttacctccccatttaatactgaaatatccttccccaatatcaccatgccagcactatccccatcctcctttatttttctctaaggaatctgtcaatttttcatttataaaggtttgattgtctttctgtccctatgccagaatcattaataactccacaataggaagattttttctgttttgcttactactgtttttcttagaccttagtgcattagcacactgtggggactcaataaacatttgccaagtaaaagtttaagaatggattacggagaatggaaaattagta

SEQ ID NO: 32391 - DNA, 1030 bp, Homo sapiens
ttaataagtaaaaagtaataaatgtacatgctacttttaattagcagagttttatctgaagaggaagccaatcataactacggtaaaaccatcaactaacagcatagtcatatttcaaaattagttggtagttgccatgctaatggaagtacaaccctatcattagcattttaaaataagtaatgaattaatatggctatcatattaattgtcgctgttctaacaactgtcatcatcctaacacaggccttgaagcagaattaaggtgcatgcaagattttttgagcacaggtttgcatacaaagaaataaatataaaatttgatttagcagaaagaacactggagtcagtcaaggcaacaggtcacagtgctgcctaagctacaaagtgggctagttagtctccaataattattgtttttttttttttaatttattattatactttaagttttagggtacacgtgcacattgtgcaggttagttacatatgtatacatgtgccatgctggtgcgcacacccactaactcgtcatctagcattaggtatatctcccaatgctatccctcccccctcccccctccccccaccccacaacagtccccagagtgtgatgttccccttcctatgtccatgtgttctcattgttcaattcccacctatgagtgagaatatgcagtgtttggttttttgttcttgcgatagtttactgagaatgatgatttccaatttcatccatgtccctacaaaggacatgaactcatcattttttatggctgcatagtattccatggtgtgtatgtgccacattttcttaatccagtctatcattgttggacatttgggttggttccaagtctttgctattgtgaataatgccgcagtaaacatacgtgtgcatgtgtctttatagcagcatgatttatagtcctttgggtatatacccagtaatgggatggctgggtcaaatggtatttccagttctagatccctgaggaatcgccacactgacttccacaatggttgaact

SEQ ID NO: 32392 - DNA, 1108 bp, Homo sapiens
cccaaagtgctgggattacaggcatgagccaccgtgcctgatcctgtgcccctcttgatagatatttaagtcatttttaattttttgatctcacaaacagtctttcaataaacaattctattttttccagcacatgggcatatatgtaggacatacttagaatcagagttgttgagatgacgagtatatgtgctttaaattttaccaaaataccttcaaataaaacctgccagtttatgctccactaccagtgtacaagaatgcatgttttcccttactctcaccaataattgatattatcattcttttaaagttttgccagtctaatatgcaaaaatataatttttaaaatagtttgatttgaacactttataatgtttatttcccgtttattctctgtagtgatggtttatatgattgtttatattgttttctttatagtttgtttatattttagaaatgattttatatacaaccgtgcatgcatttctgtattggtcggcttatctggatgcaattttttctattctatatgctgtaagtattttcctccagtctgttgcttgatattgaactttgttatgttatttttattgttgctgttcaacaacaatctccacagagatcacaaaggtttttcattaaaattgagaaagtttattactcttgctttaaagatggtatggcttttttttttttttttttgagacagagtcttgctctattgcccaggctggagtgcagtggcaggatctcagctcactgtaacctctggctccctggttcaaatgattctcgtgtctcagtttcccaaatagctgggattacaggcatgttccaccaggcctggctaagactatggcttttgacataggcatttcatcatgttttttcttttttttcagatttttttttttagaatgagggtcttactggctggagtgaagtggtatgatcacagctcactgtaaccttgaattcctgcactcaagtggcactcccgccttagcctcccaggtagcaaggactataagtgcataccaccatgaacaattaatattttttatgtggtggcgcattctagtaatcccagctactcaggaggctg

SEQ ID NO: 32393 - DNA, 1034 bp, Homo sapiens
gtggcagtgtaggacaatgaaagagcagggcacataatggaagcacaacagaagccattatttcagccctatgacttaggcctccagccttaatgtaataaatgacacccaacatgacacccaacatccccacctttggttcttctcattgccatcccaattagaaccctggctgagtaataacaaatggtctcttaagagagcactttcatgctaagaaacataagtgcttaggtaaatgcaataggtcatatggtaagagaaccaatgaacagtctactgtttttgaaacttgatagatcaacgtgaagctaactgaattttggtaattaaaccttcctaaggaaatacacattctcagcacttaagccaatagaaggacaaattatctggccatttaaaccaggcgaacaagctctctacttggcaaaatgttttaaatgtttcaaatccctacttccaacattaacaatgcaacagtagtgtacttaaatgtctataattcagccggatctactgcaattattaattcttgaggcttcagtatatctttattacattttcattaccttgtacatataagaaaacaggcgtgaccttcacagatgacagagttccaattactttaggaccagacatcacagttttaatcaattaactcaggcaaggtactaattacccttattacacatttgtagtctgactgctctgtaattatacttaaaaacactgatatacattataagtaccttagtgacttcctaattcccagcctcaaagaggatcacattttaattagtcctgaatttctaaacaagaatatgaaccaaagcagtaccaacagccttaccacaaatttaaatgtgacccacaaactactattttagaaactcagaattcctttgttggatttcaaaactgtgacctaaataaacaaaaggaaaaataatctattaaaatattattttgaaattaaatgtttaatcagaataggaatcaggtagctcctaacgcacagtgaaagaaaatagcat

SEQ ID NO: 32394 - DNA, 1047 bp, Homo sapiens
gcaaatgatataacatacttttggatggatgatgtcattgatgacttccagatggatgatgtcagtatcctatagcaaagaccaccaagaacatactcctgaattcagacgaaattggatttattgacttgttgcagtgggaagaccacacaccattgagaactgcagggcatctcagtaaaacggtgttagaaaagacttataggactcaggtgtatgttaggtgattttggagagggttcaaggaagcagggctttgctctggattggatgctgtcaggaaatggaagggattctatgattaagtctcctaaatgttatctggtaggcaggaggaatgtatgaggctgaagttatcaatggtaaagcggaagtggtcactcattagccagagtagggggatgttcggtcagtgttgtggtttggaatatgttcttgccttgcctgagtccagacatgagtatgtacggagtggtggtgttttgttttgacctatcatggtgacagtgatctctgatgttagcattctgtggaattgcctgtgttcaacaggagaacacaaagacctagctgtgagtgccaggccagctttttggctgctgttctttctcagggttgagtgaaaagagtattttttactaactttaataaaactcttaattatgaccaagagagaaccactgagatagataatctataaggtcccttccaacactgattctatatacatttttatcatagtctttggaggaagcttagaatttgtttttgattgtatctattcaaaatagcaaatgttttacaagcacatggtttaatctttagcagaacagtttgcttatgcaccagcttatggcccagactacttcagtgttttccttatcttaggcattatactcaataaagtgatgatccctcacgactccttccccacgcagatgaccctgtaaggctagtctgtttttattgggtattgttccactaagttaaatccaatttggaaaaaaaaaattttctgtggactttattagatggcttttataggat

SEQ ID NO: 32395 - DNA, 1083 bp, Homo sapiens
aatactggagtcaactcttgtagtatctcccagccttatttgcttctctatataaaagaagaatgtattatctggttggagagattgctggaatcagggcatccacaaggagcagcatggtatatggtggttaagtatttagcttgggagacagaatgcgagctttgtaatcccaggtctatcttttgtctcttagcctttttccaaacaccgcttttcccatctgtgaaatgctttgattatcatatgtctcttagagttgtgatgaggattatgtaaattgcttagcataaagtagtcgctcaaaaactgctagttatgactggctgcattgtgaggggttgccaagcctataaagtggtggctcttagcctaggctgcacattggaatttcctggagaacttaaatgttttcattccagagaatctgatttagttggcctgggctatggtcgggtcattgaaatttttaaaacctttccaagtgattccaatgggcagttatatttgaaagctatgtttaaacgcaagaaataggattctctctctcctaggcagattatgaaagagtgggctgtggagtaaacagacctggcttggtgtctgccttctaaaagccatttctctactgtgctttccacactcttctgttgactggctctttgtgacaggtcccaatccatcccacctctgatagttggagatgcgtatgaagagtctgctctgcagatccagtgcacccctggttctcaggttcagatttggcaggatgtaataggaagccttgtttgttttggcttcaattccaaattattttctctaatccggtactttcagggaccctgtaatttgaggtcattaggcctctataaagaaagtgaatattcttatccctgtctgcttatcagttcattgtgttcatactcttggttagaactaggaaggaaggaggcatgcatgagtgattgatgttaacttctacccaagctagaaattctgaggatgaacatataatagcattatctataaaatgggatattatctgcctcaataggtttttgtgatggttaaataagaaggtat

SEQ ID NO: 32396 - DNA, 1072 bp, Homo sapiens
tggtaatatgatgtgcctttccttgcctaaatcccttcctggtgtgtatcaacattatttaatgtcttctaattcagtcatttttttataagtatgtctataaacattgaactttaaaaaacttatttatttattccactactgtagcaattgacagattaaaaaaatgtaacttcataatttcttaccataacctcaatgtcttttttaaaaaataaaattaaaaatgaaaagagactcaattgtatatagagtgtctgaattgatttaaatctcaacactttaggataaagaagtggaggcaatctctgtggttgtctgtgcaaagtgcatcttgctgtacagggctgtcgttacatcctgtgtttgggtctcttgtttgatcttctgggaaatgtaggaaccccttccccctattagaaataagaaaatctttatcttttatttttcagaattttaaaccatgttctcaaaagtagttttgttatctctacatgtcatacttaatgtggctagttttcagtaaagtcatttagtggctgtggatgtttgtgttctatagtaaataaccaagtcagcttctgacttagaacaaagtcagcattactctgtagccaattattgcctgtgaaatgactggttactcaggtttctatctaatcttaattcttgaagattcattacccttcagcgccttctgtggaaggtggaaaagagaaaagctaaatgaacaaacaaaacacctttgggaatgggataagaaaatttttggcagcatgacatttttgtattggtcagttattttaaacaatgtccctgcctcttaataccccagagttacatgggaagctactagcaccataacccctggtgctgcattgtagttggtatttttagcatgttgcagggtagctgaggttatctttcctgcaaagactttttttctttggaatatatagggctgtattgttcatttaaatgtgaaactgattctaatcaggttgaaccatatgaaactgcagatattcagccatttttgatcaacctaatagataaaatcagtggcaaggcg

SEQ ID NO: 32397 - DNA, 1040 bp, Homo sapiens
tcttacctttgttttaggaggcttccctcttcagaggaaactgggagaagccaatttccactgcttctttttcctgtgcctttttaacactcaaacccagaacacttaatcctctgcagctcgtgcaaaaattcagtctgtaatttaaaatgtgtgcacggtacactgctgaccatgggcatgtctattgtttgtatctgtaatgtgtatgtccatttcagtgttgtctgttttagtatgcaggtgatagactagagaacaagacctctgtctccgtagcatcctgggtatgtgagcattcaataagtacttttatgagaatgagttttgttttaagcttaattaaaaacatgcttgctttctaaaaaaaattcttaatggttatatgtacgaagggatggggaattgggtaaagggtgcatttggaataattcaaaataatctttcttatttgtccgtaaactctaacttatcttctttcttcaacttctaaacagagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacaggtatttctcttattttaacttctgtcttcttcacctggttaataatagacaaaacgacgtaatgattgcccaattacatgtaagcaggtttgttggttctctctctccttaaagaaataaatcgtgtatcttctctttctactgccttctctccccaacttctttgcattaccatggtactcatcaatattggttggatgaggaacttttcttatcttgggaaagccttaatg

SEQ ID NO: 32398 - DNA, 1069 bp, Homo sapiens
atcagttaaaattttttttattgtcatccattttatgctgaaaaaattaagctgctaaattaagtgtcctaatatagccagtaatgctgaatctcaaaagtccacattagaatcccatgtcttgatttggtaggcaacaagcagtggtggtttggtggtggatgtgacctcactccaacatacttgaatcaagaagacgctgtccattttcacagaactctgaaggaggcttgtgaccagcatggtccagatctctaccccaaatttaaaaaatggtaggtaaagttactgaactttcatgaccccaaaattacattctgttccttctgaaggcaactattatgtcactaaataccctcttctgcttatgaaaatggaactagttttcttactttgctcatcagaagaattagaatactggttttaagtggttgtattaaattatttacttagaaatatttaatataaattgagtagtaatatctttttattccaaatgatttagaatggtagactataaactataaggtcatctatgcttgagaatgagaggctttttaatctggagtgggttgttaaattcttattccagatgagaattattattcctgatgttgacttgggaatgtctaagggcattggaagggttggagaaccactagagggagatgccaacataccagagattttggccaaggggaaagaagaattggagaatttgttaaagaaattctaatgataaaataagaaaacaaacaaaagttgggagaagacccagaatatttgttatcatcaaatggaatcttggcacaaattgtttggaatatgagtaaagtactcaattctgcttagagccaattggcattcttgaaaaaggaaggacaaagaatttttgtctttttgctttgtttttagagctaatagttgtggaatgttaatatttatgcaagagtatggagttcagctttaaaatcgtcaggaaagatgaaacatttgaatattctcttgatttaatattactactgaaaactacacagccatggatgcatgcagatactggttttttgtt

SEQ ID NO: 32399 - DNA, 1040 bp, Homo sapiens
gcttagatgtccaaagttcgttactgaacataaatttcaatagattatggaacacattttctctccttctctgggtgaatttgccctttttcctctttaggagatggaaagaactcatctcctgtgcgctaagtgtcggctaaactcctccagccaggatgtcattgtgtcagaatcttcccacttctttttactgttacacaagatatatttgattcgtttctcagtagcactaccaaatgcacgcatcagatttcctgctaggaaaatcttctcttccaatatcaaaatacttgagcatcaaaacccagttctcgtagaggcgtacattcatgaccatgttgttgcccatacagtgaaaccccacatcttgagtggaaacttgaaagattcctgacttttcctagctggaaatacaacagcagcttctcaccggcagattttgagctgtgatactgacacatctatattaaatgaagttcagtctagttttccatcttatgttttcaagcaaagaccactgaaccaggacacaacctcaagtactagaccagctgtgtgatcctcagaagttacttttttatggctgttttcccatctatgaaatatatatgtatttcatctcttttaatcctcatactacatatatatatatatatatccatatacatatatatatatatatatggatggaatatatgtgaagtgcttagaatattgtctgaagcatagacagcatttagacaaattgttgcagccacttgtcagcagtttgatcttggataagatgttttgcccctctggtcctcagttttctcatttggaatatatgagggttgtactggatcatcttatgtcccatccagctctaaatgttcttagaaataaaacaagccaaacatgaactttcatgaaacattgcccttgcagtgaccctaataccttaagaaaaaaaattagtaaggctgatacacgtgaatactaatgtgcgtctcactcactctaaggttctgaatcccttcagaatttgattacctact

SEQ ID NO: 32400 - DNA, 1043 bp, Homo sapiens
cactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttactagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaa

SEQ ID NO: 32401 - DNA, 1035 bp, Homo sapiens
ctcatgtaagtccatctgctccctcatcacctccaacccaagggtaattggtgtattcattttaccccttttctgagcctgcacatgtgcatgagtacgcagagactgcatttggttttgtttttagaaaatgggatttatatatatatatacaatttgttttcataatatatcactttctaacattatgccatatttatgtgtggtaatcaataaaatttaagtttcttgagggtgggaactgtagcaaccatatccattttctcttcatgacacctcacatacttctctgtacatgaggattctcagtaaatgctcataggttgactatagcaaatcttttttactcagtttttataaaattgagacagcaatatagaggaatatcttaaagatagtttttatgtgttaaagtaatgatttgttatcgtccctgttccactaatatagtaagaatgaaaataattgcctttcattttatttcagagtaatatctgaggaaatcacgggagctcactagtatggaagttattgtaactgcaaaacaaactttttaggaaatgaaggatattaacacatctttcgagatttatagtctaatgccaagtgaattagccaagaagaaatagagccacaatacttggaaatagcttgattgagaagttaaacatttacttaatctcatcttagctgattagaaaaaaaatcactttgattttaggcaatatatgcttattaatggtctttagaaactacctagttgatctgacctagagaacaaacagggctctttttagcttattggagtccatacttaagtcggaagacccagagtcaagttgctgccctgtcattgactagctgtgcaatccacttacagattcctgtgccctcctatttcatagggttgtctgaattagttacattaaaatgttttataaataattaagtgctggtccattgtaagatactatcattatttgcttgaagtagttaagggaatgagactcacctaaactcatatttttacctagg

SEQ ID NO: 32402 - DNA, 1023 bp, Homo sapiens
aacccttctctctttcaggggacacttatctacaagtctttttacatttaagacaagtggtaagccttttatggactttataattttttatttatataatattttttgaacactgttaggcactgtgtcagttgctgatttattgtactttctcacgtagttgtcttaataacactatgaggtaagatagttatctaataatataatgaatagagcaaattgaaagttttatatttatagagaaatggtcatgtaagcaaggaaggttccttaagaaagatgacttttgaacttgtctgaagaagtaatcaattcgttcaacagaaaatacttactgagtgccttctctttatgtgccaggcattgctctggttcgagtgatagagtaaagtgaacaaactcctgccttcctggagcttacattctagtagtgagagattgatgataagcaatgaataaatttctgtttataatgtactgtttacaatatgataaaagatgtaggaaaataaggaggactggattgaagttgggaagggccttcctcccagggaagacctcagggagaatgcaacataggccaaaaacctgaaggaggtaaaggagtgagttactcagttatttgggaagagtgtcccagggagaagataatgtatctccattaaactaacagtcatgcttataaatgagcatgtttgtaggtttcctaatgatacacaaagacatatgcccaagaaacacttgcctagttttgaaatttctctgttacagtgtattattagtgtagtgtatgttaattaaagatggaatagaaagttttcagtgagcaggtctacatgcattttgaaattatacctggaaaccaaatttagtcttttctttgtttcaggatgttatggaacactggggatggagtctggtgtgatcgcggatcctcaaataacagcatcatctgtgctggagtggactgaccacacagggcaagagaacagttggaaacccaaaaaagccaggctgaaaaaa

SEQ ID NO: 32403 - DNA, 1102 bp, Homo sapiens
acaatgacaggatcatatgcacacatatcaatactacccttgaatgtaaatagcctaaatgccctatttaaaaaggcatagagtggcatgctgaataaaaaagcaagacccaatgatacgccgtcttcaggaacccatctcacatgcaatgacatccataggctcaaaataaagggatggaggaaaatctaacaagcaaatggaaatcagaaaaatgcaggcattgcaaccctaatttcagacaaaacagactttaaacgaacaaagctcaaaaaagacaagggcattacataatgtaaagcattcagttcaacaagaatacctaactattctaaatatatatgcactcaacacaggagcacccagattcataaagcaagttcttagaaacctaaaaagagacttaggctcccacacaataatagtgggagactttaacactccactgacagtattagacagatcatctaagcagaaaattaacaaagatattcaggacctaaactcaacactggaccaaatgtatctaatagacctctacagaactgtccatccaaagacaatagaaaatacattcttctgattgccacatgacacatactctaaaaatgaccacataatcggacataaagcaatcagcagatgcaaaagaaccaaaaccataccagacacactctcagaccacagtgcaataaaaatagaaatcaaaactaaaaaaaatggctcaaaaccatgcaattacatggaaatgctccagaataactttggagtaaataatgaaattaaggcaaaaatcaagaagttctttgaaactaaatgagaacaaagatacaacattccagaatctccgggatgcagctaaggcattgttacaagagaaatttatagcactaaatgcccacatcaaaaagttagatctcaaattaacctaacatcacaactaaaagaactagaaaagtaagagcaaaccaaccttaaagctagcagaatatgtataatcaaaatcagagctcaacctgaaggacagtgagacgcagaaaaacattcaaaaggtcaacaaatcaaggagttggttttttgaaaaaaattaatgataggccac

SEQ ID NO: 32404 - DNA, 1023 bp, Homo sapiens
gggatcagatatgatcacctaaagagattaactagaaatccaacaaccctcagaagtaaaattgagtaggtccaaaaaaaggcttgagggatgacctgaggctggaatctaaggggtttgagggaagcactttaagaatactactaattaatcatcaattcatttgtgagccacctgcctggatgaaatattttgttaattttttttttagtccctcattattgttttgaaagagtatacatgtctttcacaggaaattaatctctataagttcagtgatgcatgtactgcttttccttttgaatcatttgaatagacattacttgtcatttttttcctccagagcaatatgattggtaatcattaaacattttagtcattattccatactaatttaacagccagcttggtatattattctgcttctgttatctacattgcaaatattattgacttcatgagagtcatcccaaataatctgcttttctttcattcctaggcaaatactgtggtctggggttgcaaatgaaccattcaattgaatcaaaaggcaatgaaatcacattgctgttcatgagtggaatccatgtttctggacgcggatttttggcctcatactctgttatagataaacaaggtaattttcaccttttgcaatggttcctacagtttgtaatttctaacaacaaaaataaaatgctttttttaagtacctgttttctgaaattggaatagagcagaaagactgaacaattaatagcacatatataaatttgacaaataaggtgagttcagtttcaaagttccaaaaataaaagtacataaacgttacttccctttccttagtaaaggaaatactgctgaaatgctgattttttttatttttataagattggaacacgagctataataacttttttttttttttgagacagagttttgctcttgttgcccaggctggagtgcagtggtgtgatctcggctcaccgcaatctccacctcccgggttcaagcaattctcct

SEQ ID NO: 32405 - DNA, 1047 bp, Homo sapiens
aaggctacagtaaccaaaacagcatggtactgggaccaaaacagagatatagaccaatggaacagaacagagccctcagaaataataccacacatctacaaccatctgatctttgacaaacctgacaaaaacaagaaatggggaaaggattccctatttaataaatggttctgggaaaactggctagccatatgtaaaaagctgaaactggatcccttccttacaccttatgcaaaaactaattcaagatggattaaagacttaaatgttagacctaaaaccataaaaaccctagaagaaaacctaggcagtaccattcaggacataggcatgggcaaggacttcatgtctgaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatcagacaaagggctaatattgagaatctacaaagaactcaaacaaatttacaagaaaaaaacaaccccatcaacaagtgggcaaatgatatgaacagacacttctcaaaagaagacatttatgcagccaaaagacacatgaaaaaatgctcatcatcactggccatcagagaaatgcaaatcaaaaccacaatgagataccatctcacaccagttagaatggtgatcattaaaaagtcaggaaataacaggtgctggagaggttgtggagaaataggaacacttttacactgttggtgggagtgtaaactagttcaaccattgtggaagacagtgtggcgattcctcagggatctagaactagaaataccatttgacccagccatcccattactgggtatatacccaaaggattataaatcatgctgctataaagacacatgcacacgtctgtttattgcggcactattcacaatagcaaagacttggaaccaacccagatgtccatcaatgatagactggattaagaaaatgtggcacatatacaccatgg

SEQ ID NO: 32406 - DNA, 1055 bp, Homo sapiens
tgagaatcactgctctaagtgtattacataattggttgatcaagaatgttttcccaattttagttctacttttaaatattttgtcgtattttaagtatcttggtggaataggctttacttttaagaactgtaaaaataaactggaaacacatttctaatttaggggtgaaaatgagaacgaggtctttccttgatttgcaaattcaatgttaagacctttgcatacctagcacagtgtttttcagattgcagttggggacacattagggggtcatgaaatactttagtgggtcatgagcgtgcatgcgagagtgtatagggtcacgatgtaaacggtatttcttttggaataagcaaaaaaaatatgtatatgtctagccttcccttttgaactggagtattctgaacatatatttcatagcagtaggtgcttagttaagctatttatccagtcaggttaaacttgtcaaatattttttgagatacaaagcattcaaatttgttcattgctgtagattggagacctgttgttaactttagtttctggtgcatatcatcttgcttgcaagaggaggaagctctgaactccatcacatattttagaacattcttggcacgttacttgtggactgttcctgccctccccctacacaaggttatgaaaaaagacaactctgtaattattttcttcatcagcatgcatgcaaaagtcctgtttttcatcagttagtatttcttttgttaacttttgtagaaattatccttcatgttggaaagggcagtaaatgttcgtgtatttattgagaatcaaacatgagcataagacacctaaaaattactcctaacactctgcgtgtactctttgtaaaaatcatttttaaatgacaaccgtaagttgaataatagcctacagggaataccttaagtgtgacaatctgccactacaaagtcgtagattcagctgttaatagaaaatacttgagtttctgaaattcatctacactttcaatcaccttaaaagctgcctttgttttctatttactaaagaacgtgca

SEQ ID NO: 32407 - DNA, 1033 bp, Homo sapiens
tgatagataatgatgctggatggaatctctggcagatcctaaagagagaatcacggtgcctgctccaaggattttctagtacagctttgccttctacagccaaaccatttgaaaagcagctgtgggcaaaatgtagagtcctagcagaaacaggcacttgactatggaatatcaaatgactatatgaccagaactgcccttcaggaattggctcttgtaaggttgggtgctcacagtaacaatccactgaacaacagaaatggtatacatgcgagcacatgtaagcaagtccaaaagtcacaagatacatgaacagatggctcagagctccttgccttttgtgttcctcagctcacacctatgtcctctgggttattctctatgaccagctgataatgttggaaaatgctcaaagctggttaagcttggtatgttggtagaactgaaaatggattgctactacactgcggttccactcagggaggatccttaaaggacagaggtgaacagaatcctggttggcagagcttcagtacatgcattcatctcctttgaatggagaaaatagtctgaggtcagtgtaaatgtagggccttgagcaacagtgaatggtatggttgattgggtgaaaggtctctaagatagaatatgtgaagttcaataataaagagacctgaggaagaggcatgtggagggacctaaaggagtgagcacaaagtgtgtgtgtctttgtggcacatgtgtgtgtccaccagagagtatccactacaagtgaagcattgaccaaccaggtggacaatgcggtagattgtatttttcaaagatggccaccaatatcctccatctcacctactcttcttgtaatctgaccttgacagttctcccattgagtggtgggatctgtgttccctttccttgaaccttggcagaactttatcatgtcaaccaagagaacatggtagaaatgatattcggtgacttctgaggctagatccctaaaattctgtgcatttccaccttgctcccttgggat

SEQ ID NO: 32408 - DNA, 1028 bp, Homo sapiens
ttttaaaaataagcctatcacgttgccatatattataatgggggattaaatatagtcaccctagtggtacctcttactggcatataaagtctaactggcacatatgccaataaaatgtaccttactaacatgtatgccagttagactctgtatatgcaggtatatatatatatagtagggacttaatattctttgtaggattgcatatatatgtagctaatactagttacttaaaacagttggttcttagatagctgtggatttgaccagaatcaggcagaggcaataaatctgagtatttattgagtaggtgtgaggaactcacatagactgcctgaagagtagagatgcatggggttggggatgtgctggtaagagatgaaacagaaagaggtgggcccacatcagtctgtgaaggtaaggcccttgcatgtcattagtgtcccggtattatgtcactgctttctaaaggagtctcatgttaacagtagaaacatgtaaaatttaggaaccagacggaattgtgattttaaataagccaatcaatttccctagtctgactgttcttatcagtaaacacagaatacaagggatataatgtaagcacatagtatttgtaatagtagttgacattcattgagtgctttcaatgtggtaggtactcttgtttattttaaaagaagcattttactagaatcatagtagaaacttagtggtcagacttcatgtagcatcacttacaaccttcattgaatattgtgaagaaacttagtggtcagacttcatgtaccatcacttacaaccttcattgaatattgtgaagtgcttgttgaatctgagacttaaaaattttgttcttttagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaa

SEQ ID NO: 32409 - DNA, 1017 bp, Homo sapiens
gctgggactacaggcatgcaccactatgcctggctaatttttttgtactttagtagaggcagggtttcaccatgttacccaggctggtctcgaactcctgagctcaagccgtccaacttcctcagcctcccaaagtgctagaattacaggcatgagccactgtgcctggccccattctctttaaaccatggatttttttttctctcgagcatctcgtaagactagtgtttctcaaaatcactttgtaaaacaccatggtagagtccataaattgaacctcaaaggaacctagtttccttgtacatagtgtggagtaattagactggttggattgcaagatggtaagaaaatataaaataatgtatatttacataggttacagatcagtttccacattttctaatctgtttgtcactttgtaaatcacaaaataccttccatattattattttgatttttttataacaactgtataagataaataaggcaaatatttctattgccattttagagatgagaacactgatactagacgtttaatgacatgcataatatcacatagctaataagtggcagaactagaatttgtatcctgttcctttgatacttaaatccctttcttgtaaccgtttattttcactttaaatttataaccctgtatggaaggcagggaggtgatagcttcatttctaagctgaaacaggaaactaaaaaacattaatgatttatctagcttcaggtaagtggtatttaaatttctatttaagcttttcccctaaaatggtaaatgattgccactatgtatttattctcagtgtctttagtaaagtactaaagttaggcatatttatcacttgataggtgaccatttgacttaaaatatttgttatcctaaattaaaacgaattgaatctctccccagagagtgcccacagatcaatatgggttttctcttaggtttcctttttagttctctttctatcccacttttatctatcctagattaaataatttact

SEQ ID NO: 32410 - DNA, 1036 bp, Homo sapiens
agttgttgcaacatgaggcatttctcccctttccccatacttaacaatttgtatgataatctatctgagtagactcatgataaagctgagttattgttattttaaaagttagtgtaaacatttctctactgctttacaatttacaactccatttattgacattatttcagtttttcctatcatgacagtaccttttgatagggcatataaactgtatcccaatttttcatatgaggaagcagtctaatgaagattaataaattttacttaagatgaacagctagtgagtggcagaactagttggtacttaaatctttaccttttaacttctagtccaaagtttttattgtactagattgctttaaaaaatggctatgagagtttgtttcatctcgttaaaataacaggagtaataaacaagagttagaagaggattaatggataaactgcttgaatttgatatattgttggagaaagagggtaggaatagggacactaattaatatttattgagtgcctgctaggaactaagacggtgaacataaagttatttgattctacagtattattgtcattgtctttatgaattgaagcttaaggaagttatatgagtttttcaaagttggatatagctttccagtttcaaagttcaactctttctgttgttcatagtgttgtgattatataattaatggtctaaattgggatgcttgtgagaataataggaggctgtcttagtgggtacactagacaacgagtgcgtataccagggcttttctagacaaactgggatgtatgattaactccattttgagtgtctttacaggtttggaatttgtcctgatggacaagacctgcgaggatcagttaaggagaaaactgcaatttgaaaatatttctgataatcagggctaggagagggatatatggaagggggagatttattaaataaattaggtaacatttctgatgccctcctgttctgttttatgtatacagaatttaatgattggtaccatgcacttaatctcatgtt

SEQ ID NO: 32411 - DNA, 1010 bp, Homo sapiens
ttgtccagctgctggtatagattagccaccaggagcagagcacaatttttgactgctggcttttctgaaaggaagggaactagtcttgaggattcaaacttagaaagcggagaaaggaaaagctatattttattacatcagtttattcaaagttaaaaattatgaagaagagcaacatcttcaatggtataactgattgtgagataaaacctattgattagagactaattcagatagtagcctattaagactagcccacatgggaagtattggaaaagaaaagataatactcaatcggagtaccattagtagcttgtgaggataaaggaaggaaaatatcattatttatgcctggtcaaatgttttttaccctacagatttgagttacagaataccactgcccagttattgtttcatataagaaatctcttagataataggattttcaatatcagtatatgttaactttatttttacttttaaggttgattgtatatcctccaccacctactaaggggggattaggagtaactaatgaagatctggagtgtttagaagaaggagagtttcttaatgatgtaatcattgatttttaccttaagtaagtacaatgataaatgatcctacatattttacagattttactgagaaacttaaaataaatgtctttatctctgaattattttaaattctgttaaaagtagcctgccaagatttcagatttggaaaatttttgcttaccaaggttttctagaattgacttattcagtttcattgctttacttactgtggatgctatatagttaagaagagttgctgcttttttgcttttttagcttttgttagtttttgatgtaaatttctttaactattgtattatggtggtgaaagaagttacttacaaattacaaatcattttgggaactaaaaaacagcagctctattgagatatctgttgtatctttttttttttgtttgagatggagtctcactcttgtcacccaggctgg

SEQ ID NO: 32412 - DNA, 1326 bp, Homo sapiens
ctgaaggtaccactactggtagggaaagtgtttctaatacaattagctattgaatctttattaaagcagtgtttactctcctacatctgataccagttattttttaaaaacctgtaaattaatggaaattctgaatgaaatcttaggtgtaccatttttttccatagcacattaagtttgccttgtggaatttgctttcaccaacataataccttggaaatacttagtattcttttgtttacaggattttgtcacctctttagttttatatgctagtaatatttgcaggttgaattatatattatgcaggtggaattctatttttacaatatttcattctatataataaagttattcctttttccatgagacaggcttgactgatatgcaaataataaattgtttaaaagaaaactcctgtataatcaagtttttctcaagcccctttcctttcatgaatcattttactgtagtataatatttatgtttagaaattatagtttgatacattgtgtgtagaaattgtattagaccacttttatagtttacaatattacatataaaatttaatgtgctatcctaaatattgtgttgatgatttggggggagttttattttccttagggagtaaggtgttttctctggaaattgaaaggcgattgactatcttggaatttttaccctcaatcctgttccagtgccttcctttaagtaatgtcaaagacaaattatcatgaatattagttattaggaattgttgaagctacagtaaaagcaagaatagtttgaagagaagatgtatggtgttgaagaacgttccgtgaatggaaaagtcaggccagtcagatgaattgaaaattgtgaattaaaggcaactgctttgtgacttgctgtgtataaactttgagttggtacttgtatgacatagattcagaaagcaaaataattcaggataacttttagtcaattaggtggaaacttttggaaggtatttttgtacagtacatatatttgataacaaatattaaatatttttagtaatgattggcatgagtttcaaaatgatgtcttgttgacttaaaaaaggaagtacttctctagaatgatggatttattggagacttaaaatgacagggtcttgattattgaaaagaagaaataaactggcaagtaaattggtaaccttgtgaatgatcacatattatagccaactacagagcaaaggtattttgtctccttttaaagagcagtgatcaacactctttcaaattatagtccctttccactaaaaatatgtatttatgtaaattacattttaaaagactt

SEQ ID NO: 32413 - DNA, 1087 bp, Homo sapiens
tcatttctttttataccacattgtgtttattcaccagttggatttttatgttgtttccacttcttagctattatgaataatattgtcataaacattcctatacaagtgtttgcaagtgtttgtgtagacatatgttttcttttttctttttctttttttcttttgagatggagtctcactttgttgcccaggctggagtgtagtggtggaaaacagctcactgcagcctccatctcccaggctcaagcgatcctcccgcctcagcccaccaagtagttgggactacaggcacgcaccaccatgcttggccaattattctgttttttgtatatttgaggttttgttatgttgcccaggctggtcttgaactcctgagctcaagtgatctacccaccttggcctcccaaattgctgggattacaggcgtgagccactgtgcccattcttagacatacatatgttttcatttatcttgaatagataactaggattagaattgctgtgtcatgcattaatattgtttaactttctgagcaactgctgaactttttttcaaaatgactgtacgattttgcattcccaccagcaatgtatgaaggattcatgtttttctacatcctcaccagtgcttatctccttccgttcttctttcctctctctttcttttctttccttccatctttccatcctagtgagtgtgaagtggtatctcattgtggttttgtttgccatttcctaataactaaatgatgttgattatcttttcatgtgctaattggtcatttgttttttttttttaattttttaaattatactttaagttttagggtacatgtgcacaacgtgcaggttagttacatatgtatacatgtgccatgttggtgtgctgcacccattaactcatcatttaacattaggtatatctcctaatgctattcctcccccctgcccccaccccacaacaggccccggtgtgtgatgttccccttcctgtgtccatgtgttctcattgttcaattcccacctatgagtgagaacatgcggtgtttagttttttgtccttgcgatagtttactgagaatgatgg

SEQ ID NO: 32414 - DNA, 1035 bp, Homo sapiens
gatataccttttatgaattaatgtttataaatgactgtactgaatttaaaaccgtacagtttcatttgcattttgacattactttattatacattttgcatttaaaaggctgcaccagttggcttttcttctgttttattctcaaaatatagagattctgtgatttatttgccctgtttatggattaaaaagaaaattctaatataaagcatttcaataggatgcataggtatattacgttttttaaatgctttagatctgtgattcttgacttactatttattttatccccttttaagtcagggatgctttattctattttaaagcacttatgagttacatgttgtaatcaagtttgcacaatatatttatctatatgaggaacccataaatgaatagctaatttttaaaatgccattaaaatgcatgaaatgcttattaaaaccttactatactatttcttcaaggcaagtaaattgaccatgagaaaagaacacagttattaaacactgttgacaggaaaattctccttgataacataggacaattaatggaaaaaaaaattctcattatttgcaaagaatgaacaagttaatgaacaaacaaactagatttggtatgttttcagcttttgtatcatgtttaattgtttaatttggttgaaaaactgcagttgagaaatcagatagcaatatagacattcacagcagctctgtggataccatgtaattgtcaggtaatttcagaatgttgaaaattattcagtgcagccctcatagtatcatacttgaagaaattgattacagttccactaaattgttgaagataaattatttttaaaggttatgaaaactaagttatattaattcatatgtttgatttttaaatcccacctcctcaagctatccaattttctgactttgaaaataaccatgagagatgccacatttctctctgggaaactaccactcaaagaataattgttaaaaattaagcttttaggtattagaagctgttataaagtataaaattaag

SEQ ID NO: 32415 - DNA, 1090 bp, Homo sapiens
gcctgtattgacctccaccaaaatcttattccattaaaaaaagatcaagccattcttgtactaacatggagatcaccatatggtgcgaaaaagaaatcagattcaattcccacatgaatatttttcttcctcttaagataatattacttacatagcactcagttaaagtgcttcactagtctcatttattattcataatgttctctgttgttaagagggtctgacatgctggggcttcacctcagggaaatggtcccatagaaaaatgaaactaatgattctgagtaaatgaccttaataggtaaattggaattacagtgtagatttttcctcagctcttggatgactccaaattctctatcttctttctcttcgcagatattatccttcaagtgtaactgaaatttggtttcattaaaatgtatcaaattaaaatataacaaatatactttccacctgataagaaggaaaataaacgtcttttgcctgagctcaagatgattctattacatttactggaaattcagaagcggtgattcaaaatatcacagtccaaaagaaatttccaacttggggctgagtttaaaaactgattcaactaactgcttagtaaccattgctaactgatcagtggtatctgttaaataaaatcagaggtgttatatatataattacataatataaaaactaaagtttaaaacaaagtgtattttttatgtgttcctagcaatgtcttttttctatttttaaattttgaaatcttttattgacaaatacaaattgtgtatactcaaggcatacaacaagatgatttgatacatgtatacattggggaaccatcattatagctgtgtgacatcagacaagttacatgacctcgccatctccttaaatttagggataataatctgccctgtatgataatcagaaggaagagcatacgatgaaattgctttgcaaactgaagcacattacaaattttagtcttaactaattatatatatacacacacatgcatatatatatatgtttataagtttacgtgagtgtgtgtctatatatgtataaatttgagactactgcaaagggg

SEQ ID NO: 32416 - DNA, 1050 bp, Homo sapiens
tttgcatttgagttttgtgtaatggtaattatcacacatggctggtgagagaataaattggttttaccatctggacagcaaaagagccttaaaaatattcataaattcgacacggttacatgtctagtatcttgtgctcaaaaaaattgtatgattctttccttaaaaactagcacatatatggttaaagatttctttatgatactactttataataaagaaaacttgaaaacagcataagtgttcattgcacaggaatggttttgtaaatccatatatgcatactttaaaattatattcatgaagaatgtttaccgctaatttttttttgtataatgctaataaacattgagtagacttaacattgtgtatgtgattaggaaccatcaccaatggctatatgtaggtgttctttaaaatatctttatatttccctataattccaaaatttcctagagtgaaattatgttctttataatgaagagagaaaaagtgaaataaacagaaaattgaaaagatacaaggacagaactgccaaaaccagtaaaacgtattttttatgggaaacagtttgacaacatgcatacccctaaatttataagcctaatccaattcttaaactacttttcttgttatcatttgttgtttttgtgtttaagaccctttctaggttaaaaagaaagcctaatcatgttaaattaaattttaagtttgcttttttaaaggtcagtgctaataatagcaaataatccaagaggcatttctatttgacttttgaatgcatttttacttaatttaattatttggttagatatttgattttgttactattgcattaagagctgatagtgggaggaattgtctgggacaaaataagaaataacaagggtgggcattttgtttaacagtaactttaatgggattaccttttggcagtgtagatgggcaagctttgactagaaatttggagataatataatagattacattctgtcccttttacatcaaaataatccattttcctaacaatttcatctaaataaaaattaa

SEQ ID NO: 32417 - DNA, 1026 bp, Homo sapiens
aattttcatgtataaggaagagtggttcaatctaattatgaatatccttggtaactatggttgccatcctatcaaagatgacttgctgtatggtgactatgtaaccagagtgttttgatatgctgtttctgtgggttgctggaaaacaattgcttttcccttattgatagaacagcaagagtaataatggtcccataagaatctatcttcatattcttaaaaaatggagtcatgataaaagaaggttggatttaaggaataactgtatacaaaatgtcaacagatttaggaatcacagcgctaatattttgtgtccataatgtaatcaaaacatatcaaatatgttacaaatatcctattatcttctgaacaaagcttgccctctgtttaaagatactgacattgaacatatcttagttgatcaaggtgaattttctgacaacatttacataaaattagaaatagagttgggctgctgaatatagaacatattttctttttgtttaaaatgaggatgacagtatatattcctgagctacaatggatcttaaacacctgccaccactaataccacagcaacaaaacaaaccaacaataaacaaacatgttgatttccttgtttgtattatggtagttactttgttcattcccatgtatctgatttttagtcttagatttttagtgtaatattttttaaaatttaaatatatgattgaagtttaatgtacatggggaaaagtacacaaatcatacatatagagtgagaaatttttatgaagtaaacataatccatgtttacagtatgtatccatgtttatctcctacccagataaagtagtaataccttgctgcctgcatcttggaagacgccctctctcagcgcgtcagaaagtcgcacatagtcaccacccagtagttctgatacatgccatcataaatcatacatagttgaaatcatactaattatactcttttggaaaaaactggcttcttcctctctttatgtttatggaattcaactcttta

SEQ ID NO: 32418 - DNA, 1589 bp, Homo sapiens
gctgataacttcttataatttaatatgtacttaatatacaaaataaagggtagaagggcatagatactttaaaaaatggcataagtaaattgctgtgacaatttagaagggaatagttgctttgggatcagtgatcagggactgcttcctggaggaggtggtatgttaagcttggttaaggtctgaaatcgaggtgagagaaggccctggcaccctgatccagcctttctttgttttactgcatagagattatatatgtgtgaacaagatatgaggataatgttatcacaaagatgtagtctgttgcaaagtagttaaagatgtatgccctacagagacacagattctggtgagcttggtagataatggaattgaatatctaaggtcagcataatttatataaaagttgcaaaacttttgtcataaatgtctcagtaaaatgatcaagaatgagcatcaggaggcaagtggtttccccagtaaccttttaagaattacctttaatgagagcgcgtcctcagaatgtcctagaatgtaggcaaagccctggctgagtaagtaaggaggaagtgtgactgcttacatagattattgttttaatcttgtctcaaaggtctgtatttgtcctttaactgatgaaattagacataaaaattgttagtatacactttttttagtactttgatatgttgaactgcgatattggttttcctttgtttgtttttgtttttgtttttgttttttctttacaaagtactatagtttactatagtcaccaccaagattggaatatacctacatagagtaatgtacatttcattaagcacacaatttttttggcatccaaaatattaaagcctatttcccacattgtactaaaatgtattctgaattatttttaggcactaaaggagaaaatgccattgttgccattaacatggaaattctgtgttgtagcaatctagttatttataatgttcatatattcattcagaaatgaagaatttagaaaaaagtttatccttatctgaattagaataacacagacagctaagactatactaattaaatatttattaattgtagaaagcagaacaatcttgccaggttcagggtgtaggaactgagagggtttgtttcctgtagttgcagttcatgtattaacattgtaagcttagttcaaacagtcggtaaccttcaaaataaactttctcttaaagttttaagaaaatatataggacaaattgattatggtatttctttttgaaaactgaaaattctgatgagttataaaattgtttacttgtcataaggtcaataaaaaatggaaagattgctcacaggttttttttaagagaggagtttactttgctggtacttcaagccacagaaaattatgcatttgagacatctttatttccctttatttataaccacagacatcaaggggctgaaatttctgttcaactgctacatgagtgaaatcactactacatcaaatgagggattcttgaaatagtgattagatactttccctacctcccaagtcttttcacttttgtctgctgtttttactgaattgagaaagc

SEQ ID NO: 32419 - DNA, 1029 bp, Homo sapiens
tctacactttcattttacccactttcccccccccgatcctctcacacagtgttatgtgtgagaatagatttccagactcactgcaatgtctcccatccttcaaagggccccactggcaaccagtctgtgttggctttcaaacggagaaggcatatctggggcacttgatatgcacttgcactaccactggttcccagttttctatgaggtatctatatcagatcatggctaaaatgagtgggaattgcttggcaaatttgtgtttgtttttatctttatatttgcacatactgaataaagataattttaatcctggggaagaggtagaaaaaatctcatgattttagttttctctgttagtattgcacgacataagcaccagagagatgacttttttcctcctttggttcatttgtattttacttgtcctattccaaaagaacagtattgaaatgagacacaggtatcaataaggaaaatttccagagccagaagaaggaaggaactgtcagggaacaattagtgtgacgggaaactatgttatgcttcctcagaaagtatgacaaatatgttacatttacttgagtttctggaaactgcacatgagggatatagcattaatttcctttgtcttgttggtattctgttttaccattcatgaagaaagaaaaaaaatgagagaaaataaaaggtctcagaactcacagagtaaagatatttttctaattgaaagtcaaacttcagagttgtaattctctgttaaagtgggttttggttaaaaattattttctgtaaactaattttataggctattcctatctgtctgttcattagcacagttttggggtcagcaaattattccttatagtttaaaaatattttttataatctttgaaattaacaaacttttatttgatagctattttaagaagttgttacaggtgtaagactttttcttctctaacaaagatgtgcgctgatagagctgaaacacaatatctatgtaaaataaccatggtgcccttcaag

SEQ ID NO: 32420 - DNA, 1060 bp, Homo sapiens
tttcttaacaagagaggaaaggagaaagagagccatgatagtttttaatatctatcaagcatatgctcgaattaatactttaactctcaagagaagataaactttagttttaattcaaacatattactggtaagttaatgtttggatattttaacactgatatttttaactgtttaatgtctttatcatgaacctttactataataaaagtaaataaacacacaaaatctcacactgtttttagagttgacaaacatcattttgaattgctgactgttattgtaactacatgtaaactagaaatgaaacacttgctgaacttaatattgatcgagttccataagattagggccatgaaagcaaagccattgatgttttaatgacaataattagaaaaagtttaggctcagattttgcatcttcatttcagtagcgtccttctgtaagtcttaaacacatcttaaattggactttaagaattataagctaaatgcaagagttctaattgtctgaaggtcgtttgtatgttaaaactgctaaactctaaacatctatgtgctttggtgccccgttttctttgatttggagtttaggatgagagacgttgagctccaaactcagactaagaaactataagaaatatgcttcaatgaagaagctgttcaaaaatggtaattattcctgaaactctgtaacaaaaaaaagttttacagattatttattcaattgccttctcgaatcagaaagttttttattttatttttcctctctaactgttatagagtaagattgtttccttgaggcaagaaagaaatgcagaagtcttgacaaacaaaagaagagattgccttagggaaggggactacagtgaacactgagaacttcttcccacgctaagacaatctttacagagcaagactccgtctcaaaaaaaaaaaaaaaagtaagcataagaaggcaaaaggtggtgtgactcactagcttttgactatataattgaacattaaatcttaaattatttggtcattcgaaaaatgcttatatatgctaaatgggtaat

SEQ ID NO: 32421 - DNA, 1035 bp, Homo sapiens
taaaatcgtacctaagtttcttcctgactaaagggtgttatgagtatataatttggtaatgtatgaactcctggtagagtagttagtatacagtaggctgcccaaaattgatagtgattctacaaagtatgtcatattctttaaagattctaaaagtatgtcatacatgactccaggattgttgtgggtatattgagaggtagtcagtcacaaaacacgatgtgaactctgaagtactatgcacgttttagtttccttattacattatcaataaactggatgcaaaatatcgaaacacacatccatgcagcaaatgacacttattttagtgatcaaatggtcactgttaatgattcacttcttcctcaccaatcttgtccctgaacatctaggcctaggaagttttcctttgaccatcttgctgggctcttctgctggagtcctaggccctgcttccttgtgatctgggaaagcagtccagagactgttttatcaggtgcaatcctagctgattgattcccaagtctctgaagttaaaaaataaataaaaaatgcttcctctaactcagtctcaattgtgactcgtttttatgctgctcagtagaaaggacatcaactaccattctatttactacctccacgagatcaattgttttttagctcccacatatgagtgagaacatgtgatattgtctttccgtgcctgacagatcacctaacataatgtcctccagttctatccatgttgctgcaaatgacaggattacctccttttttatggctaaataatattttgttgtgtatgcgtaccacattttctctatccattcatccattgatggacattttgggattggttaatgagtacaaaaatacaattagataggaagaataagatctagtctttggtagcacaattgggcaattatagttaattaatttattgtatattttgaaatatctagaagcaaagatgagatggggcaaggacccctcataggggcctgctgctgcccctactgaagtataagaata

SEQ ID NO: 32422 - DNA, 1013 bp, Homo sapiens
gcaaagtttttattttagggagacaaaatatatcaaaatatacatcattgcagaaactaaaatgcccaatagctgctttgccatttgcctagtttgatataggcccattttctgctgcttttctttccagaccttctctgattttcctgccagtcttggccatgtcttttcatgcctgtcatttctcttctataattagaatacactgaggatttgtcattaaagtttaagttatatgaagcatccaaggtctttcatttaaggcactgtttggaataaggtagatgacactttccatggacatctggcttacagggtcttcccattgcaaatgaggccccattggaattattggactcattacccagctggccagacttgtgattgaagaggtgggtcctgagtgaggatccattctcttgcaggtgcttctgaagtgcttgttttgtctcagactcctgtggtggttgcattcattggaagactagttgaaaataaataggaaaaggccagtaagaatttctgaaaattccaagttgaggaatatgtagagaaaatggaaatttatttgtcaaaaatatatggaacatattgtatctgatgtaaatctgcatctacacatgaggaagttagaaagaaagataaaggaaataacctgctattaataaacagaacttttctaaatgtgtgctgcttgtattcaatcatttgtgaataatataatttatgtttaatcacacccaaagccttgccaagtaggtcccacaggaatttctctaacgaatacataagcatctcttgtattgagcccagtaattgcttatatgcaaatgattttaagtacttgaacagtttgacttaagaaggataaacattatgtctgtaatcttgtatatgatattcatttgcttagcaagccattttctgatgaattatataaaagcaaactttataatcaactgaatacaaattatcctgagtttggaaaaacaaattaatgaggttttatgatc

SEQ ID NO: 32423 - DNA, 1117 bp, Homo sapiens
gaattttgctcactgagcttctaataaattttagtggaacacatacattcaaaccatagcatctctcaagttcatgttgaaaaaatgattttaaaagaaaaatcagttagaaaagccaggtaccttttctaaaggtcagacgtattttcaaattaaagcaaaatggccaagattaacccctaaccccaaccttaaaaagttaaccaggtttgttctcctcgtgaatgtattctcacgggatgatgctaatgacacttagcctctggggcccctcacttacccaaggcccagagagagtcctttatggtattcataatatttattctttttttaaaaaaagagaagcccaaaactgtataagcctcaggctccacaaaatctgtatctacctctatatatactattaaagtagacataactccctcttggttattgcaacccaggaaaaaagaaatggacagtggcagtgggggtggggggtggtggaggtgcttgtttctattttcaaagactgttatttaaaatgaacaaatgatggaaatatccatgcctgaaagtaaggtgatcaaatgaacacacctaagtgctaaaagaatggaatattttaaagaactagctgctgtggaagctggtacaacataaattatatatacagataaactgaacatattttatggcttttaatgtggatatgtggcaaattccctcttcttcatattttcctcctttgagggtgactttaaggattgtagaagctttttttttcttttttcttggaaagatgtaataaggacttatgaacagaagacatgtctgtgtgccaggcagctgtgagacaaaatcgtggatctccgcactgtaaacccccagacccaggacttacataacctagggaaatgttgtttcagaagggatgtgtaggacagttgaagtacaagaacatcaaggtcatttcacccaagggcagaatttatggtaagtacctactcttacacaaggaacaagagataaactggaaattttagaggtcttcctggaactggggttaatcagaagtcaatatggtagattagcatccaagatggagtggctttggcttccacactccatcccctaa

SEQ ID NO: 32424 - DNA, 1057 bp, Homo sapiens
cttttagctgttctttaagggaatgtgtactatcagcaaattagtttatctttctatgggaatttctttatttcttctttgtttctggagaatagtttcactgattctaaaatacatagttgactatgcttttagcacttgaaaaacattgcaccatattttttctggcctccatggtttcagatgaaaaatctgtcattcaaactggttttccctatacacaatgtactgtttctctctggttgttttttaaatattttgtctttatttttcagaagtttaattataatgtccttgaattgaatttattttgttttatcatatttgagatttgctcagatttttgcatctgtgtacatatgtcctttgccaaaattgggaccctttcagtcatttcttcaagcaccttttcagcttcaatctcttttctccttttgagaatctaatgatatgagttggatcttttgctaattgtctctcaggttcctgaggcacttttcactttttaagatcagctttctctcttttgttcagattgtataaattctgtcgatcactgagtctgtcccttgtcatcttcactgtactatcaagctcatttagtgagctttttcccactagttattgtacttctcagttctattatttccatttggttattattatttacaaattctgctatatactccagacttcctgttttttcatttgttttaagaaatttgtaattgcttgttgaagtatttttaaatcacttttacagttttgtattccatatattcaattcatcattgttccttctcttttttaaaaattgtactttgttgaggtatttttatgatggctgctttaaaatcgttgtccgataattgcagcttctaattcatcttgctgttgatgtgagttgattgctttttttttcattcaagctgtgatttttctggttcttcatataaggagtgatttttaaaattgtattatggacagtttggttacgatgttaggaggctttggttcctatttaaatcttgattttagcaggccaggcagtcatcac

SEQ ID NO: 32425 - DNA, 2433 bp, Homo sapiens
aaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttcatgttgggaccaagtagtttgcccatggcaaacctaaatttatgacctgctgaggcctctcagaaaactgagcatactagcaagacagctcttcttgaaaaaaaaaatatgtatacacaaatatatacgtatatctatatatacgtatgtatatacacacatgtatattcttccttgattgtgtagctgtccaaaataataacatatatagagggagctgtattcctttatacaaatctgatggctcctgcagcactttttccttctgaaaatatttacattttgctaacctagtttgttactttaaaaatcagttttgatgaaaggagggaaaagcagatggacttgaaaaagatccaagctcctattagaaaaggtatgaaaatctttatagtaaaattttttataaactaaagttgtaccttttaatatgtagtaaactctcatttatttggggttcgctcttggatctcatccatccattgtgttctctttaatgctgcctgccttttgaggcattcactgccctagacaatgccaccagagatagtgggggaaatgccagatgaaaccaactcttgctctcactagttgtcagcttctctggataagtgaccacagaagcaggagtcctcctgcttgggcatcattgggccagttccttctctttaaatcagatttgtaatggctcccaaattccatcacatcacatttaaattgcagacagtgttttgcacatcatgtatctgttttgtcccataatatgctttttactccctgatcccagtttctgctgttgactcttccattcagttttatttattgtgtgttctcacagtgacaccatttgtccttttctgcaacaacctttccagctacttttgccaaattctatttgtcttctccttcaaaacattctcctttgcagttcctcttcatctgtgtagctgctcttttgtctcttaacttaccattcctatagtactttatgcatctctgcttagttctattagttttttggccttgctcttctccttgattttaaaattccttctatagctagagcttttctttctttcattctctcttcctgcagtgttttgcatacatcagaagctaggtacataagttaaatgattgagagttggctgtatttagatttatcactttttaatagggtgagcttgagagttttctttctttctgttttttttttttgttttttttttttttttttttttttttttttttgactaatttcacatgctctaaaaaccttcaaaggtgattatttttctcctggaaactccaggtccattctgtttaaatccctaagaatgtcagaattaaaataacagggctatcccgtaattggaaatatttcttttttcaggatgctatagtcaatttagtaagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaa

SEQ ID NO: 32426 - DNA, 1039 bp, Homo sapiens
gtttcctttgtgaatgctgtgggtatgatccacagaaaggctacataatgaaatgatagctttacaattaatttggctgtagagttgtagactagttagcatatcattgcatatttgtttatttagaaatgatttccaattgtggaacctcactaactgcctgcttggcttgttactaatcctagcattcaaagaatcaaaaggaatgatgaatgatggtaagtataaaatgcacttaataattatagatcagttaaaacatggacattggaaaacaaaaaagcttcttgaaaatgtggctcttttttagtaaaagggacactgtcagatgataaaggttcacatttcttgatgtatacaacttaaatctactttgctaaaaattgcaaaactactactgtaaaaactgtagggtgtcacgaatcagactccagtcatatggctcccagcaaagagaaattaccactttttgtaaaatgtttttcagattccgtgtctggtgactgtaactttaagatgccttttataaggcacataaataatctggcacaaatctttatcattttgacagagtttcttttatgcttgtgttggtgattttgttgcatttaacccatggggacttaacatctctgcttttccaatcaggagcttggttctaaccttttgggagatgattaaagagagaggttgagagagagagagagagagagagagagagagagagagagagagagagagatgtttcgtcctcagcttttgcttccattttttttttaagaactctgggctaataacttctaatctttatagaatatttcaaagaaatatatttgttcttaaagatacataggtttgagatattgagtgctacaagcatttattttggttttaccttaacatattatgattcctcagttttgttggcatttagtaattatgtttatgtttttatcttatcaaaaaatgtcttcttacctttgatatttataatcactcctcggtcatgtaaatagtttgctttatattttactgtttt

SEQ ID NO: 32427 - DNA, 1033 bp, Homo sapiens
ttcactttcccttcccatcaccaactttctgggtttttttctgtttcttcttagagtccagtggcagggagaaacttgtcagtccagtctgttgccatttttcctgtttgagaaagactcaccagcttttggctggctcacagattggctttccttgggtcaggacccacccttttccctgccagctttggaagcttgacagaattcgagtgtgcagtggtggtaaataaatagtaaggaacacagagcagtcctggaggcgtgcctccatctgctgatgagaaaatccagtgctgtcatccagcccaggtcccagcggaatgggcctctctgttcagtaggatccccctcctgctgagtggttcatggcatgtttctgttcaacgcttttccatctgtaggattcttattctgtatttatttgtttttttgggtttttttattttttgagatggagtctcgctctgtcgcccaggctggagtgcagtggcacgaccccagctcgctgcagcctctgcctcccaggacgagggagatcctcccacctcagccttccacgtagctgggactacaggcatgcaccacaggcatgcaccaccacgccagctaatttttgtatttttggtagagacagggttgcatcatgttgcccaggctggtcttgaatgcctgagctcaagcaatctatttgccttggcctcccaaagtgctgggattacaggcatgagccaccacggccagccttctcatttgttttttttataaggaagctatctcttcttccctccccaactagggtattctttttccctttcgtcactttgctcatgtactgtattccttcaacttcattaatgaatccatttggaagcagtgaaaaaggcaactcagaaagctaagaagaaatagatagaggaatactcagagctatctgagtattttctttagtttgttagctctttggagctttgaaactggaaagacccagggagtgatgtggagaaagagactgagcttgtaagacacaggagca

SEQ ID NO: 32428 - DNA, 1047 bp, Homo sapiens
actgagagaatcctggatgcccttctccattgtgtgccccccccccccacccgccccacatatcagggaacaatttaaaatcctggcacaataatgagaagggagagtgacaaactgataagttccagttaagaatcacttagacaggccaggtgtggcagcccacgcctgtaataccagcactttgggaggctgaggcaggtggatcacctgaggtcaggaatttgagaccagcctggccaacatgataaaaccctgtctctaccaaaattacaaaatttagctgggcatggtggcgcctgcctataatcccagctacttgggaggctgagacaggagaattgcttgaacccgggaggtggaggttgcagtgagctgagaccacaccactgcactccagcctgggcaacagagtgagactccatctcaaaaataaaaaaaaaagaatcacttagacagtattttttgttctgtaatcttcctctctgtcattgaaatgtctcatatttcttgtttcacatagaatctgggagtcatcaagtagtcatctagtctatctcatcatctaatttacgaattatttctatcacaccccaagtagctggcgattcagattttttactgaaagcttgacatgatgagacattattacttcccagaggatcttggtctgttatcaggcaatttcagttcttccttaaatcaagctaaaacttgctactattctcactcactgggagggctgtagtatttctctcaagtttatacctctctgtgatgaaaatctctgttcttttagccattgctcatggtttcgggatccccattctagtcatcttcctttggagcaattccctgttagatcttcaaatgtgatgagtaaaactgagctcaggactgcgtttgttggtcacacccttctcccttccaaatgactgctgctgtaactttctgacaggtcctgcttccctgtaatccattctccatgtggctgccaaagaagatttgaaataagtcaggttatttttcttccctatttaaagcctt

SEQ ID NO: 32429 - DNA, 1082 bp, Homo sapiens
tacattcagagacaagcagtttaattaataaaatgagacaaatttttcattctttcaaagttttagaattttaaccaaaaaataaaatcactagactttgaaagcaccagttctttgtcccagcagtagggatctaaaagctttcctttgggatttgtgccccctattttctgatgttaaagaaggctagtaaggacagttgcaaacatcagttgaaggcatattttttgtcttcagcagacaaagttgagaaagagaaaaaagtagaagtaaatttgagatacttctatactttcagaagtcctcaaagactaaatagaaatctacactttttgatgttatttgttaaatgtattattccttcatatacacaattacttatgaatattttaactatcaaaatgatgtaaaactctctgatcaaagccaccatgtatttgtctaatattaatattatataattgattgttagtttctgacatactccagttgagtgtactgtcttacgggatgttaatccttattcatcattgagcttcatgctctactttgattgatttttggttttagaacggactttctctgcggagcatgcaaattagattgaccaagagcccctctcctaaactgtttaggaatgaccaaggacagtttttattgtgaaccatgcccatgcgaggtacacagtcagtttgtgaaggttaaggtagttcatcattttgtagtacttagttaaatacatgctgcctattagggacataaaacagctacagttaaatgtcactttcacaaatgtattcacaaacaaggagcagggttgtcataaaatgacctgcagaaattgcaaacacaaagaggtcagtcgtatttaatctgctgctgctttgaatttgccattaaacaaaatgtttttcctctcaggcaaaggagcgataccagcagggaaatggaggagtgacggaaagaaccagactcctctctgaggtacacactgatgctcttgccctgcttctcacctgtcagctgggccccagccattgagaacctacaaatggtttaacactgctaatttcagttgcttc

SEQ ID NO: 32430 - DNA, 1047 bp, Homo sapiens
tctattattggcatataggaatgcttgtgatttttgcacattgattttgtatcctgagactttgctgaagttgcttattagcttaaggagttttggggccgagacataggggttttctaaatatgcaattatgttatctgcaaacagagacaatttgacttcctcagttcctatttgaataccctttatttctttctattgcctgattgcccaggctagaacttccaatactatgttgaataggagtggggtgagagggcatgcttgtctttttccggttttcaaagggaatgcttccagcttttgcccattcagtatgatattggctatgggtttgtcataaatagctcttattattttgagatatgttccatcaataccaagtttattgagagtttttagcatgaaggagtgttgaactttatcaaaggccttttctgcatctattgggataatcatgtggtttttgtcactggttctgtttatgtgatggattacatttattgatttgtgtatgttgaaccagcctgcatcctggggctgaaactgacttgatcatggtggataagctttttgatgtgctgctggatttggtttgccagtattttattgagggttttcacattgatgttcatcagggataaaactggctagccatatacagaaaacagaaactgtaccccttccttacaccttatacaaaaattagctcaagatggactaaagacttaaatgtaaaacctaaaaccataaaaacctgagaggaaaacctaggcaataccattcaggatataggcatgggcaaagacttcatgactaaaacaccaaaagcaatggcaacaaaagtcaaaattgacaaatggcctctaattaaactaaagagcttctgcacagcaaaagaaactatcatccaagtgaacaggcagcctagagaatgggagaaaatttttgcaatctatccatctgacaaaagtctagtatccagaatctaaaggaacttagacaaattacaagaaaaaaaaaacccatcaaaaagtgggcaaagga

SEQ ID NO: 32431 - DNA, 1056 bp, Homo sapiens
tatattcctgccagcactgtgtgaagttccaattgcttcatatctttgtcaacattcagtagtgttttaatcttttttattttaatcattgtggtaggtatgttatgatatctcattgtcattttaatttgcatttcccggttgacttatgaggttgagccactttttcataagcttatttagcttttggatatcttcttttgtgtttagccatcgggccatctgcttttccttttgatttatagaagttctttatatattcaggatatgaatcccttgtcagatatgtgtactgcaaatatctactctagctgtccttttcctttttgtattatgataaacagtgacttaactttaatatactcaaaatgattttttttggggggagcaagtgtggctaatacttatgttttaagaaatctttgcttaccccaatattatgaagatattctcagactgttttcttttttaagctttattgttttgcccttcagaagatttgcaatccatctaagtttgattcttgtgtatggttgtgaggtagaactcaagacttacttggttttcatatgtatacacaaccaacccagacagtttactgaaaaggttattctttcaccagtacactgctttgtcataaatcaagtgagcatgtatgtgtgagtctgtatctgtactctgtattttatcactttagtctatttgttgttatttgatactattgaaaatggtttcttttaaatatattttatgtttatttgttgctggtatatagaaatacaattttttatgtatatctgtatctagctgtgtgtgtgtgtgtgacttgttaaattcactttaaacagtaggcctgtaagttattttgacttttctgatttataattatgtcattcgcagataacatcaatcgtcattctttgtgagccttttgtgtttttactttctcttgcctgctatactggttaagaactgtagtcttattttgggtgtaagtggtgttatcagggagaatgcttccagtatttcagtttcaccattaagtatgatattatc

SEQ ID NO: 32432 - DNA, 1046 bp, Homo sapiens
tcagaataatatgttaaaatttaaatctaaactccagttatatcaataccttacatttgcagatcgttttgtagttttcaagtactttaaaacacatttctttactgaccttgtaaagtatttgggtagatgttatctccattttacaaatataaacactgaaatttataaccttgggacagtttaatcttttaagaagctaataagtcacagtacctgaatttaaactgcttctccaaactccaagtctattgctttttccgctttacctcataacaagagttgaacaaggtgtagatatgttttgattcctgcctttagcaagttgtaattagtaatgttggtgtttacttaatgtgtgtgttggagatgatgatgaccgagtgctcctcaaatgtgagaagaaaaataaaagtagagatgcacacagttattcttggaaagaaactgttgtttgtgttattcattcttatattgatggtgtaaacagagaactgtgaaggccacctgggattccttctggacaaagtagtttgagtactgagaaggagcaaagtaaattaatttgcttctgccagtacaccaattccttattggtcctgatttcaatttttcatcgcaaactacatgaggaagggtttttccaaatggtgtttttgtaaattatctaagtattagattctttggacaaaaattatataacataactcctttagagctaagactatgtatagttgtatttccacaagaggaagaagagtgaacaccaggtgtttgtggatggtcaaccatggagtactaatgaggcagaaaaccctttcatattttaaaaaacctggcaagctcatgatattgcccactaaagccatctgcctgagacagctgtgtctgactacagcttatgatggtttgggctgctctttccccaagacaaaattgctatataggttagtatcatagatttaagattttatgtctcatgcagcaggtggactcacaatgcagaggaaatattattttaggaaagttgagcatgatgaattctt

SEQ ID NO: 32433 - DNA, 1035 bp, Homo sapiens
tgataaaaattgcaaattttttttcaattagctgtcatttgactttgtttatggtttagcttttctgtgaagaattttttatttgtaattttttcatcatttttattattgtgacttgataatgttttagtattttataggagcaatctctcatatttatttgagaattttcctgtacacttgctcatttatttttctatattatttattttagactcatcttgtctagttaaaaaatagtgttgacacttgtttgaataatgttaggtttataggtttttagattaggaagaattgacatctctatgatgttaaattatcttttctaaaacatagtgtatcttttcatgtgttcatgatcttcagtagtactttatgaccctcaataatgctttatttgaatatagtttttataccttgttaagttttagctttttgtcattgttcattatatgttcattgtattcataaaatatatgaatatacatattttgtacccaaaccaatagtgaatttacctgaagaatccaagagaatcactaaaactactataaataataaacccgttctgtcatctgtaaaaaaatttacattttcatatccaagttttaaataacatttctcttatccagatcatttttttaatatgatgaaaaaggaatttgctcttggtgttaatggaagcaattttagtgttttcccattaagcacaatgctcacttttggattaagatatacgtgttttaacttgttaagtattcatctatttctattttactaaaaatttttattaagactgggaatgattgtaccaaaatggaaatggaattttatcagatcttttcgatatctataaagataatgtgacttttttctcttttttttagtatcatatcagtcgttataggctagtttgtgcttcagtaactaataaccttaaaatctcagtagctttaaacaacatggtttatttctggctcatactccatgtcagtggaattccatactttccttcctcccagagccaggctcata

SEQ ID NO: 32434 - DNA, 1046 bp, Homo sapiens
ggaaagactctggctgtcaacatcagtatgttcacctctttgcatgcaccaatacaaagtagtttcttcagtgtaacactcctgtttttccttttggaaataataagtaatttgtgggcagatactgcatataggctgtttctcttccaacttgcatctgctacttttagtattgttgataattcttacttgaatcagttattaatttgatggttggttgccaagtggatattttcctactttttaaaggtagaaaattgaacattttggtaattttataatgtactgaaaatagcagtctatatgacatcacccatatcattcacgaaattaaaatatagtacttagagtttttcagttaatacagcatttactttttttgcatattcttacaagcaaagcatgtgagatttgctttctgtagtttaagaaaataaataggcatgttaagcatattgatttttttttaactacaagaactttttgatattatttttctacccaaaccccctaatttgagaattgcctatttaaatcatgacattcaattcatttggatcatcactttaccttggctctcagtgattaccaataaatattaaatgagtattacccataataaagtattttggattaagaaaataattgtacatttccagccttcactaagtttacattctagataattaacttttaaaaattaaaacttggtcactgctcatgcctgtagtcccataattttggaagcctaggcaggcagatcatttgaggcaggggttccagaccagcctgggcaacaaagtgacacacgtctccacaaaaaataaaaaaaaattagttaggtgtggtgacatgtccctcgggctgcagtgtagtgagctgtgattgcaccgctacacctcagacatatatatatatatatggcctatttttttaaaggcagatgtttcattgattttttatgttgtgaataatgagcatgataagtccttgaaattatatacctctgtactccataaattgagagggaacattgtgaactcaaa

SEQ ID NO: 32435 - DNA, 1163 bp, Homo sapiens
aagtttaagtggatagataagactgaagaataaaagggtctataaaataaaagagacaaaacgttaaagaaagaaatgaatgaatgaaccaaaaattctagggaaaatcaatttatctttccaatttagacatcttgagacagcctagcctagtgctaccctatacaattttctgtgataatgacagtgttctatgatgtccagtcccatagccagtggctaaaagtggccattgagcacttgaaatttggcctttgcaactgaaaaaactaaatttttgattttattaaatttaattttgataaccatcctgttagataatgcagatctgtcccattctcacaagtatgtgtttaaagaactcaatttgccttttcttaaagatctatataaataattaccccattatatatatgtagtagccctttcttaatgtaattttaacctgtttatttctaatcttctctccctaaagaagaaagtccgtactgcagctttgaagaaggtgagtactaatcatcatccttcatctctttctgtctcttgtaacacctttcatattgtttctgttgtttttctgagtgcctttactatatcagttactttttttttcttgttggactgtgtacctcatattaaaaaagcaaaagtgtgtgtaaatattttttttctaaaaaaaaaaatttaatcaaatttgaaccaccaccatagtcagggttttgtatgtgtgtatgcatgtccatttcctaatggaaaaaacaaaacttaggaagtgcatcattatattaggattactcgcatcctcttaaaattttgctggggagagtttgtctccaaagtatacattaacacagttccgttactatttacacttgccacttgaacaaatagacacatctcataaaatttggttggttaaagtttatattaaattgttcattaatttaatgtcaggaaaaaaagaatgaaactgtatgctgtgtcttaggaaattatcaggtcagtgtccatttgggtctatttacttatatattataaggactagttacttaagaataaaaagagattctgtcatgagttagcactgtcagttaaatgaaaatatgtttgaatttctacttctacctttggtcattcattcatatgttacaggtacttatcaa

SEQ ID NO: 32436 - DNA, 1034 bp, Homo sapiens
aagacaagttgaaagtgtattctcaatttgtattatattgtttaatgattattcattttaaacttaccatgtaattgaattaactgaagtataatatttatagtatgtcttgaaatggttgttgtacaataaaaaataaaagcatcttaaaatatatgtatagagaaaacattaaagttatttttcttctcaattcttcctcctcccccaaccccaattccttaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagttaatttgtgacttcgtaacaataagaagttattatctaatttagtaaagaccctgatctgttgcatgttttttatttgatagtttgaatagaaatttaattttctaagttttactttttgtttctggcttttatggcttaaggttttctttggttcttacattagaaaatcatttttaacctccattatcatttttctaaggttctttcctttttcttagttgctttctattctgttttgcctgtcttatttattctcatttgtgattatttagatcttaagaccaaactttcttggtataacagtcctaaagattacaaaataaaaatatagagagagtaaaagtaaaaagtaaagtaaaaagagagaaggtatgattttactgctagagaagtttgtctctgaagaagcacaaaagaaaatattagtgaatttaaaataatttttatactgctgtagcataatttctaaatttgaaaaaaatgcaatggtaataaaatgtataaaaattagaaaactgtcattgtgttaaactattacatttaaatgattacattt

SEQ ID NO: 32437 - DNA, 1057 bp, Homo sapiens
agtgtatatatgctatataataaatactacatgattaggcacagttcatctcattaaaagctggttgcacacatacaatttaaatgtttctagagaagagaagcttatccatttctatcaccactattgaagaaaaacaaatctacattataactgctttgacttataaacacagatgtctgtgttttgagacataagctatttatattaaaattgtaacgtgagttggcatctagtctcaatctgtggaggaaacgttctacaaaaattaaagctgtagatagagtctatttaatatagattcaaagctcttcatatttcattgactctaaaatgtcatcaattgtaagaaagaaaaacatcacaaattaaattgacatgcagttttagaggtgataaaatgtgaagaagggtatcttctaattgatggactacatgtgtgtttcaaactgcattcaagtttaagatgactaagtgaacaaggttgataaccatgctctgagacagaatacgtagaaatgtgtgaattgagagaagagccctaaggttcttacattactttacatgtgttttttaaaaaaattgttttaggaaatggaaaaggacatgctcagaatgtgcctgagagtccattattttaagcaggcaatgtttttatatctttatatttataactattttcttattctcagtgcattcaacttctacagaagttaacatataatgtcaaaattttctattctggtgccaatatagatgaattaattacgttcctgatagatcacatgtgagtatgcaatcaaacataaaaccaaatagtttatttgtttatttttaaattacaaccatgtggtagattaatttttcttagataacattttctaacatataaactgagtgagactccgattcttatttgttctgcccagatgattttaaggatcaaaagttgtaaaagtatgtgacctcattcattggtgaaaaaatgtaaaaaggaaaaaaaaattgtaaagcaactttaattttcataagaaaaatttatggactgaattgattt

SEQ ID NO: 32438 - DNA, 1032 bp, Homo sapiens
gtttactcatctgcaaaacaaaatagtggtacctaccttatagagttattatgaagatgaaaagagttcacatatgtaaagtgcctagatcgatgcctaggccagagtaagtgctgtataagtattagttattattaaaataaattatctttgttttaagagattcagtataagtaaagggaaaacttgtaaagcaatttttattttacctagtgcatataattattacatgttagacaatttatgttaatgagatacaggaccaatcctatagagaatcatttttaaaacagcaagtgtcttattctggagagctagatttataaataagcaacagggtaatgcccacagtatttcctaccccagaatatctgttactggcatctgcactttcatatttggacttattttttcttgtatagacttttactttagtaatgttaaaacactccttgggaacagataatgtgaaactcttatcagcaaagccttagaagaaaaactgatgtgggtgagagaataaagggaggatacagaaaggaaagattagagggatgctaaagcagcctgcttaggcttgatcttattaaaataagtattcaggacagagttagtcttattctaaggtaactaatggttttgccatctttgtagaaaagatatgctttgtaataaatacatccataaagtatgttgaaaattcatgctttgagacaactgcttttggcctttagttccagctttacctcctctcttctctctttcactctgtgtgtgtgtgtgtgtatgtatgtgtctgtgcatgcgtgtatgtggcttatagattacaagaaagtaaaaaaaacaatggaataatcagaaataaaatttttcaatgccttgcctggctacttaaaaaaagattcacttttcacttccttctttaatcccttaacttctgagctcacctattgtctttgggaagaagcagaaggaataatcccataactaccctctgggcttcatttttcattctcctccctcaaagtaagt

SEQ ID NO: 32439 - DNA, 1089 bp, Homo sapiens
catagtaccttaaaaaatcattatgtttgccacattcaaatgtaattggtattaaagaatttttaagtttcattttaaattaaacaaaaaagaaaaatcacaaaattatttgagtggatttaaaatgagttgcctcaatgctaaaaggcagagtgccttcttacctccaaatgaccacagtagctccccactaatggctcttaaccagattgaaatggctgaaatgataacatagaattcagaagctgggtagcaattaatatcatcaagatttgggacagagttgaaactcaatccacagaatctaaggagttcagtaaaatgattcaagagctaaaagatgaaaaaacaattttaagaaagaaccaaactgatctgatggagctgaaaaactataagaatttcataatacaatcagaagtattaagagcagaatagaccaagctgagaaaagaatatcagagcttgaaggccagttctttgactcaacttagtcagccaaaaataaagaaaaaagaattttaaaaatgaacaaaacatccaagaaatatgagatgatgtaaaggaccaaacctatgactcactggcatctctgaaagagagggagagggagcaagcaagttcgaaaacatatttgacgatactgcccatgaaaaatttctcaacctcactagagaagtcaacattcaaactctggaaattcagagaagccctgtgagatactatacaaaacaaccatacccaagactgtcatcatattctccaaggtcaacatgaaagaaaaaatgttaaaggcaatcagagagaagtggtaggccacctacaaagggaaccccttcattctaaaagtggacttttcagcaaaaaccctgtaagattgaagggattggggcctatattcagcatccttaaagaaaagaaattccaactaatagtttatatttaaccagactaagctttcaagcaaaagagaaataaggtccttttcagagaagcaaatgctaaggaaattcactacgagacctgccttacaagatgcccctaagggactgctaaacataaaaatcaaaggccataactggccaccac

SEQ ID NO: 32440 - DNA, 1028 bp, Homo sapiens
cattgcattagctgcattaatttcattgttattcgactgtaaatattttcttatttttatcacttcctttttgatccataggttttttagaagaacatagttcattttgaaatatttgtggcaattttctgatatctttatgtaactgaattctagttgaatttattcatgaactgagaatatttgttgtatgattttgattttttatatttgctatgatttgttctgtggcctataatatggtcgattttagttaatgtttcatgtgcactggaaataaatatttttctcttgtttggtagagtgttttcttaatgtcaattaggacaggaggttatagtgttggtcaaatattccatatattagcttattttctgtctatttgttctaccaattttggggggaagagttttgagatatctaagtataatgtctgttttgtctatttctcaggtttctttctggtttggctccagctattttaaagccctggtattatgttcatcaacaattctgattgtaatctctttttggtatattgacatctttatcattatgtaatatccctcttcatccgtactaatatttcttgttataaagtctattttgttttatattaatatagacactctagctttttaagtaatgtttgcatagtttatctttttacttattgtattcttttttttttttttttttttttttgagacggagtctcgctctgtcgcccaggctggagtgcagtggcgggatctcagctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgcgccaccttaaccagttattttatattcaaaatggattacttgtagacaacatatactt

SEQ ID NO: 32441 - DNA, 1057 bp, Homo sapiens
aaacagaaagcagtaacatcaacatcaacaaaaaaggatgcccacacaaatacaccatcgaaaggtcatgtgcatcaaagatcaaatgtagacaaatccatgaaaatgaggaaaaaccagagtgaaatgtgaaaattccaaaaaccagaatgcctcctctcctccaaaggaacacagctcctcaccagcaagggaacaaaactggacagagaattagtttgacaaattgacagaagtaggcttcagaaggtgagtaataacaaactcctccgagctaatggagcatgttctaacccaatgcaaggaagctaagaaacctgataaaatgttacacaaactgctaaatagaataaccagtgtagagaagaacataaatgacctgatggagctgaaaaacacagcacgagaacttcgtgaagcatacacaagtatcaatagttgaatcggtcaagcagaagaaaggatatcagagattgaagataaacttaatgaaataaagcatgaagacaagattagagaagaaagatgaaaaggaatgaacaaaccctccaggaaatatgggactatgtgaaaggaccaaacctatgattgattggtgtacctgaaagtcatggggagagcggaatcaagttggaaaacacaattcaggatattatccagagaacttccccaacctagaaagacaggccaacattcaaattcaggaaatacagagaacaccacaaagatactcccagagaagagcaatcccaagacacataattgccagtttcatcaaggttgaaataaaggaaaaaatgttaagggcagccagagagaaaggtcaggttacccacaaagggaagtcttcagactaataatggatctctctgcagaaaccctacaagccagaagagagtgagggccaatgttcaacatttttaagagagaattttcaacccagaatttcatatccagccaaactaagcttcataagtgaaggaaaaataaaatcccttacagagaagcaaatgctgaaggattttgtcaccaccaccagacctgctttacaagagct

SEQ ID NO: 32442 - DNA, 1038 bp, Homo sapiens
aaatttatattgaaagttactttagccttgaaaacaagagttcacctttaccaccactgactatgatagctggtagctccatgttctgaaagtaaagccattaaaataaggtattattattcattagactgaaattgaactatgatatgtatctctgacatcagcctgctgttcttcacagaccatcatggtaaaggaatgcatagaacattcccaatagagcttttctacttgtcttctgacaaagcaatttaggaaaaggtaaatgtagccaaataattatgtgtctatgagctgaatgtaactcttaatcacctttaaaagtgaaatattcacttagtactttggtggtataaacaccctattttatggactaagctctcttctttctaatggatttatggttagcagattacgtgctagttaactgtatttaccattttttttatagtgccgtgctataagcggtgcaaacagatggaatattcagatgaattggaagctatcattgaagaagatgatggtgatggcggatgggtagatacatatcacaacacaggtaagaggagaataaaatgacatatatttagtttaaattaaactctttcacaatcttttataatagccttgatttaaaaaagaggatacataaggcatagttttgtcccaatagacttacatgaaaaaagcaggaggacaaattttaaaaaagaagcctttagagtatgccaaatttatttctttttttgagacaagagtcttgctctgtcaccaggctggagtgcgatctttgctcactgcaacctccacctcccgggttcaagcgattctcctgcctcagcctcccgagtagctgggactacaggtgtgcacccccacgcccagctaatttttgtatttttagtagagatggggtttcaccatgttggtcatgatggtctccatctcttgacctcgtcatctggctgcctcggcctcccaaagtgctaggattacaggcatgagccactgcgcccggccagagtatgccaaatttct

SEQ ID NO: 32443 - DNA, 1045 bp, Homo sapiens
tacaagatttctgacataactcactggaagttctgtctcctcatcacctccaacaatcttattactttaaactgaactcgcctgaaagtgtaaaaccagatccagtcacgttaagtcactttaagaatctctctacaatttggttatcttagaactgactgcagcacccaacctctgttatgaaactgaatcattttagatgtttcgaacctactagattgaatatgaagtctcggaaggctgtgtttcatgattgcagcaaatcacctgtaatatattttgttttaggaaaatttgatttgggggtatcctgaatttttagcccttggcaagaaaaactatcattcagcaattcatgagaaaactttgttttcttgatccttagaaaataaacttagatgttattaagtgttctctgagaggatgcaggagaaaaggacattttgtcagctatatcttagaatagaaatgcaaatttcagttttggcattgttgacttcataaagcagtgttttgagggctcaggattcaggaaatacaaacagacatggcagagcagtttgctttgggttggcagaaagcaggaaaataaccagccttcttggattgcccacagtttttgtagactcctcagttctgagtggagcagaggggcatgcttaataaaacagtcaataaagaggcttttctttaaagatttctgcaactccgtcagaattctaagttttccccatagtttctcatgtcccctgccattttctttcaggttttacttgggccatttgctggttttgatatagatgaggagataatgaaatagatttactagagatcatctttaacaatcacctttgattatgcataacattttaaactaattgaagagtatccttttggtttgggggtaagtgctcattgaagttcatggctataaccattgcaggataatctcactgacatttggaatcctgttagtaacagagcatagctctttagattaagagctctgtattaacgagctactcattgaggctgttccaggata

SEQ ID NO: 32444 - DNA, 1053 bp, Homo sapiens
gatatacctaattaatatttacccaatccaagtcttgccctctacaaacctaacacatgtatagcatattccaaactctatgttatatacttaacaatattacctgcaaaaaggccagttgtttctcttggtcttctttgctttatattttctttcagaaccctggaaatggtctaagctaagtgttccaacagtttggtcctctgaagaagagcatcagcatcacctgggaacttgtttaaaatgcaggtgctaaggccccaacccagttgtactgcttcagaagcctgaggggaggggcccagcagtctgcattaaccagccttcccggggattctgaagcacactagagtttaagaatcactggtctaaacaaaagtcccaaagtaagaaacaatgttgtttattccatgaaaagtgaattaggaggattgggaaggcttataattgaagattagatgtgaaaggaagactagaatttgaatattgaggggtctttttccactgaagaacttttgagtgaaggatcaaggcagtgtttgagaaggttaatacctaacccaaatcttcacagactgagtagtcagtcaacatttgttgagtcgatgtgctttgatcagtccagatacattggagaggaaacagcttagaggcaggagatcagctgaatgggagaggaagttactagttatctgtctctttacacagtatatgtttacatgtatggcctcttcacataggatatttcatttaatccccaaaacagtactttctaaagctcagaggagctgagtaacttgctgaagctcttagagctaatgcatggtgaagttagttttgaaattcaggtctgtctgcctccaacgctgactccattgcttcttacaatgatgtaggcaggaattgggatatagttggtgacaacaaaaatgtgtcaaatatcaaaagccatctcaaagtaagaataaccaaaatttgattgagtctggtgaggagaaggggaaagtgaggtgacttcaaagtaacccactggaatgactgggcatgagttgg

SEQ ID NO: 32445 - DNA, 1025 bp, Homo sapiens
ctcgaagtacttcataatgaggagaataatacagtatttgtctttttgtgactggcttattctatttaggataatgtctttcaggtttatccgtgttgtagcatgtgtcagaattttcttcctttttaaggcaaataatattccattatatgtacatgccacattttgtttacacatttatttgtcaatgggcagctggattgcttcccattttttggctattgtgaatagtactgtgatgaacatgagtgtacaaatatctctttatgtctctgcttccatttcttttggatatgtgcccagaattgggatatatggctggaccatatggcttagaagtggtgaataacactgcagttagcttgttgcctttctccatctctagatccaatggggaagaagaggagagcctagaacatgagggtgagaaggaataagttctctccattctagggagagcacagctcacagccatggggaaggtgggtagtgagtgttccagaagactttatgtccctactgagcattagctgctggcctcttcagcataggagaaggacactgggctggctccacaatggagctggcagggatcagagtacatgttctggtatatgaggctgccatgcaagagggcaaccccttgtatgggggtggggctagctgaggggaaatcaaagctctttactgagagaggccaggcaggcagccacaggccagcacacacgtgcacatcatctattcatcgtttcatttgcgtcactgattagatggccaccacattatacatgtccgtggggcattacttacatagaatagaaagtgaatagcccctcctggattgtgcataatggcagccatgccaattgtactattctaattcaaatgtaaattgtaacaattatgccccaatacaaatttctgcactataaaagaattgaatcatcttgctgcatattaaggccttcaaacttctcttaggggacagtctggtcattgagaaagtcctgttacaagattatgtt

SEQ ID NO: 32446 - DNA, 1068 bp, Homo sapiens
ggcgagagccacagtgcctggctatctttttttttttttttttttttttactttgtctagtgtatctttggatacagatgttttaaatcttaatatagtaatttttttaatcaatctacttatttatggtttgtgcactatgtgtatgtgtgtgtgtcttgcttaagaaatccattcctattttgaggtcataaagatattttttggtccaaccattccactactgggaaatgaaattagtaatcagtatgcagaagagacatctgcagtcctatgttcactgcagtattattcacaattgccaagacacggaatcaacctaagtgtccataaacagatgagtggctaaagaaaatgtggtatatgtacacaatgaaatactattcagccttaaaaaagaaggaaaccctattatgtgcaacaacatggataaacttggaagacaatatgttaagtgaaataagaggcacagaaagaaaataccacatgacatcacttatatgcagagtataaaaaagttaaactcatagaaacagaatagaatgatggttaccagggtctgtggttgtgggctggggtacagtttggggagatgttggtcacaggatacaaaatttcagtgagatccaaagaacaatttcaagagatctattgtatactatgatgactatagttaataacaatgtgttatattcttgaaaattgctaagagtaaattttaagtgttctcacaacatgaaaaagaaagtatgtgaggcaatgcttaagttaattagctcaatctatcaatctagccattccacaatgtgtgtgtatttcaaaacagcatgttgtatatgataatatatacaatttttgtccatttaaaaagatcattttcagtagtttcctaattagttgtgcccttcacatttgggtttttaacccacttaaaattgaggtatatagtataagatgtatggtataaagataattatcttttaaaatactttagtaatatttgatatgtggaacatacatataagcagtggagtattacaacagaatgaacccacccacccaacttat

SEQ ID NO: 32447 - DNA, 1034 bp, Homo sapiens
tgctgtcccagggtgtgtctggagatatcatctgggacctagggcctggaataggggcctcacaactcttcctggtgccctacctactgtagcttagctggtatccaagttgcaagaccaagtcctctttatttttccccctcctctccttaagcagatgggagaattatctcccagagctgcgagctgtgctgcctggggttgggcaagaggtggcacagacactctcttggccacccaggctggtgtctcactatattgcatgccctccaaaatccactggctctgagcccagtacagcaccaggacttgtctaggaattgcagtccttatggcctagactgcctttcaagtttatttaggatcgcagagcactttaggctatggtggtgaggcttaccagaactcaggttctgactactgggctgaaccattcccctctgactcgggctggtctaaatactctgtctgtgggcactggctgagttgtgcccaaagctgctttctgttgtgacaggcagcactgtgttctgatgcagtctcacagttattgctctgtccttcccccaagtacccagattatctcttcatgccacacagccaccagagtggtgtcagcaattcaagactgtctttcctaccctctgcagtgcctctttcagtgatgtaaagttaaaaccaagtattgtcatcactcacctgatttttgattcttagcaaggtgtttttgtgtgtgtgtagatagttgttaaatttggtgttcctgtggggaggtcaattggtggaggcttctaatcagccatcttgctctgcctcctccctattctagccttgtccctgcctctaaccaccttgcccttcagtagttcaggaagacttattgattgtacaacctaggcatctcttcctctgtatcttctttgttcttcactgtttcatgtaatatgcttttgaacttgatcttctttgccttaaatgacaaacacaaaagaagacagcaatagacaaaagacagacaaaagacctacagacta

SEQ ID NO: 32448 - DNA, 1029 bp, Homo sapiens
catacctgagactgggtaatttataaaggaaagaggtttacttgactcacagttctgcatggctggggaggcctcaggaaacttacaattatggcagaaagggaagcaaacatgtccttcttcacataatggcaggaaggagaagtgcagagcgaaggagggaaatgtcccttatacaacatcagatcttgtgagaactcatacaccatcatgagaacagcatggaggtaacagcccctgtgattcaattacctcctaccaggtctctcccatgacatgtggagattatgggaactacaattcaagttgagatttgggtggggacacagccaaaccatatcactcttcttaaattattttatttttttagtacctcagcaaacccctgctccagctgtggaagaagcagaggaggaagttaagaagaaaatatcagagagcttcttctatgattatatggagcttgcttcgatgccttttgtgactctggattcaaacataccactggatcttctcacacttgtgtatccaccctggctaaatatgtataattttgggattttcatttcttaggtcagaggtcagcaaactatagcccagggagcccaaatgtgccttcccacctgttttggtaaatcaagttttattgcaacacagccacatccatttgcttacattttgtttattatggctgccatcacacaacaaggacagggataagtagttgtgacagagaccatctggctcacaaggcaaaaactatttactaccttccctttataaaaaaatgtgtgccaacccatattaggtaattctaagaagcttgaattcttagagatttgatagaaatgcatgatcttaatttaaactaagcttttgtttgatgccaaataaccatacagagaaatattttttctggctgtcctttgcacaagtggaaaggctgcagttcatgagatctgagtgaaggaaatcagaaggcttcttcttcccatttacttttgtcagtgcctgtcaagttacataatc

SEQ ID NO: 32449 - DNA, 1030 bp, Homo sapiens
ggattctcatgtagaatgaataaaagtccttgtattccacccaagcagagaagttggagtagactttttcccatacttaacaagaggtttctgctatctctgagttctattaagaaatttaggtcgagtgtaccagctaaaccatccatcatttctcacgatggtgaaggactgttagttactaaggcattgatttcttatgcttatcaaaggactaaattattgcagaccttatttaataattttgggaggtattttgttcttttctattttcaaaaatattttgtgtagaattggtattatttcttccttaaatgcttggtagaatttaccagtaaagctgtctgggcctggaattttcttgatgagtgggaaaattttaaccatgaattcagttttttaaatagagggctctctatttcttctttactaagttttgcaagttcgtatctttcatgcaatttgcccacttctcttctcaattgtcaaatttgttgacataactttgtaggatctgttttcattcttgatgttgcagatttatgttgtttctcttttatttcttcattggtgtagctaggagcttatcaatgttgttgatcttttcaaagactgattttggctttgctaatttactttgttttttttttttttttcatttatttttccagcttcttgaggtggaactttaggtcattgattttttttgacttttgttcttttcttacatatgtattgaaagctataaatttccttccaaggactgctttagctatatctcaattttaatatgttgtattttaataaattttaatttgaaaacttttctaatttctttgttgatttccctttgacccatgcattatttttattgtgtaatttaatttccaaatattggactttttttcaaggtatcttatcattattggtttctaacttacctctgttgttttcagagaacatatctattctatatgatttcaatccatttaaatgtattaaaactggtcttatgtcccagcaagtgatc

SEQ ID NO: 32450 - DNA, 1024 bp, Homo sapiens
agatcaaagagtgggtgcttatagcccaaattaaatgataggggaaagatattaaatgataggggaatgatagatacccgaattgtccagttctaggagatttgttctttgctacttcttatattctacaaaagctttaaagtaagctaatttatataaattattcttagttcctggaatttagtagcatttaatttactaagaccaaataactgcctttttatcattttaaaaatttatgcctatgatagctataaaacactggacttaaaaaaattatgactcctaaatcagtaagaggatctgttgaccaagtaatcagttatttggtagtatctctgttagagaattaacattgccaataacaatttaatttccagtaccattcaatggcacaggatgactttgttttatgcacttggtctaaatgatctgtaaatcttgagtagtctcatgtttctaattaccatctaaattttttccgtgtctttgttcaacagattgagaaacagaatgaagaaggctggtttgctctttctacccatgtatcataagtgaagtcaagtctcactgagtttgttcttaataatttattacttccctttccctgctctgacttttaagtttttatatccttctttcagataaaacctacaaagatcctgtgaattagtactaatgaaacagagaaataaagcaattattttttgactttctcaaataagttttcaacaaccaactgacctacagctccctgtgaatgaaactttgactgtagagaagttaaagttttgtattttaatactttcttaagtattttaagggttttttttattaatacatttttacctttatctttattcagggttttttgaggtttagtatatcttagttgatccatttatttatttattttcctgaagaactaatttgctttgcatgtaacttacaataaaattcctctgtgtgattagagtctggctttcaggaatatgtaacacccacttttctttcttttttcttg

SEQ ID NO: 32451 - DNA, 1045 bp, Homo sapiens
ggctggagaggctttaaaatcatggtgggaggcgaaggaaacttctaacatggtggcagcaagagaaaatgaggaagaagcaaaagcagaaacccctgataaacccatcaggtctcatgagacttatttactatcacgagaatagcatgggaaagaccggcccccatgattcagttacctccccatgagtccctcccacaacatgggcgaattctgggagatacaattcaagttgagattttggtggggacacagccaaaccatatcactattaatgaacaaataaagacttacaggttggtgaaaataagttacaaataatttacctcgttggacctaagttagccatatgttttcaagctcttgccagtattgagaattgtcagttgtttgcataatcttttaaggttaataatgatagctcactctcttactctgttttatttttcatgaatagatcttccggggctactggtaattcttgttctccactaaatgccacctcaggaagtgggagattcacacctcttaatccaagagcaaaggtacacgttaaaatgtaattgtgaaatgcatataggggtgagggtagaaggtggctgatttagtgatttccattcttaattatcattcctgttatcctaaagctggtatgatattcttaaaagaaaagaaatactaatttacctttttaggaaaaacaagccatatacttcttctgttttctagggtaactaaggaataaggtaaaattcaataggatattcaacagtccttaaagactggaaattactggtttcaggtagagcttcccatatatttacggcaggacacacaggtgtgccttgaatgggttgtagatctactgagctattggttcccccagtccttgtgcttgggtggggtctgggacagccagagcactgggtccagtcacttttcctctcattttatccctgtgtgccatatctgactgtgccattggttagataggttatggtaccagggaaaaataaatgtcttaatgtgttcttcatgtattttg

SEQ ID NO: 32452 - DNA, 1465 bp, Homo sapiens
tgacctaaagaggtgtgttgtgatttaattttttcccgttcctttttcttcagtaaacccaacaatagtctaaccttaaaaattgagttgatgtccttataggtcactacccctaaataaacctgaagcaggtgttttctcttggacatactaaaaaatacctaaaaggaagcttagatgggctgtgacacaaaaaattcaattactgtcatctaatgccagctgttaaaagtgtggccactgagcatttgattttataggaaaaaatagtatttttgagaataacatagctgtgctattgcacatctgttggaggacatcccagatttgcttatactcagtgcctgtgatattgagtttaaggatttgaggcaggggtaattattaaacatattgcttctattcttggaaaaatagaagtgtaaaatgttaataatacaaatgtcactgtgacctcctccactgagaggactggtttatgccagatcattttccggcacacacggagtggctttgacagattgataactttgtaagatgggagacatctgaaatattcatgttttccttttgtagtcccatctccactatttagaaatgttctcagactttaaaataatgcacagggcttgagctttctgtcatttgactttaaaaggaagtttcattcatatttatcctcttatgtaaaattgcggtataaagtctcatttccaaatatgttaaatgacaaaattattttataaaatgtttatgcacactttataaccttaagtttttatttgagaatgtgaaagtacaaagtgcagtagacttcaacaatcttgagtgccaagaataatacagaaaaagaagacagttgatgaatgagtttatagggttctaatcttaagatggtaaaaatgtagaaagaccttgctggttttttgggggtattcgtttcttaaacaatccaaatctaagcttagaagaaaagtttagcgttaagcacctttatcttcatgaataagcttcagcttgctcttggcaagagaagagtgcttgagttacagaaggcataagtagtttgaagaatgcagcagcctttttgtaaacttcccagatatcaaaatagactttgatatataaatggttttctgagatgacactgcctctatttctataaccatttcacctggactatctaatcagtcctatgaatgtatccctaaatgtggttattgaaaacctaatagctgcctcatgacaagtacatgttatttaaggaggaaaaaatattaaattttgaattgagtgtgtaggctccctatcattatatatagagtttctttttccacggtagtcagtgacttaacctgaattgtaaatgtttgtaaagggttaattgtcctacatcaaacttagttaaataattccatccacttatggaggaggaggagaatgtggaagaggtaaaaagctgggc

SEQ ID NO: 32453 - DNA, 1041 bp, Homo sapiens
ctttcttttattgattgaatgaaacagcagaaaggaagaaacacttccaaactttctttgaggccaagataaccctgataagaaaacatatcaagaatattacaagggctgggtgcagtggctcacgcctataatcccaacactttgggaggccagggtgggcgagcctatcacttgaggccataatttcaagaccagcctggccaacatggtgaaaccccatctctactaaaaatacaaaaattagttaggagtggtggcacatgcttgtaatgacagctgtttaggaggctgaggcaggaggattgcttgaacccaggatgcggaggttgcaataagctgagattgcaccgctacactccagcctgagcaacagagggagactccgtctcaaaaaaaaaaaaaaagaaaaggaaaaaagtgtatcaagagtaagcctttttgagataccatgtgaacaaagacttggagttaacatatactgcagccaaggatggagaggccatcaattgacaggaaaaactgcaagcaaagcagattttggaacaaagatttgaaattgtttgcagtatgttcactttgaagtgtctgctggagattgcttggatctaggaatgtagagttcaggagtgaactataggctagagacagaaatttggaaattggcagcattaaagccacacaactacaagattgaatgagatcaccaagagaataattatagagaagataaccaaatgcgtccatatacgaggccgtcataaaattggttctttttcagcttccgcatttatacacaagcatacttgatgttttagccatatcaaactgactgattttcggactacatcactgctgttttgttcatgttttattagactgcatctcttgcccttccacaggataagctagtcgttcttcaaaatgtttcccattgtcaccttcattctagtattatttttgtactatatgtacatacactgttagtagcacattgtatatacctgtctttcctaccagatgtaaacacctttgcattcc

SEQ ID NO: 32454 - DNA, 1034 bp, Homo sapiens
ggtaggctgaggcatgagaatcgcttgaacctgggaggcagaggttgcagtaagctgagattgagccactgcactctagcctgagcttctgagggagactgtctcaaaaaccaaacaaacaaaaaacctgtgggtcaaatagttgtgaccacatggctgatttaactcttaggctggcaatttgtgtcttatatacagagtaaaggtcttaaactactgataaattaagatagtctacattgttacatcatattacattcttaacagaagtaagcaaacaattcatgatccgttgtgatcatataggatagtttttccaatgacccgttctctatgcccatccttagcccttgtttccctcagcagatttctcagatttaggaatttacgcacatgccgtgggaaatttaatttagatgggtgttaaatttggatgatgatttacataacaagcttaattacaaaagtaaagctgccaaggtggaatttgagaatctgaatttttaactggcaagatgattctggtatataaccaggtttgggatccattctttgattttgtaacactactcactctccaggttttttcctcccttctcttgaacattgtttcttggacatctttgtaggttcctgttcttttacgtctaaaattcaagtgtttcttacattcttttctttgaccttcttactacagacatccttggtagtctcatatagtcccataatcaaaggttatatgctatgaattagttatgtttcaggaaatagctgtcaaagcaatgtgttataaaagagaattctttcatttaaaaagtccaagtgcatttccctttactacctagtttttatttaacattagcattgcttcagtctcattgggtaacatttagactgcattatataaatcatttttaaaattgcccattcataccttaaaagcgtttgacactagttttgatggaaaaaaaaactatcagaacatgtatttataggtgtttattccaaaagcaaagatgataacagactgtctg

SEQ ID NO: 32455 - DNA, 1035 bp, Homo sapiens
tacttcttttggataatttcctaagaatgaattttctggatcaaaaggtactgacatttttaaagctctggtgtttcttgccagttgacctccaaaaagatagtagcaatttattctgtcagcaatgtatgagaatgtccttctctttccaagggctaacgaaagggaagggcacgtggaaaaacctcaggaaaacatattgtggctgacatttcagccatgaatggtataaattttctttgcgatgcgttcaatacatttaaatacattaaaatgatagaaataactaatagcttccttacaagttgtctttgagtaaatattcacattttgctttaactctacttttactttgctgattaggtgataaacggcatttccttttttaaagatttgatgattatttagtgaagtttggacatataccatttttactggtcattttgtgacgtaagttgtttataacttacccagttattaattgggatgatgattgccttaacttcaaattgtaaaacaaagatgatattctttagagagtaggggtgagacattagggcccaggtcatttgaaataaaaatttttagaggtgaaacttggtaaacaaggataagcaaggaaaatattttgtacttaggagcacttcaaacacttctttttccagaaaattagggtatatttaaaggtatgtttgggttcccctgcttctagtgtatataatttgttacttattttaaaggaaacttactataatgcaaaaagcattgaactaaaagcaaccaagttttagttttatgtaccacaaatgatagctagcagtagggtcactaataaaggtgtttcaacctctgggccttggttgtcttttaagggaatggcttgaatctgaataggaatggccaaagattctagcttgtgtgccagttctattttgtaggtatctggggaagcagaattaacagagattaaaataggacataaagaatacatagaaaactaaatttctctattggatgaacggtgggctcttcata

SEQ ID NO: 32456 - DNA, 1020 bp, Homo sapiens
acaaatgaactaactcccagatgagatgaaactttttaattttttttgcttctaagtctgtatttaagacactcaacaaatgagttgtgtgaatcttacttgtgcttgttcggatactgaacctacaacagtataggtttaaaataagttaagcgccttgagttccaaaacttgtaccacagtgcacagtgtggtcgattttaaagtcctgactcttaatttggaatggcctgtaaaaacgaaacagtggtcctggttatgtggcttttgtatgaaattttatttgctaagtattctattgtatattgaggtaagtaaacagtaaattgaaatatctaaaattggaaactgcggaagtcccaacacgaagccagtcaaatatttaaaattgtacactgttgcctatgttgcctatcatattgaaacttaaaacttagctggtttttcttcatatttttaccatgagtatttttattagtagtagcagtaggactttccattgtattggcatgtctttcctccatagaagataaatttccggttattaactactgaatgtaatttatatgcacatgtagaagtttgagatatactaggaaatgttgcttacttttgaggttggctgtttttatgaaccagggacattgtagtttgaatttgtgggtgatatttttatctgttcttctctagggaaggcgatttcaagcaagaaggtatgccacagataaccatgactgaggtggcaatgtaattaggcagtgtaatggaaagtataataaaaccaaatcatttagccttcaattgtagtaaagaggtgcaaattagttctaataaaaaatgtctttaacaaaatgtgaatacgtgactaagatgggaaagtaggtagcagtaatataaatatggaacaatgttgactactaattggaatagtaaagggagccattttaccaaataaaattaaaatgtaagattctgcagtcagaaacaaaactttaaaaactccgaacagtggttacctct

SEQ ID NO: 32457 - DNA, 1050 bp, Homo sapiens
gaaatgtacgacaaatatagaaaagtgcttaaatcatacaaatacagcttaacgaatgactgtaaagtggacaccctttgttaccaccactgaggtcaaaacgttgaacattgctgtcgcacaggctccttcccaagtctctcttaaactactctcctgacatttacaatgaacatttgcttttctttttacttttctcctaagtatgcagccttcaatgctatagtttttcctggtttggaactttatatacatggaatcatactatatgccatattaatatttaaaatacagttatgttttatttaatccagttgtctttgagaaataaggtattctgtataagtaagttttatatttgttttctaattttaagcatttggacagaatgttcttaatttcattatgcacttccctttaagagtggtgatttggtgtcattatgagcatcagttagtgtgccgggtgtattcagtgatgcctccagcttttttgaggtatgaagactgttgtgtgggtgtataaaaatgccccttttctcaacattactctgttgcccgggctgaagtgcagtggcatgatactgcaacctctgcctcctgggttcacgcaattctcatgcctcagcccgccaagtagctaggattacaggcacacaccacgacacccggctaatttttgtctttttagtagaaacagggtttcaccatgttgactggtgctgttttctttttatttgcatgtttgtgcatgggtgtttatttctgttccttgtaatagtgttcctatcttattgccatgagggtgcctacctccaccaaaacctgtttgtccttgtttaattcacagatactggaaatcagtggagtgggaaaacagataagcaagttgattatagttttgtttaaattaaaacaaataagcaataagtgagggcattcagaggacctccctttggataaatgatttagctttagagtttgaagtttaggactcaatatctatgtgaccctgaacaaataacctttcaaagcctccctgttcctctct

SEQ ID NO: 32458 - DNA, 1047 bp, Homo sapiens
tttggttggatttttctgttaaagaataaaataataatgatccaaagaaatcatcattaaagttatgcttgtggcacagcaccttccaaaagtccacctcaaactaaaccaaggaaatgtagggatactatatatggaaaagaagcctggagtttttctctgacagaatgacgaaaactgtagttaaatatctcatttatataccatgattcctttccaaagatcttagttttatcaagactgcctacacaccactgaggcaaaaccatttctgagctgacacatagcaaccatcctctcagcaatgttttcttatgttaggggagggaaataaaggaaaagcctctttagaaataaaacgacagaaaaagagaaatgccagcacacataggaagattactgggattcatataactctcccctctaggtttattgccaagggcaatgtgtggtatatgtcttgggaggggtttaaagcattattatattttactttatgtagctaactctgtaggaattttccatctaaaatgttaccagttttggtaaagaaattgtttgttatgttctttctttcctgaccctgtaagtaacccagatgtcccattctcacagaggtgacagtgagggccaatttacctaaatattgtgctagtgttttgcatttcaaagttccatgaagtcttttttattacagaggtccctatttttaaatgtattttttttgtctttcaaaaaaagtactgattacattttgatttttaaaaattgaaaaaagagactttggcacaaatgaagcccattccctaaaattgtatagagtagaatatttcccccctaaacactagacatttcagatgaatattataaggatcttgagagccatgtgggtgaggaatgaaagacatcacgtcattgtcttactatcacagtatcctggaggtgaatcaagcatttgtctgatatattctgaagtaagctatgttcttggcatagtttgtgtttatgtgtgtggccaaggatgaagggtgggcaggtaacagggat

SEQ ID NO: 32459 - DNA, 1130 bp, Homo sapiens
aaataatatgggaaaataggtctctaccaagtgacttcataaggagtgaatgatattttcttgactctaactctaatgagatcatgttttcttctggctcatgtctttgcctgtatgttctgttttctacatctttttcaaattacccttcacttttcagctttattcctctgcttctgtctgacttaaagctaatgtatgaaacgcacaagaatttggatggaaaagcccatggcaagttttggcagaggttccaccagtctttccataaagggcaggaggaaaagtcattttcagaataggtcaggtgacaatataaatatcggaaagtacagcttttctgaataaagttttcatgtattcattcctttaacaaatatttattggacacctgttgagtgccaagcactgttcttggtgccaggttctccttgagaagaagataagaattcctgccaacattctacctgagggagacaataagtgattaaatatacgataagatggtaagtactatagagacaatcagagcagaggacggggagaaggagagctggaggagagtgtttacagtttcatatagggtagtcaaagaaggccttactgggaaggtgacatttgagcaaaggcttcaggaggtgagggaaggatgcctatgcgtatctgtaggagagcagttcaggcagaggataagcaagtacaaaggccctaagctgggaacacactgagcatatttgaggaggaacaagcaaggaggtccgtgaggctgaagtagaacgagcaaagggaagattagcgagagtcttggaaagctcacaaagggctgcgtggcaggacctggaagcgcattataaggactttgacattaattctgattgagatcaggagccactgaaggcttttgagtggagttgtgacacacattatgtggctttcattttaaaggagtcattcactgctgtggtgagaggctattccagaaaacctgtcaggaaattgttgtgctttggaccaacatggtagcaatggaggtgatggaaaggggtcagattctgtatatattttaaaaatagagtcaacagatgtcctgatcaattatatgtggggtgagaaagagagagatagattgg

SEQ ID NO: 32460 - DNA, 1033 bp, Homo sapiens
atcttagcagggttggcgagaatctgtggaatctctgtcaactcttgatcaggcctaggaaccaccatgctgataggatctgttttcttactgtaaagaagctgagttagtacagcaattaagaacatttaagaaaaagtttacccaatcttgtttctgactgagctctcagtaagagttttaacagtgaagaagccaattgatatgatgtagaagtctttgccttggcctcctccacaaagccccttgcttgtgcacattttagtgtggcagagggcagtaggatgtgctcctttcaaaaacacatagccttgtccatattggaattacttttcagcctgattatgcttctccatccctgggtgaaacctagatcaggctaaccaaagaggaaggctatgcatgtggtaaagtcctttaagatgacagatagggaacagtgcaataaacactgaaaaccagtgaagtgaaaggtttattttgaaacaagctaggccaacttggacattggaggatggattagaacatactagctgctccatcatagactatccttactaagcagaagaccttaatagtgcctaaaagtttagttttgaaattggttttttcctaacttttctttgttaaatttatttttattatcttttttaatcttagaagtaatcagagtttgacagctctttagtaactgttaataaaagaatctttcatcacaggataagcaatagattgtgtgggaaataataacacaagagtaaagatgctgaaggactcttctggaactcaaagtgacagttttgaaggttctggcacagtaggaaaggatcacaacccatataaatggctaatgttgaatttctctgaacactgtcacatatggggcatcaatttggaaaattctcaattgaggccccttccctaagattacaacattgataacctgtctttttctctctcttctttactatccgtccaagtctactattccaagtttaaatattgttcagaaagttgtcagccttgttagtca

SEQ ID NO: 32461 - DNA, 1029 bp, Homo sapiens
tggatctggccaggagtcacaggatatacacccattctggagctttcctctgttgttctagaagatgttatttgattagttggggctgggagcaggggatatatgattttgtggaaaaggtatcagataatcaaatcaggtctgcctctgctatagccagtgtgctgctgcattaaaagggaacaaaaggaaggtgcaacgtaagagcagacacaacctgagatgcccttgagatttaggagaacaggagggcgccctttctgttgtgacctgactcttaaaagaaatcttctaaaagaattctttaatttggtaatgagttgaagtccagggtaatggaagctctagggcagagaacaaaagaattgcaaaatgtattcagcaccaaacaatgctaaaccaagaaacatccaatcacaaaactaggaagtttggcaagaagtggttagagaaatctctgggcttttccatgggcagggtcgacagactctcttttcagtgatttctggctctgagaaacctctttactcactagaaaagaactttatttaaatggccaattttgttcctcagaaaaagaaattaaaaaaaaagaaaaataggatactgaagacagaaccatgtgacttggtgacaaacaaaaggaggggtgcactagaatttcaataggctccctaattccatagaaaaagcaaagcaacccaatgcctcctgagcctgcagtgcatgaagagagtgcttgagctgacccagccaccaggccttctggggctagacataacttcccactggaacagcagcagcctctttcccctctttgtgttttcatgaagaaaacggctgttctcttaggtagccaggaaatagattacatggggcaaactttcaaaagcaatctctaccctggtgctcaggctacatacagaggcagaaaaggggcacggaagagcccttgctcttgagagagagtattttcatattcccaagggctttccgtgtagagttgctatttctgatatcacttaaacc

SEQ ID NO: 32462 - DNA, 1030 bp, Homo sapiens
caggttcccacagcaacagaaactgtccccttgagtgctggcatcacagcagattctttcattccctgattacacaacactgggtgtggggacattgtttttatccacgtatgtggaaaggagcacagcttttatcctttgatttttttcctgtaactacagttgaggatatgggtctttagcttccctcccaaaaccatctatacgtattatcctggaacggaagactattatagctctacatgtgcacacggacagaattaaagttgctgtgggaacattaactctgatttccggacttccgtgccagtcacatttaaaccataatgttgtaatttttggcatgtaataaatgtgcatttcatgtacacagacagaaagaagcataaaatgtattttaaagagcaattaattactaactttgtgattaaaaaacatttggtgcatgttccttcccatttagcatcagctgctggtcttagccaggcctaatagatgacatactgtgtctcatcctgtaactcagatgtacttactgtatgttcctgttcttccagataattaattcccttagtaaagctgtagggggaaaacaaaatggaaggaatatgcaagcatgtaaatagggtaagggatatttcgaaggaaattattcatttctgtgaataaaccttttagtccctgataacgagccagaaatctgctaagtgggtgtagacaaaggtttctggccatcttagagcatctggttcggggccattagaacaacttgaaagcagatttccccttgaattgcaggcatgcccactgggggagtgattttactctgtaaaaacttataggcttaaggcttaaaaagttattttactctataacaactttttagtctatgctgtattcaaactggaaagtaaaagttatagggaatcaggtaagatgagggctttgctaaagaacccctgacttaaagagtaattttttttcttcctttacatttaaatctggtttacccatttgtgttagagaaggc

SEQ ID NO: 32463 - DNA, 1025 bp, Homo sapiens
cttccatggagagtgaagtcatcgcttcaacttagcataataagaaagggagaaagcatactgttggtgaaatgagggagtttctgctaggctatgaccagattcttctgtttctgctattttttctctaactgaaaagagttattgtggtaattcacctgcacttctgaacctgtgtgcatacacccaagacctactcaaggtaaagccagaaagagattaagagcagactttcatccaggggactcagcttctttttagtgacttctgcttgttttgttgttgtttttaaataaatttgtgtttttagaaaatatgtttgaattcccagacattgatatcctgggcatccttaggttgtgacagaaacacggattagtgactgtgacaaatgtcgcagaagccagtgcagttgcaatctatcaaatatgttggcagaccccaggattttctgatccttgttgcagaattcagttgtgtccttaccgtaggaagacagggttaactgagagttttgagagttgtggtatgtgcttttccatttgggtctgggtagctctgggactggaataccttggtaaaaacaataactaaaactagggccagcttcatgggtatacaacctgtgcagttgcacaaggtcccatgtttggacgggccctatgcctggcttgatgtgcttctgttgctgtcctgaaattcttaataattttttaataaggagccctactttttttatttttccttgagccccacaaattatagagctggtcttgcctagaatttatctttccctagcataccaattgaaagtatcagtcattttttctcttactgaaaatgatacctttttcaattcctcaaaagttaattcctccattaaactctttgaagatttctgtccacataatgtggttcagaagaactcatctctccttctttcctccaagcaccttgagatgattatgatcaaggtgatcttgttttgtaatcagaaactctatagctgtctcagccaagttttg

SEQ ID NO: 32464 - DNA, 1020 bp, Homo sapiens
ttgttggtatgtaatacacacaagggttgtcattaaatgagtcattaaactaataattttctgaagctctgaactgaaatttagggtgagaaagaactagacgcactggggggattttagaaagatagattatgatatggtttggctgtgtcctcacccaaatctcatcttgaattgtagttcccataatcttcatgtgtcgtgggagggacctggtgagaagtaattgaatcatggaagcagttactcccatgattttctcgtgatggtgagtgagttctcatgagatctgatggttttataaggggcttttccccctttgctcagcactcattctctctcctgttgcccggtgaagaggtgccttctgctatgattgtaagtttcctgaggcttccccagccatgcgaaactgagtcatataaacttcttttctttataaattacccagtcttgggtatttcttcatagcagcatgagaacagactaatatggattaagattcagcataaggaagaacagaacagaaagaagtatcctacagtggagagttccgtgccctggtggtatgcagcagagactgaatgatcactgtgagcaccagattaagacccagaccatgggttgtttaatgttctttaccatatttttgccctgggatcttaggattcttcaggcatggggatttttcagtagctattaagaattctgtgtttgggagacatcaagaagttaaaaaaaattggaaatactataagaaaaaattttacataagctaaaaccactcttgtgacccactctgagcatacactaaaagagaccagggaatataatgcagatctcactgagtttattatttgccacccatcaaggaaaggagccattccacacataatgttcaggagacattcctcactcaggtttccactggttggacacatattcattttaagactgagtaactgcaaatgcttgcttaccagcttgatttgcatagctctgagttacatacgaatggga

SEQ ID NO: 32465 - DNA, 1192 bp, Homo sapiens
aattgcactttttacccatgcaaatgcaactgcttttagtttgggatcctctagggtgcctctatttcttagctacaatctgaatatatttgcaaggtattttggttccaacattgttttatcagtatttctgtggaagaatgagaggtagagttttccactctgccatcttgctgacttcacccctattatttgttaagacattaattttacttgaaaaaaatatgccatttggactggctgatagacaaagtattaagatatgcacccctcagtaacttggcatttctaacatgcctatgggtctatagctatttaattatgtttacttgttactttaggcttcagccttcttgattaggttaggatacatcggattatttgagctgaatagtgcttcttattttgacagaagaatgtctattttgttttaattcagtgatatattttcagtggcagatctttaaaataactcttctaaaacttgtaatatttttagtattggacttagttaagttacttatctgggcctcagttgtatcatctgcaaaatgaggcaacaggatttaacatggtctctagttaattcgagctctaaaattgtgcgatctcatttgtcatttcaattcaacatatgttaacgaatggaatacttacataatgtaaatcaatgaggtagaacttgggtggatacagagatgaatgtgattccttcatgcaaatagcttataatttgatgccttcaaaactgagatgtgtattccccaacacatcctagttccttatgtttgacatgtcatttataaataagggtatattatttatttttgaagtggaagaaatttattcctttgttactatttttcatctctagatttggagaaacaaaaatgtggcctaaactatcattttaataatattgtgcatttgtatttcctcttcattgcaaagcatttacaagattctggaatcattttcttatccatccctaaagtagcccagtgcaagtagaaaaggacagttattccccttttagtgattagaaaactggaccctgatttttctggagttatataatatgccactgaatgagaacaggtaaaaatccaggaactctcatttcaagactgcccagccaggttcctttgtatgttacagtttcttttagtaagttctgcagagcctgattcct

SEQ ID NO: 32466 - DNA, 1065 bp, Homo sapiens
aacctcaggcatagatgggttaaggggcacgattacagtgtaggaaggaaattttgatgcagcttttaaaaagtagagaacttttcattttacgcttttacacatttcatatgtaatctagaatatcaccaaagcttttattgccttctatctatttttaaaataatcttgtccagcccatatctgtttttagtatttgcatctcacaggaaaaggaactggtggtatgactctttgcaaagcattgttctgtggaatttcaacccatagaaacgagacaccacgttctctgtagtctgtcctatctctaaagggaacctcatggacagttttaaaacagaaagtgaacagtttatcacacattctagttactctaaaacctcttttaatgtacctcctggttctttgcaagtgaaaagaaaaatgcttcctctcttatttaagaagtcttcagcaacttaccaatccctagcatgtgcaaaatcacaagactatataggatcactgttcttagattctgaatttggaattcctgataactgaaccatgattttcaaataaaaagaagggttttgaagtctatcaccacttactagaagtttttattggcaaagaaagatcacacttctttctgtctgcatacaaaaagaaatagctaatctcctttgttgccaggtgaattaactgtattcagaggaaataggcaaacttgtagaagaaagtctaacagattttttagaattctttcatgatatgatagaaatattatggtttatatcaggtgaaccactgttaacttgtaaaatttctactgaggcaaggaaatcaaatcatttcttgattgtagaaagtgtattataacactggtgctgttggatgccaactctagatagcactactaccgctactaagaactatacagtcttttggcttctcacagggaaatagacaaagggaaaagggaaataagtcaggaaaaacggatgagaaaggagatagattagagacttggatgtacagccatgatagataacccccagcgaaaatcagagaatgcaagggaca

SEQ ID NO: 32467 - DNA, 1081 bp, Homo sapiens
acaaaggaacctttcttgcccgattgttagaaagtgttttgaatgatgcataactaagtagagtaactaaacaattgcttttgagcatctggagcttgcccattaagatttctatagccctttattttcctttctgtggtttaagaagtgattcacattcaatatatgaaagttctgggttcagccccttgagcttttggtagaagaatcttcatgaatctaataaataaataaaacaaataatgtaagagctgaagacggttgagctcatgtgagtttatataccaaagcattttcttcctgggaagaaaaggtatcttctatatattttggtttcctaaatttagatctagaaatacaccattgttttgttagagtgtattcttagggtgtgtatgtggggaggcagattgtaagcaaccgattcaaaatttacctggaacttcatagaataatgtcaatgctttttaggtagaaaaatcattacctacaaataggggatacattatgaacgtatttcaactaagcaaaagcatagtcaagtgccttcataatgctaaattttagatgttgcactgatgagatattttccctacaaataaaagaccaaagtgtacaaaacctcaggacatgtggctgagttagaattacaatgcagctgtcatttttgcatttcctggctttcatgaatcattactagtgatcctctgtcatttaaatcagttgagaacatggatttatcttaattttcaccctttgtttccctttttcgtgataacagtttgagatatgatgatgtaaagtgtttctacttataatggtttcagccttgtcccttggcagcctaaatcttctggctaattcactgatcagttaaatagtcgaggttattattattataataattattttacatttatatagcactttcctccaaggggctcaaggcattttacacacagtaaattaccaaataggaattaatccttatatcaccctgtggggtaggtacagtcacataaatgaaattctacggaagtactgcctgtgtcacagtgctgagctctaccccaacccccag

SEQ ID NO: 32468 - DNA, 1027 bp, Homo sapiens
ccacagttctttctagcttatgtattatatatttcacccaagtgaaccatcaatgcctcatcattctaatagctgtaataacaataattattattaatgatagcatttgcttcttggtgtatgtacgcgtacacctttttctcttgcttcaggtttccttatgcttggcctctttggctcttggtgctagttcagttgttgttacatttgtgacctcacgtatcctcaagctataagacatttcttagaacgaactagtacgatacaccttccacctcctttcccccagttaagctcagaattgtggttagatgattctgcttacatgaggcagggaatccttggcagatacccccaccaaccaagattttcattttagacctaaggataccaatacatgtcacaaaagcaagataagtggtttgttcagatcatcagatccctgtttaatgaagctgacatattttctgaataaactttattggatgcataacacaggatcatgcacaactgctataggatgggatttatgacattaccgtaatgagagaactttggtgattctgctctacctagagtggtgaaggaaggataaaaaccccactcaagacaaaaatattcaagaaaatggttctgtagtcagctcattcctttcatggtggaagtgttaacgaaagaaatcttcacttatttttctcctcttacctagagaatactttcttcttacctagagtctgtgatatgaagaatatgctctgtagatggtcttatcttatgtggattggtccatgggacactatgctaggctccatagagaactggttatgtatgttctgtcctcctctatgaaaacattcctaaccgtactgttgatgtatacatttcggtcaaaagtaatttgctttctgggtatttgatggccactctgtgaatcaacctaatgtatttgtggtatggaaatctgtaacctctcaatactaagtttaaagactcttataattaattattgaaaggcactttagccctt

SEQ ID NO: 32469 - DNA, 1014 bp, Homo sapiens
taatattaagcagcacaaaaagcctaacatgaaatgatatcacttaaaaagattttatcaaaataaaaattgggcaatgatatagtgcttattgtacaattcaattgttattttaaatgataaatatatttaccatatctagtatatttatatcaaatttgatgaaaagatattttaatcatagcaaataaagaagttatttagagaatagtagcataaaaggaaagctcaattttaaagtctcacattaaattatcatattgacctagtggctatattcactgtaagatcatactcttgcatattgttatttttcaaatacccattactagaaaaaaagcaagaacacttaattagcagaaagggtgatgtttttcttttcatgatgattttggaagtttatacagttcatagtaaaatgggaatgaatgtgggatatttttcctacatagagatttgaaacaatatacatttaatactggtttataaataactaaatgtaggtttccagcagagtagagtgatttcacctcaaaaagggaagatgatcagggctttgatgaaaatatttctacccatgtcttcctaaaacagccttcctaaggaggctaggcttttggtaatttaaatgttttatttctgataaaatttcatttgtttcatgaaatgtattaaattccatttggaaacaaaaattctgaaaaaaatttccacattttgaataatctcatagaagttatccgtgtagattctgaagaaaattcttcatttgctattcccatgaatagcagttttggttctgtttagttgtattttcattttaacactctagagagcttctttgacttgtgttaagcttgcttgttccatttcagttgggtttgttcatgctgtcttgatagtttattctatcaggcatgatgttactttaccgtctcaatcccttggcagtatttttgtttttagtttttaactgaatttaatgctcttgaaaatagagaggtgggtccatat

SEQ ID NO: 32470 - DNA, 1026 bp, Homo sapiens
aatctctaaagagtattgctaaaatgaccaaattatttaggcttaatagattttgtagcatggataccagacctactcacagagcaacagtcctggctgaatatattttatctgggttttactgcatgtggtgatttggctgccatgtattgagtgacctctctgtgccaagcattttacatttaattcttaaaacaattttgtgagatgggtaccattatcttcatttaataggtaagaaaatcttgacctagagaggctaaatgacttgttaaaaggtggaaatgggatacaaaccaaagtttctaagactaacgttcatcctttctccatttccacatgcttgtgcctggttatatatttacattattggtaatgggaaagaagtttatagtataattcacttggaggcatagccaatttattccttccttccttccttccttccttccttccttccttccttccttccttccttttctttctttctttctttgatggagtcacggactgttgcctgggttggagtgcaatggtgcgatctcggctcactgcaagctccgcctcctgggttcaagtgattctcttgcctctgcctcccaagtagccaggattacaggtatccaccgccacacccagctacttttttgtatttttagtagcgacggggtttcactatgttggccaggctggtctcaaattcctgaccttgtgatccgcccaccttggcctcccaaagttcatggattacaggcttgagccaccgcacccagctgccaatttctttaaaacaaagtgttggtgagattttgctatgttgtcatgttatagaactatgaatccaaggctatagattgactagatctccagtagcaaaaggtacataagtataggcaacatcctttgattttccctttggttttggaggacatgttattgtcagttttgaagaaactacaacttaatatgtgtggcttatgtactaggcattcctgacttctcatcgagtgcctcctgtgacttgtc

SEQ ID NO: 32471 - DNA, 1079 bp, Homo sapiens
agtggatttagttggtttgagtaatgttgcactgttagtatagtattcttgcctgtgaggaagagcacatttgtgaagttccttggtgaggacaatttgcacttgagtagatatacactccctgtgttctttttcctttagtctcgaggtattttactttctctgaggatatgactaaaagaaggaatatcggggaaaatgtatttatagtgttaagaactttcttttttcatagtagtggttcctgtcccaattctttactctatgattttaaactaatgtgtctgttggcctttggactgggatagtatgttggataatatatttgttttctgttgctgttgtaccaaccacaaacttagcagcttatgacaatacaaatttattatttgacagttctgcagatcagaagtttagattggctctaccagtttctctgctgtaggctttacaaggccaaaatcaaggtgtcggctggattcttaactggaggaaactctgaaaaaaaatccactttcatgcttattcagttcctcatggttgtgggactaagatctccatttccttgctatcagctgggaaccatctttagatccttgcatgtgtgctgtccctatatgtcagagccagcagcagcaccttgaatcattattacacttgacatctttcaaatttccccttctaccacacctcttttccaaattccagccaaaaaagttctctgcttttaagatgattagactgggccagcttggataatctaggatactctccctgttttagtgttaacaaccttcattacatttacagagtcgctttttcatgtaacataacattttgccatgtaccacaggttctgggctttaggcagtgggcattttggggtgcaattattttgcctcccacagatgaattctaaaagaatgagtcacctacctccatcatacatttctagagtactctgagtattctagtgcttttgatctagaagtagaagattcagtatgaattctcaccttctaaatgctattagtagatttttttaatatatatgttatgaaacttggtaaagagtattt

SEQ ID NO: 32472 - DNA, 1040 bp, Homo sapiens
aatatatcttttgaattgtttggtctcctcaggagaaaaaaaaatgttttcaacaatcttataatattttgttaaaaatccaattctggttcaatgttttgttctcaaaggaattttgaatgaagaaaaagcttttgtaagagggaggaagcttatctaatctcttcaagactgatgagaagcaatcaggagcttgtgactctttgaaacagtaaatttctagggaattgggcacacgtttctcaggaacaataaagagtgttacacttcaggttggctctaaatgcaccccttcatgtatcccaaaaggcaatttgaaagcaccgttctctgagtcaactggaaaagggaggaagccatgctgagctgagattctttcagggggtcaagagacactgaatacagaatgaagatcactcttctgattactgtcgaattctcagttataaccttttttaataaaatgtcttcaaagatgtaggaaaataaattggctcagacaagagagttactggatattagaagatttagatttttgacaaggtcttctacttgtttgcaaatgtactatcttgaccatataaaatttgcctaacctttgctaaaatttcactgaattgttctttgcttacattacttgatattttaagactttgttagataatcaataagtgatagatgtgtagcattgttactgttgccatggttaccatcagtgttctcttcccttctctaggttagggttggcaggtacagctatgaacctgggttccacatctaaccccacatctgctcatcttcttgtagcactggaaagtgtgaggggcctgactagactctggctgctcagtagttaacctacactcatctcacctgaaaaacttgtcagtgaagttttagtcacaagccttttagaagatagaaaaacagtttgcatggaaagctctcatttttaaataaaaactgattatatcaagctaagtgagactctctaattgatgacataatactgtctacgttatcattgcttaccactagca

SEQ ID NO: 32473 - DNA, 1130 bp, Homo sapiens
atctaaaattcacctaaacaaaaggacctcatcacgtcattatttaggtaagtatagacatgatataaacataaaactaaattctgtttgaacagaaggaaggatataacaaagataagaacagaaatcaatgaaatagataatgaaaataatagagaaaattaatgaaaccaaaacttagttttttgaaaagatcaaccaaaacttagtttttcttttgctagactgatcaaggaaaaaggagagaagatgacagattaccaaaatgaggaatcagagagaaggtatcaccaccaaccccacagaaatgaaaaggattatgaggtatagttatagttaatactatattataaacaaatagtataacctcataatcattctcatttctatggggttggtggtgataccttctctctcattcctgatctcatactatactatgaacaaatattataacctcataatccttttcattgcttgatagttagaaatacaacctgtgactgatcattggttgacctcaattgtcattgcttaacaattagacaattgttagcaactggacaattgttagcaattagctggataaaatggactatcttagaaatgcgcaaattaccaaaactgactcaagaggaaatagaaaatatgaacagactcgtaataaaaagacatacaatttatacaatttatagttaggagaaaatcctagatgtagatgactccactggtgaattctatccaataccagtatttcacaaacttttctagaaatagagcaagaaaggtcatctttcaattatttgtacaatattacactgagagcaaagccagacaaagacatcacaatgaaagaaaactgcagaccagattccctcatgaatatagacaccaaaactcaacaaaatattcacaaaccaaatgtggcaaagtagaaaagcattatacagtgctgaccacagaggatttatcccaggaatgtgagtttcacttaacatccaataattaattaatgcaatatagcatattaatagaataaaagagaaaacacatgaccatttcaatagatgtacagaaacatttgagaaaatccagtatccatttgtgatataatctttcaacaaaaggaa

SEQ ID NO: 32474 - DNA, 1053 bp, Homo sapiens
ggcaaagtacacattctttgtttcaaagtattttgcagacagtctggtctattaagaacaaattctaggactaggtagtagggcttagaagttaccatgacccaaattgattttttcatttctcttaaagttgatggttcattttttgatgaaagtagcaatcatatctataaaaaccaattttgataggcctatcaaatctgaccataaaacagaaagctattttacattctacaaacatattattaaataagctcactgtgagtatacaagtactgtatgcatttttacttatgaaaatctttttaaaactgaagaaattttgaaacttttgtgatgataattaacaattatatgttaaaagccagtatggaagcctattttgtcataacattataacaaggcaacaagttttaactgaacaatggattcctgagcttctaagcaaatgcattttgacgtgttatttttcactatatgcaaatttagaagagactcagtttatcatgacctgtatgatacctcttagaatgttaaaaagaaaaaaaaagatagaaagaggaagggccacagtacacataaatcttgcctgcagcttccactaaagttactctggaaagtaacttaaggaaaagagatgattaattaatttatttaaatttggtgctatttgttaatccacagctatgttctaggcacagatactatggttcaaaaatatataaggcaaatacctgatttggaggagcttattttcagtgggaggtaaaggaggaggaaaaggatatcagaaaaaggaatgagcgatttcagaaaagagcaaagtgctgtggcagaggtaagcatagatttgaggaatcgtgggcagcaaagtaaagaaggctttcctgaagaggtcgcaggtaagtggaggtctaaaagatgaagaggactctgccagggcagagtctagaaatggggaaagttggggaaggtacattttaggcagtaggaacaatgcttggtgcaaagatccataggtgtagggtttcaacagatctataactcgatgag

SEQ ID NO: 32475 - DNA, 1086 bp, Homo sapiens
tatacatcatagaactttgcgaactctctgttaataagaatgagcaagtaaataggttaaaagcaatttgggatttgcttttcttaaaagaaaacatgaaataaaaatgcaaatatccttatgagttaagataacttcttatgatactatagcaaacaccgtgctatgcctcctcaaaaatgtatatgcagtggtttagattgtatatttgggccacgttttactgagtacttgtacacatatgaatgtgttagctttcagttttctttttaaaactatagatattagttggcatacacaaactcagctacctgggtcataaagatattatagaaatgcaaatgttttccttggcagatttctaattttaagtattcctttttttacagacaaataaaaagaagtgttaagaattgcctttgggactctgaaggctgaaggtaatgtccagtggtattttcctgaatgggctttatcttcttgaattgtcttataatatttaaggtcttggatttgctacctcaacttttcttttattttattatttttcttttattgtccttaaacacattaaatatctttttctatgtatacctaaaaataatatgaaattgtaagttaaaaagtagaaattttatactctttctgaatatttcagcttaattaggtgttgctctaactcttgttccttctatttcattatgtattatgtccctctgtcctcctttttttttttttttttaactggtttggaactcatgattttaaactgtgttcttttgttaaacagacatattggcttaaagtcagaatgtcagtaacaatttctcctgaggaagagctttacaattaactataagaaataaaattgtatttgttggggacattgaaactcttcagatgagatttagtggctactgatagtcagaagtccagaatttcaggcaagaagtttacaatagactcgtgtggctgcattgtgtataaagagctcacagggattgaaggaggcttcttagacaagagggggctgtaattacttttcttcttacatgcatggttagattttccagtgagactaacatg

SEQ ID NO: 32476 - DNA, 1032 bp, Homo sapiens
agataagggatttctataactatacaggccaggttttgctatggcaataaacttggctctgtcaggtaaacatggctctaagttactcttgactatttctaaaaagcaacgaaaattaaagagcagttgtcagtgaaaatattcaaaatgatatgttgttggcactgaaggtcaacattgttcgcacattgtgcaatatttagagcaatagctatactgtttaaagaactgtctcccaaggcaactactttgcaaagaataatactcattttggttgcataaattttcattatgtaatagacagttccttttgtttaaaagtatgttttagaatatcaacttgagtctttttatatatgttattaaataactaaattttgtaaataaattatacttttaaaatttttataaataatactttttccatgtggtaaaccatcattccttaatttatcttttttacgtatcctaaattttcaaaatttaggaatttaaaaatggagattgtctgaactattatgtgaatagattcaaatcttttgaacaaatgtctcaactttttcttcaaaactgttaataaagtgtcttaaaggccaaaatgttgctagtattcagaataatttttcaaaatgaagtgattcctaaaattattatgctatggagtaaattaaatatttatcctacctggaatagccactttcaaaatgtctccattcaaatttttttaaattttatttatttttaactaagaagagcattctcagtggaaatgtataaaatattttaacataatatttagtttgacaaatatacaaacatttccattgttacactacacatattttaagtaatgatgacttattttgagtgtgggagagagtagattgtttgaattataaaagtagaatttcttggtagcagaagaaaaaggatcctttttacagaactcagtttatatagcataacacatgcaaatatgttcatttgagaaaatattcatgtttgaacagtgactcaagtttgcattcatta

SEQ ID NO: 32477 - DNA, 1051 bp, Homo sapiens
ttgcagtctttggcacataccaggctctgaataaatgtctgttgaatgaatgacagtgattcaatcagtcagtgagtcattcagcattatataaagccataccacttgaaataaaaaaaattatatatgtaactttgttattatttttaattgacaaatgaaattgtatatatttatggtgagcaaaggatgttttaacatatatatactcagtgtgaaataataaatcaagctacttaacatatctatcatctcacatacttatcatttgtgtgtatgtatatgtgtgtgtatggtgataacatttaaaatctatcctcagcaattttcaggtgtgtagtgcattatttgttaccaactatgtgttttcatgctgtaaaatagatggccataatttatatctcctaactgaaattttgtaccctttgaccaacatgtccccattctccccactacgcaagccccaacctttggttaccactattcaaaaaataacttttgaaaagcaatgtccagtgcataaacttcttcttaaattgggaaaatgaacaactttttaatactttgctaataaaaatcagacacttgtaggttgataactgcagattccaggccacactgtaaaaacatccaccactcagcattattaaatattttaattctgagctttgagaagactaatagaatcatattgtaaaactgctttaaacacctccagtctctgcttgaaatatgttcactaatatttcaagcaacacgtcatctgtgagcaattctgatgttaagaggttcttatttactttgagttgaaacctgtatctagtattctcaacccatcattttattaatagtatatgccttgggaacatacagagtaatctcatttgaagttttcaaacatttgaaacgttttctatcccgattgttttcctaatcgcatagtcaacatgtaatacccttgattctttctaccattccaaatatgttatgattctagtctttcacccttcctcttcccccttcttaggatattattgtgcttctgggtcat

SEQ ID NO: 32478 - DNA, 1053 bp, Homo sapiens
tgatggttttataaggggcttttcccccttttgctcagcacttcttgctgctgccatgtgaagaaggatgtgtttgcctcctcttccatcatgattgtaagtttcctgaggccaccccagctgtgctgaactgtgagtcaattaaattttttcttttataaattacccagtcttgagtatatctttattagcagcatgagaacggactaatatagacatctttaaaatgctgaaagataaaaagagtcaacctagaattctataaaataaagacttttggggacataaaagctgaaagagaaatcatcacccacagacaagcactacaagatgtgttaatggaggttcttcaggaagaaggaaaatgataccaaataagatggaaatttgtaataacacaaagtaaagaggagtaccagaaatggtaaatatatgagtaaatataacacacttttttcttttaaaattttatttaaaaggtaacactttgcagcaaaataattaacaatgtattgtgggttatatagtagtaagatgtttgacataaattacataaataattggagcagggaaatagaagtgtgttgttgaaatggtttgatattatatatgaagtggtatattattatttcaaggtagccttgataagttaaaagttacatattgtaaaccctacaataatcattacaaaataaagagatataacagtaaggccaaaatagagataaaatggaacattgaatactcaactatttcaaaaaaaggcagacaaagagaaaaaaaaataaagaacacatgggacagaaaagaaatacgaagttaaagttaatggatttaaactttcttatatcaataaatgcaatgacaaaaattgcaatcaataattgcaatgacagttgcaatagcagctcatccaccagaggtgttagagaagacagaaggataatgaaaaggggttaactgttttgactctataataattttgaaaattatgtttaagtaattagagtatgtagattatttttattctcaacagaatttatacaagcacat

SEQ ID NO: 32479 - DNA, 1115 bp, Homo sapiens
aatgatggcagtagatttagggagattcataagttatttgaaaaacttcccccatatagtcatgtttaattttcttttctgaggcaagtatttgtgaatagcctactaaatacaaagcaatttactgtccactgtgggatatctttttgaaaaaagagagagtaaaacatggaagctcctttcaagaacttaattgcttagtatagaagctaagaagaaaaatataaatcacataaatgccctgtgatgagtatcttaagaaagaatcctctcagcatggatcccgggaaagccttcctgtagagatggcattttaactgaaatggaattacggatagggtttgcatataaagaaatagggaaaaggtttgcaagtgataacattagctcacattcattgactgtatattgtttcttttattcttcataatcattttgaggtagactatattattatttctacatggacatgataatatgaagtcaaagatgctttaagtataacttgctttataaactagttgggtcaggatttgaacttagacagtttaccatagatctcattctcttaaaaatagaatcaagaagatgggtgttaaaagaggttgtttgagtaatgatacaaagttaagcatggctaaaatataggtatgcccaaaggaagatagtaagtgaccttgtttgatcttgtcgtcttaaatagtattttatatatcagtggtttgggtgagaagataaggaattactatacaattttcaggttattcaaagatgaaacactgaataaattcaattcctgtattttatttcaaaatagtaacaacataaccagataccatataaaagacatggttcttgaaaataagccctgaaatttgtatgacataatagggagaggtatacacttaaaaataatatcttcttctgttgcatagaaaaaattttatgcttggatgtactttcctgatcataatgtacagaagggaaacctaaacagagcacagtgatcacactgagattaggagatagaaattgaaattcagggagatgaggcagtagaatttgcaggtagaataccggaggaagggagatatgcagacaaggaactttggaaa

SEQ ID NO: 32480 - DNA, 1112 bp, Homo sapiens
aatatcaaaatttcagggttcaacttttttttacctcatggttgttgtgaggaccaggtgagatgattaacataaaagacctaataaggtgccgagctcttgataggtgtttgagaaaatgttagttgttttcatttctattatcttgttattaccattgctggtttcttcattcccaactacctcaacccccatatcatctaccccactctctctctcactcttcatatatatatatatatatatatatatacacacacacacacacacatattcttactgataatgttgttctatacttagactaaaatgtatgaaatatgtgccataatggtcattaagaatagacataaaataatcgtctgtaattttccaatattgaagttagctaagagtgaagatcctatgagtgaaacatgtgaaaactttagttacttgtggataaaatttctgaggagttgtgaggatgaagaataatttctcataaagaattttaggcacactttatatatagtttatggtttaccagagttctggcttagcactcagtgtgattattcctccatagcttcatattgctcttttattcattcattcatatcaaaaacaacatagaatatctattagcaataacacgttgttctagatagtgtgagatatacaaataacaagattagttatatgaattgtctctatatttaagaagtctattaggtgattcagatagggaagcaatgaggttatgtgcatggactttggagccagattttctgttttgaattcctgctctgaaactcactagttatttcacttcaggcaagttatttagcctgggtttcagtttccttatctacaaattgaggctaaaagtagtacctattgggttgtcctgaggattaaatgatttggtacaagtgcatcatttagagaaataccgtggtaagctcttttcaagatactaattttagtttcttttgataaatacctaaaagtgagaattctgaattgtataacagttctatttttaattttttgaggaaacttcagactatcttccatagtgcttcaccattttgcattcctaccaacagtgtacaaggattcaaatttct

SEQ ID NO: 32481 - DNA, 1047 bp, Homo sapiens
agactaaaaataattcctacattatagggtaattgttaggctttaaagagttaagaaataaaaagtacttagaacagttcttgacacatagtaagcacttaagcattggctttaataactattattatgatacgctgttcaattccgtccttttaaatttgttatttttagcataggaagaaactgaaactcaggatggttgcatgacttgacgagggtacgcaagctatttgtggcaatgctgggaccagaaccaattttcttttaatttattgtttaatagacttttttttgagtaattttagtttcatagtaaaatcgatggggaggtacagagatttctcatataccccctgccttcacacatgcacagcctccccatcatcaatatcccccaccagagtcatatatttgttacatatgataagccaactttgacatattattattactccaggcccatagtttacattaaggttcactcttggtgttgtgccttctgtgggtctgaacaaatgtatgacatctatctgtcactattgtattatacaaagtagtttcactgccttgaaaatcctgtgttcttcctgttcatccctctctctaccctaaactcttgcaaacaatgagtttttgctgtctccatggttttgccttttcagaatgtcatatagttggaatcatacagtgtatagatacgtacagtggatagaaggcaatcttttcagattggcttcttttgcttagtaatatgcatttaagtttcctacatgtcttttcatggcttgatatctcatttcgttttagcactaaataatatttcactgcctggatgtaccataatttatccattcatctactaatgggcatattaatttcttccaaatattggcaattatgaataaaattactgtaaacatctgtgtgtaggtttttgtgtgggcataagttttcaattcctttgcataaataccaaccactgcaattgctggattgtatatgtgtttagttttgtaagaaactgccaaactgtcttccaaagtggct

SEQ ID NO: 32482 - DNA, 1943 bp, Homo sapiens
tgatgggctttgctttagtctctgaaataatcatatttttctgaaatggatggttaaatttatcatattgttctagacacttggagtgtaataatgaacaagagagaaaattgcctgcccttgtggagcttacattctaatgtcacacacactttgtgcattttagattgttaggggaggagattttttaatgaaactttaaaacctagctgctttcttgtcttaggaactacagtttgaaagagcctacagaagtttgagaaggaggaaggtgtttaccagttggcagtgataggaaagaaagatcttagtttatttcttatttgtaccttttgttattgtcatgaaactttctccatatatttcagttggtaattttaacagatagggatttttttcatgattttaataatgtctttgaaattaataaaacgttgctttatattaaaaaaatcttgtgtcttgaaagttactataaaattcctacatagtattatcccgttagcaaagtatggtaaaacaaaagctagaatatctgttaatttttggttgggatttgtttttaggaacatatctgaaaaatcaagtacctaaatctttttcagttctgggtttctttttcgttttttgagatgggaatctccttttattgcccaggctgtactttaactcctgggctcaagtgatccgccctcctgcctcagcctcctagtagctgggactaaggtgcatgccaccatgcctagtttcagttgtgattttatcaagagaaggtgaaaatttattgtaattagtttataggcgacattaaagaggagagacctgcaaaaaatgctttgttatttaaaccattttttcaaaagcatttgattggcacttttctgctttaatagacttatttgtaatgcaagaggaacattacagaagattttagcaatactttaatcatttagtctgtaggtgtaaaaatcctgggtttctaatagaaggaaagttggtacctggttaaatgagtatatgatttaatgctgagattgtgacttcaagtagtgggtgtctcacctttccaaaacctagttcatagttctcaaataacagtttttcctttttaattttttttcccatctgtcatggtgagtcttactttgttagccaaatacaagtttagttcttaagtggaataactttttttaatacaatcctccctcctccagccctcccatcctgtgccgtggagggtttgtcacgcttatacctacattagatctctatttatgctaatttggaacataatcagcctcttccaggaagggtacatattaatgcactttagagcagtttgtgattgcctctggctatttgtatacggacttgccagcatctgaaaactataaataggaagatttaggaggaaacagactttataactaatggaatacattgtttcagttgaattttttttttttttttttgatggagtcttgctctgtcgccaggctggagtgtagtggcacaatcttggcccgctgcagcctcccctcccagattcaagcaattctcctgcctcagtctcctgagtagctgggactacaggcgcgcacagccacgtcctactaatttttttgttatttttagtagagacagggtttcaccatgttggccacgatggtcttgatctcctgacctcgtgatctgcctgccttggcctcccaaagagctaggattacaggtgtgagccaccgtgcccagcctcagttgaattttttttaaagagcaaaatggaagaatggctaattgaatgttaaaaagtaagaccatttcctgttttctggtaaggatggttgatcgatgtgtgtttgcatgtgtgtgtgagtatatatttataaatgagcagtttttgaataaagacatatcaatactggataaataattccagtcctgcc

SEQ ID NO: 32483 - DNA, 1031 bp, Homo sapiens
acttattaccagccacataagcttgcctaagattttagtttggagagcagtaatttattatagactagcactagaattcattttcatatgccaaaatgctaatgtgaatgtgcagaaagaacctttgtctctaggggtaaaggaggcggtggatccattaatgttctttctttcctgccctacttccctttcattttcttttctgcttgggggtgagttattttgacatgattatgtactctcatttctgcattcaaatccgctattccccacccttgcctgccaacctccatctattgaatctacgtgtatatgtgtgtgtttttgtctctgcgttttctagcatttatctaaatgcttcccagcacagatccaatgaatatgaggcttcttattcccactaagcctgacataggaatccaacttttttttggaagaagaactgctgtgtcatcttttttggtgcatggatactacatattgatgctttgatttagaatatttattggcactaagcccatctgtagacagtttggaacctcagtttcttttgtgactttcttggcagtcagcattcctcctgtttgcttagaacagggaggtcagtggatctggggagctcttgaagcctacaacatagccatttctaacacttagtccaggcttatgtacctgatctgatcagccacaggcagaacagtcatagagctaacaggtgaggctgccacatcatctaatggcatacccactgctcagtattcagtcatttcaagtacaaataaatggagttaaccacagatggcacatttagttcacactatgactataatattactcgctatttacagactagtataggaataaacatgtttactctgataattctgaatactaatgtaaaatcatcttgctatattcactcatggattggatggaaacactctgcagaaagtgttatttcatgctattttggagatatgtatagcttctcttgcttcctcactgtggtgggtacaatgcaaaaacctttg

SEQ ID NO: 32484 - DNA, 1044 bp, Homo sapiens
tctcagttcagataaaaaaatatgcaaatgatgatatttaaatcaaaatgacagtatagtagaggatggaggggcacatttattccctttcttcccaaccctttctcttttttatatctaaggaggagtttctaactttatggatgagttgaagattaaggaaaagttcatacctgcacaccaagtaccaacttagaaagaaaacattcctgaccttgcttcaaatattctaaattgtccctcttttattcagataacgcatttggtttttgtgacttttctgcattcaaaactatcttacatgttttgagtacttgatgtgggccaacctttatgctgggcttttaaatatgttttcatttaatccatatactcatcctccaaagtaaacatttttatcctcattttcactcatataaaaatctaagtgtggtccaggtacggtggctcatgcttgtaatcccagcactttgggaggccgaggggggcggatcacgagatcaggagttcaagaccagcctggcaaacatggtgaaaccccatctctaggaaaaatacaaaaattagccaggcgtggtggtacatgcctgtaaatgcagctacttaggaggctgaggcaggagaatcgcttgaacccaggaggcagaggttgcagtgagctgagattgtgccattgcactccagcctgggtgacagagcgagactccgtctaaaaaatacaaaaagtaaaaacccaaaaacctaaatgtgatgttgggacgtatctaacactaatggatccaagatcactgaccagaaagcgagggatgcaggcctgggattgtttcattctaaattacatgtaattgtcaccaacaagaaaaggggtagatatgctcagggtggacactgaagtgtgtccaacatctctgttcatgagtagaatagaagactaaaaacattttcaggtctatttttaatgactctgaatcatcaacatgaatgcaatccagaaaaagatgcacaaatattgtgcagtgactggaaggagcatgcagataattt

SEQ ID NO: 32485 - DNA, 1032 bp, Homo sapiens
ggaaaaaagctaaaaagtaagagatgtgtataatatgcagtgcttttaatttatgttgaggtcggtgtgaatttaggattaggtatgatggttttaggtttttaatatagatgaaattaaggcttgaaaggtggctcacgcctgtaatcccagcactttgggaggccgaggcaggtggatcacgaggtcaggagatcgagaccatcctggctaacacagtgaaacgccgtctctactaaaaatacaaaaaattagccaggcgcggtggcgggcgcctgtaatcccagctacttgggaggctgaggcaggagaacagcgtgaacctgggaggcagagcttgcagggagccgagatagcgccactgcactccagcctgggtgaaagagcgagactctgtctcaaaaaaataaaaaataaaaaataaaaaatattttgttccaaaaaaaaaaccagagccaaaaataatttttcttgtgtagtcaaaaattactcttacccggatgacttaaataattatctccagctttgatatctcatacaatctccagtccttcacatccagctgcccactacacaattccttttccttctcctccttttcctcctccttctttatttttcatagacatctttgaccaattttcagaagtatatttctattcctaacttgctacattatttttttataatggaacgtttaatttgatcataatgctgttactatgtttattgaggtaatcacatacttgtccttttgtctgtgaatgaagtaaattaaatatacagatttttctaataatgtgtgaccccttgatacctgatataaaatcaactaggttctggtgcattatgtttttcacacatttatgcatttttttattagtgtcttgtttaggatttttgtctctacatttattattgagattgttttagacgtttcctttctaatgtgatccttgcttggttttggtttctgtgttattctagcctcataaaatcaggcaagttttctctgtttctattcactggaaa

SEQ ID NO: 32486 - DNA, 1071 bp, Homo sapiens
cctaactgttagaaggaaaactaacaaacagaaaggaatagcatcaacatcaacaaaaagaatgtgcacacagaaacctcatctgaaagtcaccaacatcaaagaccaaaggtagataagtccacaaagatgaggagaaaacagcacaaaaaggctgaaaattccaaaaagcagaatgtttcttctccaaaggatcacaactccttgccagcaaggggcaaaaaactggatggagaaggagtttgatgaattgacagaagtaggcttcagaaggtgagtaataacaaactccatcgagctaaaggagtatgttctaacccgttgcaaggaagctaagaaccttgaaaaaaggttagaggaattgctaactagaataaccagtttagagaagaacataaatgacctgatggagctaaaaaacacagcacaagaacttcatgaagcatacacaagtatcaatagctgaatcaatcaagcagaaggatatcacttaatgaaataaagcgtgatgataagattagagaaaaaataataaaaaagaatgaacaaagcctccaagaaatatgggactatatgaaaggaccaaatttacgtctgattggtgtacctgaaagtgatgggaagaattgaaccaagttggaaaacactcttcaggatattacccaggagaacttccccaacctagcaagatgagccaacattcaaattcagaaaataaagagaacacctcaagaagagcaaccccaagacacataattgtcagattcaccaaggttgaaatgaaggaaaaaatgttaagggcagccagagagaaaggttgggttacccacaaaggaaagcccattagactaacagcatatctcctggcagaaaccctacaagccaggagagagtgggggccaatattcaacattcttaaagacaagaattttcaagccagaatttcatatacagccaaactaagcttcatacatgaaggagaaataaaatcctttacagacaagcaaatgctgagagattttctcactatgaggcctgccttaaaagagctcctgaaagaagcactaaaca

SEQ ID NO: 32487 - DNA, 1043 bp, Homo sapiens
actttcatgcccacttacctggactcataggagtcttcctgaatgctaaccctgttgcctcagcattttctcacccaacagggcttatcatcatgtgagaaggtggaggtttcactgccaataagccctttaacttttttttttaatgctgtaagtaatactggtttcagcatggataccttgaatggtggggacaggggtgatagaaaggatgggtggcacaattttgagtcttctagattcggaggatgtaatttttttgtctttgtcctccccatctctcagaaccaacaggcattcacttcttcaggtgcttctgcctgcctttttaagtctgtgggctctaggcgcttacactcacattagcccacttctgtcagaggacagatacgtgcctctgattgcagagacctgtaactggttcatctttttgattggattttgaactctgcttaaagtgtgatatgaagaaaagagacttgactacagcatcaaatagttatgtagatcctgactgtcactatctgcacacaagtgagtaatttgagtttctttcgccatctgcaaagtggagattctagtatctatgacataaggctgtaagaagagacaatgaaaaagaaaatcacggatgatatgtgtattattttgtatcctggtcctcaggatattttatttccttttttgatagctgcccatcctttcaccaggacgtcattattttcccccttctgccttaatagaggtctgctcttctttattctgcctgtctgatctcttagtctctgctttcctaattctgttgcctgccagataattcctatctagtgttgctaatctctgactaaacaattcctttattcagtcacttttttaaagaaagcaccctcacaaaccagttttagaaattctctgattctcgataaattacatgcttgcccattttttcccacagcttacatatcaattactggagcataatttccccttacattatgaatagcaaatgttgagcagaacagccctgcccagttgcagaagcc

SEQ ID NO: 32488 - DNA, 1019 bp, Homo sapiens
ggttaccaaaaaagagcctagatatctccataaacacatttgagaagattgaatgctcctccaccttggcagatagagaaaaatggactgtgttatttgataagtatttttatttgcatatgatagaatccagtctgctcttttaaagcataaaagaatttattagaagataaagatagttgagaatcactgagaaccctgaagaaacaaattccagaccaaactccgaaaaataacttctaaaaccacaccagagagctaggccactaggtaagctgttatctttgccgtggtctagagtctagaaagctactgaatcagaaagccactcacccaattagaaagctgctatcacagctgccaactccagaactatctccattctactttgatcaagttgtagcaatgtcaggaagctgccactgaaattactcactccaaactctactttctttgccagactccttactaaaactatagatatgctgtgactaccccaccgttccagttcccaattaaagtcacacaagtattcgtgtgattgttgatgcaagtaacaagagcactagccaaaaagaagcccagggaatggagctttttttttttttttcttagtgctcagttttatctgccaggatcatgtaggtgtagacgtttagcaagctattcattgtatgtgctgtaaagctttaggacaggggctttaacttgtgtatctctatatatttctattgtattgttcatgtttcccagtgggctctatcatagaaatggcagaaggatatggaagaaggtttgagaggagcgtgttcccagaacagaatgctcaggaaaattgttcttgaagatacctgctcagaatttaatactagagtacatgtttggtccttctattgtctaggcgatgttaaaaaccgttgccctacattcggcttattcagcctcagcaagactgaaatatatccacttcacagattcctataaagtgtacatttttaaaaaatggtacagaaaatgat

SEQ ID NO: 32489 - DNA, 1018 bp, Homo sapiens
ttaataaacttttatttgaaagacagtgaaaagaggtttgcttacctttcagaggtgccactctcatgctagcaaatcaagctgaaacaatcaccaaaaagaataaacacagcaaaatactaacagatgatatttatggagcatttgatgtgggccaggggctcagcaaagctctctatcacacctttaatcttcacaacaaactcctacaggaacactattattattgccattttgcaaacaaagaaactgagacatggagaggttgggtgattttttttttttttttttttgagctgcatttgcaccatggtggtttcaaagcaaagacaagcctcgttgagaataatgctctgatggacaggaatgccaggacctgggtagaaactcaagtttcctctcctgtaatatttttatttcttttctattaagctgtctttccaaagaagaacttttaaaaaaattcaatgagggtacagttttaaatttaaatgtagaacaaacaaagacgaaacagaaaatggacaaattgaaacaggaaaaatggtcaagataggaattgcacacaagtgtggctggagttcctggaggaaggttctatttctccaaagtgttctggaagcagagctgcttacctaaaaccagtgcacaggccaaactatgactgttctcacacttggcaatgctgacccaggctgtaggctgtaatacctccttgtttgggggacttaattacttgtttccaggcacagaggcaaagaagcattaactgtgtcgttcaaagacagtcataaagccagtgtggggacaataaaggtaaaaatgtatggtgctttttaggttataagcaagccaaagaggaactatgctgagaatgcccacaaagcactgaagtgatactcaaattacatttgcgtgattgtttctcctatggaaatcacgtattcattgctatgtctccagcgtttaatacagtaaatgccattgtaggaatctgatagatattcattgaactaaa

SEQ ID NO: 32490 - DNA, 1054 bp, Homo sapiens
attgagagggaaaaatgaaaggaatatcacctatttatacatttttctactttaatcacaattaaaagggaatttaagtctccatatgtgcgaaagactagattattttattttattatttattttatttttcagacagtcttgctctgttgcccaggctagtggtgcaatctcagctcaccacaacctccgcctcccagttcaagtgattctcttgcctcagcctgccaagaagctgaaatcacaggtgtgcaccaccacgcctggttaatttttgtatttttagtagagacagggtttctccatgttggccaggctggtctcaaactcctgacctcaagagattctcctgcctcagcctcccaaagtgctgggattacaggcatgagccactgtgcttggcttttattatttatttatttatttatttatttatttatttattttgaggccaggtcttactctgtttcccaggctgtagttcaatggcatggtaggcttactacagcctcaaactcctgggctcaaatgattctcctgcctcaggctctggagtagctagaactacaggcatgcactaccaccacgcctggctaatttttttattttgttagagacggggtctcactctgttgcctaggctgggactgtagaattttttaaaatacgtatgcttacagctattcaaatttgtagagatgcacaaaactttgcttcctaggaaggcagaatgataatttctatctagaatcaagaatatttaacattagtgtaatttatgttccccatttatttagattaccggtgtgctgtccttttagtgtcccctttgctaagatattggaaaatgtcacaagcttaatttctatttacttcaactcagcatattttggggtggaccctaatatttgcctatagaaattttcccatattttaaaactccagagggaaacatgagctctgctgtgtgtcttataatgtctggttatctaataatggctgaaatttcaagtacaaagtatctgataattatttctgttaagacagaatattt

SEQ ID NO: 32491 - DNA, 1099 bp, Homo sapiens
tcctatttcattgtttcctatagattccagttcataagtgaaatttcccatcttgtcacctattttctgaatatatttggcatagtaattttaaacctatgtctaatagtgccaatatttatttttatctatgggcctgtttctagtgtatttatatattttttctttgtggttttaatattgcattcttttcacaactggtaatttttaacctggtgccagacattgtccatggtaaattttagaggctctggataaaattttaccttcctccagtgaaaattttgctttcctctggaagactgattaggacacgtttcttaagcattttaaattattaccttactaatcagacttttcagacattttgtttctaagcattcttcccatgaaattgtaatttcatgccccagatagactgcatatctgtttttgaatgtctctatatttgtgctttacacataaaaagagtaagcataaagcttattctttttttatttaatacatgattaagaatgactgaataaacaaattaagttaaaagttaatttaggccaggtatggtggctcttgcctgtaatctcaacattttgggaggctgaggtgggaggattgcttgaggccaaaagttcaagaccagccttggtaacaaagggaaacctcatctctacaaaaaatattttaaaattagctgggcctactggtatgcaccagtagtcccagctattcgggaggctgaggtaggaggatcacttgagcccatgaggtcaaggcagcagtgagccgtgtttgcaccactgaactccagcctaggcaagagaaaaagaccccatctcaaacaaaacaaaacaaaacaaaacaaatcaaaacaagacaaatgttaatcaggacaaatagctaatgcatgtggggcctaatgcctaggtgatgggttgataggtgcagcaaaccatcgtggcacatgtttacgtatgtaacaaacctgcatgttctgcacatgtatcccagaacctaaaataaaataatttttttaaatgttaatttaacaactaaaaaactcttaacatttaactttacaactgtgtttgctgagcaactt

SEQ ID NO: 32492 - DNA, 1043 bp, Homo sapiens
taactcctctctgaagtcctcccaatcacttcacagactataacccctcattctgccccttttgggaccagtgaaatagtattcacacgtttgtcacctcactgcagtttaaatttcttgtggcctggcctgtctgttattcttcttttatacataacattcagcagtatgtctgggacacagtaaccatttctattcattcttagatatgcaagtgaatgtagaaacaaatgaatagatgaataaataaatgaaagaaaaaaattactgacttggcagggactttcacttgcctactttaccaagttcacacttctcagcaaggtcacaaaagcccactgatctatacttccttccattgagtttgtctctaatacctgttggcttggccctggtttgcctaatggaattcagttctcttcacatagaatttttttttttttcctttctatattaacagttcatggcattctcttttcttggaacatcctttcatatacttcatcattttctttcggtacaaagtctgctccaattatctccaattctgcctcttaccattcccttattcacatatgatcccaatagactgatgaagatctattgttttcatgggagttttttgaagctagggtttccaccaaagtgttggtatgatgtcatttagcatatttggcatcagatgtccaatgaccaggatttcagtttcaactctaataggtgacctgtctatgagtctcagtatactcatttgataagtgaaaattaaaatgactagctacttcatgcaatttttgtaataattaaaggaacctctctatgtaaaagatgcattagccaaatatcttgaaaataattttttccactataaagtattacataaattttctttgaattattgtaactacttttttaagacccaagagcaaaaggcaaacaaagaaataaatgtttgttatatcatcattgtattaattaactctatagttctcatgtctctgaagactttattttacatatctcaactaaattaaccttcccga

SEQ ID NO: 32493 - DNA, 1037 bp, Homo sapiens
tttcttatggttgctgaccactcagtgatgctgagcaagcctccattgggcaggtctatagccctgtttatttttttcctacatatcagtgtcatgcaggtctatactaaaacgtgtctgtaatttgggtccatctcctgttttcacttcacataatctatcctctatagcagttcaaaacatctgagtggcagacactacttcaaaaatattcccattttcatcatcacccaaaagaatttctaaatcctcaccatctcctttattttgcttatattctcaaagacactagctatggatttataagatatgcttcccacaagtagcattattaagttaatgtttatgctcctctgaactgtttcatttgagtacaaagctttgatgcttcttaaaacctgtgttgattctttacacacctgtttgaatgagtatataaaataatttctcaaaatagatgttggtcaggtcatggagagtgacagcatgaaggtcctgggtatctggggaaatgtagcaggcaggagtcattctactggaagaacaagaagagaagaccataataaggcaggagatatttttgccgagtagtcaatttctcctagtgccaatgtgatttctgtcacactttctctcttaatgagtaaggcataagttctctggtaataattgtctactttcagaagttgcatgtacgatgaaatggtctgcctcgggctatctatgttgattgttttcgggaaaatataggataagctaggaacatatatggtacccattacattctcttttccaaaccagatttatttgtttcaagtttgttggcttaggtcaagatgagagcaagggtagaataaaacagatagtaaggtagatgggtgtatgtgttttcataactttaagactaaaaaacaaaaacctccaaccaataatgtaatgtgagagtgcttttaaaactgcgtagtggttatttttatgggttttatcatttcccctcatactagagactgaaaggaagtccatagaaaccatgtata

SEQ ID NO: 32494 - DNA, 1065 bp, Homo sapiens
gaggaaagtaagacacagatggagtaatggatttgcattagagaatagttattaatgttttctggatcatagactcttttaggaatttgattctaactatagcccctctcacctagaaaatgtatatagaaaaaaataaacattgtttgtatagaaactcatgttaataatctctagcctaggtaacaagtattagcctagccagaactatagccctgttaacctggcttttaaaccttgttcatttctatgttccatcctacctattaactatagcagagacatacttttattattctctctctcttaatcttgtgttaagattaatatattttctttaaaagcttactgaatatttctcctttctgtacaatatgtgatataaaacttctgtaaattaattcttctcgtttcctcttcttcacaatttctactaaggttttttttttcatgctactttcctagtccctatgggatgtggagacagcatatgatgatctgacagtttcagactgtacaacttgtgcttcacacatcaaagaacagggacttagtaagctgtgccttgttttcctgttctgccactgaaaaagtgatatattaggtttctaaatattgttcttatgatgtcaaggttaacttgtggaataagtccatatgagttataggaattcactttatgtttccctcaattgtttttgagctttaaataaaaacagagggggatgagactagaaagataatacataacactcttaaaatacacaaaaaaaatctctgtcttttgttatctaattgcttttttcttttttctgtatactttttattttctgtttgcctataatactctcaaacatataataacatctttttctatgtctttttcccttaaaataaaactttattaaaaaattatccagggcttttagtttttatcatttactctgtatcatttttatcaccagattttaaatgaaggagagtctgtgaattagacaagctgcaaacatttttatattgagtacttaaacacaatcattataattaattttgatacagaggttg

SEQ ID NO: 32495 - DNA, 1051 bp, Homo sapiens
gggctgttgtgctagcagggaataaaacaacattagtctccttgtacacttccatcagagctctaaaatgaacaggtgtactgttaatgagcagtaatcttttggaaggaatcatttctgagcagtaggtctcaacaatgggtataaaatatttagcaaatcatgctgtaaacggatgtgccatcatccaggctttgttgttccatttctagagcataggcagagtaaatttagcagaattcttaagggtcttagaatttttgcaatggtaaattagcattggctttaactaaaatttgccagctgcatttgcctctaacaagagattcagtctgtcctttgaagccagactctggctgtgaaagctctagatggcattttcttctgaaaaaggctgttttgtctacattcaaaatctgttgttgagtgtagccatcttcatcaatgatcttagctgtatcttgtagataatttgttgcagcttctacatcagcacttgctgttttaccttgtacttttatgttgtagaggcagattcattccttaaacctcatgaaccaatctctgctagctgcaaacttttcttctgaagttttcccacttctcccagcccttatataattgagtagagttagggccttgctctgaattaggtgttccttaagagaatgttgtggctggtttgattctacccaagccacctaaacttcccctgtatcagcaataaggctgttttgccttcttatcatttgtgtgcttactggagtagcactttaaatttccttcaagaacttttgttttgcattcataacttggctgtgtggcatcagaggcctagctttcatcctctctctccttttgacatgtcttcctcactaagcttaatcatttatagcttttgatttaaagtgagagacatactactctttctttcacttgaacacttagagcccagtgtagggttaatattcacctagtttcaatactgttgtgtcttagggaatagggaaacctgaggagagggagagagatgagagaatggcccgtccat

SEQ ID NO: 32496 - DNA, 1043 bp, Homo sapiens
tccattgataaaaatattgaagctatcttattcttattcatctttcacatatcctttacttactaaaagtgactgactcccacaagttaccagtatatgtaacacagaaatccagtgttctttttcttaaaacaccagtatgttagataataattcttgaataaattctataatgctatttttaaaaaatcaactcaacactgatttcagtgaagttcaggtactccatttgggtgaattttaactggcaacgtgaaaaaaaagaaaatttggaagatgctcaaataggattgatagaggttcattttgtgtcatattttcgctttatatggatgttgatatgttctcagaataaatttataactgcaatagaaaatggaatgactattgattattttttagttacccaaactaattgtcatataaagctttgtaaatcttttaaaatgagtatgggtgtaaattaaaaacgaattaaagcagaggcttataaagacactatctccccttcaatgggttatgtatttttgttgtgtgttaggaagatatctcttgatctccacacccaaaactccttccaaatgaacaaaggcctacacacaaaaattatttcaattgctaatagccagtttttatttttcaaaagtaaatgctttctttttttgaaaagtaaatataactattttaacaaagtaagatttaaaaaaaaaaacaactcagaaaaaagtgccatgcagagataacagggctgatctgtctgttatctgcagcctctatccttactgttaacaagccttttatctttgaagacactaaacatctgggatctaagcactgacacctattagttacagtggtttccttttacctttctaaactatctgatagataaacctccaggaatcctacaaaattaggcccttaattgaccaaacgaatgtctgtctctctttttcaatctaaatcaaaaaggagtttgctcctaggagatgagatgatgtacagtggaaaaaaatatttcagctgcaactccactggtaacc

SEQ ID NO: 32497 - DNA, 1028 bp, Homo sapiens
ggtgcatgaccctgggtcttttggtgatgtttggaagaactgattctttgtttgcaataattttggcctagagacttcaaatagtagcacacattaagaacctgttacagctcattgttgagctgaatttttcctttttgtattttcttagcagagctcctggtgatgtagagtataaaacagttgtaacaagacagctttcttagtcattttgatcatgagggttaaatattgtaatatggatacttgaaggactttatataaaaggatgactcaaaggataaaatgaacgctatttgaggactctggttgaaggagatttatttaaatttgaagtaatatattatgggataaaaggccacaggaaataagactgctgaatgtctgagagaaccagagttgttctcgtccaaggtagaaaggtacgaagatacaatactgttattcatttatcctgtacaatcatctgtgaagtggtggtgtcaggtgagaaggcgtccacaaaagaggggagaaaaggcgacgaatcaggacacagtgaacttgggaatgaagaggtagcaggagggtggagtgtcggctgcaaaggcagcagtagctgagctggttgcagctgctgatagccttcaggggaggacctgcccaggtatgccttccagtgatgcccaccagagaatacattctctattagtttttaaagagtttttgtaaaatgattttgtacaagtaggatatgaattagcagtttacaagtttacatattaactaataataaatatgtctatcaaatacctctgtagtaaaatgtgaaaaagctttgagtgttccttcgtgttttttattgttctttgaggcctacagatatgttcatttcagtatccataattctaaagagcttaaaaacagaacaaatgaaacaaagccctccactacttctgtctcccgtccttctgtccctctcttgtttgtctcatttgtgacctccttgtggaaccagctccaatcttacgataggcccgtccatgtct

SEQ ID NO: 32498 - DNA, 1043 bp, Homo sapiens
attgatattaaataaacagatctatttattattatatatgggaacctgtaaatgttaaattattttagaaaaatcaatgcaagaataactgtagccattacttttctatgaaataatgttttacttttttaacttccttacagttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatactcctacccactcaacagttatgaactcaaggcaaactaagctgcctctcaacaatgagggagaactcagataaaaatattttcatacgttctatttttttcttgtgatttttataaatatttaagatattttatattttgtatactattatgttttgaaagtcgggaagagtaagggatattaaatgtatccgtaaacaaggtgatgtgatctttcatgtgttagtatattcgaataatatacatatgagaggtatgcctgtccagtaaagagattgatttgtttgtatggctctggaataactcattcgtttatgaacacatctcatgtattacttgacacagtacctttggtatgtctgcttttctttcaatcctcattatctttagccctcagctggccagtacttattgctaaagaaagggagatcaatggagttgcctaccagcacccattctcttttagttcagctggctaatagtattggaatacattgggaaaagagtgggttaaagtcctaggtggggttctctttgttgcctaccaggagaaagcagtaggcttcctttctaagatacggactcagctggtctattttaccctgtgacatttaaatatacttttgaataagctactatcctgaggctgagggttttgctgccacttttcctgtgtttccacttctgcttccaaagattttcctct

SEQ ID NO: 32499 - DNA, 1042 bp, Homo sapiens
taaataaaattcccgccgggcgcggtggctcaagcctgtaatcctagcactttgggaggccgaggtgggcagatcacctgaggttagtagttcgagaccagcctcgccaacatggcgaaaccccgtctctactaaaaataaaaaaattagcagggcgtggtggcacgtgtctgtaatcccagttactcgggaggctgaggcagaagaatcactcgaacccaggagatggaggttgcaatgagccagagccaggatcgcgccatggcactccagactgggcgacgagcaagactctgtctcaaataaataaataaataaaataaaataaaataaaattcccaaatcttgtgtatatggagttttgttaaatgtggacatacctgtgtgacttaatcccctgtcaagacttcagagcgttacacatactccacaagattctgtcatgccactttcccatcaaaccccaccactgtccagagacggttgctttttttttttgagacagggttttgctctgtcatccaggcgggagtgcagtagagcgatctcagctcactgcagccttgacctctcaggctcaagcaattctcccacctcagcctcccaagtagttgggactacatgtgcacaccaccatgccccgctaatttttgttttgttttgttttgtagagacaggattttaccatgttgcccaggctgaggagtaaggtttttttgattccagagtctttgtcttaatcattactgtatcagtagttctcaaaatgtagtttctagaacagcagcatcagcatcacctataaatttgttggaaattctcagaatctaccccaaacctactgaaatagaaactggaaagtaggacctagcaagttgtgttttaacaagccctcaaggtgattctgatgcatgctcaagtttgagaattactgctttatattatttatggtgctgaagtgttagcgtgaatttatgtgggtaattacaaagtataaaatcaagtcataattagagattgtgctaataaggatgacaggaac

SEQ ID NO: 32500 - DNA, 1034 bp, Homo sapiens
catttggacattcattcattaaacaaatacttcatatagagtgccttctgtatgtcagatgccgttctaggaattgggtctcagtctggaacaggatatatgtcagataacctaaattccgaatttttgtttgttttattttgttggttggtttaatggaaacataataaggaagaaatctgaaatcccatcagtctacaataggacctctcttcgatgacattctcacctctgtctctctctctctgtgtgtgtgtgtgtgtgtgtgtgtgtgtgtgtgtgtgtgtacaccttttactttctttttttttttttggctactctgataacactgcaatagaagtctccttatggaaagtctttacaagtgtcctttactaatcacttcagctaaggatgggccagaggccatgcgtgttttcaaggctttgagtgaggactgcccccaagtgatctctagaaaaaatatatccatttacaccttagtgtctgagagcactgattaatctctgagcaacacaatttttttaaacttttgccagtttggtatgcttgcctgatttgtaagggaactgaaagcaccctttttggcctctgcaacacttaaaagtacatctcacaagaccctctgcccaccctttcctagtgcttaagtcttcccaaagatgaggtacagcatttcggtaataatgaaaagagatatcaccacagtcacttgaaaagtgaagaacttggcctcctagtgggtaacaaccacattctaatgcacctctttgctaagcccttgctcttcacaataatgacaactcaatacggatatattcacactattctctctagtcccccgtttgtctaaccttgaaatgtttgacttgaaggttgatgaaaacaggatcatatccttaagtaaggcctatcttgggaatactatgtctttcataggtctaatatgacctatgatgtgatggaaaaaccatggtccttattttacaggtgagtataggtgcttggagaggataaggaaatcaccctga

SEQ ID NO: 32501 - DNA, 1051 bp, Homo sapiens
ttagcaagttttcccagctgtgcactgttcatttattttcaagtgaactagactccagctgagtgttcatatacagctgatcccagctgtagcaagagctttgactgaaatggtctctggctccctgagtctgcaacttattcaaagacactgtcttcccggtaccaggaccatgctgaggcatgaacttaaatccaagaatagagaaattcagatttcatagtgttggccttatttaaaacaacgttccaaataacagcttggaaggccatacagttcacagcctgcagttgaaacagtgtacttgttctcttttgttgttatagcattgctcatgctctctcttgggactttttgacttgcagatgctaatactggagaccgtggacagaccaataatgctgcttctgcatcagcttccaactccacctgaacagtcccgagcagccagctgcacaggaaaaaccaccagttacttgagtgtcactcagcaacactggtcacgtttggaaagaatattaaaaagagaaaaaaatcctgttcattttagtgttcaatttttttattattattgttgttcttatttaaccttgtaaaatatctataaatacaaaccaatttcattgtattctcactttgagggagatccagggggtgggaggggttgtggggagggggaaagcggagcactagaacatacaatctctctcccacgacaatctttttttattaaaagtctgctgttgtatactttaaaaacaggactcctgcctcatgccccttccacaaaagaagaaaacctttttctgtgctgatgggtttttttgaactttgttttcttttaaagtctagtgtgagactttggtatagtgcacagcttgaaattggttgggagcttagcaggtataactcaacggggacttaaatgtcacttgtaaaattaatccatatcttcgggtatttatagacttgcctttggcatgttggtggcaggtgtggcagacaaagaaatgtgtatcattcgtaacccagggaggtcaataaagtttgg

SEQ ID NO: 32502 - DNA, 1033 bp, Homo sapiens
tgttctgttgatttggggtggagagttctgtagatgtctatctacagaacttggtccagagctgagttcaagtcccaaatatccttgttacttttctgtttcgttgatctgtgtaatactgacaatgtggtgttaaagtctcccactgttattgtgtgggagtccaagtctctttgtaggtctctaagaacttcctttatgaatccggatgctcctgtattgggtgcatatatatttatgatagttagctcttcttgttgcattgatcccctaatttttgtatttttagtagagacggggtttcaccatgttggccaggctgatctcgaactcctgacctcaggtgattcacccaccttggcctcccaaagtgctaggattacaggcgtgagccactgcgcccggcataaactggtagtttaatgcagaatcttattttcactcttaccaataaaatagttttgcatacaaagttaagagtggactctaacatttgtgtcttaaccttctatagaactgtcaagtaatccacctctggctaccatccttattcctcctcatgctcggattcaagcagctgcttcaacccccacaaatgccacagcagcgtcaggtaagaacgttctaagtctcttctataaaaacatattctgggctgggcatgatggctcacacctgtaatcccagcactttgggaggccgaggtgggtggatcacctgaggtcaggagtttgagaccagcctgaccaacaaggtgaaaccttgtctctactaaaaataaaaacttagccaggtgtggtggcaggtgcctgtaatcccagcttctggggaggctgagacaggagaattgcttgaaaccgggaggcggaggttgcattgagccgagattgcgccactgcactccagcctgggcaacagagcaagactccatctcaaaaaaaaaaaattctgtttttcaaaaagatatgattacctttcatttcatttgatgagtatgaacatttaatatcttttatatatcaaaaacagcaca

SEQ ID NO: 32503 - DNA, 1038 bp, Homo sapiens
ggaatttttcttctgtgttttgcagtataaaacaatgcagcaaaatttagttaaatggattttgttaactttttggttgattcatatctatatttaaactcattttgcttttgtttaaattgtgcattaaaatgtttaattatggaacacataattattgatgcaccatcaaaacatttgtagttttccctaataaactacgtggctttttaatgaatagttttcatgacttcttcagttggctgaagaaatttttatcacattaatttttctaaagttttctggaatttcttgccgttttgttttaaaccatgtctctaggtaacacagtctatcttttatccttcctatttttcattttcctctcacttctccagagctgtcccacttcattatggacctttttgttcttatccccctactctcaagcttagcacacatatctagtaaataaatattaccttacatttcaatttcagtctcttcaacactcctctgccttcaagaatacatacactgtgtctgatgctaacaggtgctgttactttgctgtttctatcctccaaaataccaccattttttctattctttcactgcagtttatattcaccctcactgactccatttccttatcactcattgccatgggtagacaaagtgattagaagtaggtagtaatggttgggattaaaaaaaaacattttgaactggttgacatagccctatagaaatgcccatagtctgtccccataaaaagtgtggacttacagtggcaagaataggactatagcaagagtgcaaggaggcttcctcacagggaaaagttgtaagtaacagttaacaacctctttgaagtagagaagactgaacagatgaaagcaatggattttaaggattgcctgtaattaaggaagagaagaagaacaatggggtgtagaagttggaaggatgtagaagtagtagtgattgttcattttagaattcttaacttttaggttcttgctagaaaaaggttcacaaagtaccccccttcacatc

SEQ ID NO: 32504 - DNA, 1045 bp, Homo sapiens
acacttataattcgtcaattaattaaaaacaaatgaattcagaatgaatcaaagacctaaatgttagagccaaaacgataaaactcttagaaggaaacagatataaatctttgtgaacttcaattagtcaatattttcatacatgtaacacaaaaagcacacattataaaagaaaatagaagtaaattggactttgtcaaatttaaaaacttgtgctttagaagacagcatcaagaaacttaaaagacaattggagaaaatttttacaaattatgtctggtaagggatttgtatctacagtatgtaaggaattcttacaactcaataataaaaagaaagcccacttgaaaaatggacaaagaatcggcatagacacttctctaaagaagatacacaaatggccagtaagcatacaaaaagatgctcaacatcattattcatcaaggaaatgcaagtcagtaccataatgaatactattatcacactctccataatgactaaaataaaaagacagtaactaatgttggtgaggatatggggaaactggaaccttcatgcattgctggtgtggttgtaaaatgatgcaaaccttgaacaagtttggcacttcctcaaactattaaacattgagttatatgacccagcaattcagcttgtaggtatatatcctaataactgaaaacttacatccacacaaaacatgtacgcaaagtttatagcaatgttatatagccaaaaaaggaacaaataaaatttctagcaactgatgaatagataagaaaatgtcacacacgaaaggccacatattatataattccattctatttatattaaatgtccagaagagacagattgtggagacaaaaagattagtggttctggggagctgggggaaatgagaatgatggctcatggatacaggctttcattttgaggtaatgaacatgttctaaaattagacagcagtgatgattgcacacctctgtaaatgtagtaaaaatcactcagttgtataaggggtgggtttcatgatacatgaagtaca

SEQ ID NO: 32505 - DNA, 1067 bp, Homo sapiens
ggaagagtagggtggtggaaaaaccatctgattcatctgtagctcaatttatagcctctattcatggaattttgtaccttcgggaaaaactatatgatccttaatgtcaacttgatacccagaacccattgagttgtgtttattacttattatatgtatattgtaaaaatttgtgtctaccagcaaattagtgatgcaacccctaaatcttacagtagtgaaatcaatttgaggtatctttaggtttaattctgtttcaaccattgtaatggtcagttcctttgctttgctttcaattacacatggtccccacaattcctttgctttgctttcagttacagacagtccccgacttaggatggcttaatgattttttgactttccaatactgggaaagcagcacagattcagtggaaactgtattttgagtacctgtacaaccattctgtttttcatttttaagacaatatttaataggttacatgagatgtttgacactttatcatgaaatagtctttgtgtttgattattttgcccaactgtaggctaatgtaattgtgctgagcacatttaagggtagtctaggctgagctgtgatttcagtagattggacatattgtttgcattttcagcttaggatattttcagcttactatgtatgggtttgccatgatatgaccccattttaaatcaaggagcttctgtacagttcaaccttattttcaccatcttcatttagcaaatattttggattttaattatccctgtcctgtcctatagtttgttcagtgcccatgtgtacctacactcttgtttcctgacttaacattttcattgtcagacaatctttctttttctttttcttttttttttttttttttgagacagagtcttgctctgtcacccaggctggaagttcagtggcgctgtcttgactgactgattgtgttagttggtacttaatttgttcttgtattatcagttaaattttttcatttattgctgatcagagcagcagctcttaatagtttttaaatcatggactactttgaaaatctattagtaat

SEQ ID NO: 32506 - DNA, 1041 bp, Homo sapiens
catttccttcatgccatctccattatttaatataaaatcagcttaaatcactagtagttttgctagatgcactgattctgcagaagtatgcacccaagatgtttagtcatagaaggaactgaatagagaccattagctttaatcatcattgaccttctcaagtcttcaccccagatgtttagtgataggaggaactgaatagagaccattagctttaatcatcattgaccttctcaagtcttcaccccagatgtttagtgataggaggaactgaatagagaccattagctttaatcatcattgaccttctcaagtcttcacccaagatgtttagtgatagaaggaactgaatagagaccattagctttaatcatcattgaccttctcaagtcgtcacccaagatgtttagtgatagaaggaactgaatagagaccattagctttaatcattattgaccttctcttttactacatcttagcccactagccaggagtgaacagagagagcatgatcagctggacatgaataggaagctaacaaacaaggagcaactttaagctggatgtgcaagtggaaaccaaaattattttactcttacatattgtttctgaagagaattcctttagtccagaaacaaacaaaagcatgcaaataataaaccaaaaacatccccacagtaacagaaaaccaaaacaaacaaaaaacagacctggcctggtgcagtggctcacacctgtaatcccagcactttgggaggctgaggtgggcagatcacttgaactcaggagttcgagaccagcctgggcaacatggtgaaaacctgtcactaccaaaaattagccgggcgtggtgacatgcccctgtagtccccgctacttgggaggatgaggtgggaggatggcttgaggccaggaggcagaggttgcagtgagctgagactccaccactgcactccagctcggtgacagaatgagaccccccctctcaaaacaacaacagcaacaacaaaaaatagaacagaccttgtgacagtttttttg

SEQ ID NO: 32507 - DNA, 1033 bp, Homo sapiens
gactgtcctcattttactgttttctaatttcagatgacctatcactttgcaggccatgactctgttccctgaactatttttaaaaagggtgaaagatagtaaaactcttacctggtgtttgaaacaaagcactactacttgtctataggaaaaactgcccaaatcagatatgttttattgttaatggggtgtcttcaccattgagagtgactgacttggtagggacagactgagacaccaaggttagaagagcttctgttctcatatagtgtcaaaacacttggtacagcccattctcttgggacataaaatagctttattctgataaatttggaagagggatttcgcttgtttgatagctcatttttataaaccctctgatttttttgtttttaacaaaattggtttggtcagatggagtttgggaaacactttggactgtacattatcagattggtaatttgaacaaaatactattactttcttcttatttttttactagatgaaaaggggccaaaaagtagctaaagaactagttgggctatttaggaacaaaaagctagatgtgatcacaatattgggaagtagttaaaaccagtctcctctgtaagagaggctgctccgtttttgtagctccatcaggtagtgaaaaaacttcaggctacaaagcttgggtattaacgttttgtctcgtaatgaattttctgaacataattagcatctatcttgttaattaaaaagcatcctttagaagatataacagtctcctatcaattatgctgaaaactaaatgtcataattttcatgcagcctaaaaacagggattagtatttattaatttatgaaatggttattgtatgtcagtacttggggagagggttaaaaaacaaacttcaaaactagtgatgaaggaaaaagaagttaaggttagagtcatcattgactagaaataaatggaagaaaagaaatcccagtcattgaaatccttgtgactactttcatctgtctttaccctggttttccagtaccttta

SEQ ID NO: 32508 - DNA, 1025 bp, Homo sapiens
tctctttattttgagtctgtgtgcgtctttgcatatgagatgggtctcctgaatacagcacactgatgggtcttgactctttatccaatttgccaatctgtgtcttttaattggggcatttagcctgtttacatttaaggttaatattgctatatatgaatttgttcctgtcattatgatgttcgctggttattttgcccattaattgatgcagtttcttcatagcatcagtggtctttacaatttggcatgtttttgcagtagctggtaccagttgttcctttccatgtttagttcctccttcaggagctcttgtaaggcaggcctggtggtgacaaagtctctcagcatttgcttgtctgtaaaggattttatttctccttcacttatgaagcttagtttggctggatatgagattctgggttgaaaattcttctttaagaattttgaatattggcctccactttcttctggcttgtagggtttctgccgagagatccactgttagtctgatggccttccgattgtgattaactcgacctttctctatggctgcccttaacagtttttccttcatttcaaccttggtgaatctgtcaattatgtgtcttggggttgctcttctcttggagtatctttgtggtgttctctctatttcctgaatttggatgttggcctgccttcctaggttagggaagttctcctggataatatcctgcagagtgttttccaacttggttcccttctccccatcactttctacaccaatcaaacgtagatttggtcttttcacatagtcccatatttcttggaggctttattcatttcttttcagtcttttttctctaaccttctcgctttatttcattaatatgatcttcagtgactgataccctttcttccacttgatcgaatcagctattgaagcttgtgcatatgtcatgacgttcttgtgccatgattttcagctccatcagtttatttaatgtcttctctacactgtttattctagttagccattagtc

SEQ ID NO: 32509 - DNA, 1052 bp, Homo sapiens
ttaatgatgatagcagatacttactatatgtattttttgacatgagcagttttacataattcttaccattagtactgtgtgattgatattgttattatttggataaggaaacctaagtacaaagaaattttaaattaacttgtcagggtcacacagttggcaagtggatggatgagcaaggattcgaatctagacagactctccagtgccttaccacattttatcctcgctgtatcaagcccctctaccccttctctctttctctcacagtattcatcctctttctatatcatagtatcagattctcacagtgtcataacctctttctatcaaaatatttaaaccacaccctctttctccttctcaagagagattggttttatttcattctctaatggttgcattatattttattgtgtggatataccctaattagccattgttcaattgatagctattaaaatttttttccctgccaaacattgtatatatgtgctttatcagaatacagtttataaaagtagaattctagggtttaaactttaaaccttgatataggagagcactttaaaccttgatataggctgtcttccagttagattttatccatttaaatgtacgttatttgaatatgagtaatgcccatttcctgtgtagcctttagatattaggagtatttttatgtttttcagttctgtaggtgaaaaattatttttatattttgttactttcttttctgttttaaattttttgtagagacgcatctcactacatggcccaggttggtcttgagctcctggcctaaactggttctccctcttggcttcctaaagtggtgggattatggtctgaatcatcatgcctggccctgaaaaattattttaatttacaacaccattttacatgttgtgaccctttttaccccttttagagtgtgtgtcttccttactcatttgttaaaacccatttaaaatgtaatcttgtagagcaacaaagattttattatctcagtgcttctgtgcgttggaaattcaggcatggcttagctagga

SEQ ID NO: 32510 - DNA, 2837 bp, Homo sapiens
aggcgtggtggctgatgcctgtaatcccagcactttggaggccaaggagggcggatcacctgaggtcaggagttcaagaccagcctggccaacatggtgaaaccgcgtctctgctagaaatacaaaaattagccagacgtggtggcaggtgcctgtaatcctagctactcgggaggctgaggcaggagaattgattgaacccggcagacggaggttgcagtgagccgagattgtgtgactgcacaacagcctgggtgacaagagtgagactccatctcaaaaaaaaaaataaaataaaaaataaagaatatagtttaccttgtatattttggcagttttctctatttaattccttacagttctcgtgaaaaaaaaatttcctttcttcctttaggagacaaggacggcagcaaggtgacaacagtggtggcaactcctgggcagggtccagacaggccacaagaagtcagctatacagacactaaagtgattggaaatggatcatttggtgtggtatatcaagccaaactttgtgattcaggagaactggtcgccatcaagaaagtattgcaggacaagagatttaaggtaaaatgtccagtatttcatatattttgttgctgtcgtaatacatataccataaatgattatttttttagttgcttctttttgcttcaaatttcttctattgtgcgcatttttgttcagctcaaccattgtagtgattttatttctagtcatgtattttgtagagataacattcactgaagattgcagtattacttttgtagtcattacaaatgacatatgtaatatatgtattttttaatcctgtgaaaggtaagttaaaatttcttaatttatactataaaaagtgacctgtcctcaccgttgtactgtgttgatgtagaccagaggaacactgcctgtagcatataagcattttatgtatttgactatgcttccttttttcaaaaaatttttttaatccatgttgcaacttgtgttagtctgtttttgcatctctataaaggaatacctgatattgagtaatttataaagaaaagaggtttaattggctcacaattctgcaaactgtacaggaagtgtggtgcagacatctgcttctagtaattgtctcaggaaacttctaatcatgggcagaaggtgaagggcgagtaggtgcatcacatggcaagagctgagcgagagcatgaagggggagatccagactttattattattattattgttattactattttgtagaaacggggttttgccatgttgtccaagctagtctcaatctcctgagctcaggcaagtcgcctgtctcagcctcccaaagtgctgggattacaggcgtgagccaccatgcccgtccccagactctcttaaataaccagatctcctgtgaactaactgagtgggaactcactcatcaacaaggggatggtgctaaccccattcatgagtggttgacccccttgatccaatacctcccaccaggctctaccccgtctctactaaaaatacaaaaaattagccgggtatggtggcgggcgcttgtagtcccagctacttgggaggctgaagtaggagaatggcgtgaacccgggaggcagagcttgtagtgagccgagatcgcgccactgcactccagcttgggggacagagtgagactctgtctcaaaaaaaaaaaaaaaaaaaaaaaaggagattacatttcaacatgaggtttggaaagggataaacatccaaaccatattacaacactatccatttttctcgtaactttttttttttttttttgctatcttcccttttttttcttgtccttctgcctttagacactagcaatcccaaaattcagttctcgtcatgtattttcattttctgtacctcattaggggagcctatgcatggaagctcagatgtcatctctatgttgtggtatagcagagagagtcagaagacaccgggtgtaattaagcctctgtcactatgcagcgttgctccctttactactcttccaacctctgcaacattttagtgggagcctccaatgtaccaagatctatggtaaacatgaagggatataacaagaagaagtgatcactgttctggtataacactagttataccacattctagtgtccatctgctgtaaatatctggaacattctaaagaatttttaaaaattcagttgtttttgttttcagttctcacctctcccccaagtactagtctcatgttgtcaaatgcccactggatcttgatatctgaatattgtactgttatctcaaattgtcaagccatcttatctaactatgacttaacttttaagactcaatggaaatctctcctgctagttcccagaactttggatttgccttttctttttaatggttttataattcactgttattcagactgttccatttgctcatccctaatatccagtcattgtttaacttgattttcttttttcctcatactgccttgtggctgtgtctcttctttttctttctcttcactactattctagtcagaacctgtcattatttggcttaaccacttataaacgtgtaccttagtcttctcctttctaatctcttctgtgtactaagactagaataatcccagagttctcattggtcatgttgtttctcttgcccataaatcttctatggttcttcatagtctagaaagtaaaacctgcctagtttacttgtgtacgcagaaacttccatagtcttccattttctccagatacttaactttccaaactttttatgttactctccttgaaatatgttcttctctatgaccactc

SEQ ID NO: 32511 - DNA, 1054 bp, Homo sapiens
tgctgattatactcaattttagaactaaggataaattattcaagaaatagttgctgattttttagtttgaagtgttctataagcatattggatttttttttagaacccagtgacagtaatacttctttggaaagaatataattgaatatctttttagaactttaagcaaatttatctttaaaacattttatatgctcagtgtagataatttggaaattacagagagatacaaaaaagaaaataaaaatttgcctgtattctcactatctagagaaaactgtttactttttggtgtgtttgtgtagcatttgttttcaaaattgggatcacaatatatagcaatttgtagctatatactctgctttttcatgtaatcttatgtcatgaatattttcctaaaccattaaatattcttggaaaatgtaattttaatgagtgcttaatagtctgttcattgtgagtgtatcatagtttacctaatgattctctgctattggacatctggattggctctaatttattgatatggtaaataatgccttaatgaatatctgtgtaaatcaattattttcttccagtttctttttactttcttttgccatattcctagaaagggaagtactgggtcaaagaatagggtttcatttttgttgctctgctttttttttttttttcctgagacagagtctcgctcagtcacccaggctggagtgctgtggcgtgatcttggctcactgcgacctccacctcctgggttcaagtgattctcctgcctcagcctcctgagtagctgggattacaggcacgcaccaccacacctggctaattttttggtatttttagtagagacagggcttcaccatgttggccacactggtcttgaactcctgacttcaagtggtctgcctgtcttggcctcccaaagtgctgggatcacaggcgtgagccaccgtgcctggccgttcctgctgctttttttttttttttggaagtcttgccctgtggctcagactggactgcaatggtgcgatctcagctcactgcaacctccgcc

SEQ ID NO: 32512 - DNA, 1012 bp, Homo sapiens
aactcttacagttcaataataaaataaagtccaattaaaaatttggcacaggttctgaatagacagaacctatgtatatctacttctacaaggaagatatacataatggttgataagtgcatgtattagtctattcttatactgctatacagaactacctgagactgggtaatttatgaagaaaagaggtttaattgactcacagttccaaaggctgtataggaagcatgggtgggaggcctcaggaaacttaaatcatggtggaaagtgaaaggggaagaaagcacatcttaccgtggtggagcaggagagagagagagagcgagcgagcaagcaaagggggaagtgccacacactttcaaacaactagatctcgtgagaactcactatcacaagaacagcaagggggaagtctgtccccatgattcattcaactcccaccaggcccctcctccaatacatgaggattacaatttgagatgagatttgggtggggacacagagcaaaaccatatcaatgcacgaaaagatgctcaacatcattagccattatggaaataaaaatcaaaaccatgagataccacttcagactcattaggatggctagaataaaaaagtcagattataaccaatgtttgttaggatatggagaaattggaaccctcgtacactgctgtgggaatgtaaaatggtacagctgttttggaaaacaatctggtagttcttaaaatacacacatagagttaccatataacctagcaattctatgcctagttatatatacccatatgttcatatatacacatgttcatagcattattcataatagctaaaagtagaaaaacaacccaaacatctatcagttgatgaatggagaaatcaaatacgggatttccataaatggattattactgaggaaccaaaagaaatggaccaaagcatactacaacatggatgaacctggaaaacattctaagtaaaagaagccaagcacaaaagaccaagtatcata

SEQ ID NO: 32513 - DNA, 1017 bp, Homo sapiens
gttctttaaagcagttttaggtttacataataagtgaacagaaagtagagtgagcctatataatcccttacccccacccatatttccccatttcccctgttattaacatcttgcattggtgtggtacatttttcccggttactaacatcttgcaatgctgtggtacatttgttacaattgatgaactaatattgatactaaattattaactgaagtatataatttaccttttataatttccattagggcccacactttttattgtatagttctgtgggtattgacaaatgcataatgtcatgtatccacgattacagtgtcatgcagaatagttttactgcctccagaatcccaacatccacctatttagccaccttctcatccccctcctcccatcccctcctcccatccacctcctcccatcccctggccaccactgaactttttactatctctatagttttgtctttttcagaatgtcctatagttggaatcatacagtatgtagcctttttagacgtggttctttcacttagcaatatatttaacattcctttatgtctttttctggctggatacctaatttctttttgtccctgaataatacctcattgtatggatataccacaatttttttagctgcttacctattgaaagacatcttggttgcctctacttttgggcaaatatgagtaaaactactgtaaacatttgtgttcacttttttgtgtagacatgttggaagtaaatgcttggtgctgcaaagtgaaaccagcactcaggcaaaagttttcttagcaaggcagtttatttttgcagaagggcgtgtctcgtggatggagcaatggcgagagcacagggaacaaaggagagaaggggtttttatttctgatgtgtagtccctacctcagtgtcactcccctgtgggctggggttgaaccgcacaatttaagctgacttgattggctacttgtgaatttttttttttaaataaggaagagggaaggggaaggtgag

SEQ ID NO: 32514 - DNA, 1002 bp, Homo sapiens
taagataattgcccgaaattggaagaattaaggttttttagggtacggcttaggaacttctactttttgtagtgttacttatggaggagaaagtaattgtcagtcatatataagtacagtttattttattttaaaataaaaattttaagagcaaataccttgcttttaaaactgatctggctagctataaaacagtggctgtgagagatgggtaagaagtgtagttgaaatccatattgcaaaatcagttttgagcctgagctcctatccttttcttttcttctttgagatggggtcttgctctcttgcccaggctgaagtgctgtggtgtggttgtggctcactgcagcctacctcctgggctcaggtgatactcttgcatcagcctttcaattagctaggactacaggcccgcaccaccatgccaggctttttttttttttttttttttttaattttttttgtagagatgaggtctccctatgttgtccaggctgggcttaagcaattcttctgccttgtcctctcagagtgcagggattatagatgtgagccacagagctcagtcaggatcactttaacagatgaaactgaatcttagagaagttaagtaactcttgccaaggtttcatagccagcaggtggcagagcctggattccaacccaggtaatttagtctagagctcttattcttaactactttactgtcctaagagtatgcgaatgtacagaaatggagccttgctacctctggtaacttgaaggcaccaattttgcgttcagttaacatatcatagtttgatccaaggcaagaacagaagtgttaacacttcacctgcctctgtccttattatttcccatggttattggtctcaataatttttgttgttgttttatattattcttgcactggaaaatcctttgtacttagttgtcatttaataaatgatgaatgttgaaaaataagccagaaattgaaaactttgaatcttaaatatagag

SEQ ID NO: 32515 - DNA, 1032 bp, Homo sapiens
ctcccaaagtgctgggattacaggcgtgagccaccgcgcccagccgcccatttttaaatagagttatatgttttcttgctgttgagttgtatgatgtttttataaatcttgaatattaaccccttatcagatatatggtttgccaaaatgttttcccagtctgtaggttgtctttttattttgttgtttcctttgctgtgcagaagctttttagtttgatgtagtctcatctatttttacatttgtttcctgtgttttggtgtcatggaaaaagtcattgccaagaccaatgtcaaggagatttctccctatgttttcttctaggaattttgtggcttcaagtcttatgtttaggtttttatccattttgagttggtttttgtgtctggtgtaagatgaggattcagtttcattattttgcatgtggaaatccatttttcccaacaccatttattgaagaattgtgttgtcttggtgcctttgttgaaacatagttgacggtctatgtttggatttgttgctgggctctctattctgttgcactggtctgtgtgtctgtttttatggcagtactaaactattttgattatagttgctttgtaatttaattttaactcaggaagcgtgaagcccccaacttttttttttcctcagaattgccttggctgttcagagtctggtggttccatgtgaattttaggattgctttttctactcttgtgaagaatgccattgggattttgataggaattgcgttgaatctgttttgttgctttgggtagtatgataattttaacaatattcttttgatccatgagcatggaattctttccatttatttgtgtcctcttcattttctttcatcagtagttttagttttcagtgtacaggtctttcaactttttggttaaatttattcctaagtattttgtttgttgatactaacacaaatggggctgttttcttaatttctttttcagcttggtcattatttgtgtatggaaatgccatgaattttttatgttgatttta

SEQ ID NO: 32516 - DNA, 1029 bp, Homo sapiens
atctttttttgtgttaatttcttacatatagctgagaaagcctagactttctaaagtctaggaaagaggtgagaaatgctgctgtggaccataggagttggggtgggggaagaagctaattagaaaaaagtttgtggtcatgatagattttgagtttctctggatgctgttaatgatggccggaattttagaattcagattcagctactctttgaatgtttattgtgtgccaagcactctcattccatttaactttcataatgctctgtgacaatatttgccccatttaatgagtgaagaatctgaggttaaaaaaaatatatttttttaattgatttattccggggccttacagttagtagggaataggttccagatgttgatcccaggccctccagacttgaagtaaaggaagaaaattttttgagtacttaccatgtcattgtacaatagtaagcaattaatttaaaataaatgttactatgtatatttaagatatacaacatgatgttaatatgatacatattataataaaatggctactgtagtaaaagaaattaacatctccatctcacatagttacccaccccctctccctcgcccctaccaagagcaactgtaatctactcaactcttaacaaaagcctagatacaatacactattattaactatagtcttcatgttgtacattagatcttttgacatgtttatcccaggtatttgctacttcctatactttgacctacatctccccatttcctcccctgctcaacctctgctaaccagtttactctctatctctgtatatttgacctttttttgaaaaaagatttcacatataattgagatcatgatatatatttttttctgtgtatagtttatttcagttaatgtccttcaggtccatccatatgtgtgtgtacacacacacatatatatatacacacactgaagtttaaccattcgtccattgatggacacctagggttgtttccatatgttggctgttgtgaataatgctgtagtga

SEQ ID NO: 32517 - DNA, 1060 bp, Homo sapiens
ctcagtaaatatgcatccagtgatcctgggaggaaagagatttaaatcccaacggtggctgctgccaacaaagtgactgggaaaatcatgcatttcaaggttagagaactatggagtacagtcttttcagctgtaacatgtttctataatgcaaagtaatactcaattggtattacccagttggtaataagaaaattatgtcattgattcatatgttacttttcccccagcaaatcaataatttaaacattcaggggcaagctttctcacagctagtaaaggaagctttaagcttggcagttccttcccttggtgcaagtagtgtctggcttaatggcttaagaacttgtgtcttccctacaagatgaggctgtaggagtagatgaagaagtggagaagacatttgccttatgtttaaaaacttcagttgattgttaaagaaagcacagatccagagcagatttttaattttttgacaatgttatctactggagatgaatgcccctgaggacctgtgtcttgagatttaagactgtagaagttgactttgatcctgggtacaaatgctagtggacatttactgggtggtagtgttttagttggaataattaatattttattaatactcttgttacaaagttaactgttttgagtgttatgaccccatcctattttccccacagtctattatttttacatataattttgcagaatacaaggtttatcaagtatttatatatcctgttaaaacaggaacacctgtaaacagcattatactagaaacccttatatttctttcactctattaaatattttgctgcctgttttgtttgcagtgggagcatgacttggcataaagaataaaatattaagaggtattgtgaataaaaacacattttacaattaagtggcttacaaggtcagacaaggaaagataaaataacccagtttcaaaagtgttttattgaacaatacatttgttaaaagatgcagcatcacaatcagatgctttatttcgttacaattctgtggtctctaaatttgggactgtgtgtgtgag

SEQ ID NO: 32518 - DNA, 1045 bp, Homo sapiens
attccagctactcaggaggctgaggaaggagaatcgcttgaacccgggaggtggaggttgcagtgagttgagatcgtactattgcactccagcctgggcaagaagagtgaaactccatctcaaaaaaaaaaaaaaaaaagaaaatatttgcatctgtgaactgtcttctgtgttgaggatgtttgtggcagaaggagatagacgtaggctctgtctacgtctgcctggtgcctccacaaggagcagtgtatgctcagagaatagaagtgaattttactattagtataggtgacccatattgaaaatgtttgtaaatctgctaccagaacaacacagtcattcaaagacaattaaaaatgcattttatacttcctgctatttataattattcatggatctgctgcctacagtcaggtagtaaaaggagagccagaaggaatcatagtgaacatctcatacaatgctatctttgttgttggtttgaacataagcatttttgcgtgaatttgcgtgtaggtctcttttatttctcttattgcataacctgaggctgaaatacttcaagtaatgtatctatttgctcatattgggtagaaacatccctattattccaattttcccttctcctgcttaaaacatatagtgaaatgaaagatgcagagataaggaaatcagggaaaagaaaaatagtcataggatactaaaatgagccacagatacctgaaactgcatagttgctataaatgagccataaatttgattctgagctttccagtggccccaaaaagataaacataatagtatttattccatgacataaaaatgtatttgtatttctctgtgttcaagaggaagagaaatttgtactatgggtcctcatgaaggagccactaagtcagtgttgtagaccacacattcaacgatatcgtattaatacccatgatgatgaattcattcattcaataagcatttattgagtacttactttgtgctgtatatgtttcagtgtattgcagtaattattctttttgatgctcaaattgtc

SEQ ID NO: 32519 - DNA, 1070 bp, Homo sapiens
ctctttgtgggagatgcagctacttttgccagaacgcccaagtatctaagcctccagggtctccacgcatgcctgagtggctgctttgctgagactccatgtagccctgtctgccagactgaagactgaaggccctgctgctagtggagtggattcacaaggagatctcctgacaggagggttgcaaagatctgtgggagaagcatggtttccggggtcgctcattcacttaccacttccctgggcaggggaagatcccctggttccctgttgctcccaggtgggctgttgtcctgtcttgcttttccttgttctctgtgggtcaggttgtttccttgattaatcccaatgcgagtacccggatgtttcagttgaaggtgttgtatctactcgtcccttctgttcctctccgtgagagccatgtacattacctgcttctggtcagccatcttggccactccccatccttatgaaagtttacactgtattacaattgcacaggaaagttactgcaggtttgggagtgggacagaggatagaggatgttggcttgttttgtcaagagagtgacattcttaagtctatgttggtggtggggacagataggaggcaagaaaatcagttaggaaattattgaaacaattcagccccagataatcgaagcttatcaagagcagcagtgtgagaatgcagagaagtggacagttgccagaaacatctcagaggtaaacatggcaggcctggaagatgaaaaccttcagtgcctggcaactgaggggttggaaatactccaatctcagaaaagagaatactgggattggaggtgggggccaagctgggagaaagatttcaatgtcttgcagaatatagagaggggttgatgagaataacagccgaagagcccaggggaattcccaggttaaaaaaaaaaagccccacagagatcagaagggcaaatcctcaatctagagccacagaagtgaagatttggctctagactctgaagtcagctctcctacggaaaaaagatggacccaggcctttttaactcaggcagcccccatggagga

SEQ ID NO: 32520 - DNA, 1075 bp, Homo sapiens
ttaccattttgaccatttttaagtctacagttctgtggcattaagtacattcacattgttatgcaaccatcaccatcattcactaagaaaataactatgtatattaagacaagcagggttgatctggggattttagtggctgaaattaaattcaatccttttaagacactggcatcctaaaattcaagattcaaattcctgggacaggaagtgtatttgttttagtgtggcttgtgcccactattgtggtcaggagagtggggtttcaagattggcagaccactagaattgcatgggagggacagtgggaggcagacattttccaaaggagtgaacttggggcaggaaaaaaatacttgatgaccactaaatgtggttaccatttagtggtcataatatatttgttaactagaattttgtttaatcaaaatggtttatataatgtgatcatgccagataataatatacaaaaaatttgtactatattatagacacaactgtgtttgtggatggggcaatgtgaactaatattaactgagcatggaattagggcatcagatggtgtgtcatattccagaataagctgtgaaatactgaaatagaagattggtttccctaggaagtttgaaactgcaaactattttcatttcttaagtgctatattgattctagttacaaaataaatgctacatgagcttcatgtcaacctataaaagttgtaatggcttaaaaaattacaagcgtagttaaaagataaatgatagattggggaaagtgcttccatacataacaacatattaaagagttactatccataatatgcaaaaaattcctgcaggttgaaaagaaaaagaccagtagctcaaaagaaaaatgagctaagtatacgaataagcaatttacagaacaaaaagtccttagagggaaaaagacttcagtagtagtcagtgaaatacaaattaaaggaacaacaaactatcactattcacttatcagaatggctaaaattatgcagagcacattgttacagccttttattttattaattaatttatttatttatgtatttattttt

SEQ ID NO: 32521 - DNA, 1048 bp, Homo sapiens
cccaggacgtacaaaagatcttatattaaccaatcctctgtgaattttgccatatcaaacattgtgccttattttaataaaactgttttgttggaatccagttctatattaaagtctctataatgttgatatttgcctgattacttgttacatcattgaatacatacattaaatatgtactaacattgactctgttctagatgcaatggataaaagataaattggacttgtcttctagtcttccttctgcttccacagtctcaatagacttacgggtgcatgctctaataagaaattggtgacatcatcttgctgactaaggccagttacttcttgtatttagtacagaatcacacagtcttaacccacagtaatatagttctaactgagctcattgacatagcacttcataccaatattttatagtgccattattttggcacctgacatttttctagattccaggatatggaaaaatattgtggttttaagttggggtaaacagagtggataggaaggacatgtactttgcaaaacagctaatgtttcaaatgtgctaagatggaagaaactcagcacttccctggttaatatataggatggtgatatggtttggctgtgttgccacccaaatctcatcttgaattgtagcacccataatccccacgtgtcatgggagggacccagtgggaggtaattgaatcatggggcgggttttcccatgctattcttgtgatagtgagtaagtctcaggagatttactcactagggcagttctcctgcacaagcctgctgccacttaagatgtgcctttcctcctttgccctccaccgtgattgtgaggcctccccagccatgtggaattgtaagtccattaagcctttttctttataaattacccagtctcggatatttcttcatagcagtatgaaaatgggctaatacagatgactgcttggcaaagacaggcccaaaaaatttgagggagaagagaaaacacatagagtgtatgtgtttgataccctctatgtgtttgtctgatctcttt

SEQ ID NO: 32522 - DNA, 1083 bp, Homo sapiens
tacaactgtcttttggtaatttttaatgaagtctacatttagccgtcggttttatctttcttaaatctttgacctaaacttttgtaagagcagctaataatttctaagattttccctgtttctttttcctacctttccttttctcataactgattggagaaattaatcagaagtcaaatacaagggacttcataatctagaaaccagataatcagctcccaagtcatgtagctaactatgcatttaaaataagtctgtctctttagttcttaagtcatatatttgtttgttaattacagtaaatgaactttaattggggtttttaaaagacagaattagcgaagtctaatttttataatgaaataagtttttgatattgctctacttggacgattttagtgaccaaaactatggataaaactgcctaagcataacattaatatatttagaatggcattcttcagtgctagtatttgaaattggaattagtacattgtgcattcttagtagtctttatccctagaatcaattctctcagcatcaccaaactgaattggtgaaatagtgctaagattctgggcaataggaagattagtgaatatgatacattgattccagggtgccagggattggctgacattaaggaccagctggctatggtcctcaggctacggtcctcagtattctagtatttgagtagtggaggtaaatccaaaggcgactggttatattttacttctaaatgtgtgctgaagtgtctcttgttcaaaaattcttgatatttagagcttcaagttaccacatttaaaagtaaagacttggcacggtggcacacacctataatcttagcactttgggaggccgaagtggatggatcatatgcagtcaggaatttgagaccagcctggccaacatggtgaaacctcatctttactaaaaatacaaaaattagccgggcgttgtgacgcacacccatagtcccagctaactccggaggctaagacaagagaatcacttgaacttgggagacagaggttgcagtaatctgagatcactccgctgcactccagcctgagtgagagt

SEQ ID NO: 32523 - DNA, 1550 bp, Homo sapiens
ctttaggagtctactttgactgctgtgtcagacaaattaaatttgtggacttctgtgggaagtatcgcctcccactgatgcactacttgtgttcaccagaatgttcttccccttgcagttctgcctctcacagctccacttcccagagtgaatctgactcagaagatgaagctagtgttgctgcacgcagaatgcagaaagttcttcttggttgaacaggagtgcacagtgttgtgaaatacttaaaaaactgagcaaaatggttagacaagaaaatagagcttgaagttcactagaaatcttatcttcatcttaagtgttcatcaaagagtctgggatgatataaaacattttgtgtttcatctacccattcagcaagaatgagtccagtcccatgtttagattattttaacataatttgtgaatgatagtttcacatttggctgatggtttgcagttttcactcaagttttgcatgaatcacaaagcagaatggtaccttttgaagagcagttctgcaataagtcatgagtagtataacttttggacattgagatggagaaagtgagaaattatcaaagctataattgccagagttgcccttgggtttaggtagaacactgtataccatatatactatataccatatatactatatataccatatatattatatgccataaacaggattaaccctcccttttctaattgcctgtatgtctagattacagaactattcaaagaagctcacagatggttacatgggacaaacctttctgacaaactaactggtaaagtaaggcatataacatttacatgagatattaaaactttttcattattatcctttgttctatatgattgctattaaccttatgtaatctagcaatgactgttatagtgccttaatccagcaaggatataaaaatgtattcaagaagtaatgccagagcaacctataacctgacataccatgcagaacattgtaaaatattctttaacagaactaggtaaataactgtgtatctaatatccgatctcatggccctcttaacatttttttgtttaaatgtgcactcatcccttataagcacattacttttacacttaatggtaggccacaatcttcatcaatctgttcatcataagacagagtaagaatttttaacagaaaattctaaaagagatagaagctaggaaagcttctttatatcttgcattaaatgggtagggaaaaaatatgactctcacccatgtcatgtactggaccatctttctctactttttaaagaaaaactaatacaactagaaaaacatcacaacaagccaaataaaaatggagaaaaggagtcattgtccttatacctaatggaacagtttccagaactactttaactatggaagcatttttgaaaataaagtattaataaaatagaaaaaaattattaaatatattgtatccttaatgtatagcaggaaaatagtttcacaaattaattgctattagaaattaccaaatttttattaagtactttaatatgcaatacaaa

SEQ ID NO: 32524 - DNA, 1071 bp, Homo sapiens
ctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcattatattattgttttttaatattttattttcttgactaggtattaagcttttgtaattatttttcagtagtcccaccacttcataggtggaaggagtttggggttcttcctggtgcaggggctgaaataacccagatgcccccaccctgccacatactagatgcagcccatagttggcccccctagcttccagcagtccactatctgccagaggagcaagggtgccttagaccgaagccaggggaagaagcatcttcataaaaaactttcaagatccaaacattaatttgtttttatttattctgagaagttgaggcaaatcagtattcccaaggatggcgacaagggcagccaagcagggcttaggatatcccagcctaccaatatgctcattcgactaactaggagggtgagttggccctgtctcttcttttttctggacctcagtttcctcagtgagctggtaagaatgcactaaccttttgatttgataagttataaattctgtggttctgatcattggtccagaggggagataggttcctgtgatttttccttcttctctatagaataaatgaaatcttgttactagaacaagaaatgtcagatggccaaaaacaagatgaccagatttgatctcagcctgatgaccctacaggtcgtgctatgatatggagtcctcatgggtaaagcaggaagagagtgggaaagagaaccaccccactctgtcttcatatttgcatttcatgtttaacctccggctggaaatagaaagcattcccttagagatgaggataaaagaaagtttcagattcaacagggggaagaaaatggagatttaatcctaaaactgtgacttggggaggtcagtcatttacagttagtcctgtgtctttcga

SEQ ID NO: 32525 - DNA, 1030 bp, Homo sapiens
tctcctgtgttttgtttcaggggactctgtgttgatgctctcattgaactgtctgatgaaaatgctgattggaaactcagcttccaagagtttctcaagtgcctcaacccatctttcaaccctcctgagaagagtatgcctaacctaagaaatagagagctgtagtgaatggaggcattttgtaggagccaagatagagaggattggtggaactctccagagctagctgagaaaatccccttccatgattctaaactgggccccagcccattctccccatggtgaagttagggccccacattctttaggttgatggtagtgtttgctcagatatagtgcttctgagggacaggcaggtcttgtctgggaaaaaagggtaaggtgcacagactgtagcaaagatgccctgttccaccctcacagctaaactgttgccccgtatttctggcccaacagagtgtgccctggaggatgaaacgtatgcagatggagctgagaccgaggtggactgtaaccgctgtgtctgtgcctgtggaaattgggtctgtacagccatgacctgtgacggtgagctgtgcttcaagcagaaagaaaaaacagcaaggagagagcttcatgaaatcagcatgagagaagttggggtggggatgatggagaagagggcggtggctgggagcaaggaacccaggcagacccacacctgtaaggttggagccccaagtggggagctttgagggcagaacatttatcccataggcattcagtttgaaaatcactccagaggcttggaataagagaggaccaagaccctgggcaaaagtaaatgataatggaatagtaacattatggaaatagtaacagtgaaagtagtaataatggaataataattaaaaatagtaattatttaataattaaaacattaaaataaaaacaataattattatttaataataatcaaaaataataatggaatagtaacagtgaaagcaaatactcagcaaaaaccatgtgccaggctctcttctaagca

SEQ ID NO: 32526 - DNA, 1063 bp, Homo sapiens
atttctcacataagcagcaaaatctctctgtttcaatattctcaatctttacaaatattttagagatgggtgcttgaatcctgggctagactttttccagttgtgtaccctggatgtgctaatcctatctccctgtgttgctgggatgacatatgcagaaccatgggcacggatgctcccacacagtgggtgccagatatcactggggtcctcccctgactgctccagctgacatcctccactttcctgcagttgtttgctatcagtccaaccgtgatgagctccgacgtcgcatcatccagtggctggaagctgagatcattccagatggctggttctctaaaggcagcaactacagtgaaatcctagacaagtattttaaggtaatccagaggtaggaggaagactattcaggcccatagaaagggaagcttcctcctcccattgcccgatcacaccttcccagaccacaggaaatgtaaacctgcacagacaccctgagtttcctcatcatagatcattcatgaagctgtgaaagttgccttctgaccagcttgatcagtgggagtaagcagtggagtctttgggatctaacacacatgtgctgctgccttcaggcagtgaaagccacaaaggtcttggagaacctgtcagttagggccaagctctgtcccctactcgccatgacaccttatggatctggctgttaatacaaaattccctctgattgcacccagacctggaccactttggcctctttcctgcctagtttgacatttctctaagtcattaacttgactgccaatggcttggagagagtcttcatatgagaagaatcaatggactggcatttcatgggtccagagattgttcctgaacttagatattgctgttcccaatcataattagttgaagagacagagtgttccacttgggagcaggagagatgctattttcacaaagagaaatgaaggaagctataatatttagtgatggctcgggttatcatgccatgcagatctttcacagaacttgagagttagaagaagcaattaagggcatt

SEQ ID NO: 32527 - DNA, 1047 bp, Homo sapiens
aactgtggacaaaggaaatgactgaaagccattttcgtcctccgttgctcttctacctcattaacacacatatgcatgcacacacatgcacaaacacactcttcaatgtctttctgtgggcctaagacaatctctaattagtgaaattccaggctgaatatatatggcctggtggtggagggcagggtctttagggtatttcctcaaagaagaccagttctgggagggagcagccccaggaaaggagttggcacaggtgttgttcctctctgtccctatcccaagtccccagggcagtgtggttcaatccacctttttttgctttcaacaaaggttaatggagtggcacaaggtatactaggtcctacaaaaggatggacaaacagaatctttgtcctctaggagcttgtagttcagccagaaagacaaaatccacacagtcagttctgtttttaaaaaaataaatgatcaaaatgagttcatacaaagaggaatcaaagttcagagaaggaagggggaattcataccagtagaaagtaaaaggtcactgaggatggagtggtgtaacttgacccaagccttgaaggacagggagaatttgggcaagccagacaacaaatcagacttcccagatggtgacattatttttttaggtggtcttgtgggacattctctgcctatctgaaggttaaagaagcatctgacaattcctcatcatgctgacattttcaaaggctaatgagttctcatttcaaaacatagagccttgggagccctagaccctttttttaaattttagtccacttacagcttaaatctgctgtggctacctgctctgcttacagacacttcccaaagctttcagtatccagggtccctaagaagtggagggttgctcgaagtgaggagcccacagatctcgaggctacatgaacaatgaagtcacccaggagagaggaaaaacgccctgtgccatatgccaaagactttgttaacagtgcccaggtagaaggcagtaggtgacagtgtcgggcatccaactcagtg

SEQ ID NO: 32528 - DNA, 1024 bp, Homo sapiens
caactataatcccagcactttgggagaccgaggtggtggatcacttgaggtccggagttcaagaacagcctggccaacatggtgaaaccctgtctctactaaaaacacaaaaattgtccgggcatggtggcaggcacctataatcccaggtactcagcagattgaggaaggagaattgcttgaacccaggaggcggagtttgcagtgagctgagatcatgccactgcactccagcatgggcaatagattgagacttcgtctcaaaaaaaaatgtacctactagaaaattttaaattctgtatgagatgggtattctatttctgttggacagcactgctctagacagttgtcacttaaccatagccacacattgtcttgagttatctcttattagattgtgttgttctgttatttaaaattgcatatattcattcccctagcttctcacctaagctacaagctccttagagacacagagtgtgctttactcctccttgagcccctggcacttggcatgatgtttggtatgtttttgattgtcctgtatattacttatagatttcatctatttccatgttagatattgataaggaaatgcagattaatttgtgtttggattgttgcttttcttttcaaaggaactgattttatgtagttcttagtttgttccacaaagattaacattcctctaaactggactattaaaatccaggggacctgtagagggtgccagaacttcctgacacccatgcctagtagagaacaatggtgttaaaattgatgcttacaggttttaaggagcccctcctgaccaccccagaaatcttgagaagttccaaactcagctcagaaacttgtgctctacttttcaggacctgtctgagtaataggtgcaataaattaggcatgttggcccagggactcccagccttaaaccagggttgagaagagggtcaccaccagcctgagtcaatgagtaactgtcaggaactcctaccagatggctgtgattcccaaagtctct

SEQ ID NO: 32529 - DNA, 1026 bp, Homo sapiens
ggggttatatttgggagctcctctatgttctttagaattgttctgatggtagactcaagtaagccttgcatctaacccatatctctgactgcatcttcttggtgccacaacttgtattattaacaaagctaaaaagatctctaaaatgatctcttgcttgtttatcctttggcaaataagctacttgttgcagttctaaagaccattgctggaaattggggtgtaaaacatagcaggggctgtgcagactagccagaacagaagggcaagcacccagcataggaggccctggccatcgcaagtggctttagaaggtggacacgttacagttcccctagaagtctctggattgggtgacagaaaccaggactccatccccaggctcatagaagcaagttggagaggaaccatgaggtgaagatctggtcatgggctgaagtggatgtaatgatccgagaggaaatgccccaaagacgaaaagaaagtctttgaagtcagtggggcagagcaacacatgctgccacaagaataggaagtaaaggatgagctgtaaattaccagtgatcacatatgagaattgaaaatgtcatggattctttgtcttagtcctcttcaaataactggacatctggcagaatgtttctaacagacataaattttattagcttaatgataccagttaatagggaaaaaaagtacattagataggttcactttgtaagccagatgattaatgtcctcagagggcaaatgcatactttttgtttaggatgctctattctgactcctgcgattttggcaaggggtgctttctctgagagtatgccatgaatggcgtggccttcccttcactgtcctcatcgagcctatcccctgctgcagctgagcgcacctggtactcaggtcagagtcacagtgaagcacaaggcatggtctctgccctcacattatttacagtctagtggtgggtccaggtgctttaaatcgtggcagctacagtttatattattataactacatagtaac

SEQ ID NO: 32530 - DNA, 1026 bp, Homo sapiens
gcttgagcccaggaatttgagaccagcctgggcaacatcgtgagaccatatctctacaaaaaataagaaaattacctgggcatggtagcacacacgcctctggtcccagctactcaggaggctgaagcaggaaaatcacttgaacccaggaggttgaggctgcagtgagccgtgatggtgccactgcactccagcctgagcaacagagtgaaaccttgtatttaaaaaaatagaaacaaactcattaagcaaagtgtcatattgttttgaatgtgttccatggtgtcctacttccttggcacctcagggttgctttctgattgcttcttctctttcttacctgctcactctcttactactctgtctgcagcatataccttcagccagcctccctccagattctgccacatccacctgagcacacacacccatgcactctgtagtctgcttgaaagaaggtactgggtgtagcatatgtctctagatgtgtgtagattaacatgtgaatggactaggcagagagggcagcagcagagggagtgcctgcactaataattacacagatatcccttttctagattctctggggagaggactgtgtgagcctgctcatctactctttcccatccccctcccattgggaattactacagttcattgagaagtgttgatggtggatgcatagtatggagcctgggaaaatgttaagaacacaggcggtagtgtgtgtgcccttgaagctcagtcagtggatatctgtcactctaacatggcaggctggagagaaccctgtggcccaactgcctgctttaggaagacagccctggcaagtacccaagcatacccccactctcccttggtggatgtctctgctgtcactatgattcccagcattccaggtctagaaattcattatgataagtcacatgtacagttaactgatttgtagttcagaatcctcattccagtaagggatccatgcttgacccatgaactttgagtgtattacctaagagagaacaatag

SEQ ID NO: 32531 - DNA, 1057 bp, Homo sapiens
aactaggactgctttcctggctgaggatttcaatccagaagaaattaatttggtatgtattttcactaatgcatgcttgtattattatcgggtaaagacaaaactgaagacatattcaaataatatattctagtgaaagaagctttatacttgaaatcaggctatttggattctagtctaaacgtagtcaagattggaatcaacatatctagactgagagatgtgcacagtcacttcagccttttatgttggtctgttggaatgttccaactttattctatgaataatttaaatcataggcttctttttttgaaacagagtctcgctctgtcgcccagactggagtgcagtggcgcgttctcagctcactgcagcctctacctcctgggttcaagcgattctcatgcttaggccacctgagtagctgggattacaggcatgtaccaccatgtccagctaattttttaaatatttttagtagagatggggttttgccatgttgcccaggctagtcttgaactcttgactggatttgccctccttggcctcccaaagtgctgggattacaggcgcgagccactgcacctggcccatgggctttttcttgagaaaggtttttaaaatcacaccaaaattaaaataaattgattaaagtggcactataagcatattattcttgcttttaaaaagcctcttagcttcttaaactacaaattttaccttaaagggcaacgtaacaaatacatgaaaaaattgcaaaccttaaactaggagtgcttcataaggactaatttatgtacacttatgcatatatagaggattgagtcccttgatgagataactagctcaatgagaactgagcgcgtaaaaaagctaagaaatggttgtcatgtaagcctgttaggatcccagaaaaagatcctggccagcaatttcagtcatggtcatgttgttcacaaataggatttctgcaactgtgcactggcattccagaaatgcagtggtggtggtgtaatagtactagtgagcaacatttattgagcacttacgggttgaa

SEQ ID NO: 32532 - DNA, 1062 bp, Homo sapiens
ccaaaacagcatggtactggtaccaaaacagagatatagaccaatggaacagaacagagccctacacatctacacatctacaaccatctaatctttgacaaacctgagaaaaacaagcaatggggaaaggattccctatttaataagtggtgctgggaaaactggctagccatatgtagaaagctgaaactggatcccttccttacaccttatacaaaaattaattcaagatggattaaagacttaaacgttagacctaaaaccataaaaaccctagaagaaaacctaggcaataccattccggacataggcatgggcaaggacttcatgtctaaaacaccaaaagcaatggcaacaaaagccaaaattgacaaatgggatctaattaaactagcttctgcacagcaaaagaaactaccatcagagtgaacaggcaacctacagaatgggagaaaatgtttgcaatctactcatctgacaaagggctaatatccagaatctacaatgaactccaacaaatttacaagaaaaaaacaaccccatcaacacgtgggcgaaggacataaacagacacttctcaaaagaagacatttatgcagccaaaagacacatgaaaaaatgctcatcatcactggccatcagagaaatgcaaatcaaaaccacaatgaggtaccatttcactccagttagaatggcgatcattaaaaagtcatgaaaaaacaggtgctggagaggatgtggagaaataggaacgcttctacactgttggtggaactgtaaactagttcatccattgtggaagagagtggggcgatttctcaaggatctagagctagaaataccatttgacccggccatcccgttactgggtatatacccaaaggactataaatcatgctgctataaagacacatgcacacgtatgtttactgcagcactattcacaatagcaaagacttggaaccaacccaaatgtccatcaatgatagactggattaagaaaatgtgacacatatacaccatggaatactatgcagccataaaaaatgatgagttcatgtc

SEQ ID NO: 32533 - DNA, 1116 bp, Homo sapiens
aagattgctacacggaaaatttaaaaaacactagtgaaagaaattgagatgacacaaacaaatgaaaaaacatcccatactcatagattggaagaatcaatatcattaaaatgaccatactgcccaaaacaatctacagattcaacacaattcctatcaatttgccaacagcattcttcacagaagtagaaaaaataattctaaaattcatatggaaccaaaacagtctgaatagccaaagaaatcctaagcaaaaagaatgaagctgcaggtatcacattgcctgacttcaaattatactacaaggctataataaccaaaacagcagagtactcgtataaacatagatagataaatggaagagaatagaagacccagaaataaaactatatacctacaactaactgatctttgagaaagtcaacaaaagcatccactgagaaaagaacatcttacttaataaatggttctgcaaaaattgtataaccatatgcaggagaataaaactggacccatatctctcaacatatacaaaaagtaactcaaggtgaattacagatttaaatgtaagacctgaaactataaaaatgctagaaggaaacctagcaaaaactcttgtgtggacattggcttaggtgaagaattcgtgactaagacctcaaaagcaaatgcggcaaaactaaaaatagacaaataggacttaattaaactgaaaagcttatgcacagaaaaagaaataaacaacagagtgaataaacaacttgaggaatgggaaaaatatttgccaacaatgcatctgacaaagggctaatacccagaatctgcaaggaactcaagcaattcaaaaaggaaaacacaaataaccccattaaaaagtgagcaaaatacatgaacaggcacttttcaaaacaacacatacaaatggccaagaaacgaaaaaaaaaaatgttcaacatcattagtcatgagagaaatgaaaattaaaaccataataagataccatcttataccagtcagaatggctattaataaaaaataaaaaaatagactttggcaaagatgcagagaaaagggaacgcttatacagtattggtgggaattagtttagtacaactt

SEQ ID NO: 32534 - DNA, 1044 bp, Homo sapiens
catgctgcaacccctggcccaccttctgaccacaataaaaacccagtctcttccttgttctctcaagttgccttgctctctgcagaaagcctcactgagtaataaaccttttcgtatcagaaaaattccaattaaaacaataagatgccattttcatctttcacagtgtgaaaaaataaaaatatttgaaaataggtgaagatgagactaatttttatacactggtagaagaataatttagtcaacatctatttaaattgtttaaatgagcatgccctttaattcagcaattccacttgacattaacatcttccttagagaaaacacttgcatgtatgcaaaatacatgtgcagatgttcactgcagtcttgtttgtaatatcaagagattggaaaatatctaaatactagttaagagtggtagcaagttatggtttattgacaccatgggataatataagtgagttaaaaagaatgaattataggtactgacaaagaacgatctgagacatagtagagacatgaataagcacgttgcagcatagaaaaattttttagaaggaaacacagcaaactataactcgttagtttagatgagtaggaggtaaccaagggaaatactcacttgatcttgtctaaatttatcatatgactattacaatatgcatttatgtattatttgtgcagttaaaatacattttaaaaaatgtttaaataatggttggattcccaaatcagctcacgagactattgttgaagctgcaaagccgctgtccatttgctatgaaaggtagaagacaatgccattgaagtgcaagtaatacaacaagattggaaatattttatttttataactttattttggaataacttaaaacctaggtaaaagtttgaagaatactaccaagaatcccaatcaagtcggaaatcaccattcaagttttgttaatttctccagttatgtcatttatagcaaaagggtccaatccaagactaagagttgcacctagttgtcatgactgtctagtctccttaaatccagaa

SEQ ID NO: 32535 - DNA, 1546 bp, Homo sapiens
aggaagacaagacactgtattgtcaggccgacagctttgtttcctgtgcatgaggattttggaactctaccctagccctgggatggctgtataaatattgagtccttacaggtagaaaaggagctaagagtgttccgttttgtactagttcttaataagtgaagaattgccaatgcaagatgtttttgtcttggaggaattaaacaaaaatttggagtctttcccttagggtttctaagctccaagcattctagcaaaaactttcagaaattcctgctcatcagtgaagaagagtatgagatgtctttttatttattcatttatttattttattttttattttttctgatttagcattttaagcaccattgggtgaagagctccagtctggtttataactttctcaggggatggtttgggaaacattctttgactgggcagtttgttaactacattttttttttccttaggtagctcagattgtcaagaatgaaatggaaagtgctgtaaaactgtctgtgaaattgaaagtgaaagtgaaaataggcgccagctggggagagctaaaggactttgatgtgtaactgtgctgttgatgaagtcctcccagggaagcctgtgcagatgcagtcacctggaaagaacagagattaccctttcacctacctcagcaaaacaaactttcaagtcttgatagacttagcctagtaattttatagtgagagtttcaaactatatatcagtgtctatagcatcaaaaacttctgggggcgtgggggaagtagaataccaagtataatagttacattcactttcaaagagcatctatgaatttgccttttgtaacttactgtggctttaaacatattcagaacagatgcttgaaatatgcacttagcactttggttccacatctgtctgggtaaaccatgaagaaaatgaagctgctgcctcaatcgacccagacagcagccataggcagataaagatttggtttcaccctggtggtggtaggcatcgtgtgtgactttttttcctctaatatcaattttacagtacggaaatagtattttaaaatagtattggctaataaattatgaattctataaagtagtaagacttggtatggttggagtgtaggaatgaatattcatgaaatgtttcttattgcttttccttccctaattcatacaatgaatgtatttggaatacttacatattataaaataaactatacctcttcaagaggtatcctgttctgtaagatcagatgtttttattgcaggtcaatataatactgccagagacagaaaatacccccttatcagtcccttagtgcctctttctgtttgtggcatggtgagaaaacccatgctgaaaagattgtactttgtgatcccaatcagagggatggagctaatctttttgctgttgaaataaaatgaatttatgagaaactttatatcaacaattgttttgttaaaaattatagttggtctaagagtgtcccttatttagttactccatagcttgttcataggaaaca

SEQ ID NO: 32536 - DNA, 1028 bp, Homo sapiens
ttgtttctcctaagatccatttgattagcctttactcattaatatgaccgctaacatgttatagtgctgaaatctgatactcattttagcataagactagttcagtttatcaaattacttctcattgtgcgatggttttctgtgtaaaacatagtagtgtagccaattcatacattcatttatttgggatggtcttgtacttattttatcattgttagacacatgaacatgatgaaaaatatttaaatataaatgtatttcagttcagcattgatagtctgcatttttaagataatccagaaatgtgaatactgttaagacaaatactagattttttttcctgattttatgtctttattctgcttgattttaggacgaataacctttacagaaccaaatattcagaatgtgccaagagattttgaaatcaaaatgccaacactagtaggagaaagcccaccttctcaagctgtaggcaaaggcctacttcccatgggcaggtaggtgctgtttctctgtatctgtattaataaacttttgtaagtatgaatggctcaaaatagcttattagacaaataaatgaaattaatttaattttatgtttcagacatacccatttctgtcctagaccgttttgaatcctgagtcccatctataaagaagctaattcatgtttaattcaatgtttgctaaaaaaagttctagtatctttgttaagctttaaagtgagtctcagataaagatttggttttctttgtttgtttgtttttttgagacggagtcttgctctcttgcccaggctggagtgcagtggtgcgatctcagcttactgcaacctccacctcctgggctcgagcaatcctcccacctcagcctcctgagtagctgggaccacaggcgtgtgccaccatgcctagctagtttttgtagagacaagggtctcactttgttgccctaactagacccgaactcctgggctcaagcaatctactcgcctcggcttcccaaagtgctggtattacaggtgt

SEQ ID NO: 32537 - DNA, 1033 bp, Homo sapiens
ccatttgaatttacccagatataaattaacacattggtttgtggtttggtagcccacaaattctgtggagatattccagcatggaaaatccgaatcataagttagcagttgtgtccttccttcctatcattaaaatggtgtaaaggtttataaaggtgtaccaccatgcctggctaatttttgtatttttagtggagatggggtttcaccatgttggccaggctggtcttgaactcctgacctcaagggatcctcccgcctcagcctcccaacgtgctgggattacaggcatgagccactgcaccaggccctgatttaagaatttaatctgctaatttcaaagtacaattgttaatcataatccatggaaactgtacacattagtgggagggaagagagaaggggcttaattttacatttttacagatgtttcaggggaaaaatagggtagaaaatatagccacagagctgtccaagttgcccttgtgtagaattgtggtccttataccgttatctatgatttgtctgctcctaggaagtttccttagctccaggctatagcacaatttttaatttaatctcactggcccttttactcacaagtttctgttccttaatagttcactgaaagtctatagtatgaaaaattcaaagttttaaaaataaatgtctcctgattaccttgatatggaaaccgtataagtatccgggcaagcacaaaaacaactgggatacttccagtcatgtgaggagcgaaggaggaaaatgcataaagaaaacagatggtgtaaaataaacttttggtcgggtgtggggaggcagttactttgttaaactgacaattcatttatttttttgaaaaaggtagttttaaattgatactgctcagtattaccacatttccattttgtaaactgtagttatagttttatcaatacggtggtttaaaaaactccaagtaatagttttgagttgtcgatattactctcaaatttaattttgagactgtattatttacagaaaagagattcta

SEQ ID NO: 32538 - DNA, 1027 bp, Homo sapiens
caatgactataaacttttccagtttgaatagaaaaaatacagagttaaatgaagaacaagaagttatttcaaacttggagacaaaacaagtgcagggaatttcattttcttctaataatgaagtaaaaagcaagattgagatgctagaaaacaatgccaatcatgatgaaacctcatccctcttacctcgtaaagaaagtaatatagttgatgataatggtctcattcctcctacacccattccaacatctgcttctaagctgacatttccagggattcttgaaacacctgtaaacccttggaaaactaataatgttttacaacctggtgaaagttatttatttggctcaccttcagatattaaaaaccacgatttaagtccagggagtagaaatgggttcaaagacaacagccctattagtgacacaagcttttcacttcagttatcacaggatggattacagttaactccagcctcaagcagttcagaaagtttgtccataattgatgtagcaagtgaccaaaatcttttccaaacattcattaaggagtggcggtgcaaaaagcgattttccatctcactggcttgtgaaaagattagaagtttgacatcttctaaaactgctactattggcagtaggtttaagcaaggtaagaatttttttaattttattttttcatatttataaactacttagtagactgagataagagttagatttctcaatgttagatattaaatataatctattcaagttgtagtatgtatctcctctgtggatttatgtgtagaacagccttatttattcagcatacctaaattaattaatgatagttgccctccagtataagaggtgcatgtaatatatattagaataaaagtttataaaaataaagataatacatattttgaatatgaacgtgacatttcttttatggtatattaatgttgtaacataatggtttttattaatcaccagtgctcatgaattcttttcttttttctttttctcctttcttttctttt

SEQ ID NO: 32539 - DNA, 1031 bp, Homo sapiens
ttagtagagacagtgtttcaccatgttggccaggctggtctcgaactcgttgcctcaagtgattcgccttccttggtctcccaaagtgctgggtttacaagtgtgagctaccgcgcccggccggatgtttttcaatgaaagttttatggctttcacttttttaaaggcttctacttaaagaatctgtcttagtgaagccttcctttattatgccatttaaaaactacagaaccacccaccacccctttctggtgccttatttttgtatacaactcttatcaccaggtaatatagaatgcattttaaactttttgtttattttctgaattccccagctagaatgtgccatgagagcagatacatttctctctcttcttcattgttattttttcagttcctggtaacagctcagattgcatgtttaataaatacttgccttacgaatgaatgaattcatttctgtcttttcccatctccttgtgtagtgcccggaaggcagtggatgaggaagaggaagcagttgaagaacgtcgcaatatgcgaactatctgggtgactggcagaaaaggtttaactgaaagggaagcagcagcccttatagtggaagaagccagaatgattctgcagcaggacttagttgaaatgggagtgcaatggaatccatgtgccctgttacattctagtacatgctcattgactcatagtgagtccgaagtaaaggaacacacatttatatcccaaactaagagttcttataaaaaattaacatcaaagaacaaaagtaacacaatatttagtgattcttatattaagcattcaccaaatatagtgcaagacttaaataaaagtagagagcatacaagttcctttaattgtaatttccagaatgggaatcaagaacatcagacatgttccattttcagagcaagaaaacgggcctctttagatataaataaagagaagccaggagcctctcagaatgaggggaaaacaagtgataagaaagttgttcagactttttcacagaaaac

SEQ ID NO: 32540 - DNA, 1050 bp, Homo sapiens
aaatggagataataatacccacctcagggctgatagtctttgatgaatgtttggtatctgaataaatgtttaataacatctattatttctagtaaattctcccataaacattatgtaagtcatttgccaaattacctaactactcctactcctgttccctctctaaaacgtgaagactgttggcagtgttagtatgctgaatgcttgtggttagtggtcttgtatacttctctcaccattcgagttgtatgcccttcaagagttagttgtgttcccaaacttgttcatgtcagtttgcttctgagaaaattaggctgaggcagaaggatcacctgagtccaggaatttgagaccagcatgggaaacagagcaagaatctgtcgctaccaaacaaaaaaaaaaaaaaaaaaattgtgtatggtggtgcatgccggtaatcccagctacttggaaggctgagacagaagaatcacttgagcccaggagttctaggttatagtgagctatgatcgtgccaccatgctccagccttggtgacagcaagagacctcgtgtcttaaaaacaagcaaaaaaatataagtgagataactgaaagctctgagaaaaagttataggaatttagacagggaggaaactaaaaggacactgctcaaagtttattttgcagttatctttaatttttatttatttatttattttttgagtagagtctcactctgttgcccaggctggagtgcagtggcacagtcttggctcattgcaacctctgcctcccaggttcaagcgattcttctgccttagcctcctgagtagctgggactacaggtgcatgccaccacacctggctaatttttgtatttttagtagagacagagttttaccatgttggccaggctggtcttgaagtcctgacctcaagtgatccaccctcctcggcctcccaaagtgctgggattacaggtgtgagccattgcacccagccaatgattatctttaatatctaacttcacattacaaaacagaaactggatttcttagacaatatattg

SEQ ID NO: 32541 - DNA, 1031 bp, Homo sapiens
ttattttgaatgtttgttcctctgtttcctcaccctaaccctaaaccaggaaaggtgtatcatccaacacatcttggttcggccactctttcttcttcactttctccagctgatactttagatatttttgctgacctgcaaagagcaatgaagggctttgttttagagaatgatcttcatattctctatctggtaagttctgttttaacaattatgtttgtgaaaatagggagaaaaaaatagatatataatcctgaacatcaaagataccctaacagaacatctcgtctgttttccatgcctaggttagtactggtgggaatagagaagaggtaagaagataattgttttaaagtaataatctaaatgttctagttacctttaaatttattttctccaacctcctttcaaaaaagatttgagttgttttataaaaaatatatatttttacaacgtataaaagaacagcaaagaaaaatgggatatcagaaaattaaagatcggatcatgatgtaaaactcaagcaaaggtcagtacacaaacatgcgtgccattaagtcatgtccaatgctgttgtcaactttgattctgggttttctagcaactaaaagaaagaggaaagcttgattagtgttaatattcataagataaaaaacaaaacaagtttaggaaaaacattgcatttccctgcctaagagaaatttagtcctaaaaggatactttggaacttaacattgtttgataaaaatctctataataaatgcaataaggaattttaagtttgtttatattagacaatgctctgtgaatattattttgtataacaaagatattaataagaattggatagtgtttaaggtcatgttctctggcaagaacctgatcagaaataattaattttgtcagttaagagcagatgcatgcattttgataagcaagtgataaggggaggtgagtaaaattgaaattctcattagaatgaagggggcttatcaggaaatgtgtttcaataaaaatcgctatgtagtgag

SEQ ID NO: 32542 - DNA, 1023 bp, Homo sapiens
tgagggaagagagtgagattcttccttcccattcctatttgcctacctctgtccatccccaattttcagtggactcacacctctggggaatggagtataagtccattttacatagataattgtctctcgggacagagggtcttttagttaatgtagaagataaggagaaataagacaagaaataagctgagatcttatttgccttgttatgttcttagcttatatttattatgggaaagaacaattggaaggttagtgccctgggctaattatcaagccttaaatcagacaactctcaaacagaactaaaatatactgtaataagttcatttctgaggtcttaaagacttccaagcttttgatcttgcatatcattgtatttcaggatgtcatatgacttgctcataacttcaagctaatgaagaatgtaggaatatagtggtttatattcactatggagacttaaatacttggtcatgctttttgtatcgtgtagcatcattggaaattctgtgcattttatattcctggacagcacatggtgttttatttagatgacacttcagtctttccatagactacttagaagcttctagtataggatgatggtgcttggtgccaaaatagcgatttgtaagttcagcagtcagtaataaattatttgattctaaataatttcaacttccctcttgtgatgtggatgagtcctccctagacaggtggttgcaggaacctgtacatatatactgatgttcatttggacattttataaaccttgcccattcaggaaaagggcagttcattttgttgaagaatcaaagccccgaaagacctttaaacagcccaaagtggcttgtttatcttgctgctaatgctagttgattcattttctaggtaatttatatgtgtgtgttttctttcttaagctgggctgttttgtagccattgcaagagtcaggtgttatattcatgtgatttttaaaaattggatattgacaaattataattgtatatatttttgag

SEQ ID NO: 32543 - DNA, 1028 bp, Homo sapiens
tcgtattgtatacaataaaatgatttagtattatgtaaatcaagatgacttcttattacttagctggaagatgatttttaatttctaggtgtagtctactctttagcactaattaattttcacagatgttaattcaacttaggtgactggtctcagaaatcagacaaggatgctgggatgcaccctcacactttgggaataggaacttgacatcccatcttttttctcgaaattggtgctggctctgaaaaaacaccttttcatttttttttaccttgtatcagcaagttatgattgtttttaccagcaatccaaacaaaagttttgtcttaagcagtaaggaagaggtttgtttgaattaaatgtcaaaacggcagcaaattttatttctaacgtgctgtatcattatatgtaactaaatcattatcagccatctaacattgaagaaccttgggaggaacattccctgccactttctactctaggacataattgtcatctttctactgtaggacataattgactccagtattttattagatatgtcaaaaaaaaacaaaacaggcaaacagttctgtggctactgaagagaaattaggaaatccaggagaataaggaaagtggatgggaaatggatattctgggcagaggaagctgggtagtacactgaggaagtaacttttagaataaactgacttgtcacatgaagtccccaaatatgtcagttctcattattcatggattccatatttgaattttccaccttaacagaatttattcagaatcccgaaataatacctctggggcttttgtggacatatgcagatctgcgaaaaatttgaatctttccaagcacactttccctgctgtggttgaacaagccaaagctctgcgttcttgtttcagctcttatactgtgaacaagcttctttttaatgggctagttagtgccatatttttcacatttttgtgcttttagttggtgattttgctgtttaacatgacccccaagcaaagtactgaaatgc

SEQ ID NO: 32544 - DNA, 1072 bp, Homo sapiens
atttcagaggcacagtagccaacaaagctggtcatacatggtaacatcactcaacttagacccaaagtaacgaaatgatgaaaggatcctttttattgaaaggtatgttagttaaaagttaaactaaaaaaaaaaaaattattattaaagtcccactgaatttgacttttaaaaacttttcttccaattacattaaaaaattggtcattagtaggataatgagactattttcctcatgaagtataaatttgtttctttaagtgttatagctagtttcttgctatttattagattaaaaatgttagtgcttaaggtagtttttctccaattttaattcctctaaatagctcttagaagtttttagattattatgctgtcattaaaatggcataattttatttgactcttaacagttttgtcagttctaaactttatatttttagtatatgatctaaaaagaaccagtgtgtcctggccagaaacaactgatgacagtaatctggtagatgtctttagatacttatgtctatgttctgggatagaaccagtttataactcttgaatttcaagttttttcacctgtattgttcctttttactcaattcagagtctgtttcaggaagtaggaataaaagtagacggttatatgggcagcacctctccatcaaggcatttctcttcattggatattgcagtctgcacaattgagagagccaatggtctgatcaatcgcctcatagaggaaaataagatggatctgttaggtaagaaagttagaaaataagtaaatactttctattgctatttttgatggaatgaagtggagctgttgtgatttctctaggtcccatttgttttcctattgtctattatctacttctggaggcaaggattggcatctgtaatgttaggaacgctgtgtttataagttttgtgtcctgctgctgttattgactccgttacgttgcatttttgtactttacaaaacgtagattatatccttgagccctcaataatttctccttgcttctttcctatctaaactctaccaggaatagaaggaggcctgctg

SEQ ID NO: 32545 - DNA, 1047 bp, Homo sapiens
tccctgccctgccctgccctgccctgccctgccctcccgtcccctcccctcccctgccctcccctcccctcccctcccctcccctccccttcccttgccttccctctctttttttagataaagtcttattatgttgcccaggctggcctcaaactcctgggctgaagtgatccttctgccttggcctcccaaagtgctgggattacaggcatgagccaccacatcagatattttcatttctggagtttcttttggttctattgcatatctgctgattcattttccataagacattatggtttcattatggttccctgtgccacttctttaagctgtttaattattttaaacatgtactttgcagtttctttcatattttatattatttgcagttcttggctgtgccatttcttctgactaatctgcgttcctcatggttatttatttccttgatggtttgtaatcttgtttataaacttattttagtgaaggagagggatatttgttttatgagaatttcatgtgccctgggtttagtaagtacctcatccagggaaatattgcctctacttctggctcaactctagaggtcttaatagtaacggacattttttttcctttattattattttttcccatggagttcaagtctttctggtttttaagttggttatggtatgttgtgcttttcaaggaatttgttcattttgtctgtgttgtcaggtttattggcataaattcatttataatattctcttctttttaacttctgtaagatttctagtgatatgaaatgcctattttcatttctgatcttacttacttgtgttttttctctttttaattattcttactagaagtttatcaattttattactctttccaaagaacaagcttttggctttgctaattttctctattatttacttgttttaaaaaatgtattggtttctgctcttatctttattatgtttttcttctacttagtattaatttagtttgttcttttcctagcctcttaaagtagaaacttagataattgatttt

SEQ ID NO: 32546 - DNA, 1024 bp, Homo sapiens
tagagcctgatacatagtgagtaggcagtcaattcctgatagttattgtcacattttgctgctgctgaaggaaacgtatctgctggtaccccccttgcatgggtttgggtttatgggagcagcttttgctgcaagtctcctcctgtgctgcattgtgtggcaggatgactgggaagactgggcctgatcagcctctcatgctatgaaccaatgctatgcctcttttttttctcaactcaggttagagcacagtgaatgggactcttcccggactcctatcattggctcctgtggcactcaggagcaggcactgttaatagatcttacaagcaacagttgtcgaagggtaagaggaagaaggataaagagagggtgttttattatctgacagggctggctatactgggggcaaggagctgaggagaaggaatgtggaagtccagccactgagcagcgaatgagtctaaggctggaagggcgtggaagattagaacctggtggaatttgccaagttgttgactctgaggcaactttcctctcagaatacccctttctacagtggttgggtcagctttgcttaagtgcaagactagtaggagggaaagcaacatagccctatagggtgaaaactctctgactttcacatttttctttcagacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctg

SEQ ID NO: 32547 - DNA, 1027 bp, Homo sapiens
gttttctgcatctgatgatgctttttgttttcctctcatcctaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggtaaaggctgaaggagatagcctctgttcccttccgatcctttctgatcaaactcatgtacatttcctgccagacttaggatttcttaagatctttttctcatcttgaggtagttgctgcaatgagtttaccaacattgtggtcacccaagagaacactgtacttttggagtataagagagtcagtgttttctaaaacagttgttcttagagaataataatgatatctaccattactgaaagatattttatttcaccctaaccataactatatgaggtaggtgttgggttctctagaggaccaaataagtgacaacctcattttctacctgagatctgaatccatggaaatcttttttaaaagattaaaagattgagagattaaaagactgctttataaatgatgttaaaagaatgtagctttttatttgttggcaaatgcacttcctaaccctgaacttcccctcccagtcacagacaatgttgggccaaggtagacctccttcacagaaaatcctgctcttgccaaacaagagtattggaataacagagtgaactgtgcttcctatgagcagtttgctccaagtgtaatttggaagggcagagctacacatccctagttccttattctcatcaaaagaatcactatgcatgagaggatagagagttgctacaagtattttgctgctggaagtccctttccacggaaaatatcgttaaaagcaggcacttttattatattttgggagaaagccacctatgtatatgatcactttcctcagagaatgacatttctgatattaatgctttcttgtaaagtttatgtggcagaggtgacagccccatt

SEQ ID NO: 32548 - DNA, 1033 bp, Homo sapiens
taactgtagagtgagtttttcctttttattgtaggtaattgtattcattcctatctcacttaatatcccatatttatagacagtctttccccttttgtaatccgaacaaagcctctctgttcagttatggtttttacttccaacatacacatacttgtttatattttttaaataatttgagtttagctgactttgccctgggagcttggccttttgtctgtcttttcagaccgtaaatgcaaaaggttctattcatcaggatggtatgtgcctcaaagctgtaatttatgatatgctggtattgattatcttctaagtcaaaatcttttttcatggagctgttaggatagattctgaattagctaactatgtttaattcagtgaattgctttattattcttatctgttataaacactaggcactaaactttgcacatttttgtctgctggatagttacagccaagccaacttttttattttcgtgtttctgtaattcagagtcatattattctgttcccaaatgctcataactgtgattttattttaaccatcaagatgtatcactcctttattcacagtgtgcctcaagtatttttattttccatcttcaacatcctaagataagctctaacactttacccttaaactgttctaataatgttgcttccaggttatcatctcaccagtattttcagaccatcaccatataagtctttctgaaactctactgtattactgcactactcaaaaatatttaaaagttgtactatctctagaatagacttagtattcaaaccccctttagtctggcatttaagaccctgtttttttgtttgtttgttttttgagatggagtcttgctctctcacccaggctggagtgcagtggtgcaatcttggctcactgcaacctccgcctcccaggttcaagcaattctcctgcctcagcctcccaagtagctgggactacaccatgcctagctaatttttgtatttttagtagagatggggtttcaccatattggccaggctg

SEQ ID NO: 32549 - DNA, 1741 bp, Homo sapiens
aagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggtaaatgagtagtgaatttttcctcctccagaggtaacttcaagcaaagaaagtctctaaactatttctgtttccttttagacaatgggactaattttggcataaatgtccatggaagatatattctctctcacttctgacttttttttggcaaacaacaatcctgctacaactgcatgaacatgaaaagttcgcatcttctcttcccatctttctattgagagatttctgtacttctgttttgttttgtttaagatggagtcttgctcttgtcacccaggc

SEQ ID NO: 32550 - DNA, 1027 bp, Homo sapiens
gctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaaga

SEQ ID NO: 32551 - DNA, 1082 bp, Homo sapiens
tattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttt

SEQ ID NO: 32552 - DNA, 1056 bp, Homo sapiens
aaaacaattttataaatcttcttcctttcttaagaggtacatattcctttgcctctattcctctttgtggaacctctcttcatgttcattctccttcaggagagagaccatgttacttggtgacattaatctaatcttgtaatactatttgtttgtgaacctgaaaatgttctttcttatgctatagacttgggatttctatctttgtaatccaggcttcaatcttaaatttaaaagccaatgaacttgatatttgtgtgaaatattttatttctttttctaaatctttagataaaacacttttcttcaaagattacctaggcagataagtagatgttatttttaaagtattttcatggctggagaacttctagaagacaaaaatgctggaggctatctgggcgttagtgtgagaattttctgctggagaatcattaatttgttgtctttctacaatttaggcagtcactgaggagaatattgcttctttgcagaagagagtggtagaactagagaatgaaaagggagccttgctccttagttctatagagctggaggagctgaaagctgagaatggtatgtataaaagaaaaccataattctctgtcttcttatcccacaagtgcctctacttttatcactaattatgtataacatgtagaattctctgattccgtgataataaagatttagataatagagctggtaactatcaaagataatacacattaaacaattagagcatagtatcagtgtttacataagtataacattttgcaatatggactatacatgctgcaggatttctttataactcataatcattttggaatggtcatcgtatcctataggaagtatggcttgaacaggaccttaataagatgatttttaaaataggtaaaatgaagaaagaaaggacattctggtaataaatttgtgggatgaggtaacagagatcagtataaaggtttaaaggtagaaactatgttgtgagtgagtggtttatgctcgtgctgtaccctgcttagaatcctgctcctttcctttagtctggat

SEQ ID NO: 32553 - DNA, 1035 bp, Homo sapiens
tcaggtttagtgaacacgagtcagtctaatcaaacttaaaagtctactatggaaatcatattgttcccattaattaattaacagtaaaaaagtatataatggccaagtagcttcttattggccagtatattctttctttcatctacaaaaatctctgtagagagctagattgtaatcatcgaaggctgattcaggctgattgagcctgaatatcagaatgaaggcagttagtttgatgttcttaattgactaatgtcaagttgagataactagattcagtcatctccattgtaagattatacccttccaaactcacaaacatattggtcagcagagtcctgtcattcctgggctatgctgtccactgataaaaatttttgcctcttggtttctagcatctaggctttccagtctcttctgttctcccattctcgactttttcctccaatgttttgttaagacgttttccaaccattcgaataagttgcaagagttttgtagcgaacatctgtatacccaccatctgaattctatcattaacattttagcacgtttgctttatcaaatgtctatctatttattcatccctctgcccatccatcagttcatcttaaatttataatacatttcactgtaagttgtggacatcagtacatttctctctaaatttgtcagcattcatatcattgactatattttaatatttatttataattgttctttttcttttgaggtaagatttacaaacctttaaatgcacagatctgaagtataccattccttgagttttgtcaaatgcatacacctgtgttacccaaactcctattcaagatatatcacattaccatcacctcacaaagtatccctatacccctttacagtcatcctcacccttcccctccaaagacaactactgatttttcaccatagattaattttgcctgtttcacagcatcatatacatttaaccatacaataggtcctcttatgtgtaaagcttttactcagcatatttggagattcatccatattgtg

SEQ ID NO: 32554 - DNA, 1365 bp, Homo sapiens
cacatgaggttctttggtagaagcaattctttgaaaataagactagaaagatagattggtatttccagttgtagagaatcttgaataaatgatatgttagtttgaattttcatttatagggcatgagaattttactgaaagcttttcagccatgagcaagaagtgtccagggtttaatagaaatctaacttaacttcaccttatgtgtttaatatcttaatctttttagaactttaaaaaatacacttcttgtatatttaaaacatttctagtaaccatgaacatataatttttgatcaaaatttatgtttaggctaacttctgaatttgaaaataggctttctctcgcatttcatagttactgtccagcctatctctcttccaacatcctcatccttgacaatcaaaatttcactttaaaaagctactatcaagtctcagtgtctgtcttggaaagtagtctgtgagttttatttgtgcaatattcggggagtgtaacttgcatagtttctctggtatgtgtcttcagttgagttccatgcagcaggtggtccgagagaaagatgcccgctttgaaacacaagttcgtcttcatgaagatgagcttcttcagttagtaacccaggcagatgtggaaacagagatgcaacaggtgtgttgctaaaactcggtagaatgactgtcattttggttaatatttaatccatcacagccaatttcctacccttacccactgctcttcacttggtgttagtgttttccttattggcctcttttgtgtccttgtcttctgttgcataaaaattatttattttttcttatccttttcttgccttttacccctctaatcaggttgttggtgctcaaaagctgagtttagttggtgaatttatgtggtagtcaaaaattggtttctcttcagttttctgattatagctacctttgtgcattacacacctaacccaaagcttcaaatcaatgaagtcagttttaaatatttaaaaaattagagaagacaaagaatgattttgaagacatgaagtcttttattagatcagtaattcttttttaaaaaaatttgagtagattttgaaaattggcttcattgtatttgagttcaccatctactaactcaaagtattttatttcacttagtgtgtagtgcattgtggtactgaaaggcacttcagtgatactttatgtttgatctgtttaattagattgaaaattaattagaattaattagaacggaaacttttaagttctaagcaatctttcagaatgcaccactaaataaagttttagaatacaacatattattaagtagaatactaattgtatatgtgtatcattgctttatttatt

SEQ ID NO: 32555 - DNA, 1054 bp, Homo sapiens
tttttcctctgtcagttctcttcccctcactgtggtagcaccaacctctctcctcatattgctttgttccctccagcttctcctcagctatgatgtcagatttttaaattatccattttatactctgctttttaatttcatttttagctctgagaccttaaagcagtaatgtcttagagttcattttctttctctgttaaagaaatgatttctaagtttcagcaatcagtcatagcaaccctttaactattatatactcaatacagagctaggtattctgtggaaagtatagttgaagaaatgacaacagtcctcaggtgcttgactgacttatgtgaaagtataaaagtattctttgtaattccagtaagcagaaatagctttgtttagggggttgggagggactaaatttacaaagaggcagaatctcagtctaagggagagcttttggaaaaaaaaatagattattgaaaaaattggatttcccctcactggctcttttctgatgtgttgcttctcacttagcaacagctatagtttcctgagctctctccttgattcttcaaggcaacaagacttcgggttttctattaaggtttagtcctgcatggcactgactggttttgccctcagaataaaagctgtcaaaatgggaaactcggtaccatttcttccaattatcacatcccctccagtatcttcctgcttttggttgctctccagtattttcagatagctgttttctatattgtccacagttttgggttcacatgcttggtgtgagggaaaaaaaaaaaaaaaaaaaaaaaaaaaatatatatatatatatatatatatatatgtgtgtgtgtgtatgtatttcacagtttatagctattatgtgagggagggtaggtctaacaggaactgcttggccatacaaaaactggacaaccctaagatttcttatttgttagatcagctggtttttcttgctcccatcagtttaataaaattataactaaatggttgtaaatgaaaaattagaagaaaatatcaaatatatattaattgt

SEQ ID NO: 32556 - DNA, 1079 bp, Homo sapiens
gtatacatgtgccatgttggtgtgtaaaaaaatttttaaatgttacgtaaagacaaagattacattgctcagtaggaacagtgcaagcaagaagatacctttttttttttttttttgagacagagtttcgctgttgtcacccaggctggagtgcagtggcgcaatctctgcaactgccgcctcccgggttcaagtgattctcctgcctcagcctcccaggtagctaggattacaggcgcctgccatcatgctcagctaatttttgtacttttggtagagatggggtttcaccatgtttaccaggctggtctcgaactcctgaccccaggtgatccacccatctcagcctcccaaagtgctgggattataggcatgagccaccacccccggcgaaagatatcttgctttaaagtactgaaaggaaaaaaagttgtcaacctagaattctgtacctggcaaaaaaatattgttaaaaaaaaaaagactttttcagacatacaaaagctgaaagacttgatcaccagtacacttgcactaccaaaaatgttaaatccttaaagttgtaaaggatttaacattgcagaaatgttaaattctttttatttgtgtagattgagggagtaaaaatgcacatttacatgcctatattgcaagctcctgcccagcaaaataaacagtcaacagtaaacagcctatagaatgggaaaaaatagttgcaagctatacatctaacaaagggctaatatctagaatctacaaggaactcaactcaagaagaaaaagacaaccccattaaaaagtgggcaaagccagatgctgtggctcatgcctgtaatcttagcactttggaatgccaaggccaggaggattgcttgagcccaggaattcgagaccagcttaggcaacatggtgagacctggtctctacaaaaaatttaaaaattagccaggcatgttgatgcctgtctgtggtcccagctacttgggagactgaggtggggcgatcacttgagctcaggaggttgaggctgcagtgaggcatgttcatgctactgcactccagcctgtgtggccgagtga

SEQ ID NO: 32557 - DNA, 1079 bp, Homo sapiens
taaagatgtgataagattgggatagggatatctgtagaaggctttctgagatgagcatattttttaatctgagttttgaatagtgtgatgacattgactgatgggacagggtgagcatcctaggcatagggaatagcatgtaagagacacagtggcacagaagtagatgtcacaaagattctcacatattttgattggataactttataaagtctttcaactcagagatttttacatttaaggtatgttgctgatctcttttctcttaacaaaattattttagtaactactaaagtacaattttcaaaaagctcaaacatgagtcttatacaaatataaaatttgactgctcaaaattttatgcaactcattaatgagggaacaaataagatatttatacagggtcaaaggagaatttgaggaaaatagatttatggagttggtttgtcgaagaaatgtagaagtaaatttgctgatagatttttaaaatttgctaataggaaaatatgacttataaagcaatgtagcttctagaattaccttttctactggacagaaatcatttgtattgctttgaataagagtctgtttacattgctcttagataagaatctttagcattgttttctaccagccaacctctatttttacagaattgtaaagtattttaatagtgagtagaaaattaaacagaggtacatacgcctagaaaatcacataactccttaagggggtaaataaaaggatactcactaaccctttccttttgactatttctaagttttagataatttttcacaacatcagtaatacaagatgggttgttagtataatgaaggaaataccaaggaaagattttaagtttctcctatattaagcacatgatagaattcctatggcatttttgtctttgtacatcatttaaaaattaactgtgtacctgtcttgatttcacttttatcattgccttgaagcttttaaattatttattgtttagtattttgcacatttatatttcatccttgatttgattgcaggcttctctaaggagaaggcctttggctactttgtattctcta

SEQ ID NO: 32558 - DNA, 1046 bp, Homo sapiens
aaaaaagaagaacaaaggagaaacaaaaccaagtggtagatttaaacctatctatcttagatgtaaatgtggaaaaactaaagttaaaagacagattgacagattggatttaaaaagtacaagcctactatatgctgtctaccagaaatgcaccttagatataaagacacaagtaggttaaaagtaatggggtggaacaagatataccgtgcttataccacagaaagttgaagtacctgtattagtatcagataaagtaagttacagaacaaagaatatttctagtgctaaagaaggttatttcataatcataaaaaaagtcagttcatcaaaaggatgtgtttattgacctaatagagttttaaaatacacaagcaaaaattgacaagaactacaaggagaaatcctcaattaaagcaaaagatgttaatatacctcttttgatatttaatagaataagtagacaaaaaaattagtatgaccacagatttgaacaataatatcaaccaatctgacctgattgacattttacaaatattctaccaaacagtagcagaatacatgttcttttcaaatgcagatggaacatttacaaagaagggtgcatattccgagccataaataaagtctcaagaaacacaaaaggggccgggcacggtggctcacacctgtaatctcagcactttgctgaggtgagcagatcacttaagtccaggagatccagaccagcctgggcagcatggcaaaaccccatctctacaaaaagtacaaaaaattagctgggcatggtggcaggtgcctctagtcccagctacttgggatgctgaggtgggagaatctcttgagcccaggaagcagaggttacggtgagttgagatcacatcactacactccagcctaggcaacagagcaagaccctgtctcaaaaaaaagaaaaaagcaacgtaaaaggatttcagttatacaaagtatgttctctggcctcgatggaattaagttggaaattgatgccaagaagatctctgaaaagtccccaaatatgtggg

SEQ ID NO: 32559 - DNA, 1028 bp, Homo sapiens
gagaccactgctttaagtaattttaaacacagttctctaactttaagttgattttccttattgaaaggcgcttttaaaagttgctgtttgcttccaccctcacaacatatttccagtttatttacttagcttcagatttaggtcctcttaagctttgtctgaatgcctagcttctgactgccttctaaatttaactttttcttcatttacacactgattctaggtgcctttctggttcttattcgtggtcatcttctgacctttattgcctgcacctgcatgcatttgacatatagatattataatctctcttttaaaatctgttcaggtttttttggtaatacttatcaattatcaatcagtctcttgcttgttttcttgtttgtttttcctaaaagtgtttactctctcctttgggctctatcttcaagttgtctaataactacaagctcacatgtctttagtactaccttgacttctagctgctgggccctgccctaagtccggtttacttacatgcttctctcttcttttggcatccctgtttgaagacagtttcttagctccatatggggaatgtagcaggattattttgctccaagctgtcatttgattttttaaaaaatgatatttcctcactaggtacccgcaagtgggaatccaaaaataagtaatgagaagagtggaactgggcattaatgaatacattatattaatatgcaaactatttttaccttttgacagcagaggttcatcttagaatttataagaagtgataagtctacaaggctgaaactcctttaccttagaagagttcttggctatatgtacatttgggcctactactatatcagagcttgagcagattcacaactgttgtcaattatggacagatattaataactcagtcacttgacttactctgttcaggctgctgtaacaaaataccatagacttggtgacttaaagacatttatttcttatagttctggagactaagaagtccaagatcaagaagccaacagatc

SEQ ID NO: 32560 - DNA, 1050 bp, Homo sapiens
gagtccaggagttcaagaccagcctgggccatgtggtgaaaccctctctctacaaaaatatacaaaaaaattagcaaggtgtattgcacatgcctgtggttgcagctatttgaggggctgaggtgggaggatcacctgagcccaggaggcagaggttacagtgagccaagatcgcgccactgcactccagcctgagcaacagagtgagaccctgtctcaaaaaaaaaaaaactttcaagacatttctagcaacattatattatgctcataatataatgtcttgaagccagattttaaaatgttacatagtacctcagttgtataaaaacattaataggtatgtgtagaaaaaagaccaaagggacatattaaaatgttgataatggttaactatggatgatttttatttaaagtttttttctaacttttctaaaatgaaagtaataataataataatttttattttaacaaatggacgaggaaagaaaggagttggtttcagtcatggatttaagtttggcaaaggtaagaagtagcatagtatattgagggaaaaagaatcaaacgttgcttttaatacatattaatattgaatattaacttggatgttttcaataataagtatattcctagtattatataattctgttttattttcattcgttctttctttttttaagagacagggtcttactattgcccaggcaggagtacagtggtgtgatcatagctcactgcagccttgtactcctgggttcagtgatcttcctgccccagcctcccaggtagctaggattgtaggcatgagtcaccatgtccggctaattaaaaaaaattttttttttgtagagacagggtctcactatgtctgtcattaaggctggtctcaaatttctgggttcaagtgatactcctgcctcagcctcctaaagtgttgggattacaggtgtgagccaccgtgcccagccattttcttgatgctttttaagtggctgtgttttgttgttgttgttgttgttcttgttcttgtttgaatattttgtaaatttg

SEQ ID NO: 32561 - DNA, 2183 bp, Homo sapiens
cgtccttcacaggtataataagagtttttgaccaggaaagcattttgtccccaaaatgctgaattaggaactgagattaatagctataacaatctatagcattcatatgaggtgatttcatctgtatttgattgcctgtcaccaccaggcttttttatgcagaacttctcagtttcttaatgtaggaaatgatataaacccatgttaggtacttgagccaggaagaaacagggagaaagtaattttgggaaggctactttagtgttagtacatgaaggggattgagtaaaagtactccatccaactataagtcttattttggtaatctgggaggtggtggcttggagaatagcatggcaatgccaaaggaaaggaaaaagatggactcaggattttaaaaattgagaatgtaaattaatagcctttgtgaactagaggggtttaaaaggaaacttgatatagcgggcagatgatgtgtttgagatgactagcagacctaacgtaaactgctggctaccctgggctgatgctccagtgagaagtgaggactagagagttttcgcacatggaagttcacatgctatgagagaatggaatagcagaggagcagaaaattgagctcttaacaatttgttactgtgggcagaacaaaagaggaaagtgaaagagaaaagaactcagagaaaataggagattataagatcataaactccagggaagatgttttcagtgataccaagacagaataaggattagggataggctgggtgcggtggctcccacctgtaatccctgcactttgggaggccgaggtgggtggatcacctgaggtcaggagttcaaggccagcctggccaacatggtgaagccctgtctctactaaaagtacaaaaattagccgggtttggtggtgtgcacctgtagtcccagctacccgggaggctgaggcaggagaatcacttgaacccaggaggtggaagctgcagtgagctgagattgcaccactgcactccagcctgggcaacagagtgagactccatctcaaaaaagaaaaaaaaaggttagagataatgacataactcttttcaatttatttctgacaggagaaggggtgttaatagtcaaactagcttagaaattataattagtatcatgaatatttttataaatctcacagttttttccatttaagtttttctttaattttagactgtgatagatgccaacattttcccagccctcattagtattttacaaactgctgaatttcggacaagaaaagaagcagcttgggccatcacaaatgcaacttctggaggatcagctgaacagatcaagtaagtaccaatcaggcagcatattgtaagttaaagaaaaattattattgtgtctatcactttataacctcccacatattacctagagtaaaagattagctgcctttgaggggaaaagtaagtgagagacgatcttaccaaataagaatgtttagttccagtccttaggaaattgtccttggtgtcataattagatgtgtatttaattctttataactctcccatttctttttgctgaaaaacaatcctgggatataagaagtaggcatagtcgaggcttgaggcaatagaaatccttgcttcaacctactctggagctacttgtcagaaatatcttgggtaatataggttacttgtagaacttgagcccaagtttaataactcactcttgccctttttagtttagatgtcttaatagtagaattggatcagaattgaaagagtggtatgtctgagaatgaagtgccaaatttagtagaggcaggtatcttctaaagtactatggtattcttgttaaagggaggagctgtagcagctcaagacttaaatggctcccttggtagcagcttagtgattgactgattgagatggagtctctctgttgcccaggctggagtgcagtggcactgtcggctcactgcaacctccgcctcctgggttcaagcgattctcctgcctcagccttcctagtagctaggattacaggtgagtgccaccacacccagctaatttttgtatttttagtagaaacggagttttcccctgttggccaggctgatcttgaattccggagctccggcgatccacctgccttggcctcccagagtgctggaattacaggtgtga

SEQ ID NO: 32562 - DNA, 1050 bp, Homo sapiens
taattcttattaacagtgaatacttttttttacctgtataaagttacttatttataaaatttcaaggggagatgttatgtctttcataaaatgtgttccttaagttaaacattgatatttagaacaatacaataagtaaaattttcaaactttttcttttaggtaattctgaattgctcagctctgcagagtttattgcatttgctgagtagcccaaaggaatctatcaaaaaggaagcatgttggacgatatctaatattacagctggaaatagggcacagatccaggtaacctcataggacctaacttctctttcagtatttttattgaaaagtaaggtttttttctcagtcaccctttaaaacacatttgtttttggctgggtgcggtggctcctgcctgtaatcccagcactctgggaggctgaggcccgtggatcacttgcggtcaggagttcaagactatcctggtcaacatgctgaaaccttgtctctactaaaaatacaaaaaaattagccagtcgcagtggcaggtgcctgtagtcccagctacgcgggaggctgagggaggagaattacttgaaccgtggaggtagaggttgtagtgagccgagattgtgccactgtactccatcctgggtgacagagcaagactccatctcaaaacaaaataaaacgtatatcgttttcattattgctttgaagaccactttcaatgttgttgtcttatttcatagtcagctttttactttatcctagcttatagatgttaagtcttttgaaatttacacttaagccttcattttttctgttgccgttaatatttgatgtttcaccaagacccaagaaatagttatcaggggaaccacctccagtgtttcatgtaggttcttttctgttttccctaagtgtcggccggtctgagaaataaagggaaagagtacaagagaaattttaaagctggctgtctgggggagacatcacatatcggcacgttccgtgatgccccccaagctgcaaaaccagcaggtttttattagtgattttcaa

SEQ ID NO: 32563 - DNA, 1028 bp, Homo sapiens
taaaatttctctggaaggatatacagggaactgaaaatgttggttgtctttgaggggaactggttggctgggatacaagaaggggaaagaggcttttaacaactatggagtcttttataccctctgaatttttgaaccctatcagtatctttctgtccctcacccacctccatatgctgtatgcttttgccatatttgttccttgaattggctgtggccactctcagctcagagttttaacgcatgctttattccctctgcctggaacatgtgtctccactgctaccccttgctctgactgccacctcacacatatccacattctctgctcctaatgttttcttgttcttcaagtcttggtattaacattattttctctgagaagccctgtttgaccctaaactcttaagttaggtacttatttttttttctttatccatcagaatattaatcacattgtattgtaactaattactagattttaagattctagaggtggattatgtcagtgtttatttctgtgcctctgtaaatctaataatttctggcacaatatatagggacttaaagaatatttattgaatgcaatgaagttctgaatctctacatctacttctgacctatctcaagtttcagtcctatatctgcagtagtttcttacatatttctgcttgcatatctcacgtttgtctcacagtatatcttctttcccccacaaggcaagttccaagtttttatttttcctatttcaggtaatgatataactattctctttacctacacatgaaactttgcagttacatgtggtgtctccctcccttatagtttgtatagcaagttgctgggtcttcttgattgttattgttactagatccccatcaaattacgtacttttggtccttgtcacacacacaggttgttgctgtacccatccatcctccgactgtcctaagcagttactcttctcaatttattccccctaataacagctgaatctttcctaaagtaatgttatttgcattatcttc

SEQ ID NO: 32564 - DNA, 1050 bp, Homo sapiens
taaactatgtaacctttattaatgaatgattctttcacaggcagtctgggctcttggcaacattgctggagatagtaccatgtgcagggactatgtcttagactgcaatatccttccccctcttttgcagtaagtttcttcttccttcttcctttttttttctttttgagaataaaaatgtaagagattcctcagaaagcattacatgtttggaaatcattttggattttctagtgttatttttaattccagatattttcttgtttagatcatttcctcaagcaccctatctttttccatgccaaaattctgaattctgaattacttgcatcagaattaatgaagttttaatgttctggagaaaagctatctgaagacatctctttatcaaaagtattattatttagtatttatgtcatcagataatcactgtctgttacatagtttaccattgtaccatcgtgcttttaggttattttcaaagcaaaaccgcctgaccatgacccggaatgcagtatgggctttgtctaatctctgtagagggaaaagtccacctccagaatttgcaaaggtaaggactatgcttttgggacattggcagaaaaaatacaattaaaagagtattgcaaccaatggtaaggtgaacaggaagataatttttgttaaaatttaaaatgttagaattttatctgtttttggagaaacagggttgttgttgtttttgttggttctctttattatttaaaaagcaaatttagagcatagcttgaaggtgcacatttacgatgggactgcaaataaagcatagcatgaaggaagaatttgtaaagcttattgaaattaggcttcatacaattagtatactgtttaggagactatcctttcagttctcttaaaacagtggttctcaaagtgtggtctgtgagttctctgggagtccatgagattctttttttttttccaataggtttttggggaacaggtggtgtttaggtacatgagttacttgtttagtggtgatttctgagattttggtgcacccaacaccca

SEQ ID NO: 32565 - DNA, 1072 bp, Homo sapiens
gttgaaagtaggccaggtgctgtggttcctgcctgtaattccagcacttgggaggctgaagtgggcagcttgcttgagcccaggagctcgagaccagccagggcaacatggcgaaacccagtctctacagaaaataaagtaggtgggcatggtggcacacgcctgttgtcccagctgcttgagaggctgaggtgggagggttcacttgagctccaggaggctgaggctgcagtgagccgatatcacaccaccgcactccagcctcggtaacagagtgagacctatctcaaaaaaaaagaaagtggctagtctttgccacttttgtgcagaaaagtacagaaagcaagtttctttttgttcactgttttcttatgtaagcaagaaaatactctctttctgtctctttttttctttctgtctttctctctttctgtctctccatctttccgtctttctttctctccgtctctccatctctccttctctccgtctctccttccctctgtctctccttccctccgtctctccttccctccttccctccgtctctccgtctctccctccctccctccttccctccttctcttgcttcctccctccctccctccctccctctctcctccctccctcctttccctccctcccttccttccttccttccttccttccttccttccttccctccttccctccctccctccctccctccttccctccttccctccttccctccttccctccttccctccttccgtctgtccctgtcacccaggctggagtgcattggctcaatctcggctcactgcaaccttggcctgtcaggttcaagcagttctcatgcctcagcctctcaagcagctgggattacaggcgcctgccaccacacccggctaattttgtatttttagtagagatggagtttcactgtgttgcactccatactgggtgacagagcgagattctgtatcaaaaaacaaaaacaaacaaaaatgaattagttctttcctttaataaaccgaataccttctgtttgttgtacactttaggatattatttatcttcctcccccaat

SEQ ID NO: 32566 - DNA, 1070 bp, Homo sapiens
taataaaactgttaaagtaacctggccaggtgaagtggctcacgcctgaaatcccagccctttgggaggccaaggttgggggatcacttgaagctaggagttcaagaccagcctgggcaacatgatcagaccctgtctctacaaaaaataaaaaaattctctgggcatggtggcatgcacctgtggtcccagctactcaggaaactgaagtgggaggattgcttgaacccaggaatttgaggctacagtgagctatgattgcaccactgtactccagtccgggtggacagagcaagaccttgtctcaaaaaagacaggagtgggggaggggaagtagccatttctgatgtccctttgggatatgtctgggcatgtatatgtttaaaagactgagctcttagaataacagagctcttcacagtaaactcatttgttctctccccacttgtattgtagaaatcatgaccaccccaggaaaagagaactttcgcctgaaaagttacaagaacaaatctctgaatcccgatgagatgcgcaggaggagggaggaagaaggactgcagttacgaaagcagaaaagagaagagcaggtaaatcctttacctttattcatttcttttaaagaatttaatgttccattttaagcctgaaactatcttcattttagcaaagttggggtgtgtgtgtgtgtgtgtgtgtgtgtgtgttttccccttctcccctgtaaaatcaacacttttttggagtggggatgaggaggtactgaaaagtggtatacaagaatggggaaatctctcaggttctcattttctcagcataactacactattcaatattttcacctatttgtgtttagtgtattttagttttctaagggtgcaactttcttctttaagatttttttgatgtatgtttgttaattaattcacaagtgaccactaaagtgttgctgttcattgtaaacttaaaattggaaatgtaaaaatatacacaaaaagaaagaataaacctcatacataaaccagtcctttggattcagtaattgtcaacagtttgctacacttgcttcg

SEQ ID NO: 32567 - DNA, 1045 bp, Homo sapiens
gaaaaaaaaaattagaaatgaaagaggagacattactagtgaccttgtaaaaattagtaaggttataaagaaatactgttaacagttgtggctgggtatggtagctcatgcctataatcccagcactttgggaggcagaggcgggtggatcttctgaggtcaggagtttgagtccagcctggccaacatggtgaaacgctgtctctactaaaaatacaaaaagtagccaggcgtggtggtgcatgcctataatcccagctactcaggaggctgaggcaggagaatggcttgaacctgagagacagaagttgcagtgagccgagattacgccactgcactccagcctgggcaacagagtgagactccatctcaaaacaacaacaacaacaacaacaaaaaaacagttgtatcccagtaaataaaatggtttagatgaagtgcacaaatttttggaaagacaaaaactaccaaaactgactcaataagaggaacagacaatctgaatagacctgtaacacgtgaagacactgaaatagtagtcacagaactgcccgcaaagaaacagcctaggcccatatggctttactgctgaattttaccaaacatttaaagaaataatataattcttgacaaaatcttcctggggaatactttccaactcattttatgaagctggtatcactctgataccaaagccagacaaagacatcacaagaaaatataaacccgtctctttttttttttttttcttgaagagacagggtttcactgtcacccaggctggagtacagtggtgtgatcatggctcactgcagcctgcaactgctggactcaagccatcctgctgcttcagcctcctgagtacctggaactacaggtgcacaccaccagcctgtctgatttttattttttaaattttttgtagagatggagtctcaccatgttgcccagtctgatcttgaactcctggcttcaagtgatactcccgccttaacctcccaaaatgctagaattacagacatgagccactctacccgtcccttgt

SEQ ID NO: 32568 - DNA, 1041 bp, Homo sapiens
cacctccttattcgagtattgaaatgtatttatcagtattttttctaaacatttttagaaaatattttgttaattttaaagctttttctcattctcagcatttttcctttgttatatcttttgttatatttatacatataaaagaatatgtaacataatatataatacaacgagcaccagtaaactcattacctaacccgaaaactagaattttttatttttttattttttagagatggaatctcattctgttgcccaggctggagtgcagtggtgcagtcatagctcactgcagcgtcaaactcttggcctcaagcagtacttccactttggcctccaaaagtgctgggattacaggcatgagccaccatgcccagcctagaattttatcagtaacttgcatttgtgctgtgttcttcccaatccctttcctgtctgttccgttcactctcctcattctcttgtttaaacaaaaaagttttgtcacattatctgtccatctatccatctgtcttatctctgtacacatatgcacacatatatatttttttctattggttctctttctttggagaaccttgactgatataccatatgacccagcaattccattcctaggtgtatacccaagaaaaatgaaaatatatgtccacacaaaaacttttttttttgttgtttgagacaaagtttcgctcttgttgcccaggctggagtgcaatggctcgatctcggcccaccgcaacctccgcctcccaggttcaggcaattctcctgcttcagcctcctgagtagctgggattaaaggcatgcaccaccaggcccagctaattttgtatttttagtagagacggggtttctccaagttgaagctggtctcgaactcctgacctcaggtgatccacccgccttggcctcccaaaatgccaggattacaggtgtgagccaccgtgcctggcccacacaaaaacttctacacgaatgtttacagtagtagtattcataatagcccaaagtgacacaactcaaatatcaatcatctga

SEQ ID NO: 32569 - DNA, 1029 bp, Homo sapiens
ttagttgctacacaaccttccacccggtatctgcagagggattctagcgctgagtcagagatggacaggtgaccactgatggtgcctatattcccttagggattgaatttaaacaagtaaaaatgaacacttagcttttgtcttcttccatgttttgtcttaaggtcagagtactaacttgtatcttttttttttttttttaattaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggtaatagggctttaaaacattaatgacctgccaggggacaccacagctgtaactctctcaagtccttatgctgtgtgcttcccctccctgcgcagtgcaaatgagaatggcttccttccctctgctctgctgttggaaggtagcttccccagttgtaggcttcagacacatacacctctgcttcacaggtcctggaaaggaaatggcaagagggaacacagctcctcctattggtaaagaggagaatggactttggaggaagacagtctacaagagtcattttcatttaggtcaggagaaaatgttcaaggcatgggtactcgagcatctctggaacatttaatcacagttagtatctgttcaattatgatagcactgaacccagacacataaacacaggtcggaatgcctccaggtgtgggccaacgggcagaaggaaccgagaatgtttgcttttaagcaaaaatggatgttgttttcataaattactaactctgaaacatttccaaaggtactgtacatagtgctgcttcccagtgaggaaaatttccttttcaacattggcacttgctgtctgatatttcattaataatttgaaaggttttcttagtcacttaagaagattttattctctcgattatccctctccc

SEQ ID NO: 32570 - DNA, 1036 bp, Homo sapiens
gtctcagagatatttgaaataatgccatttccgctgcattcactgttctaactgcccaaaacacgctttccctaaatatcagcataatcctgtctgtttattgtctgtttccaactctgaaatgtaagcttcatccgagtaggcattttgtctcttttgttcattgattcattacaagcttccagaacagtgcctggcatgttgtaagtagtcagtaaatatttgttgaatgattactattagtgtggttattcaaatatgttattggctaaaaagatttcttgaactgccctggaaacctaacctcttccatctgtagcattttccataatagaatattccaactgctaaataacagatgtgcaagtgaaaatgggcagcattaccatacagagaagttggttagttcttgatggattgcaactttatttcaaaacaggatgtgaaatggtctgacttcgggtttcctggaagaaatggacaggaaagtacattgtggattggctccttgggagcccacacaccctgtcatctggactcctatggttgtaacttggtattccaggtacaaggaaggtaatgtgtgtgtgtgtgtgtgtgtgtgtgtgtgtgtggaacgcacatgtgcatgcatgcaataggggtggcagagagaatagggcaataccccaaggtgtagtcccagccccatcctgtcagcctgcctcatgattagggcagacctcttaacctctggttttggtttctcctctgtgaaatgaggacagttaaaatggtggtttacaggtgcgtgccttgtcatgatcaggattgtcttcagagagtttattctagaactctgagattccactcccaggtcagctagacagctctctgcttggtcttttttttttttttttttttggtaaattagagacatttgagacagtcttgctctgttgcccaggctggagtgcaatggcatgatcatagctcctggacctcaagccatcctcctgccgcagcctctcaagtatctaggactacaggtgtgtgc

SEQ ID NO: 32571 - DNA, 1031 bp, Homo sapiens
caggttctgtgtagactgtatctggggttcagtttgggagccaggctttagggctgttgacaaagtaaaggaaattgagagaagagcaattggaaggaaaagttaatgctgctgtgtctaggttaaaaaaaaaaaaagataaaggagaagttggacagttttctgataaaaatagcaatttttggcaggaaataaacttgttctctttagttatagaaagcagatctaggaccctcctctgtaagctaccaggaagtagatactgattttgtagtaagtggtcaactagctagctacttgtcgctcttttcagggatggtgtagaatagaacttgctgagaatagatgatttttaaagatttttccaactcttgaggtatgtatgagtagactccagaacagatcaccccactgatcaccctttttggttttacagatgcagcactcaaacagggcctcctgtttctagcaagactcaagacagattcctgggcccacattgacttcagacatttgactacccataagtggctgaacttaattgggaagagaatcccaactctcaatgctgtctatttttacactgacaattttgcttttttttttttttttttgagacaaggtcttgctctgtcactcaggcactcaggctggagtgctgtggtgcaaacatagctccctgaagccttgacctcccaagctcaagtgatcctcccttctcagcctcccaagtagctgggaccacaggtgcatgccaccacgcccagccaatttgttaaaaaaaaaaaaaaaacctttttgtagagacagagcctcaccaaacattgcccacgctggtcttgaactcctggacccaggcagtcctcccacctcagcctcccagagtgctgggattacaggcatgagccactgcacctggctgacagttttgctttttaagtcattattactgttagacaggaggccagggaagtctctcctcagtttctcatacagtaacctcaccctgtagaaaaaccttcagtgattct

SEQ ID NO: 32572 - DNA, 1033 bp, Homo sapiens
tatctccaactgcctcttttcactcaggagaatctcagccccacggggcacctccaagacctggcctggccagagagagatcagtgctcccacgaggaggagctggggaataaactgctgactggctctgcaaagcgggtgttttatgcatgaaccacccctttcctccttccagcatgcctttcaccctgcctttgagaggggtaacctacccccaactcattcacagatctcccctggctgccccatgagcacagggaaggcccactctcagccatttttttgctcacaagcttcagagataccttttccaccctggacagctcccactgtgagactactacaccacagtgctggaatcagcctgcctgcaacttccaccatccatctctgtcacacctccgagcccatggaatgaacctgttcctttttgtaatggctgcttgagacattgcagtaaaaaaaaaaaaaaaaaaaaaaaaagacatggtgatatattattggtctgatggctcctttatgaaaaggactctaaactgccacccatttccacagtcagagacacactttaagtctcttatccttggagctttcatttttcttaagagtgttccctgctctgtaagctttgaagtggcctttggccaaaagcagcaaacgtggttccacttgagccaaggaggcagttatcccttttattcacaagaagagagctcgggcactggcctcaagaagcctcaggggtcccctcaggctgccagggaaggggcagggcaggcgtgtccatgaagaatctggtatcctctttcttctctgggacttaattgagggcaggggaagctgaaggggtgagagggcttggagaaaggagactggagccagcatctactccacgtttttcttctttgctattctgccatggtttggaaagacaagacacttcatcccttggcttgggaatcttgacaaaagtggcccctggcacagcagttctcaaccatgggtacacagcagagttacctggggggtattt

SEQ ID NO: 32573 - DNA, 1065 bp, Homo sapiens
caggaacgcttcctggaggaggaggatccttggtttcatttctaaggtaatgtaatatttatccaggatttctgagaggtcagctaaaaacctaacccaccagactccagatccacttcttatcctatattgcccaaaagccatcgtgactacatgacaattcttgccaacctatagtcaccaacctataatcacctgctgggggcaaaggcaggcccaaggggtttgcttcattttgctgcagaatttctttcttcttctttttttaatcatgcctatcacagttttctgaaaaacatccaactcacaaaacctccagttctccagggagcgattaaatgtttgcctgtcgtgcagaaatgaagggctgcttttactctgtagtggagggataatgagcaatgatttatttcctttggattacacacacacagactctctctctctctctgcctctctctctatctctctctctctcctggcccttctgtgagtcagttgctaaggcactgtggggagaaagcacagtgcctcccattaccctgaatctttaccaacagcggcatgaaagttcctctgctccatggctctctccttactgctgccaattcccacccatccatgggtcatgcataggctgagggagagctatcaggaggctgtgaatcaagaagggagaagtgtgtctccagcaggagggaaaccgggcgagtcagctggcactttctaagcaggccctcccagaccactccccatccgcccagaggccgtgaggtctcctctctgcccacccagtccctttgaaaggccttgattgggaacaaccttccttggaggcagggtggacactgaccgcccaatctctgcacctcccacctctgcagaatcttgtctgaaaatccaattcccctcatacaagaaggaattgaggattattcatatattcgttcaaacactgctaggtgctggactgagcctggagatctaggaagcaaagtctttcttggcccccagggcaaactaccaggctagacacacagtgtggcagtaaagtagaagactatg

SEQ ID NO: 32574 - DNA, 1050 bp, Homo sapiens
ttcttggcagttggtctgctgattctcctccactctctgacttgaaatagaaggacaaggattccatcgggctttccctgagtacatgaaagctttaaaggcaatgctgtatgtgctgaatcccgccatgacactgtcctcattgttctgcgtttaataaggatgacttaatcagacttgcgcatggaacttgtttgaatttgaagccttgtcgatattatcagagtatctttcatttgaaccagaaatgtcctggccagcatcttctgtgatgggaaaggttggtacttgaaggatgtttagtgaccatctgtcctgccagtcccctgaggatcaaattacaggtttcagttacagagtggggaggctgggttagaaatgagggaggcttttctgcttgagcacctctgccaaaccactgggttcttcatctgtgaaagggaggtgttcagaagaatcttaaagccctttctggccctcaagtcagtggttttgaatggatattgcagtcgcttcttgattttccaggagtggctcgttgacttttctgtggattctttgtggggaatgtgagtctcaggatagtttccagttaccatccaacccccctgttgttaacccatctgaccgactgccagtcactgcatcttcagagaatgcattttcctttttgcctcagcctgagccaaatatcatctggaaggtaactctgctgtatattgaggcatacatgtgcatataaacatacatacatatatgcacatataaatgtagatgaaaggtattccaaatctgtgtgttaccggctgaccattggattaaccgcagttctgtccgcagtttcgttccctgccagagctgatgtaagcccgccctgggaggcaactttagggaaatggcttgcagggtaacaatttagatccatccctatttgccagtcccactggtctacctgagccatagctccctccctactgccctagccattgtccggaaggcctcccaagagcccccctgttaggaatacaaaagagctgcagttggctctta

SEQ ID NO: 32575 - DNA, 1018 bp, Homo sapiens
atgagaaattagtcagagggtcagagaggacctcaacttcatatgctttaaatagagcatatgcaattttaaaccatcctcttaaccaatttttcttttcttttcagtttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaacactaagtacttgagagttacagtctgaataatgaagtcgtaccagctgaatagcccagcttgcagtatagttatgtttcagtctgcagtgtgtttagcattcccttgtcaaagtgcttgactgcatgctggaaactttgtatttttgaagcggcaaactctgttctctggaatgctctgaagttatggctgggacctatcccctcacatctaatgaatgaattataaaatgtatatgtctatgaagcttcggggtagtgcctgtaatcagaaaacaacttagaacccttttgtttgtttccaattgagtcattactgcctgccactaagaaacgtgcttgaatctaataagtatgtgtgtaccgtaaagaatatatcttatctggagctcagcctcaatcatgtcttaacaaaatgacaggtctcagaaagggggagctcaatagctcaaaagtgacaagtccttttcacagcaccattctcagaacacctctgagtaacgtg

SEQ ID NO: 32576 - DNA, 1074 bp, Homo sapiens
aaggtgataaaaaaaaaaaaaggttttaaagatagtcttttatgttgttatgcttgttggcaaaatattcaagtagataataaaagatacctaacttaaccattagatagtgtatcaagtctgatgtccatgagcttccagcactcattagacacaaataggattgatttctcatcctttgtttcctatttgttttgaaacccgtattgtaaaatgagtcttattttaaagattaggtagtggttttgctttctccatctatacagtaagtgtaaaaaatactgtacttggtcagtggttttgagaggtttaagaaaggtacctggatcccatggttttataataccattaaaaatattattgtttttagggagaaaactttgttttaatgtggactacattgaaaacttagtctgtgtaacaatatagacacctttcagttgctcaagaccgttttgactctaaacatttaagttggaatgttttagaaaatatattatatatcgaaacttagtacagtacatttatttatccatcccaaaatttctttcaggaattgttccatcttctgttgtcctgacttctttccaggtgatgtcaagagtttttctaatatgggcagtaacacatagcgtcaaagaggtaagtgtttatatagaccaaaataatgtcaacactaacaaacactagtcaacttttctgattcacatgtttgttatggctaaagagttccaggtcagagttccaggtcatgtcaatatagctgagataaagctcacattcactgtaggaactgggttaatagtgggaaacatatcccagatatgcagtgttgttaaaaagaagactgattaaatggtaaagtcctgtaatctgagttctcatggaggttcagatggtgtggatgtggtctgcaactcagttatatttttctgatatcttgttcgtatcatgttgcccaggccgctctcgaactcctgagctcaagcaatctgcctgcctcactctccccaaattctaggatttcaggcatgagccaccacacctgacccaagtcatcattttaaacctata

SEQ ID NO: 32577 - DNA, 1058 bp, Homo sapiens
ataaggggagggggtggttttgggatgaaattgtttcacttcagatcatcaggcattagattctcataaggagcactcaacctaggtcccttgaatgcacagttgacactagggttcatgctcctatgagaatctaacactgctgctgatctgacaggaggtggagctcaggcagtgatactcactcacctgctgctctcctgctgcgcagcccagggactggggacccctgttttagggtctttttaagtttaggataacagtcctttgtcaaatattatcttttgcaaatattttctcctggtctgaggcttgtctttttattccctttacagtatcttttgcggagcagaaatttttaattttagtcaagtccagtttgccagtttgttggacttcagacattctaataggcgtgtagtggtagttgttgttttaatttttatttctctaatgacaaatgctatggcacatcttttcatatgctcatttgtcatcttttggggcaaggtgtctattcaggtctttgctcatttttcagttggattgtttttttgttgagatttaagaattctttctatattttggatacaaattctttatcagacaggtgttcagcaaatattttctcttgctctggggcttgtcttttgattcttttaatagtgtctttgaggaagcacagatttttaaatttaataatgtacaacttaaccagttttccctttcatggattgtgctttggtattgtgtctgaaaacttgttactatagatatctcgattaccctgatttgatctttacatattacatgaatatgtcaaaatatcacatgtaccctgaaaatatgcacatctattgtatatcattttttttttttttttgagacggagtcttgctctgtcacccaggctggagtgcagtgtcatggtcatggctcgctgcagccttgatctgcagggctcaggtgatcctcccacctcagcttcccaagcagctgggactacaggcgtgcaccaccacacttggctagtttttgtgctttttgtagagatggga

SEQ ID NO: 32578 - DNA, 1050 bp, Homo sapiens
agtaaacttccctaccacccacagctagagtagagactcttcctcactcttctataataccttgcacctaactcggtattataccttcacaatgtattatgtgtgtggtctgacaccgcacccatgtccccaccagtaccactgaatatttttagagcaagagctatttcttattgatctctgtatcctggtaagtacagtaagtacatagtacctagcaggagtttggtgaatatttgatcatcatcttaccaaattctggtgggaatttccaaaacttatttcaaagttatttcagttccttaaaggaattagagataacaataaggagtaagctgtttctagcattaacctaaaggcaatgcttcatttttacttagatcacttaagtttatttgtggaatgatggtttatttttcggtagcattctgaaagttttcattacaacaacttagtcttcagaaacttattttaaagccttgagatacctttagtttacatattgttgatgaaaagtatagacctgagtcagactagggttactcactagctgtgtgattccaggaagtaactcaatttttgtgctcatttaattcttcatcagtaaaagggggataagaatacctacctcacagattgctgtgaaaattaaatggaaaaatgcatgaagaacactcagcacaatatctgaaacatggctgtattgaaaattgcccaataaaatggtagctcttattattacttaagcaacataatctcatagaataatattaaaagattattgttcctctaatgttcaatatttagatatatataaatgtaactctttcatattcttaattttcttaaattataatttctttgcaagtgagcacttcagggcccttcattcttagtatgagttggggttgcgtcttgctcacggttgtgacaatgcaacttggcaaatacggcctccagaaacaatcaactaaaatccatggaggggctcatttctgtgtagctgtaaatgagttcccacacctcaactttttcaaagtaggtggtttg

SEQ ID NO: 32579 - DNA, 1050 bp, Homo sapiens
aaatagtgaagttggtgggtgtaggatattggaagtgatagatagaagacataatagagagcctgtctagaggcgtccaaattttaaaaatttaacaaaaatgtattgatttccctgcattaagggcaatgtatatccagccctctctcttggggtaagtatagattaggattttggaattgcaagggacaaaaacccaattcaaactattttaagcaaaaaaggaattttctggcctctgtagttgatacagatacaggattaatttacaaagaaactagctcaggaatgagaaccaaggagctgacactgccagattctcttgctttctctcatttctgcttgtctgtttctctttgaatgttggtcttgggctctccacatggtgggaaacagggagggtgtttatttttcgcagcatctgtgtcacacagttcccagagaggattctggttggccctacttagactatgccagtgatgtgaggtgcttgattagccaatcttaggacacatgcccattcttctgtccaagggactatagactttgcttatggaaaagagggatggggatagctttgggcacacaaaatcaatagccgccatagttcgtatatttcattatggtgaaaaaccttcagattgcagggaagatctggttcattttgcttagcctccaggcaagaccatcataacatttatactttactggcaacttttaaaacctgaactatggaatgatacttaagaaaaaatcatttatctcgctgggcacggtggctcacgcctgtaatcccagcactctgggaggccgaggcgggtggatcacgaggtcaggagattgagaccgtcctggctaacacagtgaaaccccgtctctactaaaaatacaaaaattagccgggtgtggtggcacgggcgtgtggtcccagctactgggaggcaaggttgcagtgagctgagatcacgccactgtactccagcctgggcaacagaacgagactctgtctcaaaaaaaaaaaaaaaaaaaattctttatctcatgaaatga

SEQ ID NO: 32580 - DNA, 1027 bp, Homo sapiens
gggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagcggacttgctgtctctggaaaagaaaataaactgtgtacacctgtaatctgttcctcttcaacaaaggaagcagaagatgcacctgaaaaactttccagagcatctgatatgaaggacacacagctcctcaagaaaataaaggaagcaattggtaagatccctgctgccaccaaggagccagaggaacaaactgcatgtcatggcccatcaggttgtcttagcaacagccttcaagtgaaaggcaatactgtctgtgatggtagtgttttcacttctgacttgatgtctgactggagcatctcttcgttttcaacgttcacttctcgtgatgaacaagacttcagaaatggccttgcggcattagatgccaacatagctagactccagaagtctttaaggactggtcttctggagaaatgaattcagaagaaaactcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaa

SEQ ID NO: 32581 - DNA, 1038 bp, Homo sapiens
atttgtttctatttctttgtcaaacttattgttttgtttgttaattattttccaaatttcatttaattttttatctatattttcttgtagttccctgaacattttaaagagaagattattctcaattctttgtctctcatttctttagagtccattattggtgctttatttcttttagtggtgtcatttttctgattcttcataatccttgtatccttgcattggtgtctatgcacttgaagaagtggccacctcttccagttttgcaagtgttatgccctaccccacctctcacttgaggtgaaggggatagaccttcactatttagtctagcctgggattctggattggccatctggtagtgactataggcaggcagaccttgctgttgggttctctaactgggctgctacctgtgctttgaggtcagtggagctattgactgtactccatgatcttgtgaaaccaatggctgtgctccgtcaaccagtgaggccactgactgggttccaaggtcaggtggagctgccagctgggctctgcaatcacctttgattgggcagggttgcaggctgtattccctggctgagtgctactgctgtttagaatctaattgggcagggttgcgggctgggcttcagtgtttctgggtttgctgcccagccactcgtgacaggcagggctggagattcctccacagtatgcagtcacaggtttgcctccctgcctgggcctgggcaaaacctcaggctggacttcaaagctgaatggagtcactgcttaactgctaaggttgagcagggccagttaactgtgttctgcagatatgtaaggatgcagttttgcctcctggcctcaggaaactatatgtacagctgtgaagttaggtagggacactaaagtctggcagggccagatgccgacctccacagatttatgctaatgtgcacttgcctctgggtctggggaagccataagcagagtactgaggctgcatggggttaccgctcgccctctcagttcttatgggaccagatg

SEQ ID NO: 32582 - DNA, 1731 bp, Homo sapiens
catcttcatcaacacttgttagctttcatcttttttgtaatagccattctgacaggtgtgagatgatatctcattgtggttttaatttgcatttccctaatgttgagcattttttcttagacatattggccatttaaatggagaaatgtcctttgcccattttttaattatttgtttttttgctgttgagttgcatgagtcccttacatattttgaatattaaccccttatcacgtacggtttgcatatatttctcccacaccatggcttgtctcttcactctgttagattgttccccttgctgtgcaaaagccttttagtttgatacgatttcatttgtctatttttgtttgtgatatctgtgctttcaaggtcatatctaaaaaattattgcctggaccagtgtcatggagcttttccctcatgtttttttctggtagttttacagtttcaggtcttgtatttaaatctttaatccatttttagtatatttttgtatgcattgtgaaataagaatccaattccattcttctgtacgtggatctccagttttcccatcaccatttgttgaagagacttttccccattttgttttcttgtcacctttgtgaaaaatcaattggccataaatacatggatttatttatgtcctgttccattgatcagcatgtctgtttttatgccagttcatgccgttttgatttcaattcctttaatatattttgaaatcagggaatgtggtgcccccagctttgttctttttacttaagatatttttggcttttcaagggtttttttttttttaatgattctgtatgaattttaggatagtttattctatttctgtgaaaaatgacactggaattttgataggaattctgttgaatttgtaggtcattttgggtagcatgaatattccaacaatattatttcttccaatcatgagcacagggtagccttccatttatttgtgttttcttcagtttattttatcagtgtttcatagtttttagtatatactaataatatatgtatatatttagtaaatactaataatatatgtgtattgttcacctccttggttaaattttcactgaagtattttactttgttttttgttgcttgtttttcttaatttcttttgggtagtttgttgtgagtgtatagaaatgttactgattttttatgttgattttgtatcctgcaactttactgagtttataagcaaaacagttttttggtgtttaggattttctgtgtataaaatcgtgtcagcaaacagacaatttcatttcttcctttcttattatcttctattttttttctcttgcataattactctgggtaagagttccagtaatatgttgaaaagaagtggtgagagtgggccttcttaccttactcttgatcttagaggaaaaactttcaacttttcatcactgagtatgatgttaactatgggtttgtcatatatatggcctttgttgtgttaaggtacattccttctatacggaatcttttgagagttttttcatgaaagagtgttgaaatgtatcaagtgcattttctgcatcttttgcgatgatcatatagttttaaattcttcattctgttaatgtggtatatcacattcatcggttttatacgttgaaccatccttgcatctcaaatgtaaatcccctttaattgtgttgaataattcttttaatttattgttgaatttggtttgct

SEQ ID NO: 32583 - DNA, 1053 bp, Homo sapiens
agcataattcttccagatgggagctactagaggaagaatagatttgttttatttcatactgttaatgttttttgagttaggcaaggtaataggagagcctgtgagttaagatttagacctgctgagttagactgtctggagtacaggaacaagatgaaagatggaaatgtagactcgggaattattctctgaacatgtttttattgagctttttgtatagatctggcactgttgtagacactggagacaatctgattgaaagtaagtgatctgttaccagcatataagtaagtggtatattcaccaagaaggtagagtgtgtgaatgcagtgaaaggtgaattgctggggagtaacaactttttaaggaaagaacagaagattaaaattaggagagtgacatcacaaaagtcacaggaagaaaacaatttataggagagattttgcatagcattaaaataaacagacaacaagaacaaaggtaggtccagaataaatatcacaagacaaattactcaaagaacttcagaaaaacttaaaacagtattccatagtctcaaggaaattaaagatagtaggatctcttacagggagaaagactgagattgagacaaagtgctcaaagaagaaaaagaaaaagagaagaaaagtgagttaagtgaactcagaaaaataaagcaaaaaaattacaaaaatgaaagaaacaaatgtaaaatcattaataaacagacaaactcagggatattgtagtccactagaacttaagtattgtgaagcctgaagttttttgttttgttgttttttgggcttttaggtttttttccctaagtctttctgttttaattgctactaaattcatagttcagtgtctcctactacccttagcttcttcctcttcctaaaccctttaaaaaatttttatttttattatggtaaaatatatataatatttacctttttatttttaaccatttgtaagtgtacatttcagtggcaataaataaattcacaatgttctgtagccattaccactatctgtgccaaaactttttca

SEQ ID NO: 32584 - DNA, 1026 bp, Homo sapiens
acaatgaagtacagccctgcttagagaaacttgtggtttagtcagaaaggcaggaggatgaaagataagcaatataaggcagtgtgtcagtggcatatgatttctatagacaatatgtgctctagggtggtgaagagtagtcactagactggaatgattggattggaaaaggcttcatggaagaagaaaactcagatgagccttggtgagtgggtagaattggattggtaggaatggttcatgaacaatgttattggaaggtgagaaaagcttgttgggtaactaaattggcctgcctgaaatgaaaaattggagttgggagtgatggggcgatagttggaaaagtagcttgtggtcaagctttggaaactttaaatgccaggccaagattttgtttgtttggttggttttgttttgttttgtttttgaggacccaaagcatcagaattgtacaaactattctctttcctattgcattttcccttgagaacatgaactgacaaggaacaaggtgaaggagtttgactggactttagggataatataactcccttaaaagaagtgttaaaatgaaggagagattttacaaatggcaagtagcataaaaaatgggaattgtaaagaattagtatagatgatttttgactggggaaacttaaacactaattactttcagaaagaatttgagatgattttctttagtaggggtgatagtggtaaagcccttctatgaagtatgtgatggattggactacttctgagagccctttcttctcttaaaatcttacggtaaaagtttttgaagaatcatatttcaagaacttttttcttcttccacattagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaa

SEQ ID NO: 32585 - DNA, 1068 bp, Homo sapiens
acctgcactggatgtttgttctatattcgagtggcaggaataacttcctgtcagacagtgcttgcacagcagctagacttcagggactgaaaaagttttgtggactgagtaaatgaatactttcctttcatgaattctagttatcacctgacatcacttaaacattgccagaccaatagctaaaattttcatgtagagtgcgttggtgtaattaacaagagcaagaaaatatacttcatttgtatttgtgtagtaacaggctcatttgatcattggtttgttttattttaaaactgtgtagtagtcatataactgcagtccttcccttatggtttctaacttgtcttggattgtttgctttaagacttcatatcgttaagtaaagttactcaacattatccgtagagatttgtgtggactgagtttataaaggagcagaatatgtcattttagttctaaggctttgattttgaagaaataggtttggaatttattaatttatgttagttgatgacatctgctggctgaggcataatgtagctcagctttattagaaactgtgaaaaccacgccttgaaaagaaagtaaatgagagcctgatgctgtgacctgtgtgtgaaatctgagaattcttcaaactagccaattcttaaggaccagaggaaatccaagagcagaaggaaagacccaggaatcaagaggaaaggacttgtggtatgctagatggccatgggctatgatctcaccctctatcattttagatttcaaagttaaaatattttagagggcacttttccatttgatttattataaaattgtatttctggtaagaaatagtatttgctttacaaaagtttattaaccagttttgtttgagctgatcagatagtgaaggtaactcttattacttttgattttaatcatctcagaggggacatgttcagaggtttattactgacatcagatagtatgatttatgaatatgatatatttacttgtctattgtaagagtgcagctatttggtgatatttaacattgagtttttactgtgtggtagacattgcttt

SEQ ID NO: 32586 - DNA, 1022 bp, Homo sapiens
cagatggttatgtgctcatgtgtaaaggtgagcaggtgctgatgtgccacatgtatccttttaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagaggtactggttccactgacagccccaccttacttctcacccaggccaggcctgtggtccagccaggcagccctcagggccggctagcctccactcctcacctcctgcatctcccacccagcaagcctcgctggggagccgcattcttaccaaccgtaactgaaactgtggctttcaaatgctggttccataagggttttgtaagaaaacaaaaacagaacaagaaatacaaaactgctactctgttcctaaacacgtttagaaatcacgaaatcacagagttaaatgaaattaaattggtgttggtaccaaaaatagcaccttctcagagccttgagtgtactattgtgtgctttcacaggagaatacagtgtgcatcttttttcaaatgaattaaatcccccacactgatatctcccaaacagtgtttcacagaacccttatgggaaatgctgacaaacatcatcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctcagctgctccggaggctgaggcaggagaatggcttgaacctgggaggcggagattgcaagatcgcaccactgcaccccagcctgg

SEQ ID NO: 32587 - DNA, 2148 bp, Homo sapiens
aggcattatcctcatcaacacaggaggaaacggatcatcagagaagtttagggacctgcccaaggtgacccagggatctgaactgagctccagcccacaccctcagcttgtcacacagctggtcaccctgtttccctgaactcctctgctgttggaacttaaggcttcagcatctccccatggccacaccctcgccctcagcccagcctctccttcctcccactccatctctactgtgatctcttcagagtttgccattcccttgattccttcatttccccatcctgcacgactttcttctgaatggttctctttaatctgaagaatgctcaaatgtatcccatctgcaaaatcccccatcctccttgtcccccatctccgcctgtccccacacaactaggttacctgtgggagtcccctacgctcactgtcaccacctccttacaccctgcaggctggattctgtcctcactgctttgtggtgcagcctggtagctgctttaggatttgcctgccttgacctccacagagcgtcgatgctggggcttcctctcacgtcttcctgggctgacagggccactggctccccttctgcctcccagcctgccccttcctctgaatagccaggattcaattttataagaggaggcaagaggctgtgtcttggcccatagcccacacaagcacttttgctgatggaaagctgttgaattctatacagctgaaaatctgtataaatagacacatttacaacttcctgtccatttggctatcaatcattgtaacaaaggtactaataataacaacttgcatgtgtagcagttcacagcttgcacagggatttcacatgtccttcagtatccctatctatgtgtaatgaaaatattttttccgcaggcactattaaattcaactcactttgccaaggtagcattagatgttagctttgttttgatgaagagtcctgacttaggtcctctgagcactgtccgccaggatgttgttcccaatccccatgatggtgattgataggttattgatccttgggacagggccaaatgacgctggtccttttgatgacatgtgttcctcctagggcagtaggagggtctggggctgaccagaagatgcaggcaatctctgagcacgcaggctgagggaaaggcaggttgaggctcaactgcaggagctgagacatttggattgggataaaatgtgaccaggcctatgtagcttttgactgtctgtgtgggtcacgctttctgaaggagtcttggaagtcttggtttcaaccaaggtggcccagtagttgtgacttgtgtgccagctcccaccacttggtagaacctacttggaggactgcattgaggattctgagggcaagcccaggccccttggagaagactcctatgaggagacagcgatgcctgccacaagtgtggagaaggagatgtgcagcgtctgctgtcactgctttaggctgtctctgaaaggcagggaactacccaaggtaaactcaactgggactattatcagagtcacaaaggacaagcattctggtggcttcagtgatttcatcaagtgtgaagcctggggcttattttctggtttggctggctagggctttgctttgaagtcatcaaatattggaggccaaaaagccatgcagatgaaggttttctgatgtcccacagcccctccgtggctcccactggctcacccccagaaacgggctgggctccacacaccactgctttcctggcagcttctggctgggctcaagggtggtaggaagcttttaggaatggccagcagctctggccttgggtcttgtccctctccaaggaacggtggtgacctctggtgagccaccagctctcaccctctcctacccttgactcctgactcctcttcttataccctaggtcaggggcacactcaaccgccctgaccttgggctaggctgtggaactctcgggcctgcaaggtatcagacatacttaaagcagctaggcttccctgccccccagccatcccaggggaaatgaagagcagcaggcaccttgcctggctcccctctgcagcgaacaggccttttcacaaggaaggcccgttcccttaacacacatgcctcaccccaagcccagg

SEQ ID NO: 32588 - DNA, 1152 bp, Homo sapiens
actgcaacctcctccacctcctgggttcaagcaatttttctgcctcagccttctgagtagctgggattacaagcgtgtgccaccacacccagctaatttttgtatttttagtggagacagggtttcaccatgttggtcaggctggtctcaaattcctgacctcaggtgattctcccgcctcggcctcccaaagtgctgggattacagccgtgagccaccgtgcccagcccacaaccacatccttaaaacagttgtctacacttgctgccttccttcactgactccctctcagtccttaactcagtctaatttggattcagtcctgtgactccactaaaatagtcttcccatgtccccagtgaccttgtcttgataaatctatgggctctcagccctcatcgtacttgacttctcggctgtagtggactccgttggccatgccctccttgaaatgctctcttcccatagtggtaaggagtatgggcttctggtcaaacagatatgggtgaaattccagccctgccacctacctgctgtgtggttttggatcagttacttggcttctctgtgcctcatttctatatctgtaaaaattagagtaataattgtaccacaacatagggttattattgggaggactaatgaatgagataatccatgtaaaatgcttagaaccatgcctcgcctattgtaagaattccataaagttttactattattaagagattttaatggcttgttatctcagtggaattacaacttcccagaaggcagtaaacattgaagtacaacatacatttctctattgcacattgactaagaatatcccatgtcctataagatagacaaggcactattcctctcctactggtgaggaacctggaccgctgcccacagccagcaggtaggtgggtgaggttgcacggcagcactgctcagagaggacttccccagcaagtctgaggagttgcacagtggagggacagggataggacctaggagagcaggggagacgttccaccaaagctgagttctaggggtggttttaagcaagggagagctgtgctttctttgtgaaagaaacagcccttagttggcaagttctccaatgcataactcccccaggcatggtaatgctgtttacaagcgcag

SEQ ID NO: 32589 - DNA, 1029 bp, Homo sapiens
aaacagagaggcacactctactagagaaggaaaatataaaatgaaatgaagatacacacaaagaaaagtaaggcatctcatcaggctacgtcactaatctctgtattccagagctttatgcctgagcctgcagactataggagaccagtgggctagtctggcgcagaaattcccaaagaaaccaataaatgtcctgagtgaatacagcagtctgcatatggatctgttccatttaaagaaactgttcctgggtcaccctggactgccgcatttagtctggggcaggaattcccaaagaaaccaataagtgtcctgagtgaatagagcagtctgggtatggatctgttccgtctaaagaaactgttcctgggtcaccctggaccatcttcaaaaactccccacatgaacgtgctccttctcacaatcacagatgagccaagtttgaattacagatctcctcggtgtgctcatgtaagctaaatgtaaactcgtctctgagattcttttacgtgatgaagcaatgagaacttaatctggaatccctctccaccctccacccccagaacagctggccatagttccctctccttcttgctcttgaatgtccacaaaagaacctttgtctgattgtgtttttctattgctcctgcctgagattatcactgataaaatgccacttatattttcttgagttctttatcctcctttagttcaaatcaatgttagaagatgaaacaagggaaaaggattgtttttctttttttgtttagtggaagatagcaggataaagcctattcagggcgtggtggtgtgtgcctacaatcccagctaccggggaggctgaggcaggagaatctcttgaacccagggggcagaggttgccgtgaaccaagattgcacaattgcactccagcctgggggacagagtgagattctgtcgcaaaaaaaaaaaaaaaaaaaaaaaaaaaaagcctatgcacttacaaataacgttttatgtttttagagggctcaattgcacagactgta

SEQ ID NO: 32590 - DNA, 1053 bp, Homo sapiens
ttctccaaaaggctaatccctttgttcactgtaggtctcctggctgtcagtcctcactggcttcttttcaaacttcttttcctcctcatgttggcgggctcttttgtgatttatttattttttatttccatgccgcctctggagcaagtgagaaaatatcatagctcttttggctgttttatccaccattatgatgataagtaagagaggatgataccctctactcttcatctgtcgtaagagagcaatagcttttaacctgtaaggtctgtgaatccagtctcctatttcagtagcaagtgtgcaggtatagaagactctcagcagtgtttaaatccttcatttattcatgctgctaccgacgcatttggggatgcccgttcaccattactatgaaggcgaccatatcccagtgtttcttgctctgtatcaaggtctagctgctcctaaaaatgatgactgggagtgtttttgtgtagagttggcaccacagtggcagagtatgaaaaatgtagagtccttcctttccaatacagactgtattcagctgtgcctccatctgaattctggataaatttcagatagtggagcagaaagggagaaaagggatctgattgactttaactaccaatgtggctcaaataacaattggaatggtttatatctaccagaatagacggcaggttttacaaaccctcaaaagacagacccatctattggtcatttgagtgctctgttctgattgactcaggtctaatggggggacttaacaatcttaaccatcatcttagactagctagcccagccaaccaggggatgttgttgggggaaaggttaaaagttgttctggggaaggaagaatagctgaggccaaaaggggaagcatccaggaggagcagctctcaggggtcatcagtgaaaggagcagagaagagtatgatgagctggagggagggggtttcaggtgcattggccaaagtgggcaaagacttggacatttgtctgtgtgcatctgggcttccccagtccaggctgcgtctcttcggagcctct

SEQ ID NO: 32591 - DNA, 1028 bp, Homo sapiens
atatctggtgtaaactgctcacagaaaaccctatgaaaccaaagggggaccattcaggtctaaaaagcgacaggtccgagactgggtctgtcacctgggcattttcaaagaggacattttgaagaatttgcatattcagatttttaaaatgcacttaacatacttcattacagatttcttgggtagggaggatgggataggccagggatgggatggagtcagttctgcctgggaaactaatccgaatcatttacctttctgtattaaccttggcctgtcctaaaaagagaacgactgtttcatcatgagttgctctgagttttgttaatgtttgtgttggtggattgacggttaaatgaagcatttagctggaatatgaactttgggagttttcatgttgtcctggatttctctttgtaaacctttaaaccttagcccctggttgattgtgttaaacccattatgagaatgttatttaaagttgtattataattgcaacctccactaattattcagtactgtagcagcaaagtattatttgtaagaatttggttatttttatacttatatccactctaagtctggcgttctagtcagtaaaatgatgcaataaaattaatatcattttcattgtgtgttttcctcttaataacaagaaaaccagaccagaatgcaacaagttaccagttgtacagtgagcttccacatggcaaatgtggaagctgagtcatttctgtattctcagtgcccagcactggggaggtacacttttgatgatggatggatggacaaacagacctaaatggcaggaagccaaacttagatacagcacctgcttttgtttatgtgaattggagaccataagtgaccaattcagatacttacaattccctcctcaatgtctcccactatcccttccatgccaactcttcatgtgttggaggagaggggaaagtaagcctatgtgtgctctggtggggagaatctgcagaactttaagatggtgggccatggatcttacactcatg

SEQ ID NO: 32592 - DNA, 1044 bp, Homo sapiens
cttgagtattttggagatttggcttatgtaaaacagtctggatggcagtacatgtcctttctaaagatcagtatttaggcaagccagtttctcagctgggctcagggtctttatgcttttgtgtttaggaggatatctatgccttaaaggggctgcctggtctacagagtggtgtgtgttcactttttcgtgtgaatctcatttctcacttgaaaccagaacagagtcacagagagctcgtaaactgatcagagaatggagtagcctgtgcacaaaaatagataagaaaatctataacgtttcaatgtggaaaaaggaggctgaataatcagacagaaatttaagatatttgagtcttgtttcccaaatgctggaatactagaactacatggtatatatatatatatatatatatgtgtgtgtgtgtgtgtgtgtgtgtgtgtacacatatatagtctttcagaagagatgcttcaaggctaagagtagaggttacatcacaagcctgcggacctgatcctaagatattgttagaaacagagaggcttggccgggcgctgtggctcacgcctgtaatctcagcactttgggaggccgaggcgggcggatcacgaggtcaggagattgagaccgtcctggctaacacggtgaaaccctgtctctactaaaaatacaaaaaattagctgggcatggtggcgagcgcctgtagttccagctactcaggaggctgaggcagaatggcgtgaacctgggggggcggagcttgcagtgagccgggatagcgccattgcactctggcccgggcgacacagcgagactccgtctcaaaaaaaaaaaaaaaaagaaaaaaagaaacagagaggcttagcagcaggaggctcaaagtgcagcagacctgtatcacgtgtgcaagaaactcatctgaatgcaatcccacctgatggcagagaaagagagagccagtgagacaggtgagaggtgtggaggtgtggccaccctgttcacgtgtgcccctcgggtgagccagggagcaggaggtaaga

SEQ ID NO: 32593 - DNA, 2097 bp, Homo sapiens
ccattggattgccttatttcacttaatcacctccaataaaatactttttatagctgggagattgagagccacaaagaggttaagaaaagttttttgataaggttaagatttgaggctaggcatggcgaatcatgcctgtaatcccagcactttgggaggcagaggcgggcagatcactttgaactcaggagttcgagacaagcctgagcaacagggtgaaaccccatctctactaaaaatataaaaatttgctgggcatggtggcacatgcctgtaatcccagctacttgggaggctgaggctggagaatcacttgaacccaggaggtggaggttgcagtgagccaagatggcaccactgcactccagcctgggtgacagagcgagactctatctcagaaaaaaaaaaaaaaagagttgtgccggcaacagtatttaagtgaggatcattccaaagcagtttgcagccttctggtactagaataatcttgtggactttagggtggctggcgtttaattaactgggagtttgggagaggtaaatagacacactcatgcattttccttttgtctttcagcatgtgaagatggatataggcttgaaaatgaaacctgcatgaggtaggctccatgttgatttagtctaattttgttacaaatcttatttagataaattgcctcacttatttcttttgagattggaaactaattcttgcccttttttctttcttggcttgcagttgcccatttggccttggtggtctcaactgtggaaaccgtaagtgtacaaaagtggaccattatgcgtgggcaggggcctggccctgttgttagtgcacaggtgtcagtctcctcccacttccctcagttcacacctgctgtcttcttaggttctatgccaatggcatgggggaaacaaagagaaaggccagacgtggtggctcacgcctgtaatcccagcactttggaagatggaggcaggaggatcacttgaggccaggagttagagaccattctggccaacatggtgaaagcccgtctctagtaaaaatacaaaaattagctgggtgtgatggcacatgcctgtaatcctagctacttgggaagctgaggtgagagaatcgcttgaacctgggaggcggaggttgcagtgagccaagatcacgccactgcacttcagcctgggttacagagcgacacttcgttttaaaaaaaaaaaaaaacccaaaaaacaacaacaaaaaaaacaaagagaaagacttgactggtactgttcaggggctcaaggtctgggctgggcagggagagaaacactcactcctaaatacccctgctgtgtgctgagtgttactgtgataaccagacatggggtgtgggacggggaggcagggactgtgcccacagaagaatgagaggacactcgacagtacttcttggagggagtggaattagaggaacagtaggaaagatttagactggcgggtatggggggaggacatcccaggcagagggagcaacttagacaaaggtcttcaggcagccatgggcccttggtgttctggggacagtgtgtaagtggatgtggctggaagataggaagatcggaaggcagaaagtagaggatttggattggcaaagtatatgaggtctgaactgttggggttgggatcaccaggctgaggagtgtagactctaatcaataactgtcaggcagctggcaaaagtcttagagcaggaaagcagtttgatcaaggaaagcaatttgggctgcattgagaacagactggacagaggagaatgtgggtgcagcttagatatttccagcatagtcccaccaggcatgctagagacacacttaggagtcctctctgctccaggtggaagtagagggtggaacgccaagcagccaagagtgttggtggggactgtgagcggggcgtgttttgcacctaatccagttcttggagaaaaccagttgtgattcatttaagattgcttgcactgacattttcttatattcatacattagaaattgaaattatctgcaaaattaaatttggggatatagcatatcataggatgtaatagaaatactaac

SEQ ID NO: 32594 - DNA, 1050 bp, Homo sapiens
aaaggatgagaggggcaaagaaaatggaggcagcaaggaaggtgcccctagaaacaaggtagaccccctttcctccctgcagaaagcctttttgttcacttatttaaccaactgggaatcttctgacctttgaccctaggacttttcctcaaggccttggaaaaaaaaaaacctatagaattccttttaaagcaaagagcttgaggtcactccaaggtccttcatctttcactcctgctgggataggctgtatccctccttcatgcccgaggccacctcagagccagttctatttctggaaggctgaccctgacttgggagctccaggccaggcctcccctgggtctgggttcagtccagcagacgtctgtcacccggagagaatgctcagctgaacaagagccgacccctcacagggaggggaggtagattttactttcttcatcgctagagcgcttgcaggggaagcgttttaaaaatctgatcgtcaaatctcatgtctagcactttccaacatgcttgatttttcttagggctgcttctttcagagcaagaacaaggaaggaaacgaaactccctgagagccctggacagtccagatcgagggctgagtcttttgttcacacaaactcatttggcttctaaacgtcctccacccaaaatcattacatccgcagcagcatttcaaaacacagcccagagtggcctcgctgagtgggcggctgcttttctggggaggctgcagccaccttcccacaggcccccaaggttcttgcatgtcccagaatatcccgctgctggccaccggcctgaaatccccctcatccggaggacccttggtggaaggtatgaggcaaagagggcctgcaggggaagggcccctgctgtctgaaggggactgggactggcagccgtggaagggaggatgagtttctaatcctaaccttgccccttccaaactcccaggcacagtctcagtgtctacccctggggggcccgttctcacaccccagaagcatcatagggacttattaacatggtccagctctc

SEQ ID NO: 32595 - DNA, 1052 bp, Homo sapiens
gaaacaacacataagaaaaccagtgttcagtgatttcagtgagtctgagttttctgataaccaggattgggagccttttggatgggtcctcctgtatcactagatgctatcactcatttcacaaggcagcaaggtctcaatgctgagagggcctccacaggtcctccagtctgcaatgtgtcccatgcaaatgtctgcccctccagcacccctgacagatggtcatcccggctctccctcagcatttttgtgtttggggaggcaccatgctactgtcactaacaagccctgagtcttacaagtaacgtgctccatttggttgttggagaagcttcctgcaggcctttcgtgccatggggatgctggtagtcagggcctggcccctgggacttccaaatacactgatgtcagcagcaagggccacagatgtccttttcttccctgtgggccatttccagctcttctcttcctggcagagttcaacttctcactgctgagtaaccgcgtttgcattccattatgtggattgtttgcctgtattagactgtaagtccctggagagcagctccctgtttatatagccattgttaagcttttgcacccacccgtcaccctgctggctgttcagctgatgtttattgctggtgtttcagccagtggtgacaagatgctgagacctagaggttttctttttctgcgtgtgtttttctaccactcaggacttccgagccacagttctaagctgaatgcaaagtttatatgccttaattttgtgatccatatgctatgctttaattgtgagatctgcagatgagagggagagaaggcttaaatcataatgaaaatcaatgcagaaggaaagaactttcccacccaaaggggaaatgacgctgagtagctgagcagccagcccgagaaacaataatcttagaaaaatgcagctccctggaggaaaggaagcgctttgagctgagccccgtctgagctgttaaatagctgtcgcctgaattgctctaactttgtgggccaacttcgtcatttagcttggctgc

SEQ ID NO: 32596 - DNA, 1025 bp, Homo sapiens
ctctgtgctcaaattagagcacctaaaccatgtttctgaaatacagtgtatatgaaattaaagtgtaagttgcagctagtataaaaaaagcaaatcattttattgtggcagaataatagtgacatcgtatgggtgggcaaaaagccacaggaccctgattaggaaaatgattttagtcatgaaaaaagtatgctttctgagagaatggtccttcatcttttataccctagttaatttttttaaagggaagaaagccgatgtgcatttttacagttctatatgaagagtaagctgatgatgggtttcttttaaggggactcaacatagagttatcagatttggtaagtccattatgggcttaatgtagccttcactgctgagctcttattatagggcacttgttttcaggaggtagctggaaattggggggcttatatcaagttcagaaatagacatgactaatttaaaatgttagaagtcaggatactttttagtaaacattgtttttaaaaatctgttgtacgttttgggattctaactcatttgtgtttggtaagaattcactggtgcctacatatccagccattttactaattttacatacgtcatatttagatggtgtttacagtaactgctgttgctttaatttaggtcttgtactgcataggtgccatcattggaacatcaattatttagtgttaatatgcttagatgctagtaccagttgtgtaccgagtgtataactggctgatagaaaagtgagatgtggaagtgtcataaatatatggtgttcagcttattttggaattaggacaatggtttttttgttttgttttgtatttttcatgtatacttcctagatcaactctcagatctttaatttgtgcatagggcttcctgaggatgttgctcttactagaggtaattgatcagttttcattgatggctccctcataaagtggaagtttaaaacctaatctgtggaagccacgaaacagtttccctcagccagtcatggtggctca

SEQ ID NO: 32597 - DNA, 1029 bp, Homo sapiens
tacaacatgatatatgtatacattgtgaagtgattgccacagtcaaactaatgaacataaccatcacttcacataactatcttttgtgtgtgtggtgagaacgcttaagatttactctcaacaattccatgtttacaaattattaactataggtcccatgctatatatctccagaactaactcatcttacaactgaaagtttgtaacctttgaccaaaatcctcccattcccccttaccatagctcctggtgactattattctactctgtttttttaattctgcctctttagattccacctataaatgagatcatgcatgtttgtctctctgtgtctggcttatttcaactaatataatgtcctccagattcatccacattgtcacaaatgacaggctttccttttttaagctgaataatatttcattatgtacacacacaccccccacattttctttatccattcatccattgacagacgcttgggttgtttctatatcttggctattgtgaataatgctacagtgaatgttcagatatctctttaagataatgatttcagttcctttggatatatagccagaaatgaaattactggatcatatggtagttctatttttagtttttttttgtttttttaggaacctccatactgttttccataatggctctgtcagtttacaatctcggcagcagtgtgcagtggtttcttttcttcacagcttcaccaacacttgttatcatttgactttttgataatagccatcctaacaggtttgagatgacatctcatgcttttgacttgcatttccctgatgatttgtgatgttgagtacatttttatatgcctgttggaaaaatgtgtggtcttctttggaaaaatgtatattcaggtcctttgcccattttaaaagtaggctatttgtaggtttttgctattgagttgtatgagttccttttgcattttggatattagcttttcttgatgaatatatggcttgcaaatgttttttcccattccataggtta

SEQ ID NO: 32598 - DNA, 1837 bp, Homo sapiens
catgctgttttggttactgtagcctgtagtatagtttgaagtcctggttttgttcttttttggctaggattgctttggcttttggggctgttttttttttttttggttctatataaattttagaatagttttttctatgtctgtgaaaaatgatattagtagttcgataggaatggtggtgaatctgtagattgctttgggaagtatggacaattttaatgttattgattcttctagttcattaacatggaactttttttcgtttgtttatgtcatctgtgatttccttcagcagtgttttttagttcttcttatagagatctttcaccttcttggttagatgtattcctagggtatgggtatgtgtgtgtgcatctagtgtaaatgggattatgttcttgatttgcctctcagttgaatgttattggtgtatagaaatgctgttgattttgtatcctgaaactttactgaaattgtttatcatgtctaggagccttttggcagagtctttagggctttctagatactgaatcatatggtcagcaaagagagataatttgagtgtctcttttcctatttggatgtcttttatttctttcccttgcctgattactctggctaggacttccagtactatgttgaagaggagtgatgagaataggcgtccttgtcttgttccagttcttagggggaatgtgtccagcttttgcctgttcagcatagtgttgattgtggtttgtcatagatggctcttattattgtgaggtatgttcctttgatgcctagttttttgagggtttttataatgaagggatgctggattttatcaaaagctgtttctgtgtctattgagatgatcatatgattatgtgatttttgtttttaattctgtttatttggtgaatcacattcattgatttgcatatggggaaccagcattgcatcccgggaataaagcatacttgatcaaactgaattaactttttggtgtgctcctagattcagtttgctagtattttgttcaggatttttgcatctatttccatcagggatgttggcctttagttttgtttttttttttccccgttgtgtctttgccagattttggtatcaggatgatactggtttcgtagaatgagttagggaggaatcccttctccttgattttttggaatggtttcagtaggattggtaccagctgtcttttgtacatttggtagaattcagctgtgaatccatctggtccagggctttttttttttttttctttcctggttggtgtgttttttattagtgatttaattttggaactcgttattgatctgttcaaggtttgaattttttcctgattcaatcttgggaggtgtgtgtttataagaatttaactatattctctagattttctagtttgtgtgtataggggtgttcataataatctcattggagcttttgtatttctgtgggattagttataatgtcacttttgttgtttctgattgtgcttatttgaatctttttctttgttaatctagctagtggtctgtcaatcttgtttatcctttcaaagaaccaactttttgttttgattctttgtatggtttttgggtctcagtttcatttctactctgttttcttttattccgttagccttgggattagtttgttcttgtttttctagttcctttaggtgtgatgttacatgattaatttgaaatctttctgtcctcttgatgtgggagtttagtgctataaactttcctcttaacactgcttttgctgcattctatagattttggtaggttgtgtctctgttttcgtttgtttcaaagaatatttt

SEQ ID NO: 32599 - DNA, 1069 bp, Homo sapiens
actgccatgttaaaaaaatactgttttgtgaggaaagttggaaatttggaaaataagttactgttaattataactaatatgaagaaaattgtataatatttaatatttttatgctaaaatatttactcataattacaaatgtattaatcaaatttaggtatttaaatttttttaaaacaaatggaacaacatagttaagctttaaggaatgtaatattactttagctttggtcagtttgagaagtaggcaaaacttaaatactttttttgttttcagagatgaagtctccctctgttgcctaggctggagtgcagtggcatgatcatagctcactgcagcctccacctcctgggctcaagcaatcctcctgccttagcttccttgagtttctgggactacaggtgtgcaccagcatgcctggctaaagttatttttcacagtagtttcttatttttcttatttgtccatagtatggtttggtttgcctttttaaaatattttcaaaaactgtagaaaatgtactctgaaacaagataagtttctctactctttgacttgttaacctgccttcctttaatgtagggccccctgaaaaattattttacattctacagaagatgaaacattcattcagttgggtctagatataatgctttgttttacaaattatttcacaccatattcttttggaaaaatactcaattacttctttaaactcaaactcctgaagacctcaggatttttgaatattggaagcacaccaccatgcctgggtaatcttttttaattttttgtatttttttttttttagagatggagtctccctatgtatcccaggctggtctggaactcctgggctcaagtgatcctccgattttggcctcccagagtgctgggattataggcctgagccactgtgcctagcttcagtgtgcatttttaattattccagaaaatatactcagtttactcttaattacctaggagtgaattgacgaggtcataggttaattattaaactttttttaattaaaatttttactttagattcagggggtacatatgcaa

SEQ ID NO: 32600 - DNA, 1063 bp, Homo sapiens
tggtccctgaaattctggtttaagctttattcctttagactatggcactgaaaactgccacattgtaaatatcctcaggactgctatttttggcagttatgggagatttaccttttttgtgaatattatattttttgtgaatattacagatcctttatttaggtgatgttttggatgtgagagagaagatgaggatttgaggctaaggtcgaagataattataattgatcattttgtttagggccaggattactgatcaagcgcatatcaaggttaaacatttatcatcattggcagatttccttgtggatcaagtacttttgtctgacgtgccctttccttgtctaaggtgcctattttaaaaatgcatatatagaataaatgttagaatggcatatatccatagttgtgttattttcttctcaccccgtgagcattttactctaagaaactgccagtcttatcaccaagagggattgaggagtaaaaaacttaagtacaatttttaattttatttttgtaaattcctctaaatagtaagccacagaatacctatcctgatgttctgttatacaaattatggtagctttttagttatgccagttttcataatttattttttatttcaattagtaaaaatgttacgaagctatttctatagggaagtttttataaatgattctcctcccggccgggtgcggtggctcacgctgtaatcccagcactttgggaggccacggcaggcggatcacgaggtcaggagtttgagaacatagtgaaacccaatctctactaaaaatacaaaaattagccaggcgtggtggcacatgcctttagtcctagctactcgggaggctgaggcaggagaatcgcctgaacctgggaggcggaggttgtggtgagcagagcatgccattgcactccagcctgggcagcagagcaagactccgtctcaaaaaaaaaaaaaagattctcttcccaaaaaaaagagatttttgaaaaaactaaatcactcagaattatatatgttcactaggtttctttttccataaggttctttttt

SEQ ID NO: 32601 - DNA, 1036 bp, Homo sapiens
aatttgaatttctttagtttctggtcacactaaacttctaaaatttttgttggcattttatatttcatgttttgtgaaattctcccttcttcttttcttccctctccctccacttctttttttggggctttaatgtttttctcagtaatttatatcatttttgggggttctttacattaatgaacaaatcaagttcttcagatatagaataatactaggttttatgtaaaaaattatttctaaaatcatttgtgatagtgattggttgttacttcggattcattgctgatctatggggtatctatttcaagtgtactctcttcttgaaattctgactaaaacccagattatcttcttattgggtgttggactctgtatttggtgatatgttctaggtatttgtaaatatagattaggtatttacaggctttaagctattttgcttgtctaatttgcgataaactcatttataatgtatcattttagaatatttctaaaggtattatttaagtatttatatacctctgtagttgccagatgacggagttgtcctattctaagtatagtgcgtataagagaatgttttagggtagccctttagagaattcttaggaagatgaagtgactagaaacaatatacagcagacagaggtgtaagaataacaaacaggccaggtacagtggctcacacttgtaatcctagcactttgggaggctgagacggaagaattgcttgaccccaggagttcaagaccatcctgggcaacattgtggaaccctgtctctggttttgtttttttttttttttaaataaagaacaaacaattatttttcaattgtcctggcatgttacatgtaatgggacagggaatggttttggactgttttttaaccactggtctgccatctccaggtgaatgggttttttgtgtctggagtcttagaactttaagatataaccagtgagtaattttacattttctcaggagtgtatataaaaatttatgcttcagaacttctgttaaaataattcatt

SEQ ID NO: 32602 - DNA, 1035 bp, Homo sapiens
gagcccaggaaagtactggctgagatcttgagtcatatgacaaaactgttgagcatgaagataattagattttcattgttaatttgtctttcttttgacaaattatcttttagaatttgtgtggtttacttgatattttataaatacagagcccatctagaagtctaaatacctcttttattccctagtattgtgttgaattttggaccttaaccttttttgtgcgcttttaacttcagtatcagtttccttaaatgtgggaatgaaattgatgttacgatttcctgacttctgcttggtcttatgatcatcttttcccaggacgtctttgatcttttttctcaggtagattaaaaaaaaaatctgtttatccctcaatttatgtactctcaattcttattacccactgcctattaatgaattctatagcactgtatatagttaggacacacacacatagatcatcattctggaagcacctgtatgtgggtttagcaaaggattaaacataaaatggccttttgtcacaatgaactttttatttatgtctaaaattggcttttctttttttaaacagataagcgtaaagcaggaaattacttttactgatgtatctgagcaactgatgagagacaaaaaacaaatcagagagccagtagacttacagaaaaagaagaagcggaaacaacgttctcccgcaaaagtaagacaatgtattaaggtggtaatcacaacctcttaattccaactgttggttaattctataggcaagaacctggctggaccctaaggcagatgtagaagtcttgtgtggtttagtaggagggggtgcgtgcctgcatggaggtggtgggccttgctttcaatttttctgcttctctttcaccatgttcctgacttgtctaaaagtgaacttttctttttccatatctctatcggatggcatgcattgccctttcttctcatttgtattagttttccttatctttatattaaggtttcaggaaaatgtaataccagttattcatcaggaaa

SEQ ID NO: 32603 - DNA, 1029 bp, Homo sapiens
tggtcagttgtgttgtagactgtttcttaatttgagcttctctggtgttttctcatggttagattgatgctctacatttttgactacccacagaagtgatgttgtgtccccctcagtgcatcatatcgggggcacataatgtggataggtcttaaaactggtgatagtaaccttgatccttctttactgtgattatctgccaggtttccccactgtagagttactgtttttttctttataattgacagataatcttggaggagatactttgagaccgtttaaatatcctctctctcaaaattttgcccactaacttcagcatctattggtgggccttgcctgtaatggttattaccatgatgtttacctaattgtgatttttgtcttttccgcattccttctatattgatgttccttgtagctgtcccatttcctccatttatttgttgtttttactgtttcattttgtatctgtggatatgcattttattctgtgggttataatccagtactgttgttgcttacgttcttgctcagattccatctttggtcattaggagctctttcagtctgggtcttatgtccttttgacatcctctgatccttttttgaacactttagcttctgacattatgattttctagagtcatcttatatttttccccgacccagctctgggctcaaccacttctcagagaactctggttcttttttgtttggataatggcatttagaaactaagttctggatgctaggtgtgttgggtgtcgttgcttttcagtgacctcagcaaacaagctaggaaaatacatgtatgtctactaacccacacatgcacacaacatctatagtaatttctttatattggtagggcccgggcatctgtattaaaagagattgagtgaaagagagaaagggattgtatagttaagatgtatctagattagcagctctcaaatgttctggccgtggggtccctttatactcttaaaaaatactgaggactcctcagagcttttgcttatgttg

SEQ ID NO: 32604 - DNA, 1038 bp, Homo sapiens
aactatatttttaaagatattttctttgtggttgctgtcaggattatgcattttaacaggctgcttattatcagtaagataaactttcttccaatgtaggtccattttctcttctttattgtactgctattgtaatatacatctgtatatattataaacccagtagtacagtgtcgtgatcattgctttatacattcttaggtcttttaaagggaggaagaaatgagaaaaatatgtttatggagtgttttttgaattaatccacatatttgccatttctgatgctcttcaattctttctgtggatttaagtctgatgtgttttcctttcagcttaatgggcttcctttagtgtttgtttaaggcaggtctactagcaaaaaaaattttctcaatatttggttatctgggaatattttttcatttttgaaggatagttttgctgtcttcttggttgacagctgtatctttcagctttttgaatatgtgatttccctgtctttcttgcctctattgtttctaactggaagttagccactaatctctgcatatgctgaatcattattctcttcctgctttcaagatttttctccttgggtttgctttcaacaagtttgactatgttgtgtccaggtgtaggttgctttatattttcctacttgaaattcattgtgcttcttagatctgtagatttattttccttagaaaaattaaatttggggccaggtgtggtggctcatacctataatcccagcacaggtggggatttgggaggccaagatggtcagatcacctgaggtcaggagttcgagaccagcttggctaacatggtgaaaccctgtctctacaaaaatacaaaaattagccaggcatgatggagggttcctgtaatcccagctactcgggaggctgaggcaggagaatcgcttgaaccggggaggcagaggttgcactgagccaagattgtactatcgcactccagcctgggcaactgagtgagactctgtctcaaaaaaaaagtaaaagtaagtttggcaag

SEQ ID NO: 32605 - DNA, 1029 bp, Homo sapiens
tttaggagtgggctgtggttctagtggcagtttaatttttagagactttgcagtctacttggtttgtttgatcctactggagctcccactggaaggggtttccccatgctgggtttctgattgtctacagatgggagaggattatggtgggacccacctactggtctcttcttttctcgcctgtcctggtaactttgggcaagtgaagaggttcttggcccaacctgagccacttgctatggctgggtccctgaattttgcctacttgcctctctgtctctaggtggaaaacagcctcaggccaaatagggaagaagagtgcttcctgtggtctttattgtcatttgggcttcaagttgatctccttctcctgatgttttcaggacaacatcagagagttgttgccatttgttttggcggaggaatgtgactatctgagctgctttctgttgctagattggtggttgggaaatgccaggtctggattgtcttcttctgttgggtgtgaggacatgaaacactctgctgctcttttgtttctccattccttgggtcccaaattggtttactgcctttttaccacctttggattttcctttgcttattatttcagtggtttacagttgtgcttcgtgagtaggggcagtaggagaacagatctaggccattttatctgaactggaagttgaagtccctgcatcatctcaatccaggcagttatttcagcattgaaaataatggtatatattgtctacggccataccaccctgaacgcacccgatctcgtctgaaaataatggtatataattatgtgctttgtgaacttaaaatttatttttaatttttaatttttgtaggtacatagtaggtgtatatgtttatggggtacatgagatattttgatacaggcataatatgattatggggcatccatctcctcgagtatttatcctttgtattaccaacaatccaattatattattttagttatttaaaaatgtacagccttgtttacttctaagcattata

SEQ ID NO: 32606 - DNA, 1053 bp, Homo sapiens
tatgggtttaccacttttttttgtattcattcatcagttgttgggttgtttccactttgtttttttttttttggccattgtgaataatgctgctgtgaacgtccatgtgcaagtttttatgtgaacatttgttttcatttcttttgtgtatatgtgtatgtaagagtgaaaaattgctgagtcatgtggtacctctgtttaaccatttgagtaacttccagactatgtttcaaagcagctttaccattttacatttctatcagcagtatatgagggttccagtttctccatatccttgataacacttcatactgtctttttgattatagctatgctggtgggtgtgaagcagtatttcatggtttgattagcatgtctctgttggctaatgctgtggagcatcatttcatctgcttattggccatttgtatgtattttttggagaaatgtcttctgatcttttgcctgttttttagttgggttgtctttttattgttgggttttaagagttctttatatgttctggatgttagacttatcaggtaaatgatttgcatatatcttctccaattctgtgggttgttttcactttcttgatagtgtcttttgaagcataacagttaaaattttcttattgtaataaaaaatacataatatgagacctatccttttaacaaatttctaagtgtgcaatacagtattgttaattataagcacaatgttgtacagcagatctctagaacgttttcattttggatagcttaaacaatacccattgaatagcaactgcgctttttttttttttttttttttttttgagaaacaaggtctcactctgtggcccaggccggagtgcggtggcacggtaacagattgcagtctcaaccttctgggcttaaacaagcttctcgcctcagccttctgagtagctaggactacaggcacctgccaccacgcctggctaattttaaatttttaaattatttttgtagagactgggtctcattctgttgcccaggctggagtgcagtggtgcaatcacagctcactgta

SEQ ID NO: 32607 - DNA, 1030 bp, Homo sapiens
atatcattttcactgctttttaaacctgcacttatttttgtgtgttcacagttctagcaattttatgccatatataaattcatgtaactaccaccaagaccaagatccagaactattgcctcatcacaaaggaaactcctcttgctatccctttatgttcccaccccattccaacactcctccttgtaccctggcaaactgtttactatctatagttttgttctttccagaatgacatagtttgtttatgtatgtatactttgtatacatacatactttgtttagccattcacttgttaaagaacttttagtatgttgcagtattttgttattatgaataaagaggttatggacatttgtgtacagcgttttttgtaaacaaaagttttcctttctttgagataaaagcccaagagtgggattgctgggttgtatggcaagtacatgtttagttatttaaaaaacttccaaactgctcaaaaatcagttgaacatatttgtattggtctgttttggggttctgtattctcttccattgataagtgtgtctgccttccctccagtaccacgctgtcttgattattatagctttatagtgagtcttatcgagtagagtgcctcctctcacttcattcttctctgtcaagattgttttagctcttctggttttgttgcctttccatataaattttagaataatcacatctgtatctacaaaaaaaatcttgctgggagtttgataggaattgaataaacctatagttgaatttgagaagatcttttttttttttttttttaagatagaggtccttcagtccgtgaccacaggatatttctccgtttacttagatcttccatgttattttgaagcaaattccagccatcatatagttttccttaaacggtgttattgaggtataacttatataccatacaattcacccacttaagctatacagttcagttgttttcagtgtacagaggcatacagccatcagcataatcaattttagaacagtttcatcaccct

SEQ ID NO: 32608 - DNA, 1043 bp, Homo sapiens
gagttaaatgaattgttacagaatatttggaaaggtcattttcaaggttttggggacgagcctaggaaacagatttttctgtagccataggggcttctggaatagatgcacaaactttgatggcagtttggggcaaatttgtgtaagttggagagtgttagctttgaggaaatgagaacagacaagaaaaacgcagtgtttgagaaagttatttatgtattgatttggtaggagctgataaaaaattataaaagttgtggagagattttgaatagctaaagtgggagatatcatggaagtgatttatgaagcttttttttttctttttcttttttgagatggcatcttgctctgttgcccagagtggagtgcagtggcgttatcacgcctcactgcaacctctgccttttgggttcaagcgattctcctgtctcagcctcctgaataactgggattacaggtgcccgccaccacacccggctaattttttgtatttttagtagagatgaggtttcaccattttggataggctggtcttgaactcctgacttcacgtgatccgctcgcctcagcctcccaaagtgctgggattacaggcctgagtccccgcgccggtccgatttatgaagcttgttacttcaagtattagaaaagtaaaatggaaagatggtttagagaagatttcttttgggaacaatataaaacaagcaaggcaagaaaaaactaaaatgagtaaattagggtgtggaaaagttagagtaagaggaaggattaaggcggaggctactgaaagagatttcttactgtcaggctgtgtgataatacaaagctgtgttctgcagcgttttgttggatactattgataactggttctttaaggaaaggggcttaaacaggccttggtttgtagaggtgaggatattgacaagcatcattaaatgtaatatttttattaaagaaacttggaagtagggagccctcatattccctgggcttttgcagcccaggcccgattgggccagctgcgcgggcgggactgtgcc

SEQ ID NO: 32609 - DNA, 1045 bp, Homo sapiens
aagttcaggacatgtttaggggttggtggtctagattagctataatttagggttcatgttgaggaatggagggaaataaagctgggaagtaggcagactatctcaaaaattcaggctaacttggattttgaaaatgtatttattgagataaatacagtaaagtgctccaatcttaagggcacttaggtataaatttatgtagccaccacccagttcaatatacaggacatttccgacttccagaaggatgcctcatgtgccatttccaagctgatatctcatccaaccaaaaataactattattctgacttttgtcataacagagtagtgttgtgtgtttttgaattttgtataagtggaacccaatttctgtgtctagttcctttttctcaaggagcatgtctgtgagttttatccatgttatgtttggctgtttattcttttttcattgctgtgtggtattctatcatatgaatataccacagtgtatttatctattccatgattattggatggtttcaagttttttgaagtctgaggtgttctgtttgtttttttcaggcagagtctcactcacccaggctggagtggtgcgatgtctgctcactgcaacctccgccttctgggttcaagctattctcctaccttagccgccctagtagccaggattacaggcatgtgacaccacgcccagctaatttttgcatttttagtagagacagggttttgccatattggccaggcttttctcaaactcctcacctcaagtgatctgcccacctcggtctcccagagtgctgggattacaggcatgagccaccatacctggctgaagtctgaggagttttaacttaagtcagtatgcagtggagaaccagtgttgatttttgaacgggtaaataagagactatttaagaatactaatctggtgacctttctctttttgtaatgaagagaacctggtgactgggagacaaagttaggaaaaagtgtgaagtaggctggacacagtggcttatgcctgtaatctcagcattttgggagg

SEQ ID NO: 32610 - DNA, 1031 bp, Homo sapiens
ggcccaatctcctctgttaggttagagtcataaaatattaatgtttttgaaatttgtgtatgaggtgcaaatcactatggtggatgttgggagattagaaagataattactccacttctttttgggagtctaagtaatggcaactcttgagagtcttccttactttcagtagtaacagtattcacatgtagtttatgtattgctaaattttgtatttgtgacaattattctctttgttttgcaaatggtacattgtaacctgttctagagcagagacttcctgtagtctctagggaaactaacagcaggttgattcttaagtgcttaataaatacctgttgaatgactgatagaaagtagtgttcactgttagtgataatagtgggattgtatgaaattgctgagtactttgggggtattgtaggcaaaactgtgtgtgtgtgtgtttgacagcgtgaaggacaaaagggatatctggagaggacctttagatttaagggaagaagacagactggattagaatggaattgcagtggttctgtaacaacttggaagaggtgggaccaaggggtctcttctaaatttgaagctagtttaatctggagtaaaatctggtctgtagcagggtgctggtttaatttagattttttttttttacctcaggcataaatgactgttttaggactgtctgatttaattcttttttaggatagtaaaaataacagataagcttcttctctcaaggaatttgtagtatttacaatttttttttttttgagacggggtcttgctctgttgcccaggctggggagcagtggtgcgatctcagctcactgctgggttcaaactccgcctcctgggttcaaacaattctcctgcctcagcctcccaagtagctgggattacaggagcgtgccaccatgctcagctaatttttgtatttttagtagaggtggggtttcaccattctggccaggctggtcttgaactcctgacctcaggtgatcctcccaccttggcatcccaaagta

SEQ ID NO: 32611 - DNA, 1040 bp, Homo sapiens
tcaaagttttatcctacaaatgcaagtgtacattttccaccttccatcttggatataaagggagatttgtactctacttaattgggagccaatcttgccaactcttttatccctaaattattttccttgctgaaaaacactgccctgggggagtaagagtggttaagtattttatctagtgatttgatgtcctcaacttcaccactgcctctttatttcaatgaaccacagtaactgaatacttggggactgtgaaaagttttttaagccacattacagagtttgaactttgtctcaggatcagcggataacctttgcagtagaaagctgcttaaaagcaagggggtggtatagatttggactttggaagatcatccaagcagagtggacagtagattagaggagtgtgggagtgggctaggaggccagtcaggaggactggtgagagatgatgatgctaatctgaatttagggcattggcagagagaccagagaaaagtgagtggattggggcaatgtttaggaggtagaatcaacagactgggcaattagtggaatgtatgaggtgaaggagaggagaaggaaatacagatgcactcaggttttcattctttagagtgcaagggagcacaagggaaagatttgaggagtagtggaagataggttgagctttggctatggaagcaagtacaaatgtctactaaatcagttggttttatagatctggagttaagagagatttgggctgatggtagaaatttggaatttagcaatatgtagatcataatcgtgaagctttgtgaatgacaagtcacataggaatgtatagattgaaagactgattggaagatagctgaggacccaggactgaaccttgaagaaagccagcactttaaggatgttttcaaagtataactacctgaggtcagctgggcatggtgatgcccatatgtagtctcagctgtttgggaggctgaggcaggtggatcaagggctgcagtgagctaggatcaagccactgcattccaacctgggtgaca

SEQ ID NO: 32612 - DNA, 1029 bp, Homo sapiens
gggatagtattagttataactaatgtctaggtatactctttaaaatgaattatgatttaataattctatttttttgccatgggagccatttgtgaattttgcatttcatattttggttcatttttattaatatgcaatgaataaatttagtagcaaacttaaaaaatgataaaaatgagcatctattgtgctgagcatggcatgatgtaaatactttctctagactatttggagactgatttaagttctgtgactttttgtcctaatgtacaaatacaccttgtgcatttcatggagggcaaacaggttattgtcaagcaaattagaaaatagcaaggtcctgataatgtttagaagactggtgcttcctaataggtcttacttatgctggcaagaaatcctaagtagtcaaaatatttaaaatatcctttatatgattttaccttaactttctgccaaaagtaaattgaacttttgtatgtatgagacatggcattgcctaccagccctttataattaaaagtaagactggagatgaatttttatgacccctcttcgccactctttcagagctaactaatattttgttcttttggatatttcttggtacttggattaatctgatttattaataacctaaattgaagtttttgtggtgtcttggtctttgttgtgaatgttattctctcattttggcagaagtgaagttaaaaatgctttttatttaatgaaacactagctaaactagattttatcatattataaaatcaattatttatgcattaaggcttttagagtgttcctaataaaactgtttctcttatgtttaaacaggctttctgtaacagaaagaaagtggttaggagtaagggctttgaaatcagatggatctgagtgctttatccacagacctttgtgatcataggcagagcatatactgtgcagctgtgtcctcatctgtaaaatgaggataataaatctctgcctcacagggttgtcataaggattaaatatgaaaatacatgaggc

SEQ ID NO: 32613 - DNA, 1034 bp, Homo sapiens
gcctaaaataaaagtttaaatcttggtgaagattgtctacagacaattctgaaaatttagttttccttctaccagaaagaaagaaaaagagagaaaagaatcttctaaaaaaaaaaaagaaagaaaatttttatacagtaagaagtttaggaaatgagagaggtaatgtggttcttttcaaacttaggtcatttcatgacatatgtatgtttatgtatcccagagatttgtaaggttattttttaaagatcatggccctgtgagaggatttttgtttctgtttttttgttttttaagttaaattagccactttaaaaataatactttagaaaacagtgttagctgtagccttctaagtaaattttaagtttacaatgaaaaaggatatatttagtatatgcctgttttttcacccacataggtattgattacttttactgctaggagagaaccttgatttggataatctggaataacttaataatgtttgtacttgactttgaaataaataaaggatcattgttttcttctgtagcccagttctaatttgaacctgggagttagaagtgaccatacatcagtaatagctagactgtgaatacatatttaagtagatcatcaataaatgtgtggcacacaaaaggattattgagtcaactttcacaactatatttcaatataaatttattttaaaacatggattttatacttaaaaacatgttggaattacttgaaaaattggttaaacaactgcaggatttggggtagggcccaggattttacattttttatttaaaggtccagctgctttcagtacagatgggcgatggacctttttttttttttttaaggtggagtctcgctctgtcacccaggctggaatgccgtgacatgatcttgactcactgcaacctcctcttcccaggttcaagtgattctcccacctcagcttcccaagtagctgggattacagacttgcaccaccacacccagctgatttttgtatttttagtagagatggggttttgccatgt

SEQ ID NO: 32614 - DNA, 1079 bp, Homo sapiens
ctgcctggccatcatggcgaaaccccatctctactgttaataaaaatacaaaaattagttgaatgtggtggtacacacctgtaatcccagctacttgggtggctgaaacatgagaatcacttgaacccaggaggcagagtttgcagtgagccaggattgagtcactacactccagcctgggtgacactctgtctcaaaaaaaaaaaaaaaagttgttgtatctgttgaccctgcactgaggtgagaggattgcttgagcccgggagtttgagaccagcctaggcaacatagcgatacctcttctctacgcataatatttaaaaataaaataaaaattaggtgtctctttaaaaggtccctggtctcatctgccattcaacaagccagtccatctttaaatctgttgaatgtgtccttttaacaattatggtgttcagttgtgttattcttggcactgttctgtactttactactgacagtttcagtaattttatatcatctaccaaccctactggtattattgttgtgtgcctgtttgtattctttagcttttatgatagctgattttatgcttttatcttttttccttctttgtaactggatggtatgacagggtcaatttatgattcatatgtcttatctttttgactggggagatattaataacttgctttatcagaatgtgctttcagaattcagcgaatttgtcactggagcagatggtaaatcaaactgcttggctgtgggccagaatgtattattaatacatgtatatatgtatgtgtcaaccaatgagggcttcataaccaaccctgatgttgggtggcttgtgcttaggtgatttcttgagctttcttttggttgatgatttcctgctgtctctcttattttcttagtacataaatatataaaaacttatattttataaaaatgccttgaggactgagatttttgtttttgttggctgatttcaacccactgggttggctctttttctttatcttcttttagcatttttaccttcttcctcatttttcctgtacgttttgggagagctgtgtagtgtatcatctgttttc

SEQ ID NO: 32615 - DNA, 1067 bp, Homo sapiens
gcctcccaggctcaagcgattctcatgcctcagcctcctgagtagctgggattacaggtgtgtgccaccatgcccagctaatttttgtgtttttagtagagttggggtttcatcatgttcgccaggctggtctcgaactcctgacctcaggcgatccgcctgcctcagcctcctaaagtgctgggattacagacatgagccactgccctcggcctatgtggtttcttaaaacaactccctaatttagtaattcataaagaggcacaagccatttgggcaaatatttcagaattactaggtgtttaaacaaacatacattcagtgcattccttccccttcccctcctctcccctcaaagagaaaatcaaactaaaaacccgtcctttgaaggtcttcacatcccttcacttctctccatactctctctcactcagtctgtcttcagttgaaaattactgtaatgtttttatggcctcattgtagctgttactgataggaatttggtctcaccagaaaagtaagttagttttgcgtgtgctgtgcacagtggggctctacttttcatttaattcccaaaattacttccaatagatgggtaaatggaaccagccagaggctcatagagaagtaatttgaccatggtcacaagctagtcagtagcatggctgggatttgaatctaggttcacctggcattgaaatcagtgcttcttccattaagccattttgcttcattaaaaaaaaagtttaaaatagtcttgtacattgtttcaatactgaattttaaagtttttagtgtagttaacactaagttgtaatttttttagactagtcaagtgcagtagtgagaaggggggaaacagtagaacaaagagtttgatctgtaactgatttgtgaaattgagataacttactatcttcagaccagcctaagttgtaattttggaaaggaaaaaaaggtttgaaagatgtgttgatttatccatttttttactacaaagatgtctaggcaaatagtgttcagagatgaaaaaacagcttgcttaaccaccattttttttctttttt

SEQ ID NO: 32616 - DNA, 1093 bp, Homo sapiens
gggaggtcatcgtgacaaagggtggcatgaggtacctggccttgacgccctccccggctagacggtccagattgggggtgtccacatcctgatcctagtcccagcggaagccctggaaggagatcagcagcagctgtgagtgctcttcctccctgggacggggtggctactcagtaggacaggcggcagcagctggagggccccgaaccctgtcatcccatgagcacctgtcatgcactcctcacagagatcgtgggcttctccctctttaatccgttgttgaacaacgtccacattaataattcagcccagctctgttgtgggacaaacaacccggagtgtagcaaggtgccgcatatttgcaggacaggatgaaagcgttctggagatggatgggggacatggctgtacaatgtggtggatgcacttaacaccactgaatttttcctttgaaaatggctaaaataatagattttgtatgtattttaccacaataaaaaaattaaactggcctggcgtggtggcttacacctgtaatcccagcactttgggaggccgaggcgggtagatcatttgaggtcaggagttcgagcccagcctggccaacatggagaaaccccatttctactaaaaatgcaaatattagcagggcgtggcggtacatgtctgtaattccagctacttgggaggctgaggcaggagaatggcttgaacccgggaggtagaggttgcagtgagccgggattgtgccactgcactccaacctggacgatggaatgagactccgtctccaaaaacaaaaaaaatcaaaccatgtgaaatattttgggcccttatactaattccaacattttgaagatctggggagaacaaactagattggtgctttccttggcttagtatgtcctgtttttatagggagagcaaattactgttcaccagcactattaaaatagctacaacaggatgggcatggtggctcacacctgtaatcccagcactttgggaagctgaggtgggaggatcgcttgagcccaggagttcaagatgtcagcctgggcaacatggcgagaccctgtcactaccaaaaata

SEQ ID NO: 32617 - DNA, 1058 bp, Homo sapiens
gtggtgatatcacctttatcattttttattgtgtctatttgattcttctctcttttcttctttattagtcttgctagcggtctatcaattttgttgatcttttcaaaaaaccagctcctggattcatggattttttgaagggttttttgtgtctctatttccttcagttctgctctgatcttaattgtttcttgccttctgctagcttttgaatgtgtttgctcttgcttctctagttcttttaattgtgatgttagggtgtcaactttagatctctcctgtttctcttgtggtcatttagtgctataaatttccctctacacactgctttgaatgtgtcccagagattctggtatgttgtgtctttgttctcattggtttcaaagaacatctttatttctgccttcatttcgttatttacccagtagtcattcaggagcagtttgttcagtttccatgtagttgagtggttttgagtgaatttcttaatcctgagttctagtttgattgcactgtggtctgagagtttgttataatttctgttgttttacatttgctgaggagtgcttcacttccaaatatgtggtcaattttggaataagtgtggtgtggtgctgagaagaatatatattctgttggtttggggtggagagttctgtagatgtctattaggtcctcttggtgaagagctgagttcaatccctggatatccttgttaactttctgtctcgttaatctgtctaatgttgacagtggggtgttaaaatctcccattattatcatgtgggagtctaagtctctttgtaggtctctaaggacttgctttatgaatctgggtgctcctgtattgggtgcagatatatttaggatagttagcacttcttgttgaattgatccctttaccattatgtaatggccttctttgtctcttttgatctttgctggtttaaagtctgttttatcagagactaggattgcaacccctgcctttttttgttttccatttgcttggtagatcttcctccatccctttattttgagcctatgtgtgtctctgc

SEQ ID NO: 32618 - DNA, 1015 bp, Homo sapiens
ttcctcttgacgtgcagcacccatgtgttcctccactgatgtgctcctctcgaagtccagccgcctgtgtgtctgcctgctagggtctcagggtttttataggcacagaatgggggtgtggcagccagggtggtcttgggaaatgcaacatttgggcaggaaaacaaaaatccccatcctcacctaggtccgtgggcacaggccctgggtggagcactagccagcgacaacaccctcctctacccagtacttcccttcttcacttccatatcatttaaagggaccacattcttcccttccgatcacttcccttctgtatcacaaagtgctgggattataggcatgagccactggtcccagccaattccgttcttttaatgcaaactagaaaataggtgttcagaaaggcctgccctatccacctcagggagttgctatgaagatcaaattagatcatgtgcaacagaagtttagaaaagattccaaaagcactgcacaatgggaatgtatttttaaactccactgagtggacttaaaactatgttttttactttcttttttttttgtttgagacagagtttcactcttgttgtctaggctggagtgcaatgaagccatcttggctcactgcaacctccgcctcccaggttcaagtgattctctgcctcagcctcccaagtagctgggattacaggcacccacaaccatgcctggctaattgctttctttctttctttctttctttttttttttttttttggctttttagtagagatggggtttcacagtgttggccaggctggtctcgaactcctgaccttaggtgatccacccaccttggcctcccagagtgctgggattaaggcttgagccaccgcacccaacctgtgtttcttttttaagcaagaaaacaaatgcctctccccagcactcactaaaccaatccctctttttttttttttccataggattcttatccttcttgccccagtgcaaacaatctattttcttttgg

SEQ ID NO: 32619 - DNA, 1044 bp, Homo sapiens
gtgcacaccaccacgcccggctaattttttgtatttttaatagagacagggttttgccatgttggccaggctggtctcaaacccctgaccctgtgatctgcccgatttggcctcccaaagtcctgggattacaaacatgagccaccgtacccagccactcttgattaacttaatggaaatatttagagattctttcttttctgggttctagagtcttctctgtaacctctgcaggtaatacattttccttcctgataaagcatttctatggttgctttcacttgcaaatcctctaatacttatttattccatttctgattggcattagacataattctcaatttttagtgacagcacttttgttaacttacatataaatcgactttgccttgaaatgtgacattgactagaaggacgacacttctaacatgttgtagaacatagtttgactggctaatttattatttagaagaagctaatattgccattatgagggacttaggtggctctgaagaacaagttgtatttctgatgtttgcaatgttaaatcacagatattgccaatgtgaaatagtttccgtatgctgtgttctcaatacacaccttttccaaggatatcccaagctgtagtcttaggaaactgtgatttttcttatttggtctcataggaatttggggagctatgcgggatctccataaaatgagctccagaaagacacatgtgtgcgcgcacacacacacacacacacacacacactcacacatgtaccgcaccacaattgaatctgtttatttgggacccatgattattttcaacaaacacttctgagaaataatctgaacacttaattggatgcaaaagagtgagtatttactattctaccctttaattagcataatcaatgtttccagcagcaaaagcaattggaaaatcgctagttttattaggttcattattctcccttagcgtagtgtggcatcagcatggctattattcttaaattgcctccttaaaacaagggctggtgcttcttacaggccatt

SEQ ID NO: 32620 - DNA, 1035 bp, Homo sapiens
atctggagaaactccagaatggcaactttgtggcaatttcagttctttgtcttctggaaggaaagatttcaaatgagagacacaggcaaggtttaaagcaggagggagaatttattttaagcaaagcgagaatttattagagagtacacttgaaggagagccatgtgggtgacttgaaaaatcaagtgtgttgtttgcttcagtcacgccccccacatccatgcctgggcagttgtttaaaggtattttgttcctaactgcctcccccattatcttcatgtacctggaatttgtgatacaatgaacaataatatagccaatccatagcttatgttattttaatgtaaattctttgtaaacaacttaggaacagcctcttcctttatctttaaaatcccacttgtaactgctactaattgaagtgtatattcagggcacttgaatctatgctcccactgagctgttcttaagttttgggctcaggtgaactctaaacttagtcatagaatagggtgttagacatgagcagggcaggagagagggcccccaagaatgttgggcagttgtcaagccatggtcaggcaattataaatctgtccccctgaaataatgagcaggagaagggaggaaccccagagctgtctggttctcattaagtaacggacaggcaggcataaaaccgtccctctaagataataagtggccatgactggtgcctggaatgacaggagtcttagaacagacagaagacacctggaattagcaagccataatccccgatagggttttaagcatgtgcagtgaaagggcaagatggtgaaatttaactggtatatgaccttcctctggagcgctggaccagtgagaactgcccctactgagcatgtgcaccacttcaataaacacactgcacatgcagctctcccaagtgctggcagggccactgcacatgtgatagataaaggcccgcccaggggaagaacaaaaggaggacacagaaagcccaggaaaagatagggggtataaaaactctaa

SEQ ID NO: 32621 - DNA, 1026 bp, Homo sapiens
gagtgccaccttcagtccactccagccaccctggcccagaaatactctggacactctgaaatcttaatccctttacaccctacctcttgccatacttcttcccctctcatgtctctctctcccacctctgtggatgtctgagctcctcagcctcctgccctcaccgctttacctcttggtctcacttcctgctttgtgcagccttcgctcagtgatgtgctcctggatgccagtgatggactcaggctcacatgcacagcaagggccaggctgccacgtgggctgtacaggctatagatgtgtacttttattttaactgttttatagatgataaaaaatattttgagaaaggagtgtcttttccgactcatactcagaaatcatatgggccagcacaagtcccttatctgataagatcagcacccaggttggagctggttgattaatagaaaacatgagttgaagcagcagacaggcacacttaggtctcagtgaacacacagtgcagctgcagagcagaagaggggtgagtcattggccactcgtgctcagcacgccctgggttccactgagtctctaccctgcctccttcccttactgttcaaacagggacacctgcggtgggtgtcatatctactcaagagtggactgaggcctaaccacagtcaggtgccgcatcccagatgtcagtcgtgctgaagacaaaaaggctccccttctctgtgaaaagaaaatgaattatcaagtgtgttagcagtaggcacatttttatatttttctccttggagttcaggaacttaatgaactgagtttaaggaatctaggaaaatatatttgctttgaaaacttttctgatttatgtcttgaattttgttggtaagtgttatgctgttaggagccaaaaaccatttttaaaggataaagtcatatttatgatctcagttttttatcctaagagaagagagacttatatgtgttccttaaatgggatgattttgccaaggtgacattgagcggattggtggt

SEQ ID NO: 32622 - DNA, 1066 bp, Homo sapiens
ggtaaagtaggccagtttcaaaacatctaaatgaaataaaatatatacatgaacatacataaacatgtctctatatactcccgtacacactggaaatagtcgtttataaggtataatttaaaaagagattcccttcaaactattaaccagtttttaagtagtttcagaataatcctcaaaacaaaatgggcaaaacctatacaaataaactacaaagctttataaagagaaataaaaatttggagagagaagttcctgaatggcaaaagtcaatgttgtaaagttatcaattctctttcttttagcttataaaattaatacaaatttttctaataactagtgatggtgagcatcttttcatgtgcttattggccgtttgtatgtcttctttggaaaactgtctattcaagtcctttgcccattttttaattagtttttttggttgttctgttgttgagtcgtagttccttatatattctgaatattaatctcttatcagtatatgctttgcaaatactttctccagttctgtaggatacctttttgccttatgtcctttaatgcacagaagtttttaattttcatgtagttcatctatttttgcttttgtcacctgtgcttttggtatcatatccaagaaatcattgccaaatctaatgccttgaaactttttgcctatgttttcttttgagacttttgtagtttgaatttttgtttaggtctttgattcatttagagtttatttttgtacatggtgtaacataagcatccaacttcattcttttgcatgtggatatttcgttttcccagctccatttttttgaagactctccttttcccattgaatgtccgtggcacccttgtcatttgaccatatatttaagggtttatttccaggatattttattccattgatctccatgcctgtctttataccacaccatttagattactgtagctttataataagtttcgaagtcatgaagtatgagacctccaaccttgttctttcttgagattgttttggctattcagggtcccttaaattccataggaatctataaat

SEQ ID NO: 32623 - DNA, 1089 bp, Homo sapiens
aaattttaccctttcattagtttgctattaatgttaactttaattttaatgaaaccttatagataattttatttaattttaatgagtttgactatgaagtgagatttttatatgcccattataacccttgacaagttttgctaaagagtagattagcattttaagaaaatcttgtggtgcttttattttagtgtttaatttacagaaaaaaagcatataatactcttttgagtttagttaatgtgttaacacacaagagttttatttgcagaattaatttttatgatgtttttacaatttgcctaaacctttcactttattttatttaattttaagacaatttattattcttcagcaaaatgtacatttttatgcctttttataatttttaactaaaaacactttttactgtttttatacaccttgcatgcaaatccatgtttagcagttttaattacatgttataatgataacttttagcaatttttaactttaaggtaaaatgtgttaagtttttttgtgtgtgacttgaaactaaaaacactgactcattttgtaatttgggcgaagtagctctgaaatataatgctgttttttcaattttaaacacttgggtaaaatcgcaaggtgagtgcttaggtagaaataagtaactactgaacaggtgggagcaaagtttagttgggcaatactctttatgataccgacatgtgaatgcttactagttttaaaagtgctggctttattgttgtagtcacagaggagtctaaaggcaaggctgggtagcttctggctcccacgttaacattatttatttagtatgccagatttttcttaaggtgcactagccactgaggatatttttgctggtgggaactgagattttctagacaggtaaattagctgccaattatggtttatcttagggacatgtttatagagatagtattcttacttagcttgcattctaaattttgttcccttattatcttgttaaagcgatgaatatgtttgtacaatgaagacaactttttttgcctttttaggttagagcttcagcatgagaattatacttcaacacagaaagtt

SEQ ID NO: 32624 - DNA, 1022 bp, Homo sapiens
cacagaaaggctgtgcacctgcctgaggtcacctggcagacaacttgcagactcagaaatggagcccctgcttggagggtgggaaagggttgggggaggcccagggtggagtgtgggctctgcccagccttgtgcccttcacagtgtctagcactttcattccttcccagcacctgatttggtgaataggtgcattttaaaacatattccaggtttaaatccttagctgagtatttaaaccaaaaagccaaatgtcctcctagtaaaactggcctggggcacagaccttgccttagtttcctggagctccgtgaagcttcctgggtaagttgggaactggggctaaaggtcctggggtccctgagcaggaagagacttagagatctttgaagcatggaacagatgaggaaactaaggtttgggaaggggagcaaggacttgctcaaggttgtagctgatgatggtattggccattgggcagtgccgggtgccaggccctgaaggggtcctggagacagaggggctgggtgtagaggtgatgctgggcagcagagaacctctgactttggtgcagagcattccccttccccaagcttgataaacacccagcctgccctggtcactgagcagggacaaaggttcacagaggtggccccgtcacagctggacactattgactctccttggcaccagacctagcatgtccttggcttcagaggatgcagctttcccttctcctctctatcaaagttctctgagcccctgctgggcaccagcggccagtccaggcactggggacgcagcagagacatggagtgcactgtctcagggggagacaggcattagctgaaccttcgcaaggcggtgagtgtcccagatggagagagcaatggcagagagtgcaggggactccacttccttattggtcaggatgggctgggggggtggttgtctcctttcccactagatgggtgtgaagtccaaggcagttaggcacatgcgggtgctctgggaccccagtg

SEQ ID NO: 32625 - DNA, 1024 bp, Homo sapiens
gacctgactggtagattgtagattgggtgtgctcgtttttatatttcattttaggagcctcacagtctactcagagaaaaataaaagaaggcaaaatgagtcctccccatttccatgcaagccagaacagttggttgtgtgggagcctcgtggtgcccagcggaggacggccaggaccagctccagcagctggggtgcagtgcggggcgcagggcgtccaggtccagctggtgcaggtgagagctggccagtcacacaggccagctgtaggcggggtgggagggtcacgcaggtctgagcagtgtgcggcatgctgcatcccctgcccatcgcagcaccccctgcctgcctgcccctcgtgcatcctcccctgtagactgccccaagtcctgtctcctcacagcccagctcctccctttttcccagcctgtcctgcatctgctcaagctctgagtgttgctgggaccgtgcatccacttcctgaacctgtctgtgcacagccctgcgtctagccccagagtagcccgcctccctgcccgaggcccccagggctgttttgcagcaggatgagatctgtttgaggccaccctgcccttcttctgcagggctggggcaaaagggctccgcaggccgtctcagccaccccatttctagggcggcctgcttgtggcgcactagcagcctttctatgctgaaggtggtgggggtcttttcagtgtttttctattttctttcctacgaaacagagcccctccagggcaggcccaggcccctcccagcctgtccgggccacagatacctgcagctgtggccagtttccaggaggtctttgagcacacctgcttcagcagccctgagcacacctgcatcttcagtctcagtttgaggggctggaatggggagggaagatgatttggaaggatttggggagagaagagatatacaagccggggctgtctgggtttggcccaggtgtgtgcccctcttcaccactccactttgtagattccctgtggcaggggat

SEQ ID NO: 32626 - DNA, 1075 bp, Homo sapiens
aagcatttttaatataattttgcttttaatatcataattatctatcaaagtttctgatatattttgttttgatttgttttgcattactaataattgcagttgtaacagttcaaaccaaaaatgttaatgcctagaagttaaataaaagttaagtttatgtacatatttttatatgctagggtgataaaagacttgaaagcatagaaatgcattcaggtaaaattctggaggtaagtgggatagtatacaagctcacggaggatataggcacgcttcattttttgcagttgactttttttttgctttttacaaattgaaggtttgtggcaaacctgtatccagcaagtctgttggcaccatttttccaacagcatgttctcacttcatgtctatgtcggtatttgttagcaataaagtatttttaaattaaggtatgcattgttttagacataatgttattgcagacttaatagactgcagtactaggaactgatgtgaagtttcctcaaggaggggtgagtaagttttgtgccccaggcacctctcttgccccagacccagccctgctcttctgtctgaagcaagtagagcaattagaaaaagagaaaccaggcgtggagaacagtcagagatgatccagagcgagggttgctgggttttctggaacactgatggatgaacagaaaggaagtattttgtaatggaagtgcatctccctgcagtgagggggaactgaatctgtgttacccagaaacctcctggttagcatttgcacttcaaagaaaaagagccctgaggcacccagaaaagacagcaggctgtgcctaagtacagaggacccaaggtttgtgcacccagttggcttgcctgctgagtgtgaagctctccgggacccagggcactgcggaagacaggaagggatctggagtgaggtgagcaggtcagggagacagcatatgcagggcaagtcagctctcaccccatgggctgctcagaaccttcctgtcaaacagcctcgtaaaaacagcctgccttgggcagcagggtcacccaattgaatacttttattaggaat

SEQ ID NO: 32627 - DNA, 1211 bp, Homo sapiens
tgccggccttggtgcacacagcgcgtccttgtgctttctcaggagagcttcactggggacactctgtgatgtttttggagggtcatttggtaatgtgttcaggagccaaaaaatatgcataatattcagtcttacaattacattttttgaatttatctcaaggaaatcccagggatctgtgtgaagctgcacatgctgctgctgctcagtgcgggactgtttataatatttgtaactcaaatgtccagaagaactgtacactctgtgcatgttttcagtaagttcatatttgtaagaaaaagtgggtgtgttgagagacaaatttttgtgtacatttacctggaaacaagcagtagtacacatatgcatgcatgaagtggtgttttcctgagtgttaagattgtgaatgttttattatgatcatttctactttttctattggaaaatactttgtgtaattaaaacatgaagatggagctaccatcaaaatggtgagcaatagagcactgttcctcctggggtggcctggtgggcctgagggactcaggtggtgatgaggagtggccttgagtccctttcctttccatgggacagtggggacgagagctagagtgatgaggcaggttaagtgtgtgcctacctccctgtggctggagcactgttgtggccaccccgggaccccctgagcctggtgtcgccctggcttgctggtcccagcctagggagtgggcccctatgggcagagggtgaggtggctgtgctggcactgcagctcaggcacacacacactggagtgttccaatgggtgatcaggttggatggagccttgaaattaagtcagtgatgtaatttttataatctgtttcactttaaaacaaaaatctttgcacacctggtccaagttttctcccctttcttcctgttgctgccatgatgaaagcagaagggaccaccctccagggagagcagcaggaagggagatgcgggtaggggccctgggtcagcaggggcggtcagtccggaggtgcacccccatttattcctcgttctggaagagatttctagtcacatgcatgtggctcctgtgccacatgtgtcatgaggtgcccaggtgggtttggatttggatgagggcatctttgaggatgcaggggctttgtcataccctgtgggccccgtgtacacccctggggcagatgtggcctctaaca

SEQ ID NO: 32628 - DNA, 2492 bp, Homo sapiens
cactggttagggtggtagctgctaggtttcttcaccatcaacttcttgtttttccctttgtaattaactatcttgcagtagatgctttgagactgtatgtggggcttgggggtccctaagaccaccttcacttctaatagcaactgcaagcttgggggtcctcaagaccacccttaggtaattctctagaaggactcatggagctcactgatagctgttgtactcacggctaaggcttattgcagcaaaaggacacagattaaagccagctgagggaaaaggggcccaggcaaggcagggcccatgagagttcctagtgtgacgcttcaagtgtcctctcatggaggtgtgaacagtgccaacttctcccagcatgtgacagcacccagagaccattgccccccagggaagcccacctgagactcactgtctggagttttgttgggtctcagttgtgtggattggctggccttagtctccagccctccagaggctgagctggcgctgtgtgcccgaggcctccaccacagggttagcacagactgtggaagtggcccagggcacccagttagacagacattcttaccaggcaggactttccaagggtctagagatctcccaggagctgggggcagaggcgaggcctctctggcagggttaaccctttgccttgcactgcaagtgccctgtttctctttaagctttcctctcatgtaacactcagcaggggctttttgcctgtggggtttaatggtgattttccatttcccttattcttgtgtacttattaattttataaggaagagctgtctcttctccctcatttacttattcgcagtatggattcaatgatactgattcttttttttttgtttttttttgagatggagtcttgctctgtcgccccggctggagagcagtggcgcgatctcggctcactgcaagctccgcctcccaggttcacgccattctcctgcctcagcctcccgagtagctgggactacaggcgctgccgtgcccagctaattttttttttttgtatttttagtagagacgggggtttcaccgtattagccaggatggtctccatctcctgaccttgtgatccgcccgcctcggcctcccaaagtgctgggattacaggcgtgagccaccatgcccggcctcaacgatattgattctttgggctgtagtcagtattggattatgatcaatattatcaccatttattttgttgctccagttcttccagctgtggccaatccttcagttggattcttgtgccccatcaacattctccatcctggctttttgttttgagcacttccttccttcctagcaccaccaggctcttgtattatccctgtccctgccctggaatcgactcctcctccagagagccctggtttcttttgttagaggatggtatatagaatccaacatgcagacactcggtggacttattgttactggggttttgttatactagggtttcagtggtcagtgctagtatttatgtatgttaacccacgctgtgctttggattcaggctatttcaaattttagataatatggtacatatattattaataccactagttactacattggtacttttcagcaaaatatatctaagtgggatcaaatgagactgtaaatagctttacatcagttcaggtcagttatgttgctaaattacttttggcattaagtttagggaaaaaaaattgggtttgggattttttggtttcaacatttgtgattgagagactatggacctgtaataagtccaagaacagcagttgcagtgtaacaggactgttaatggaatcgggtcatttagaaacagtcaagacttcgctgttgtgcatgtggttaggagccagtgcacacgtcagttcttaggaaatgtacagtctgagcaatagcatttgaaatccaagactcttcccattgtgttgctgttgagtgtagaaaataaaatgtgtgaatttctttatcttgagtattgagattctccccttagaataaaacaagaatttttctctcagtgtaaaaatgtcaagttttattcttgaaatgaatagcaaagttaagcttaaaaacgtgaacagcttcagaactataaatgggtatgtatacctttctgctgtctaagggcagagaagggaaagaaagtgtggtgcttatcagaggagacagcagcaagacacattgtgacagaaaaccaagggtatcctgtgtcacagtgaagtgtaatgagggcacctctcctttcaagagacgaagattgaatacatgggaagcacactctccgctgtgtgttgtctaggagaggtgcaccctgtatggaaatatttgggaaggttaagattaagacagggtaaaataaagcaaaggcaaatcacaaagcaagggctaatgttaatatgaaaagtgcagaattcaaggaaaaagcatggggacaaagaagatttttcctctttttggtt

SEQ ID NO: 32629 - DNA, 1046 bp, Homo sapiens
gccagcaagaccttggtcttaaccccgtgttcattttcttgctagctgtgtgacgttgggctacctcgcttctctgagtacaaatggtgtgtggtgaatgggtcccaggtatgctacgagctttgagggctgctctttttctcttcatagcgataagtgttaaactgtctttcttaggaaacgttcacagacttgcaacagctgatgtcctctgagtactgtctgactccctcaggcaagttcctgaattcagtaccatcattattatttttgtgtaagactttgacaaagtatagcccctgccaccagagcagcctgtacagtgggtctctaaggtgggacctgccccgggcctgccatgcacgtgtgtgaaacagcgtgaaaagtgtcgcggtaaggtgaccctgggttacccaggcaaggctcggtgtttgtttcagaaagcagagaagtatgtaattgattttaaaagtttctgtttaaaatatttggctatgttttagactatgaaggaatgaactttgcttctctggataagaaagtcacatacattgttccagctccaagtttgttcggccctcgccacaagtggatgtagcgtttggccctttgtgtgccttgctggtgactctggttttgggagctcggatatgtcccagaagcaggcttatggcacttctgtagctcccttgctacccttcctttgtgtctagataagtgactgacatgcttttctttggtctcaggaaagtgggggctcagcaagaactgattaccgagccattcaactagccaaggaaaaaaagcagagaggagcggggagcaatgcaggtgaggccgtgtgtgctgcagccggacgagcaagggcctgagggttctctgtcactgttactggcagaagaaacacagcaggtgtttctgtgctcttggttttacttttctgttcagaatacccttttatcaactccttagttttatttgaacttaagggaaaaaattagtaacaaaattcccagcatcagtatgaacatattttatttgcctaa

SEQ ID NO: 32630 - DNA, 1026 bp, Homo sapiens
acctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggtatgaagcactctattcagtcaccaccatataggtcacttctctcatactcggtcttgaggatattctggattaatcctttctatgcagacgtttctggtttacaaaaggacgcagccctggactacaagtctggaactgacaagttcttatgaccttgacaaatcaccttaacccatctgagccttaaattctcatttatttcctgcataaggagatttggctaaatgctttctgaggtcctttggagtcctgtggctccatggtaatgtgctcctttccttgaagattgggggttttgtaatgttgagatactttgcctctatgcttgtcagctcatgaccagtcctagaagaggagtcgagacataagccaccttcagaggttcaatggaaactttaaaaccataccaaactcttttttaaaattagaattaacaagaaaaaaaaaaagggtggggtttatgagccttagttcttggaggattataagagtacttccccagttttgaggctggacagttaatatactttatatcaattatacatttaat

SEQ ID NO: 32631 - DNA, 1031 bp, Homo sapiens
acgtttattctgtccatactgtctctcctagaattccagctgcagatgtgttaaacttctaatgtcctacatatctcagactttcaattttttcctctttgtttttcagtttggataattgtaattcagtttggacatactgacctgtctttaggttcactgattatttcttctactatatccaatcttctgttaaaactattaaatgaattctttatttatgaattgcatttttcctttttagcatttctgtaggttcttttttatattttcacttatcttctcaaattcctcctctattctcacataacatccaccttttcctttagactatttaacatatttatccgagttctatagcccctgtctgttcccaacaccttggtcatccctgtctgcttttattgaacgttttgaacgttacctcttattgatgggttacattttcttgttttttgacatgtctcctaagtttgcatgtcaggcattatgtatgaaaggataggctgaagaaagggcaggctctgccctccacaggtaaggtaagggagggctatccaggaccctggggttggctgcccattgaacagcttgaagcccagcgctcagggtgttagtgattctcacgacctaaagtagaggctgaagtattaataaataacatttaccctccagaaaaagagtgttcctccttttctgcccatgtgttagtgtgggtggctcagtcgttccaaatgtagccaagctgggctgggctttttttgcagttgtagtcagactcttctccacaaacctcacgtcttgaaagtgtgatcaggactgacccatcggtagggcttaggatctcagcactggaaagactccagccatcttcatgctttccagcctgcacccagcatctgaccacaggagacttttctctgccttactgagagccctcggccctggggactgcttaggcattcttgttgctctccagtgctgcctctggggtccccttgtgccctgcgccatgcctccagtctttactg

SEQ ID NO: 32632 - DNA, 1037 bp, Homo sapiens
ataaaataaacctcatatagattttaaaattcaacaaaaagggattagggcacagacttagcactgaacttacttcataattgcaaacaaggaaaccccaagcagagaagttcatggggtctagtggagtgccctctgagttggtgatcctgagctgtggctgtgacaggttcctgctaaacttcaattaaagcatccttgtcaaagcttgcaccaaagattactagggaaacctgttcatcaaacaaagctgtgtttattaagcttagcaaggaagagctcagccttgacagagtcgagtctcagtatcattgcaaatgggagttaggagagagtactttgtgagactagggttagtcatagggtagttataggagagagattagtaagtgtgtcttggcagcagtgggtcagagtttgaaaactatttgctggaatggtctgttagtggtcttatttttagaattgggggtatacgagaccatattgagtttctgttactgtagtcttttcttgaaacatggatctgaatgagctagtgtaaaagattttcaacttagataatttgttgtacaacatggcttagtatggttcatctatttttgagtaatagtacacttgttaagtagttggctttattttccaatggagaaccatccagtgcttctaagcagggaataacaatgagacctgttaggattttattgcaaaagattattaaatatttattgagacttatgtttcgagccatgctggaattacagtgactatactcacttttcctccataagcaaactggaggatatatgaaatgactacacccagacatggaacaacaaactgcaggacggtgatcccagacagaagggaaacaaatgaggtgatacttaacggttgcctcaactttctgcatggaagtaattttcagctccaaacaaagggagaactcagacagcctggtgaccttcctgagttatggtggacatcagagtttagggaggttcagacagctgacagttgtaggggagatgcaggtg

SEQ ID NO: 32633 - DNA, 1039 bp, Homo sapiens
aaatcagtaaagacttatttttgagtagcagaattaacaagctcaactcaaagattgtacccaatatgaaagcacactcatttcaagcatgcatggaatatttatggagtttgccttgtgctaggccataaaggctaggcttaagaaatttcaaaaggctagtgtcgtataggcattggcaagaggatttcagcggtgggactaactagaaacccaaagaccttaaactccatatagcatgatggaaagtagagggaggagttggtgtgagggaagtgaggggttagtgggagaacaagctggagagttggtagaaccaggagctgcttcacaggaagcagagagcaatagaaagttcctaggctttgaagaatgataaacttgggaatgcctggtctcatgacttactagatgtgtgataggataaattgcttaaattttcttattcatttattaagtatggacagtattacctgtctcacagacttaaagaattgaacaacatttattaagttgttaatatagcactttggatggaaaatcttggcttctgtgatgataagtagggtcccattaaggaaagctcttgtggacactcaacagtacaaccagtaggcaggcagacaggaagaagggggacaaattgctgctcttgcagactttcactgtggaagggagcctccaggttggccgccaaattggatctccaccaatgggaaatcacacctttgtataatccccgcctgttagaccagggctggtctgtgtggccagtagcatatggcaggagtgatggtatgtccctgccacgattaggtcatgaagagattgcagcttaagttttggtcaccctcatgcactctctcaggtcacttgttttgcgagaaggcagctatcatgttttgatgacgctcaggaatcctatggagaggcccatatggtgaagaactgaagtctccaaccaacagtcagcaagaaactgaggtctgccaatgtctgtgtgaacgagcttggaaatgaatgctactccagtcaagcc

SEQ ID NO: 32634 - DNA, 1030 bp, Homo sapiens
ctcttcatctattgtatgcttttactgttgaagatcacagtgaaggataatctgatgaaggaacattgacaaatggacagcctagaatgcaccgttaccgtggaaaacgactgcacatcttgcttcccatcttggtgggtcagctcattgcctgcaccccatacctctcagcacacagccctgggtgacagccctgcaccagcctctcctttgtctccacttgatgttgggagcagggcatcttgcttcctgggccagcaacctcttatttccagtaaaacctgctgccctagagttattccaatgttggactttaattcagatttgttatgttgttgttgagcattgtctcagcataatttggaaatttacatcatactaatgaactccttcatgcagtgggtaaattgcttgttctagtaaatttgagtgcaaattaactctggatgtgcatttactggctcatttaacagattcttacagtggcttagtttcatggtaatgttctctgctcactttgacattgaagttctttttctgtagtagatactgtatattttaactgtgaatttgcagtgaatggatccatattcagaccattaacctactgggattctctttgttttgtttctgtattaaaggatcgggtgataggatttcatattcttggaccaaacgccggtgaggttacccaaggatttgcagctgcaatgaaatgtgggctcacaaaacagctacttgatgacaccattggaattcaccccacatgtggggaggtaggaaacaggaggttttaaaaattggcttcagttgatgtagtttgaaaaactattataaagcacttgtcagaaagatgtcatattagtaactgatttgtatatttttaaatttattttatttcattttatttttttcagacagggtctcactctgtcatcgaggctagagtgcagtagcatgatcttgactcactgcaacctccacctcccaggtgcaagtgattctcccgcctcagcctcctgagtagctg

SEQ ID NO: 32635 - DNA, 1079 bp, Homo sapiens
gagcaattctattatttcaagacagaaagatatttcttggatggcagattctgaggaggtggatttccctaagggcacctaaaagtaaggaggccatagggaccctttttagaatgtccctaaaaccttcttgggcacccattcttcatggggacacatggcatttggtgagtccacgtagttatgaagcatctgttgtgtgttacaggaagggctagtttgatcatggtatttgtctaaagccaaggtaatgggagtgagcaactgacttggcataaagaaaactgttactaaatcacacatcgaacctctaacatcatctaagctacttctgatcacaaggagggccaaatgagcaagaggatatggcccagggccagcatcatgactgttgctgaaagaaaatgggagatgttggtgttgtaaaggaagctcacctgtgtaactacaaaagttagatcgatttatgagaagccatgacaaaatttgctgataatgcataagaattgttttcaaaatgaagactagcacaagtgagctaatgaaaaatgatacttggctattccactgcacttgactataatattttgataattagaccaaggaaaatgacctcatcttacataggtacagagccacaaccttctaggttatttgacacattcctagctgtcaggtgtaagaagggacaaaaacatatgtactttggtataagttctaactagttggaccctgtttttaaatagcatccagataaatttacaactccaacttagatgaattatagatttttcctaagatttttataaaagaaatccataccagttgaacatagggtgtacataaatagctgtaaaactttaaattctgcagtgttctttctcctgtaattaaaccataggcatatcagagtggtttgttacagaagctccttcaggaagatttggcatatgattatgatctcatcatcatcggtggtggttctggaggcctttcatgtgcgaaggtatgaatatagaaatgaaactcgtagataattttcctgatgactgccatagctatttcttctgctacttaaa

SEQ ID NO: 32636 - DNA, 1079 bp, Homo sapiens
ttgatcttgggtgttataggttggttggctgacgatttctttcttacaccgcattcctcctccaccctccccaaagagttaatttttttgagttatatggtgcctagatattatggctatgtaaatattcatttcagacctaagtggtgcactatgattgtttccatttgtttaaaccccccccttttttttttttgagacaggctctcactctgtcacccaggctggattgcagtggtgcaatcacagctcactgcagccttgacttcccgggctcaagcgattctcccaccttagcctcccaagtggctggcactgtgggtgcgcaccaccatgcccagctaatttttttattttttgtagagacctggtttctgcacgttgcccaggctggtctcaaattcctgaactcaagtgatctgcccactttggctttccaaactgctgggattacaggtgtgagccaccgtgcccaaccctagatcatatatattttttttattatagtcataatttgcctcatgttttcactgcagaattctctctgtttacatacttaattcctttcccatgttctatcatttcttcaataacccatctagcatctaattgttttgtttttgcttttgtattgaactccttcgtggagttctttctctttctcccacccggagtgggtgctctctgccccacagtgagttggtcagcctgggacttcccaagactgtcctagtaggatccactgtttcctggtccatgtcttccttttccttggtttactaccttattctgcttgagcacatcctcaaggagcctcttaagaatgcatggatggtagatgtggcagttttgaaacatggctgcacatttattgcctcttctgtcattgagaggtgagtctatgtccttcctcttgagtctgaaacttgtgactgcttcaactaataaagtacagtggaagtactttaagagacttctgagggtgggtcatgcaaggccatgtgcttctgcctttcttgctggaacacttactcttggacctgtgtatctgccatattggagggccacagggacccagt

SEQ ID NO: 32637 - DNA, 1049 bp, Homo sapiens
tttgtttcttttctttttcttttttttttttttttgagatggagtcttggtcttgtcactcaggctggagtgcagtggcacaatcttggctcaccacaacctccacctcccaggttcaagggattctcctgccccagcctcccaagtagctgggactacaggcacgtgccatcatgcctggctaatttttgtatttttagtagagacagggtttcactatgttggccaggctggtcttgaactcctagcctcaggtgatcacccgcctcagcctcccaatcttttatttctttttatttatctttcttgcctaattgtccagctagcaccaccagtacaaacttcaacagacatggtgagagtaaacatccttgtttgttcttgttcttattgggaaagattttagtcttttgccattaagtatgattttagctgtaggcttttcatagatatcattttaaggttaaggaattccccttctagtcctaggtttttgagtatttatatcttgaagcgctgttgaattttgtcaacttgttttttctgactctattgagatgataatgtgttttttttttgctgaggatctttgcatctatattcattagcaatattggcctgtagtgactttttttctttggctatcagggtaacactgacctcataaagtcataaagtgttgagagtgttttctttctttctttttttttttttgagatggagtctcgctctggctctgtcgcccaggctggagtgcagtggcgccatctcggctcactgcaagctccgcctcccgggttcacgccattctcctgcctcagcctccccagtagctgggactacaggcgcccaccaccacacctggctaatttttttgtatttttagtagagacggggtttcaccgtgttagccaggatggtctcgatctcctgaccttgtgatccacccgcctcggcctcccaaagtgctgggattacaggtgtgagccacctcgcctggccaagagtgttttcttaacttttttttttttttatgaaaagtttttgaa

SEQ ID NO: 32638 - DNA, 1032 bp, Homo sapiens
tgcaccaaaacatcaagacttaagaaacagtatggactctgctcagtgtaaccctgtggcagatagtgttccaacaaaaaaaaaaaccaactttatggagacataattcatataaaatacagtttttttttgtgatttctagtgtattcacagagttgtgcaaccatcaccacggtcaattttagaacattttcatcaccccaaaaagaaactatacccatcaatagtcatcgtccccttctgcacccttacccccatccactggcaaccattaatcaattttgtctctatagatttgctttttctggaaattttgtataaatagcaccatataatctggtcttttgtgactggcttctttcacttagcatgatgctgtagcatgcgtagtacttatttctttttccagctgaatagtattctattatatggaatatttaatagtgtatcttatttaaccattcattagttgatggacattgggttgttgggttattatgaataatggtgctctgaacatttgtgtacaactttttttttctttctttctttttctttttcttttttaaagtagagatggggtctcactttgttgaccaggctggtcttgaactcctgggctccaaggatcctcctgcctcagcctcccaaactgctaggattactgtgagctaccacacctggcctatgtacaacatttttaagtggacatggtttttatttctttcggttatgtacctaggagtggaattgctgggtccagtggtaactgtttaacctttcaaggaactgccagctgttttccaaagccagctgcatcatttgacattcctaccagcaatggacgaaggtcccaatttctccacattcttgccaacacttgtctgtctttttgattatagatattctagtgggtaatgaagtaatatctcattgtggttttgatttgcattgccttaacgactaaggatgttgagcgtcttttcatgtgcttattggccatttgtatattgtctttggagaaatgtttat

SEQ ID NO: 32639 - DNA, 1058 bp, Homo sapiens
gggtaagccccacaatgggggttctgtagtgctgtgagcactgcagtatagcaacagcccttccccctcaggcggtttctttcacttgcaattaggaatcgaatgcgtgattcaagtccatgtggcagcatcttgtagctactctgaatccccgtccgtgatgctctctagacaagaccactgtcataagtgcttcctaagtcttggagagaaagtgtgtgccagatccagcatggctacttgggcagcttctggagacagatgcatgtgggccttatggctggtatgcctggcatgcctgtggctgtctggacttgcttagccttggctaggccaggctgaagcctgacagtgcagttggtgaaagggctcagccttggacagatggtgccccctgctggggagctctgctaataggcttccctccctccacagtagggaacccagcccagcccatacctgcagagcctggcatctctcgtctcagaagtaaggtctctcagtcccatcccactcaggactaaggtgcacagaaaggtggccttgatctcagaacctgctcagtggagacaaagctctggtcagcctgagacccgggagatttggccccagccccatctgggctgatttgatcaagggctgctagaggttgtggagactccttgctagactgtagttactcaagtggaaggaagacactcagaacatggatttttaggcaggtcggctcaggtaacgcagattcggttgtttgctttggaagagaattttggcactatgttctagtaggaaatttgttgtagtggtgataataatgtcaacatggtaatgaaaaaagtaatagccaacaataatagccatctgatatgcttcccacagactccacccctagaggggaactacagggcttccttaccccccagaaccacatctgatctctagagctccgaaggaaagagagggggaagggaggtgactaactgagggcttcctgtgtgtcagaaactatacagagcactctacatgggccatctcatgtcctcccaggacaccctgac

SEQ ID NO: 32640 - DNA, 1056 bp, Homo sapiens
actcctccttcatggcctagtcacccccaaaaggccccacatcctgataccatcactatggaattaggacatcaacaggtacattttggggggataaatgcattcagaccatggcactggtttcagttgtcatgtaagtcaccactcatatatcaaggctaactcatgaccctagatctacatggggtctgccctctacctcacagcagagatggacacccacaccaccatcttccccgtgtctcaccacctgcaccccaattacggacacctatgcctctgtcttccctgcgtctctcagcactctacagcgagtgacacacacaccttcatctttcttccatgcttcatgttgcagtggagaggctggggattgggaggaggtgctgctggggtatggggagtgagatctgtgccgcagtggggtgggattcaggagaaaaccaggcagtgtcccaccagttcacttgcttgtaacacagaaacctcttcaatggaaatggaaccctgtctagaatgccagactctctgctgaccattctctctggtcagaactggatcactttatttgatgtaaattgtatttgatttatttttttcttttttaagagatgaagtctcactatgctgcccaggctggtctcaaactcctgggctcgagtggcccttccgcctcagcgtcccaaagtgctgggattacacgtgtgagccacagcactggccataaattgtatttgatttttacagctacctgtatttagccatgtgaaagtgattttccacttatgtcagagatacaaagtttcgtttagggataaattgtaaaaaagaatataggcctgggtggtggctcatgcttttaattcccatactcagcttgagtaccggaaccaagactagtcgaggcaacatagtgaacctcatttctttaaaaaaaaaaaaaagaaaaatggcttgagcagagtggagctggattagctggaagctccacctcgcagaggccgggagccggtggccagggttgggttgctggatttgacgccacctggctgtgtg

SEQ ID NO: 32641 - DNA, 1022 bp, Homo sapiens
cagggactagactgctgcagactcgtagaccttctgcaggcccgtttcactcaccattaggcagggcacaactgctccgagtttcagccactcctcacactggcctgctgtgctctctagggaatcccggttgtgtgttttggggttctgctgttctcaagcccatcagttgccctgtttcttctctctgcgttctccttcacagacactgataacgtgaaggtcttgtggctgtcggtgttttgacccccatccctgtctctgtgttgtggggttcagtagagatactttgttgcctggttttgttgtaaacatggtccgtgggtttttggttttgctgtctacttgctctgtctttatgtgagcccctgtacttctttctctcctgcccatttgatccgttttccacatcattgcttatgcttgcttgatccttcaggtgaccagtatgcactgaagatgaggtttgtggaccatgtgtttgatgaacaagtgatagattctctgactgtgaagatcatcctgcctgaaggagccaagtgagtgtgactgttcctctcctttgcacccgatttctctggttgtacccttgtggtaccctaaggagagcctatgttctaggggcacagtctttgtgtcacttttctctagatttactttatcagggaacatctacttggcctctcttgagtcacatgtccactctgactgccagaatgagagaccccttgattttcttcctgtggagaatgttccatagtggaagagtagttcctcatgcaaatccaggctgtgctgtttaccaggagaagggacagtgggcctgggcagacaaaagcaggacatgtcccctgccccgtaagaagctcttattcatgtgaagagaaagaacattcagaacagctcgtgaggcatctgttcaagcctcccagggattcactgggtaggatgtacaggagagctgtgtcaactttgtgactccaaggagtggggccagtactggtgagaacttgggagtggag

SEQ ID NO: 32642 - DNA, 1044 bp, Homo sapiens
ttaaaaacattctaataggtaatcccagctattcgggaggttgaggcaggagaatcgcttgaacccaagaggtggaggttgtggtgagccgagatcgcaccattgcactccagcctgagtgatagagtgagactccatctcaaaaaggaaaaggtgatctcttaaagataattgcttttgtctttggttcaaaattttgttgtgactttgaactgctactactgttttcagtatcctcagtctctcttacttctcttgccttgttcttcctttagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggtaagctcaggtggagtccagcccatccctgtctgcttcagagaatgtcttgcagagtgactactggttgataggcttgggtggtgtggggtggatgaaatctgcagtcatttctaaggtcatcccaaaagtgtttaacctgcagtgaaatgactccatgggggtcttgtttctccttgggggatcacaggtagaggctaggggtagcatttggagaggtggaatgggtgttggagatggaagcaaggcattccacgcagaggcagtaagagggacaaaggctttgagatggtgtggctgggcagatactggggtagcaaagctgttggagtggttgagggccttccttgaatgttgggccttggttggaacttgaagagagagggagcaattaaggcttacaaagattttgttactatggcaaatcgcaaacatgccaaagtacaaagactagtataaact

SEQ ID NO: 32643 - DNA, 1025 bp, Homo sapiens
aaacaaaacaaaaattaactgggcatggtgttgcaggcctgtaatcccagctaatttggaggctgaggcaggaaaattgcttgaacccgggaggtggaggttgcagtgagccgagatcctgccactgtactccaacgtgggtggcagagcgagactccgtctcaaaaaaaaaaaaaagaaacaaagcttttgtccccatctccaccagaagtgaagaaaagaatggcttccagcttgaggaatggggaatggggatgatggtactacactactactactactattaaatactactgctactgctacaacactacacattcatatctattcttagaaggtattaatcccagaaattcaggttgaggttgggaaaagtaggttccttatccttgggaatctgtttacttacctataaaaccagagtgtagtaaataggaatccctgtcctggctgcctagccaggttgttaggaggaaagagagatttggtgtcctatactagcattcagaatgacttgtgatgggacactgtttgcaaggctggggaaagcaggctgtgatacctacaagtgggagtgtacatttttacaactccatgaggaggcaagctggcatatctgttaatgtaacattaatcctttgtaccaatcctttgattaagcacttcagggccaaggaaactatcttacatatgtattcccccatgtgcacagacaaacgtagaaagaggtacagttgagggctgtttgaatggcaaaagcatggaagcaaactaattgttcataaataggggactggcttgatttttgaaaaatgacacatcaagcctgagcaacatggtgaaacgctgtctctacaaaaaatacaaaaatgagctgggcgtggtggcaggcacctgtagtcccagctactcaggaggctgaggcaggaggatcacttgagctgcagaggcagaggttgcagtgagtggagatcgcactactgcactccaacctgggtgacagagtgacaccacatctcaaaaaa

SEQ ID NO: 32644 - DNA, 1047 bp, Homo sapiens
cactccccacttcccgagctcctactcgccaaattatccttaaaaactccgatccctgttttgggggagacttgcttgttccccgactgtagcattgaccacagtgttgggaaatgcctccagcttccattgtgtcaactccttgagaagaaaaagaaatccctttcatctcagcaagctaagctcagcaccaaaaaagattacattgctaacacaacatcaagaaaaaagagctcaaaactctgcaaggcgtagagtctaaactgcaaaatatttgcaggcatcttttcagattattttaccttgtctaaggtctctcacctggtttcttcatcagtggttgatatttacttgcttagcattcagcttcacaagaaggtatttggaaacaactgcctttgtaaattatccccataggtaaaacaaagaaaaatatacatatgttgcaaaaactgtttcaattttgagctgctgtacttttttgccaaacaaatgtagtcaaatcagtcaagtactctgttaatgtgtcaaatgtttagtgtacacaggtctccctaaatcaaccaaatgagaaatccagtggcacagaattttacaaaacaaaaattagaaaaatgttaaggcatagtttctaattgctccaatagagtatagcagaagagttttgctgtttcactactatactagtttctaaattcagtttcctcatctgtaaatatgagtatgataccctttatctcacaggacttttaaaaggtttaagtaaatccacatgaaagcacttagcacagcaagtgataaaaatgacaatagttacactttgatccttccatcttatatttaagtattagcctctgagaaatatgatgttgttttaaacagtttcccctgttcagtgtactaaaagaaaaacttcagctgaattaaatttaaaggagcttaattggccgggtcgggtgcagtgcctcatacctgtaatcccagcactttgggaggatgaagtgggcagatcacttgaggtcaggagttcgagaccagcctggccaa

SEQ ID NO: 32645 - DNA, 1054 bp, Homo sapiens
attgcactccagcctgggcaacaagagcgaaactcagtctcaaaaaaaaaaaaaaaaaaaaagtaaatttaatcaaagttaaataaaactaagaattcagttcctcagttatgctagctacatcaagtgctcagtagctacctgtggctcacagctaccagtgcagccagaaagcgtttccatcatctcataaagtccagttggacagtgctgatctacaacttatattaaaagttaaatagtttacagtcatttttcccagaactgtagttctctcttgtttgtactacaattatatgaatctagaatgtgactgtttatataaacacaaaatatatacaagtgagggtcctgctgcggtctcacatcctcaaaggaattattggactgatgagcaaaccactaagacaaacactgatgagtggactgactgggcttctaaatcccatgtgagtgaaggtagccagccctcgctaaacctaaacctacccaggacaaacttaaagctgggtccctgtcttcatcacccaaaagggtagactccaggtggactgaacacctaaaagatacaattaaaacaaaagaatatccagcagaatacccttgtgacctaggaacggaggaccactcaagaattcaaaggcaaaaatcataaagccaaaagaatttggtgaacctgattacatcaaagaacacactggggccagctggcatcacttggtcaaatcatttatgtgtctccacaagacccagcaacccctctcctgggacagttctcacagcaggctgctgcacggtggtgtgggggaggacacgcacttggtgtcatctggagtggcaggcagttggaggcagcctagtgtccacccctgggagtggatggaggagtttgcagaggggaaaagcagccagaagatgcactcgcagaacaacatttggggtgggaactccagcgccgagtggggagtcagaggcacagtgagacatgtgccacaacgccgccaatggggtgcaaacagacccgaaagactcacttcgcaagaacacatcccaa

SEQ ID NO: 32646 - DNA, 1021 bp, Homo sapiens
ttggctgatgtctaggctgctgctcaggtattatcctgggatttatctctctttccatcatcctggcatctccctttgcctcccttttcagttgaactctctgttttctggatcccacattttcttattttttgttgatttctttaggtagaggaactttcagtcactccctgaggaagggtagcaggaaggtgaatttttcgaggactgtatgtctgggagtgcctttattaaaccctcacacttgactactggttggttgggtagagaattctaggttggaaataatttttctcctcattttaaggcattgttttgttggctgtctaatgccacatgggtcttttgtgttctttcttcttgcctgttgttctggaacttctgcccatggatgcagtgtggtctgctctgctccattgtgtgtgtgcctggtgggcccctcagtcaattctggatacttttcttgaaatacttgatttcctctccttgattgtattgttctctttttctgaaactctgattatcctgctctcctaggctgcttcttaattttcttttcttttcttttctttttttttgagacagtctcactcactctgtcgtccaggctggagtgcagtggcgtgatctcggctcactggaacctctgcctcccaggttcaagcgattctcctgcctcagccttcccagtagctgggattacaggcgtgcaccaccacacctggttaatttttgtatttttagtagagatggggtttcaccatgttggccagcctggtctcgaactcttgatctcaggtgatccttctgccttggcctcccaaagtactggaattacaggcttgagccaccgcacctggctttcaattttattttctctcttttccatttctttgtattttttctctactttggagggatttcttcaactttatcttccaaccctgatgttgcatttttcatgtatgttaatcatatttttaattgagctcttttttctttctgaatgcgcctcaccaaa

SEQ ID NO: 32647 - DNA, 1021 bp, Homo sapiens; identical to SEQ ID NO: 32646

SEQ ID NO: 32648 - DNA, 1021 bp, Homo sapiens; identical to SEQ ID NO: 32646

SEQ ID NO: 32649 - DNA, 1021 bp, Homo sapiens; identical to SEQ ID NO: 32646

SEQ ID NO: 32650 - DNA, 1021 bp, Homo sapiens; identical to SEQ ID NO: 32646

SEQ ID NO: 32651 - DNA, 1050 bp, Homo sapiens
atagtttcctcaagaaaatggaagaagagggaacactttgtaactcattttgtgaattttagtatcagcattaccctgatgctaaaatcagaaaaagatattatgagaaataactactgacaatatttcctatgaatatagacaaaaatctttaatgaaacattagcatatcaaacctagcaatgtatggccgggcgcggtggctcacgcctgtaattccagcactttgggaggccaaggtgggtggatcgtgagatcaggagatcgaaaccatcctggctaacacacggtgaaaccccgtctctactaaaaatacaaaaaaattagccgggcgtggtggcaggtgcctgtagtcccagcttcctgggaggctgaggcaggcgaatcgctggaacccgggaggcggagcttgcagtgagccgagattgcaccactgcactccagcctgggcgacagagcgagactccgtctcaaaaaaaaaaacaaaacctagcaatgtataaaaaggataatacatcacaactaaggaggatttattctggaaaaacatagtagattcagcattcaaaaataagttaattcactgtgtcattccaaagaagaaaaactgtatgatctaagtagatgcagaaaaagtatttgacaaaattagacgtttattcatgataagaactcagcaaactgggaataaaagggaactttttaccctgataaagcacttcttttttttttctgagacggagttttgctcttgtcacccatgctggagtgcagtggtgcaatttcagctcaatgcaacctccgcctctcaggttcaagtgattctcctgcctcagcctcccgagtagctgggattacaggtgccagccaccacgcctagctaatttttgtattttcagtagagacagggttttaccatgttggcaaggctggtctcgaattcccaacctcaggtgatccacccaccttggcctccctaagagctgggattacaggcatgagccaccacacccggccctgataaagtacttataagaaacccatagccaa

SEQ ID NO: 32652 - DNA, 1050 bp, Homo sapiens; identical to SEQ ID NO: 32651

SEQ ID NO: 32653 - DNA, 1050 bp, Homo sapiens; identical to SEQ ID NO: 32651

SEQ ID NO: 32654 - DNA, 1050 bp, Homo sapiens; identical to SEQ ID NO: 32651

SEQ ID NO: 32655 - DNA, 1034 bp, Homo sapiens
aatagggactggagtatgatgtggagaacagctgtaagctgaaaccggtaaattatttcatttcttagagactcacccaaattagagataatatataccattctttggattttttttttaattttatatacgcacatgtatatgaatacacccatatttatgtatgtttgttttaaacactgatagacattgtttcttaaggtactataaatatgccatgaaatagctataacctagtttggctgtctctctattgcaggacagttaagttctttccaatattaaatacaatgcaatcaatgtttttcctaaggagagattgtagaatgaggtttaaggcttgatgaggatcatctggaatgaaaacttcaaatgtttttaggccattagatgatttaggcttaaggcctgaatcagttctgaatgttgtttgaaacttgtaaatagtataatggaaatgtgttatttttttctccttaggaacgaagaccctttctggcctcagaatgtactgaactgcctaaagctgagaagtggagacgacaggtatgttctgggtaaatctgatttcagtagaagtaacaagtctctcatttcttcttattatctaaatgactgttagaccaaaagtctaagtatttttaaatactaattttgaattatagtttttctgtgctttctaacatattcaaaaattattaaaatgtattacttttttttaatagatcattggagagatctctaaaaaagtggctcagattcagaatggtaagcaaacttgttcctttaaagtgcttgattctcaaatccacaattagacttgaggacttcaatactcctttcaaaataatcaatagagcaagtagatagtaaatcagtaaggacatagaagagccaatcaatacgatcagtcagtttgatgtagttgaaagttgtagaatactctgtctcacaacactgtacctaacaataaagaatacgtcattttttttttttttttttgagacagagtctcactctgtcacccaggctgg

SEQ ID NO: 32656 - DNA, 2656 bp, Homo sapiens
atctgactgcagccatgagcagcaatgagtgcttcaagtgtggacgatctggccactgggcccgggaatgtcctactggtggaggccgtggtcgtggaatgagaagccgtggcagaggtggttttacctcggatagaggtattttgtcgaatagaaaaatttgaagtacttcagtatttgttagtatcaagactggtctgactagccgaattctttgtttttgctcaaaacaggtttccagtttgtttcctcgtctcttccagacatttgttatcgctgtggtgagtctggtcatcttgccaaggattgtgatcttcaggaggatggtaagtatttaacacttccttttcatacccctctagagcttggagaggtgagcacatgcaactgtgtatagcatttccacctttgaggttttgtattgtataatttaaaacgtaacactttgtaaaggttttatagtcttggcctgtttcttttccttattgttgaagcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtaaggtgtcagaatgttgttagaagaaaactcattgcagagattcttccagagatgaattagctataaatggaagggccttagtaaattcagtgaaacttagctgtgaccagataagaccaattttcagcatatgtaactggcagtctatctgtatataattctgtattctgccctgatatcctgtggcttatggtacctgggcagttttcacaactggacttttttaatatataaaagtaagagtgttataatttgaaacttccagagacttcatagaaagctctgtaatatacataaatcttttatcatgtaaccagaaatctttgcctgtttgtgacatgtaagtgtataatttgataaatgttgttgtgtacatatctgtgaaaccttaggggttaattgcatgaaaacaaagatcaggcgttttgttctgcatggtgactgttgctttggtagacagtttttttctgaggcccattgtgaaaacttttaatttcttttttaggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttattt

SEQ ID NO: 32657 - DNA, 1051 bp, Homo sapiens
ttttttgagacagagtcttgctctgttgcccaggctggagtgcagtggtgcgatcttggctcactgcaacctctgcctcctgggttcaagcaattcttgtgcgtcagcctcctgagtagctgggattacaggcatgcaccaccatgtccagctaatttttgtatttttagtagagacagggtttcaccatgttggctagctggtctcgaactcctgacctcaggtgatgcatctgcctcggcctcccaaaatgctgggattagaggtgtgggccaccccgcccggcccagaccttatcttgactatcttagtcatttcttctcttgcctgacatgccctgtgctcctaccaccctttaaagtggtttgtgtcataaacatttgatacacaaaaatggaaacttaggacaaatatcttgatgtctggtggttgaaaatgtgaactgatttggaaatcaccggtgtttctcctcttaatctcttctccattccattcaggaaatagactgtaaggtgggaaacaagtataagcagttagcctcactctaaacctgctatgtaatagacattggactgagttctgtctactctctgtaagcaatccaaggtaattggcgaaagtggaaggaatatgtactcagaagaccaaaactttggtttttaaattgaatatctattaagcacaaggtaacaattcttaccacacacatcagttttattatttcccttttacaaataagacacagatgggtagtcagatgtctttgaggtaacacagcaagtagttaaactgggttaagtgattaacccaggttgagtatggttccaaaatctcttacagtgtcaggcaggctacatcagtgcagtatacgtacatcaggtttcacgaaaaattttttccagagaaaacacaaacccaaggaaccttcagtaagtggtgccttatattagtggtttttagcaaaaggaagaaacttaagtgttttcctgctgcctgacaaaagtgaaaaacagtattttggtttttattgaagttagcatgtatgtttgta

SEQ ID NO: 32658 - DNA, 1133 bp, Homo sapiens
taaactgccaggatcctaggtacatgctgtttttagtttgttgagcctgattcttgtctacaagagttctttgtgtattggaatataaaaggaataatttattacattcccaagggcagaattaaagacttaagtttttccgatttcatctcttgataagtttttctttaaaaaaataacagtttgtgtttttctgaggaaccaaaggtcctcttttttttcatattggtaacaggagaggtaatgtatttcagatggtgcagtctgtaaaatattttgaaccaaatcagtggaagaccaggggtttttctttttttttttctgagacggagtctcactctgtcgcccaagctggagtgcagtggcgcgatctcggctcactgcgacctccgcctcccggattaagcgattctcctgcctcagcctccgaagtagctgggattacaggcgcccgccgccacacccagctagtttttgtattttagtacagacggggtttcaccatgttggccaggctggtctcgaactcctgaccttgtgatccgactccctcggcctctcaaagtgctaggattacaggcaggagccaccgcgcctggccaggtttttcttaaactggcatttgaacatctggaacaggcagggagatgtcttttttaaagtataaatgtgttttgttacatgatttatgacaattctacttgtctttttttttttttttttttttttttttgagacagagtctttctctgtcggccaggctggaatgcagtggcacagtctcggctcacagcagcctccatctcccgggctcaagcaattctcctgcctcagcctcccaagtagctgggattacaggcgtgtgccaccacgcccggctaatttttgtattttttgtagagacggggtttcaccatgttggccaggctggtcttgatctcctgacctcaggtaattcacccgcctcggcctcccaaagtgctgggattacaggcctgagccaccgtgccttgccaacaattctacttgtcttttaaagttcaataaaaatatgtggcacgtatatgggatagtaccaaactggtgcctaaaagcagtgaaaccaccattggactaattggaatgatttgtct

SEQ ID NO: 32659 - DNA, 1031 bp, Homo sapiens
ggacaaaggcggcaaggccaagaagacggcggccgccgggggcaagaaggtgaagaaggcggccaagcccagcgtccccaaagtgcccaagggccgcaagtgagcgtgtcggccggtcagagcggccggcgtgggcttttcggtgtttttgtttttctaccccaagtgacgtagattttgtacggctcacgccggccggggccgcgaggcctggtctgagcctcagggaggggccccgggtcctctcagtctttcccctcccccaacgatgtagcgtttttcgttgtttgctttaggtttttgaaacagccccggcgacgcctctattggctctcggccttggcaacggccgtcgtcatggttactggcccctaggcgccgatggccgaggccgcgcctgcccaccgggcggggtcgctggttggccgggcccaggcgcgcggggacgcggaggccgcgcatcctttcccagctccccaccctccttgcctttgggtgcgcgacaaacaatcgctccgggctcagggctgcgcggctcttcccttcattccatgggcctttttttgggcacaataaagcgtttaaacctttcagcctctctcgtttaatctgagtggaatagggatgggcgccttcggcacgcggggttggatggcgggcccctcgggtccttataccccagatctgttggccagggtaggcctggagccaggggccttcagcaaggggtgggaattgctggcttgggacgaacttaaagtacctgggacagggagatagacaggatcggtcccttaggagggatggatctatctgcccccacagggggtccatcggccattgcggggagcgggatgggggaggggagaggaggggggattaatgggttttcagagttaatggtcagggacctaaacttggcctccagagaggtagttcttacaaagtcacaccagactggcctgtaaacttagtcattctgactccagcgagggttagagtgagatgtgaccaggacgaagtgtggtggc

SEQ ID NO: 32660 - DNA, 1054 bp, Homo sapiens
cacaggaccaggcttcctgtcagagactgaggacccaggaagaaacatgtctcggcccctgtccccctccacaattcagaggccacattctaacaggggaggctgaccaattaaacagataatgacacctcctagagctaagagctctccgactatgaaccagatgcctggagaacacggatgaatggtctgagcatgagcaggggtgggaggcagcgttaagggaggcatcagagtcagaacctagcaaacaagtgtttgtgaagaagaattcatagaaaagggcaatgcgggcatcacatgggctaaggaacagaggggtagcagtagctgttgtgccaagctgcaggtgttatacactaccctctagatctgggtttccttaaaacaccttgagaggacaaccctgcaaagcacggcacagtggccgagagggaaaggagcattcgaggtctcagtcctcgctctgagcctacttctctgcttctgggctccagccatctttgtggaaagggggctgctagtgacaccctctcaagggtctttccagctctaggtcggctgtgctggagtctaggatttgcccactgagaaatctgtttccaagttccttcaacctgatgcatcctgcagcatcacggcagctgttcagagtggtcagaaggcccctgaatgagctcagtagagggaagcctgggaacagggaggcacctgcagctctactcatggcctggccagagctcagcagctcttctctgccatctagtggggatggcataccatcactggggaccaccctgtgcaaactggtgagcctgagtgcctgtcacagagggaaagaaaggggggggatacaggatttagatgaaatagcaactcctaccctattgtcaaaatcatccagctttttcaaaacatcatattgtactgatttttttgtgtttttgacagagtcttgctgtgtcaccaaggctggaatgcagtggcatgatctcggctcactgtagcctctgtctccctggttcaagcaattctgccccagcctcccaagtag

SEQ ID NO: 32661 - DNA, 1043 bp, Homo sapiens
aagctggtgaaagttttaacgactgctggaggcaacatgcttccacactgacagaaatcatctttcaaaaatcctgcacatatctcaggcttatgaaacaaactaattcctaatagttggaaatgaattaaaagcttgcggtgagataaaagatagattttggctggatgtgatgactcatgcctgtgatccctacactttaggagggcacagcaggaggatcgcctgagcccaggaattcaagaccagcctggtcaacatagcaagactctctctctgcaaaaaaaaagaaaaaaaaaaaaacctcccaaaaaaaaggttttactaggcatgaaaatgagtccatttccattctaggccccaggatatcaccatgaccaataaaaacaatctgtggcactcagcaggtgcatgtcaacatgggcaggttctttctccccgtcagcaggacaagaacatctcccctatccaaaaggcacccactgaggatccgcagttctctggaattatgctgagcacccagatgtgtgcaactaagccctgagcagtcgatgtggagcgcacttgaaggcacttcatttttttttaagatacactcttaggagtttactttaacccacttcccagctcatagcacacgaggagaggcagacattttaaccttggtaagacctgacaaatgacaatagttggaccccacagcaatcattacttttgtagacagcaaagttatgctccttggcttcaggtgaagacccccagatccaggccagtggatttacaagtgagagtcagcagcactgggcatttcaggcaatagctctgaacaagccctttaccatgcgggtaggtaaaccccagaatatacagatgccccttacgatacatgggtggggagggtatgtggccgagagagcataagcttaggagacagagtggatttgaattccactgagcttttggctgtggacccatggggacgtggcatatgtctcgctgagccttagtttcctcctgcatggaatagggagagcaatagtacc

SEQ ID NO: 32662 - DNA, 1025 bp, Homo sapiens
ctgagttaaaattttgttatccccggaagcagagatgcactgactctggtgatctcagtatgaatgtggtatgaaatcttctaggtgtctgtggtggggcctgagggagggtaggaaaggtgacgaggaaaaagtagagggagcctgaacaccctgggtctcaggtacggagtgaagaaatcactaaggtgaaaagacaggctggggcccaggagctcgtccaagtcctgatgaacaacaagtcctgggcaacatcacaggccaccaaacacaccttcagctccagggtcgaatagatggtggaagagcacagccatctggaaaatcagaaaaaagtggggaagattttctatcttgaacttgtgagctggagaattaccattagtagcccactaataggttatggccgatgagtcccttcataacacactgagagccacttttgacactcccagaaaaggcaggttaacaaaaccccttgatggaaggaagaccctcattgcccaatgtacccaagcctctttgaaccttgcttagactgaactgcaaatgtcttgactgctctgggctccttagtgcaactccttcccacagaagccatcaggagcctggtccaggaagctcctctcctacacctgccttaaaaggcccagctctgctggggagtaaggttcatgggggccgtcccaatgcaaaagggaatctctgccatcacccactgcaaccacatggtagccactctgcagccggcaggcgtgaggcatgctgcgctaacatgggagggcggaggctctgcctgacttcccagaagcccagtgagaagtccaggacaatcagcaggtgctatgggaaccttggctggcaggcaccatgtcgtcctgtatgatcggcaggaccggctccttcctgaagacaccgattcttggcggctcctgacaaggattgagaggatttgtgggggacagccctgaagccctgagccctcaactcaatgaagggattgtgctggtgtagacccacagcca

SEQ ID NO: 32663 - DNA, 1026 bp, Homo sapiens
gaaaactaaaaaaggatgtaggaagagctgttcaggttttgttcaaagtgatagcaaaagagaatctgtgtgtaataaagcagatgctgaaagtgaacctgttgcacaaaaaagtcagcttgatagaactgtctgcatttctgatgctggagcatgtggtgagaccctcagtgtgaccagtgaagaaaacagccttgtaaaaaaaaaagaaagatcattgagttcaggatcaaatttttgttctgaacaaaaaacttctggcatcataaacaaattttgttcagccaaagactcagaacacaacgagaagtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactggtgagaaaatatttcaaggtatccagtgctttcaagcactattaaacattatgtgatgagaaatttataatgctgcatcttgtattcgtgcccatacatggttaagatgtgaaaatagagccaagaaatagggccaaatatgagataccagttgatcctaatactttatcttaaactgatattcaagcagtttcctatggcagagagaaaatcggctgactgctgtcgtgatgccatggcaaaggagagtattactattaacagctgccatcgtctctccctggtgcagcagctgggactctcctcctcagcagtgctttcccttcttcccatcctctttccagccagtaatcttaaaacttgaaggaaaattaaaagccttcacttgtgaaaaatttagggaaggcttcttatatacataaatgagtggagaatagttggtgtcttcacacccctcctgatacttactactaagtgtgacttccaatttaattttgtatatatcatagtcatttttatcttctattttaatgtaatgcttctctaaaatgctttagagctctaaataattcaa

SEQ ID NO: 32664 - DNA, 1067 bp, Homo sapiens
actgagaggatccaatgaggccccctcagcaagaagctcttactctgtaggagacaagtcctgcagtgtgagtgaactacggacaacagcaaaaagccttcaggaaaggcttcctaattcctaaaggagggatgctggagtagggttggtttgtttgtttgtttttgagacgggatctcattctgtcacccaggctggagtgcagtggcgcaatctcagctcactgcagcctcgacctcctgggctcaagtgatcccctcatttcagcctcctgagtagctgggactacaggagtgcaccaccacatccagctaattttactttttgtaaagatagtgtcatgctgtgctgcccaggctggtcttgaactcctgggctcaagcgatcctcctgcctcatcctcccaaagtgctgggattacaggtgtgagccaccgcgcggggcctggagtgggttttataggagtcttggttaggccaagggtttcatcagcaattgtaacatgaacagccttgcagacaaggccatttccagagctcctcctctgtgccctccaccctggcaccttctctttgtaccctcacactctcccccagctctttcctgccctccccattttacagatgggaaaatggaggctcagagagaggtatggcttgcctcagtttacatggagagagcgagaggcctctccctatgtggctgggccggtacctacccctcaggcccagctccctgcccggaccctgatggcctgtcccttgtcccccagagtggttcgcctccagcacacagagctacatccttcgggacctggacgacacctcagtggtggaagacggccgcaagaagcttaacacgctggcccattacaaggtgcagccctgccccccgcccccatttccccaccctcatgcccccaccccaacctccggcctctgacctcggcctctcccctcccatcagatccctgaaggtgcctccctggccatgagtctcatagacaagaaggacaacacactgggccgaggtagtgcgggtgcacgtgggaagggagcccaggctgc

SEQ ID NO: 32665 - DNA, 1069 bp, Homo sapiens
attcacatcaatggtaatatattgaattcaataatgaactaaatgtgttttatggctcagagatcagcatagctcctgctcagatggcaaactgaggtaatacatcccagatgaaaaaaagaagatgttatccctaggttaattattggcgtttcataaatatttcaaacttggtgcattattgtcatgaaaatatgaggaagaaggtgatcttgtatatagttctttctagcaaattgttacctggtacagattaagatgggaaccaagaaaaggattgtaatttggcacttatactggggatttttattaccctaagaaggttattttattactcattactcattactctgttactgcttaacagagagcaggtttgtttttttatttttagagacagggtctcgctctgtcactcagactggagtgcagtggtgcagtcatagctcactgcagcctggaactactgggctcaagtgatcctcccacctcagcttccctactagctggaactatgggtgtgtgccaccataactgtgtaatttaaaaaaaaaatgtgtagagagggggtctcactatgttgcccagggtggtcttaaactcttggcctcaagtgatccttctcctttgacctcccaaagcactgggaatatagacgtgagccactgtgcctggccaagaacagtttctagagccttcttctttgggacctattcaaattcaccaccacaagccacacccagggatgacctactgaaggatttttttgtcctgaatttgggaaacttgacctccccaaatttagctaactatgttgaagagtgaacatttatgcttttaaatctgagtatcttgtctttttcttcaactcctttgaatggttctcacccacatgaaaggattaagtatacgtgctttggagtcccttgcctaacaaaaaccttttactggataaaggtcacaaaatatgggctccgaaagacctgatccttgtccctgacttgttaacttagctcttactgttcctgtccctgagttttcaagttttcttgctcaaggttatcacctt

SEQ ID NO: 32666 - DNA, 1029 bp, Homo sapiens
ggctgttgaaaaagggaaccacttttcagttggtgccttcaaaactcatagctaagtgctaagtattaatgcctagagcatggaattcccctttaaggactttgttcctaactcagagtatatcacgactgttttcctcccctgtcctgtgattctgtagtccaatgtaactttctctttctttcctcctttactctccctctgcaccccactcttcttcttcctctcctctggttttttcctctctccttccctttctttcactccatcattctcctctcttcccctccccttatttcccattttctccctcctttaaaaaaattgtttctgctagaattgggaggagttccagtagtccagtgattcatggtttcaggtgttaaactaccttactgctgaagctatgggttagtttttttagaggctgaagacgttgggttctatcagctatactcttgcaggcatgttgatgattctgagtaggagccaggacacactatggctccaaacagcccaagtaggacggaagtcagattaaagacagcctagtttatttcttcagttactacataaggaaataaaatcacatctaaaatgtgatcacttgtaaatatggggatacattctgaggaatgcatttagggagttttgtcaaagtgcaaacatcgctgagtgtgcttacacaaacctagatggtataacgcctgggctatgtggtatagcctattgtttctaggctacaaacctgtacagcaggttactgtactgaatactgtaggcagtgtaccacagtagtgtttgcatatctaaacatagctaaacagaaaaggtacagtaaaaatctggtattatagtcttatggaaccactgttgtatatgcagtccatcattgaccgaaatgtcattatgcagcatatgactgtatgttgaaagtttagtgtagagattttttttttttttcattttagagatataatcaaatacaatcatggctcactgcaacctctgcttcccaggttcaagcta

SEQ ID NO: 32667 - DNA, 1027 bp, Homo sapiens
gttgtgatttttttcttattttttgacttttctatatcagctgtatggaattgcttcttagcaataactaaaacattttgcaaaatcatgtttgatggaaaaggatgaccaagggaaccagaaggagaaacataacttgtggtcattcagttgtgaccttcagagataatccaagttttctcatgtgtctctcaacagacagaagccagaaatttccagagcaaagaatgcagactaacaaacctcttttcttttctttgaatagtcataattatgcttttttttccctgctttttctatagtctgaagcgggagaaggaaaaataaagccttcctcctgttatagagttgttgccactggaacagtaataggctgagaacataagtatggaggtggaggaaggcaggataaggagtctgctattttcatagctgtgcgttggtgggtatttgtcttgggttcattgtcattgctgtttgatatcaagtggttgtgaatgctgtatctctttgcctctactatgactgaatctcttttatgttctcttttgtatattttctttgccagactcaattctattgatatgaagcctttttctgttactgtttatacatattagccgttattagagaaaaaatagttgtagagagtagccctccaatatttatggacctcaaaaaagataaggatgttgtttttctctttaaaatgtatgttttacttttagcagattttggagtcttgcttctggattctttaataagtgttttattacaaattagagaaatgagttgcattagatttgcaaaatcctaccagaatcaccttgctttaagttggatcttatttcttatgttttttttctaaacattaaagtttacttttcctcatcctaacttaggcaggtgttactggaaggtatattcctatctcggagagccaagtttcctagctgcttagagtggccacagaagagatccattgacacctgactttttgctgactcattggttatgtaagccttgt

SEQ ID NO: 32668 - DNA, 1034 bp, Homo sapiens
agtggatacttgcaatacttcactcactgctagcaactggaggtggctgtgaaaattgtacagtagcacagtatatactacagttaattttatgcagtttatgcagttacgatttaatactgcatctttgtttacatttctcttgactgcaaatggcaccatgtaagtgtttgtataaattttgatagaattaacttcagatttgtacatactttatggtgttaaatgataaaataaacttagtgtctgcatatgttttatgcattcattcacgaatcttaattttttggtattcctaggttatgcaatttgccattttttcccaaattgtttcaaatctccaaaatattttccaatatattggaaaaaatatgcatataagtggatccatgtagttcagacctttgttgttcaagggtcaactatgtatttcatagtatcacaggaattcattgaagaattttaagcagaggactgatgtgatttgacttaggtttttaaaggatcattctggttgtagtattaagaacagatatgtgggcaagatagaccagttgggaaatcattttagtaactcagacaatatatgatcatggttcagactaaagtacaagtgaagattataagatgtagttggattttagatgtattttgaaggcgatgctaacagaattttctggcaggttggatgtaaggtatgaaagaaatcagtaactatgaggattttaacctaaacagctggaagaatagatttgtcattaactgagatgtaaatgctgctggagggcaggttttgtgggaaagtgctggagttcagtttcaggtgtccatcagccatctaagtgggaatgttgaataggtaagtgacatttttgagtctagagactcttagagtcataggatactaaggagaaagttctaggcagaaaatgtaattagggagaagaagaaaaggaagaagattgacctatgagagaagaggaaaatctagagaggatggtgtactggaaaaccaagtatggaaattcttcata

SEQ ID NO: 32669 - DNA, 1050 bp, Homo sapiens
gtcacagaggtggtttggggttcttcagctaggtcgtagtgcccaggaacagatcagatcagaatcagtatgttgtttatgatacagatcaaattaactaatgattcttccagttttcttcttcctgattatttcctccagacacaaaatagggtcaaggagaaaagttcttttctaccattaaacttttgagctgcctgtgtttgggattcaaagtattttgggtgcttattgcttaactgggctgaagattatctcatgtgacaccatagatctcttgttttggaattgccattactttctagaacaggcattctgtacagctgccaacatgccctgaatcctcttgcttcatattacagtgatactgctttgtcagggtagaattcagcctcacagggctggagtaagtctctgctgacctcatgccacagtacaacatgttcaaatctgggagaaacctgagggttattcggcatattcctcctcctcctctctcacaagcatggagccctcactctcctcggaaaccgtatgttgtatatgtgtgtgtatctgtcttttaaaaaaaaaaaaaaaaaaatctcatcctgaatcctatagttagttagtcctgcagctttaagtgggggctggttgaatagacagacaaaggaaatagcctgagctgctgaaacttagcgtttttcagcagtagatctcagccaggggcatttgctattttaggactgacttgtgtaaggttgtaataatggagaagcataatatgtgtttcctagttgttcattttacccaaagctatttggacagaatgtagagggtgctctgtagctgtatggacatgctcagatcatcctggagtgtcccgtctcttgtgtgtaatgggctgcttcattgcagagtaagtgtcatcctcactttctcaagcgaaatagttactggaaaatcagtgtttctttcaatgaacaagagtttcatttgccttggactgcttgggaaaaacatgggttaaattcgaagatgccaggcatgcataacaaataggaattt

SEQ ID NO: 32670 - DNA, 1206 bp, Homo sapiens
taattacaaaatttcattttaaaaactgttatataaccattcagtttatctatttcatcttaggtgattctggtagtttgttgtttgagaatttggtccgcttcatgtaaactgttgatttatgtacacacagttctttgtaggcattccctattatccttttaacacaattccaatcagaaatctcagcaggacctttttgtagagatagacaagcttattcttaaatatatatcgaaaggcaaaagaactagaagagtcaaccatactggaaaagaaaaataaagttacgtgaattattctgcccagctttcagacttaccataaagctacagtaaccaagatgaggccatattagtaaaagggtacacatgtagattaatggaatagaatagaaagttcagaaatagacccacgtaaatattgccagttcatatttcacaaaaatacaaaggcaattcaatggagaaaggatagtgttttcaaaaagaggtgttggaaaaagtagaaatctgtaggcaaaaacttgaacttctcacaccttatataaaaattaacacaaaataaatcataaattaatatataaaataaactatgaaacttttagaacaacacaggaaatttttaatctgtgaaagatgctatcgagagaattaaagggcatgctgcatattgggagaaaaatttgtaaatcacatatctgacaaaggacttatattcagaatacagatggttcctgacttaaaatggttcaacttaacaatttttttgactttacaatggtgcaaaagcaatatatgtctagcagaaaccatatttcgagtacctgtacaactattctgttattcactatcagtacaatagtcaataaattatttttctatttttttattttatttatttaaaaatttttttaaaagcagagacaaggtctcactcgttggccaggctggtcttgaactcctgggctcaattattcctcccatctccgctcaatattcctcccatctcagcctcctaaagtgctgggattacaggcatgagccactgtgcctggcctcattcctttttatgaaataggctttgcgttaggtgattttgccaactgtgggctaatgtaagcgttctgagcaatttaaggtaggttaggctaagccatgatgttcagtaagttaggtatattaaatacactttcaacttgcaata

SEQ ID NO: 32671 - DNA, 1036 bp, Homo sapiens
ctgggattatatgcaggtgccaccacactcagctaatttttttatatttttagtagagacggggttttaccatgttggccaggctggtctcgaactcctgacttcaggtgatccacccgcctcggcctcccaaagtgctgggatttacaggtgtgagccaccatgcctggtcccatcttacttttttaaaatgagaaaagattcagctgtgtctatttaaaggcttctctctctctctcctttgggaaggacatgctttgtgcagctaaaatggagaaagagtggctaagatccttaggatccagaatgtctggcaacaagccctagtggctgcaatcacaactataaacatacagcatttcccatcagggcatttgctctgaagaggaggattcttgtggaaacaagtaggcttagagaaatgcaaaactactcttggcacaggctgagctgcggagtgaagcgctcagtttagcactgtggctgagaagctgttggtgttattctctgtgctcacaagagaaggtgtacagttggtgtaggatatgacaacaaaatgttttataatctcatcatacaagcccaagagaagagtgaatttcaagaagtgtgagtgcatgtttaaaattgtaacgaagtttttttctctttgtttttgtacttttgaataaaaatcttcctagtagatagcagtgcctccagaaatggtagctgataccttgaaatctagtttaatttcatttagcacatgacagtgcagtgcatgtcttacaagaaatttttattctctccattattactcaatatgtctacatctccccttgaaattgctctattattgtgtgataatggagaaatctcttaaactttctgaactgtgaatttttccttctgtggagcagtgaggaagattcttgatgtactctaaatgattaacaaaaagcatcataatagttcaaggcacagataggctttgtaagctgaaaaccgtggatttgaaatccttctttattacctctcagctttgttaccttga

SEQ ID NO: 32672 - DNA, 1582 bp, Homo sapiens
tagatatctgttagatgtctccaactgtaatctagtaccacaaagttcattcttgccttttctttttgcttatctgtaaattccctcaccaacagtaagacatctgatccaccacccatcatccatttacttattgtttatccacagtatacatgtaaagcagtttcaggactgtggatctgggagaaacaaatttaccaactagcatacagtgtttatgtatagttccttttgttttcagtcttacagtttccagccaaaacactattttccaatgttatatcaggtatttgtattaaaggtagattcatttttcacaatctttatctcattcagagatccccattgcatggttgatttttttttccattttctaagttcacatacatcaaagtttactctttgtgatgtccagttgtgggtttggacaaatgcatggagtcatgttgtgattttgagtgttatgatttcttttttttttaatttatttatttttaagatggaatttctctctgtcacccaggctggactgcagtggcacaatctgggtttactgcaaccttcaacctcctgggttcaagcgattctcgtgcctcagcctcccaagtagctgggactacaggggtgcaccaccacacctggctaatttttttgtttgtttgtttttagtagagacggggtttcaacatgttggccaggctggtctcaaactccagacctcaaatgatccccccaccttggcctcccaaagtgctgggattacaggcatgagcaaccatgcccagccgattcctttttattttggtctttgtctttctgttgagaggggtcataagccaggatagccactctttaggagagccctggttggcagggaagggttatattcaggtgtgtcaggtgagacacagtaagaaagttaaaccaaaatgcatgagagagaagaaatttgtaatttgcagagtgcagaaaggttgctgaggggtggcagtgggaagactggaggtggcagggagctcaaccagaggataggggagtaagagagaaggaaagaaaaagggaggaaggacctgtgggactgtgcctttattaaggttcatgggcattatctttcccttgggggttgtagattgtagattggctaagttaaagaaaacaggagtgaaaggggaaacttatttgtatgactctggtgttgactgttaggttttattatgatctgcagtttggaatgttgtgggctttgggtcaatgagatgaggaagaagcaggccatatggcaaacagccacacagcaaggagaagttttaactatgccaagggtgagaggcatttcagaaacttatgtcaagcctaaggatgaatgctgaggcagcaactatattaaacaaatttatgacacatgtatcctatagtaccatacacaacaactcctttaccctaaaaatttcgctttgcttccactttataatcaacaactcccctcactaccaactgctggcaatctaatcattttccatcactatagttttgccatttccagaagtcatgtgaatggaatcatacaacatgtaacactttg

SEQ ID NO: 32673 - DNA, 1050 bp, Homo sapiens
caagccattctcctgccacagcctcccaagtagctggaactacaggcgcccgccactgcaccgggctaattttttgtatttttagtagagacggggtttcactgtggtctcgatttcctgacctcgtgatccgcccgccttggcctcccaaagtgctgggattacaggcgcgagccaccatgcccagcctattactttttttttgcctgtaacttaccccgatataaaccttatgacaaggacttttttctgttttaattcacttctatatccaggaacatagaataatgtctggtacttggtagctgctaaaaaaaaaagtttcatgaatgaatttgagtataaggaataatcaaaactttgcttgtcttcttgtcttctttttcccatcccttcccatactaccactgccgtcttcaccccaggctacgtctaatccagttttcattctactgcagagtgataccatgtttgataaggcttgacacattgaagataccaaatatttgttgaatcttcagaaagatatgcaaatattgtagtctctgccaatattctttccgagctatcagacaagtctgaatatcagaaatggcaataaattatcagcctacttcttgaataataggtatccacatttctaacttcatctttttggtgtgacgaaaagatttcaaggtagaggagttcttctattctaattttagacagaccatttaatttctctgtgcttcagttcctgaattttacaatggcataatgattatttaccctcctacctcatagaagcaaatgaaacaatggatgtgaatatgcttggaatggtatttaaaattcctaagtataaagtaatattccagaccacattttgcaactatcaaatacttaaaacaggccctgaaggcaactttcagtccttttttttttctattttggtgcttgttggaaaatagatctccctactttattgatgaaagtctttgtcaggaggtgataatctaccacatttaataaggggtatatcatgtgggaaaaaaaatgatcataaaa

SEQ ID NO: 32674 - DNA, 1030 bp, Homo sapiens
cccagcactttgggaggccgaggcaggtgaatcacttgaggccaggaattcgagaccagcctggccaacgtggcaaaaccccatctctactaaaaatacaaaaattagccaggcatggtggcacacacctgtaatgtaatcccagctgttcaggtggttgtggcacgagaatcacttgaacctagaaggcgaagattgcagtgagccaacatcgcgccactatactccatcctgggtgacaaagcaagactctgtcttaaaaaaaaaaaaaaaaaaagggggtgagggtaagttctaacatgaacgtcctttcaaaatctaatcttctaagagtaaatttacattttctctgggatatttaaggtaatggggttgctaaactaaatgtcttaacttctgtggagggaatagaggggtaaatctaggaaactctcttctaagtaatatatgtaagttgcctaatattatcaattaatatatggaactgtagctggaaagccttaataaacttgtctgacattctttcactgtcttctaattatttgaagatcatagatctacatggtataaacaacacctgagtgtaactactccttctgtgtgtgtgtatgtgtgtgtgtgtgtttgtgtgtgtgtgtgtgtgtgtgtgtatgtatattgagacttaggaaactagacataaaggctgatctcaattaacacattctctttgggcaccattggaatctgacccagtctattcagtatctagtggtgaatgattacttgagtttgagccttatgaaatgctattgatcactgtatttagataacacccaacctttgggacttcaagaaattttaaagcatacaatgtaaattctatgtatattctaacttggagaaaacttggaacatggtaattgggggtcatgagttaggtataaagatgaacattcactttgtttattactgtttttcactgacactactctagctacatccaatttcttgctgtatttcagacataccacagctctgctgcacgtcc

SEQ ID NO: 32675 - DNA, 1044 bp, Homo sapiens
tgtggaatcagtgctttcatacatttcactattaaactgagaaaaactaccacaaaatagtttaatgagcaagactggcattaaaatgttaaaatgagtggttgtgttgagaaacttgaatacttaatgaagtatatgaaaagcagttacagagaggctcacaaagcagtttttacagagttctgatgaaaagcaggttccatgtgtgcagcttttggggaaaagtttttttaacctgagaaaatcatacttaaaatagtaaaaaggtgaagcacgcatttaagaggggatggtgatttatgaaatccactctgcctgtagccagccctccttgacccagtcatttagtgcagaaactaatatggaaagaggtgtggtaagagttgagctttatttcaaaacccattgtgttctttaaaagctccatttaaaaaatgtagcagttggtggctcagttgtgtcacagttcattccctgaatacagaagcttaaacaaatagtaagtctgtaggcattcttcactgccttggctgttaatcagaattgttagatcctgaaatgtattgtgatcttaagggaaaacctttagttccctcacaggtgaccccagtgtagagtgtgtgcactgatgcagaaatgagcaaagtgcttgcttccatccctgtgtcacatatgcatagtttttcttgggacttctaagcctaacgggatttttaggagtattaaaatatatttaacttgctcccttcccccctgctccatggtgtgtgtgtgtgtgtgtgtgtgtttgaaggcctccacatttctcttacacaataaaaagaatcatttttgttgctctttcaatgtcctccagtgcttgtattttcatatatatagtacatttaaaaagcagatgggtagatatcagggcagtgacgttcctgcacaagagtgtctgatagttgagagccaggtgataattttctaattagaaggtaactatattatgggtattttgctgccagtacttctctcccaattattttttaaactttaccctct

SEQ ID NO: 32676 - DNA, 1002 bp, Homo sapiens
gttacaatggcctaggtgctattgcttcacagctagtctctatagttttgttttttaagagatgaggtttcactctgtcacccaggctggagtgcagtggcactatcatagctcactgtaaccccaaatttctgggatcaagcgatcctcctgcctcagccttccaagtagctgggactacagtggtctctgtagttcttacagtggtattgtagtttacatattgttttaaactcaatatctctgggggaaagaaggcctatgtttcctagttcaccatcttgatgatagtatactctcaagtatcactttttgaagtataaatgttgccaggtaatttatttctttttgtacaatgtgtaaataaaagggaatcataggtgtaatattttggacttgagtaagacatttggttttgtcctttgtgaggcccatgtctacaaacagaaaaattcaaagcattgataacccaactttacagtttatgcaatcttatgttggagtgtagaaataaggtaatagaatagttacatattaatcccaagacaagactatatagtgtcttaaggttttcctggcattcacaaatatttattaaatgtctgctctatgtaaggtagtgtacagttgagatacataaagtataagatgcaatccttcaaagtgctaatttttaacttgaaagctctgatgccggaaacactaaataacactatttggtacaggagccatatagaacatataaatgtacaagaactgtcactgtacatgatcaattgtccagaaactgttgtgagttaaaaagtagaaatgacatgaagtggactgatcttacttctatagaaaatgaatttaggccgaatcttgagtgtaggatcatatgttagcatctaccctagagaacaactcacaaatgcaaaaacaggcatgggccgggcgcggtggttcacgcctgaaatcccagcaacttttggaggccgaggtgggtgggtcacaaagtca

SEQ ID NO: 32677 - DNA, 1965 bp, Homo sapiens
tactcagcagactcagtactatgcagccttaggagtctttcaatctggaaaatttatgagtcctttcaatctggaaaactcaaagactggatctggaaacactggttttaaaaaacttctttcaatatttttatattctgtattttatattttattgtgtaatattttattcatataaaataaacatataagctatgacacatagtaatacactacctgtgaaccagccatacaacataagaatgggaacattaccattgccatgcttttgtaactctttacagttctcctcctgtcctaaattatatatttcagtacctggacttctaaaagaagaattactacaaatgtttgttgacactaaacaactattgtttagttttgcctgcttgggggctttgtaaaatgataccatagcttatgtagtcttttagggcttgctttttaggcaaaaataggtttctaagattgatccatgttatcacatatagctgtattcatattatttatttaatttcctcctccacctatatatatctttttcttagcagttagctctcctgacttaccgtttagtggttttttttcctttgttctttcttattttctctctgtcttttgttctaatttctggtagatttccttaaagtttattttccaatcctttcactaaatattttatttctggtattatgtttttaatttcctgagtgcttctttttcttgtctatgaatgcttcttttttgtagcatgcttttcttgttttatatatttgttttcttttgtctctgagggtattttcttttgcttcttgtaatatgtctgtcttctgagtttcttctccactaagtgttttagtttctgtcttttatgttaaagacttttctcaagtgtctggttaaccatggcttccttctcctatttgagagaggcattaaaatggtatgggaaaccctgtgaggacagagactagtttattgcaaggcccttcagttatcagtatctataggtcttttctccagttttccctgagaaattgttcaaacctttgcctttggaaatgggtggatgatggtggtggtaattagtctgggtgcctgtgttccataagacgaggtggaagaggactgaaattctcatctgttggcttagtctatctgtcctcagaatgatgatctgtttttcatctttcataattttattggaatcttttatctattgctgtctcctctccagttctctgcctgtgtaggtttatgccttttattattcaattttagtagagagccaagataagtctgttcaaccctccgcgtttaatccatgcttcccaaacttgtattagaatagaacttcaaggggcttcgatacaggcttgcccactaaactcttctttgtccctaaataaatcactaggaatctcacttctgtgacactgtaggccaattaaaagaaaatgacacttacattacttacgttttgttattgagtaaacagaatttgagacagaaagtagctaccaaagtgattttgctatataattgttttttgtttttttgtttttttttgaagagacagggtcttactctgtggcccaggctggagtgcagtggtgagatcatagctcactacagtcttaaactcctgggctcaagcagttctcacctcagcctcccaaatggctgggactacagggtgccaccacacccagctattatttttattgtttttttgtagagatggagtctcgctatgtggcccagtctggtctcaaactcctaacctcaagcaatcctcctgcctcagcctcccaaagtattgggattacaggagtgggccacccagtccagccagaaatgttcttttaattgttatgattagaaacaaacggattctagtctttgtcttctctacttcaaaacagtagttccctatatttcaacagactgtgtatgtgctagaca

SEQ ID NO: 32678 - DNA, 1026 bp, Homo sapiens
tggtgcctttgttgaaaatgggttggctataaatgtgttgatttatatctgggttttccattctgttccattggtctgtgtgtttttatgccagtactgtgctaatatgtttactattgctttatagtatgttttgaagtcaggtagtgtgatacctcccattttgttctttttgctcaggattgctttggctattcagtgtcttctgtggttccatataaatttaagagtttttcctgttgctgtgaatgttacttatttctagctttattccattgtggtcagaaaagttaatatgatttatttttttttaatcgttgagatttgtttaagatatggtctcttctggagaatgttcccttgtggtgatgaaaagaatgagtattctgcagcaattgggtgaagtgttctataaatgtcaggtctattaagtatggtgtctactttaacttttgtgtctctgttgattttctgtctggatgatctgtccattattgagaatgaggtgctgactttctctactagtattgtattacagtctatcagtctatctctccctttagatctactaatgtttgcctcatgtacttgggagctctgatgttgggtacatagatacttataattgttacatcggcttcctgaattaaccagtttatctttatatagtgacctactttgtctcttcctatagtcttcgatttgtaatctattttatatgatgtaagtatagctacttctactcttttttgttttccagttgcatagactatattttccccaccccttcactttcagtctatgtgtatctttgtaggagaagtgggttccttgtaggcagcatatagttgggtcttatttctttgtccattcagccactttatgccttttaattggagaattgagtccatttacattcagtgttatttttgataagtaagggcttaatactgccattttattgcatattctggttgttttgtaactcctcttttcatcccttttttactattgtctttgtggtta

SEQ ID NO: 32679 - DNA, 1033 bp, Homo sapiens
tgtagttgatagtattctttgcaagaattttgttgaagtgaatttgtttttatatcattatatcagatcattcttaacaaatatttgagtgtctaatgtatgtaagatcctttccatgtatactttgcagtttaatttgcatgtgagtattttggggcaggtcaatacctttaaaaaaaaatgaagtaattagtgcttagggaaaattttaaaacttgtctaagaccagagagctagttcatggctgagtctaagctctttgcacatgtacacatctacatctacatctacacatctacagcacagatgcctcaatattgatagcttttatcatgtacttagtgtggggagtgtaatataaaggcagagaatatagatcttagaatgatacaggctgtcaaaaagtcggtaatctgccaagtaattttcctaaaacacataagaaaaaaacttgaacagttggtcttagttaaaattgaagcaagatttgaggcttcataattaactcttgaagtagaaacttagatgaaagaaaaaagtaagtttcccactgctttccttatgtactatcaaaaggccacaatgaaattgctggaagtcgccacctcttactaacctctgaacagtgcttaaaagtaggaagtgagaggtaattggctggtttatctttgcttccatgcagttttactggcctataatctggtggttaatagcatcgattgtttttaattctgttgtttttttcctgccaagttgctataaccatctgggaagggtaagataagagtgctggagcattgtcctaagaaagttccacttctccttttgagcctttctttaacacaaatctcatattgggagagatttctacagtcgttttcatttatagctctctaacattctccctaaacggttgtctggcctctcagaatctcccaaagcagcctattctacttgtgcctctgttagacaaatctaatatattaatctgaatctggtaccctgtatttctccagttagggccaatcagaat

SEQ ID NO: 32680 - DNA, 1148 bp, Homo sapiens
cccccctccctttttttttttttttttttttgcatgtgattttagtaaccatggcagttgcgttgattttacatctcttagtttcagcttccttttaatttcttgcatttaatactggtatatgtttgctgtttgacctttctttttctctacttttctatcctacccagttactttgcttttgagtttgtatggatatatgggaagcttctgtcagggatgacactatagagaaagggatttctttgaatctcctttcttgatagctggtactgagcaaagctctagtctctgattctgattctgtctgaaccattcactcatatggtgccagaaaggtcatttgtgcttcagcagagaattcaacttacaggatttttatttccattctcttctcaaaagagcaaacctgtcatctctagttaccagtgaacttgatgaatatgaatggtaacacacttttccattaaaatccacatatagttagattgggatatccatttctcactgttgttctttgattatactgagtttcagcctgtgaataattaactgtggttatgaatgagagggattaaattgcctcagctagagtaaacctattggatggtctcttctcttgatttcccaagcaatggctgttctgtcaactaccattatagtgtccattccaagatggctcctctaatatctaattctgtatatattgaatcttgtagggatttttgcttttgaacattgctgttttaatttcctatggacttgttctgggctttttctctcattctaaaaaataatcattacccactatctagaaaactgtcttttaatcttctgattaaagattgcttaatgatagtgcctatttgtttggccagtagcatgtttttctttgttttaacactggagtttctgcatggatttataatataaggttttttttttgtttttttgtttttttgtttttaacattagataggcatgaagccttcgtctcacagctgcatgcgtagtcactgttgaagcaaatgcctacctaatttgacactcttggtgtgtttaaaaaatttttttgagtttgcaaataagcatattaagtctactgatggagccttcgggcagtgaacagttatttgaggaccctgatc

SEQ ID NO: 32681 - DNA, 1062 bp, Homo sapiens
aataacaaaggagtctaatttttgggtcacaggtagcatcaaagaaggaagtattttgagagtaaagagttttcattcttactagtccagcagttaagttagaaaactaaaataaaggattcagttctccatcagctgcctgcctagaccagattttggatttcagatgaaaagatgcagaaatagtgttagaatcaaggcagaatgacctagcacctttcttgcggttaccgttcaggaatggtgagagaagatgggagaggcagggaagacaaggcaaaaactaccaatgcaaactctggatttaatttgtacgttcctgaaaacaaaggtaagaaaaaaaacaccgaatgttgggcattgttagaatttattcttgcatatgtatcatatacctaggatttgtaggtttcaaacatttaattatttttcccagttttacccaaaagatccctgtctgtgtggatgccagatgaagactagtccatactttgtatgtttctttctgtaattccattcactcctgaaatcatggcagtgtttttccacctataatattattccttctcgattttttagctttttatacattactagattttgtagatttttggtagatatccttattaaactaagggagttcccatctgtctttgttgggagtatttatcgtaaatagatattggaatagtctaatgtgttttctgcgttttttgttatgatcacatggttttcttatttagtttcttagtatggtgaactacattgatttttgaatgtgaaccagccctacatccctgggataaaccctacttagcctagatgcattgtctttttatataatgctgtatttgatttgctaatattttgttaaaggtttttgcatatatgttcattagagatactggtctgcatgcagagttgtttttttttttttttggtagtgtctgttttgttttggtattagagtaatgttagtctcataaaatgagttgggaaatgttcccttctcttttttgcaagagagagtagaattgttattatttcttatttaaatggttg

SEQ ID NO: 32682 - DNA, 1113 bp, Homo sapiens
attccgtagtcacatgtttgcttgctcattggttcacattacatttattcagcatctgcttgagccaaggcactgtaactacatgttttttttagttacctacttttgtaaggtcctgtttctttggctacatctgattacagtaaacataggaagtttaataaaacaattttcatgaccgaggagacagcattcttttttcaaaattatgtatgtatgtatgtatgtatgaatgaatgaatgacaggatcttgctctgttacccaggatgaggtacagtggtgtgatcatagctcactgcaggccagaactcctgggctcaagcaatcctcctgccctttttttttttttttttttttttttttagtagagattgaggtcttgctatgttgcacagactggtcttgaacttctgggctcaagtgatcctcctgcctcagcatcccaaagtgctgggattatgggcttgagccactatgcctggccagcattcttcaaagtcataaatgtctactgaacttgattatatttttcttatttttgttttaactcttggatttcctattactgggttagtaatgtgttataaaaccaggaggtcaagagaaagatttgttttgagtgtgaatgactggttggtaaaagatgttgctaaatcacaaattcccttagtaggtggttggaaaaatgttgctccttataaaatagaagcacaagaaagaaataactttaagaatagaactgttgaataaattttcagtgtagcaaagcataaagtatgtgttaccttcgaaaccatttcaaatgacctgcagtgaaggagaaagcataaatgggagatgtttttaaaatctgaaaaacatggctaaggtttcacttctataagtagtgtgataatagctccctgcagcctctatctcttgggttcagtggatcctcccacctcagcctcctgagaagctgggactataggcatgtgccactatgcccagctaaagtgatctgcctgccttggcctcccaaagtgctgggattacagtagtgagtcaccatgcccagcccaaaagagaatttttcccccaacgccttttggctgccaaatactaaagtatt

SEQ ID NO: 32683 - DNA, 1016 bp, Homo sapiens
aatgtgtatttatttcataatcgtaagtttagaaatcagtaggataaaggtcagattgggtgtcagggcatccagaatagtgggtgtattccattttgatctgcatatcttattctgttgttgattaagagcagtgagagtccataaactatggtatatgatagctgtgatctctgatacaagcttcatgtagatgacactcaaatctgcacattcagcttgcacttccctactgcctgctggacatctgcattttgagatcccgctggttcctgaaacctagtgtgtcttctaccaaagtcattggcattttgcagtgatatttttttgcattcccataaacctatacctcctctagttttacttatcttgattaatggcccatcattcatttagccaaccagtctacaaaacttggggttttctttaatttctttcttttttacttctgaaacatgtcttccctgttgaaccttaagagtgttcatttattcactcattcactcgtttattctgacatttattaagcatctattatgtgccagacattatgcaaggaattaaggatatagtggaaaataagatcaattttctgctcttacagaccttatagttcaagctttcatcattttctccctatcctctttgggctattttgatagccatccatattttttctggttataaacataatacatccttattttaagaagtgcaaggatgccaggagtggtggctcacgcctgtaatcccagcactttgggagtctgaggcaggtgggtcacttgagcccacgagtttgaaacaagcctgggcaacatggcaaaaccccgtctctataaaaaaaaaaaaaaatgatgtggtgtcatgtacctgtacttccagtgggagctgaggtgggaagatctcttgagcctgggaggtggaggttgcagtgagcccggattgcgccttgcaccactacagggaaaaaaaaatgaatgagaagcctgagctttctggagcaaatcttactg

SEQ ID NO: 32684 - DNA, 1032 bp, Homo sapiens
ctcagaacagtataaaataattatactttcctctctataactcagttctcattcatttacttgttccatcttcctttctcccattttctctttttttctagcacctgtagctcaacaagaactttcttaatgtatataatgaaacagctcatttcctacattcttcctgaatgttattagacacgggattagacttacaagtaacggggagcagcttgaatttttttcttttaaattaaatctttattttttataatagagacagagtcttgctgtattgcccaggctggtctcaaactcctgggctcaagtgatcccccacctcagcttcccaaagtgctgggattacaggtgtgagccactgtgcccagctgtagcttgcattcttatttctcaaattgaaattgtgacttgggtaaactgaatttgttctcattctgcatagacactggatggtttaggaaagcttagtaacgttagcataatattatggctgtatgatttcatagtctggttcagtttcattggcaagaggaggtgtgatattgtagagttttgaactaaaaattgagacttcagtcccaggtttgacattattacttccatgctttgagagttaaagtatgtttgttttctcacctttaaaatgggcttatcattacttgctttacacagctcatggggttattgagaatcagataagaaaatttgcatgaaagatttttatcaatgtaaaggattgttattgcgttgtagacagttataggtatatctgttgttttcactcaaagactcaatttttctttctgaaaacctttttttttaagacaacgtcttgttctgttgcccaggctggagtgcaagggtgcagtcgtagctcacagcaatctcacattcctgggcacaaacagtcccctgcatcagtgtctcaggtagctgggactgcaggcatatgccactgtgatcagctaatatttttattttttgtagagatgagggtctcgctatgttgcccatgctggtctcgaactc

SEQ ID NO: 32685 - DNA, 1024 bp, Homo sapiens
gtaggaaagtgtgatgggaactgagttctaattctaataatcagggtactttgaagtttgtggaagacaagcatgttggaagatatgtataaattctttttttattttattttgtagaaatggggttgcactatgttgcccaggctggtctccaattcctgggctcaagtgatcctcccgtctcagcctcccaaagtactgggattacaggtgtgagccaccatgcccagcctgaaaattcttgatattgcttttttctttattttaataatgtaaatgattctgctcatactattataaaagtctttgtccagtatgcgtgtatattttgtttattcatatattttacctttttttggtgctctttgttcttttgtatagttctagatttctgtgtggtatgattttccttctgattgaaggatttctaatgtttcttgtagtgcacatttgctgacaatgaatccttttagtatttggacatctgaagactttaatttgtttttagttttcgaaactgttttcacaggatatgtaattactgttgacgtttctttatgatgctgtttcaccatcttctggcctgcattgtatccaatgagaaatctgctttcattgggtttatttttctgtatgtaatgtgtggttgtttccttctggctgcttttatttttctttcaaaaatatattttttctttttttaatttaatttttttatttctaaaataaaataaaatagacgcgaggtttcaccatcttgtttcaccatgttggtgaaaccaagttggtcaggctagtcttgaactcctggcctcaagtgattgatccctcttggcttcccaaagtgttgggattacaagtgtgagccactgctcccagcccaaaaaatatattttttttattgtggtaaaatacatataattaaaaatttaccattttaaccattttttgtttgtgtgtttttgagacagcgtctcgctctgtcacccagggtggagtgcagtggtgtaaacatgaattactg

SEQ ID NO: 32686 - DNA, 1031 bp, Homo sapiens
cagcccctgcacaggaatctattggagttcacccaactctagcaaaggaggggaggggaagcagggaggagaaacacatgggtgccaaggagcttgccccccgagtcagttcccaaagtcccagatgtgggactgccacatctagccctggggactgcctccatcttgaaactttttttttaaaacagggtctcattctgtcacccaggctggagtgcagtggtgcaatctgacctcactgtagccttgacctccccagttcaagggatcctcccacctcagcctccgaagtagctgggactacagccaggcaccataatttttatggctattttttattattatttcttgtagagatggagtcttcttatgctgcccaggctggtctcgaactcctagactctagcaatcctcctccttggcctcccaaagtcctgggattacaggcatgagccgccacacccggcccatctctaaacatttaacaagcacccactatggtgtcagactccttggtaggtcctgaaggcctagaagtgaatgaggctcagccccagccctcaaaaagttcagaggcagtgagggagacactgcaaacatgaaacctcaggcttggtctcccaactagactccaggatttgaagaaatgccaccctagctaagatgaaatcagatagacctgttgtcttttgtacacaatgacgagggtataaattgatccaatcttttgggtggcaatctgaaaatttaacacatatgtaccttccatgagacaattctgtttttcagaattcataatacagatactcccacctatatacatgagaatgtatacctcagggtattcagtgcagcatggtttatacaagccagaattggaaccagcctggatgtctgtccatcaggagggggacacttaagtcaactaagacccatctaaaactgtggggtactatgcagcctttaaaagaataaggcagttccatatgcactcatgtggaataagctcccagaagcagagtagagaacta

SEQ ID NO: 32687 - DNA, 1010 bp, Homo sapiens
tcagtcaagtgtgcccagtgctttctctcagaactcatcaaaaatgtcagcaatgggcagtgtccgcccagtagctggacagcatagccacctgcgtgctggagcccccgtccttcccaggccctgggcctgctttgccaataccagcatggcaggggcctccccaggcaactggctgcagctgagtgtgacccatgggagacagtgcagggcaggaagaaggggagaccagcgtctctccctcactctgcctcatggggtttccacagcagctgcttctctggggccccagctcctagaatatgaattctcattcctaccaggctggtccagcccacagcactggaaccctcatccacaccctctgtcctgcccgctgaagggtttggagtttcctgctcttgtctgtctctgggttgccccacaggcccctgttggaagatttagctcttgccatacctttggaactagttcctctgtgaattctctgcattgatcctgctggaatgagctctttcctgactgatacaggatggattttattttttacttatttatttagttttttgagacagtctcactgtggtgcccaggctggattaccgtggcacaatctcggctcactgaaacctctacctcctgggttcaagcaactctcgtgcctaagaagctgggactacaggcacacgccaccatgcctggctaatttttgtatttttagtagagatagagtttcaccatgttggccaggctggtctcgaactcctgacctcaggtgatccgcctgcctcagcctcccaaagtgctgggattacaggcatgagccaccacacctggcctaggatggattttaaagatgggcccaaacatgcagggtttgacatgaggatgtcgagaggccgttccttagtaggcagtagcagacctgctgagtgaaagggccacacttttagcaaataaacaatcccctgcttctccaatacctgctttctccctagtcctccccaaaa

SEQ ID NO: 32688 - DNA, 1049 bp, Homo sapiens
tggtttgaccatgcaatggaatattattcagtcatcaaaaggaatgaagtactcacacgtgctacaacacagatgaactatgagaatattatgctaagtagaagaaaccagtcacaaaggtcacatattataagatttcatttatatgaaatgtccagaacaggcaaatctatgaagacaggaaccctgtctctactaaaaatacaaaattagatgggcgtggtggcatatccctgtaatcccagctactcgggaggcaggagaattgctttaacccgggaggcggaggttgcagtgagccgagattgtgccactgcactccagcctgtgacagagactctatctcaaaaaaagtagattgtcagggcttagtgggaggaggaaatggcaggtacctgctcatggatacagggtttcttttggggtgatgaaaatgttttaaaattgatcatgatggtggttgccgagctctgtgaatgcactgaaaccattgatttgtttactttaaattggcaaatcatacggtacctgaattatattttaatagttatattaaaaaagtaaaatcttccttgaagagatgacacttaaggagaggcgtagggggtgggatgagttcactatgtggagaaatgaggaacagcatttcagggtgaggaacaccatagtaaagtccctgaggttgataggcatagagcagatgtaagggactgttttttttgagacggactttcactcttgacgcccaggcttgggtggagtggtgccgtcctggctcactgcaacctctgcctcccgagttcaagcgattttcctgcctcagtctcccgagtagctaggattacaggtgccatccaccacacgtggctaattttgggatatttagtagagatggggttccaccatgttgaccaggctggtctcgaactcctgatctcaggtgatccacccgcctcagcttcccaaagtgctgggattacaggcatgagccactgtgctcagccagatttaagggactttcaagaagtttctgtggctgaagcctgcag

SEQ ID NO: 32689 - DNA, 1048 bp, Homo sapiens
gccaagtgctaagtagaacttagagcctgtctgaaaaaacctctgctgacagaagtgtcctagaatctgtactacctatatggcagccatgagccacatgaggcttttgagcacttgaaatgtagtgtgactgaggaactgaaatttaattttaattaaccacatatagctggtggctactgtattggccagtacaaaaaaggagccatttcagacaatcgtattttacagggatgttgtggaaagagttttgggttcaaacacattcttcacattttaatattctagcccctagccgagcagctttgggcaaatcatttaactagagtgacccttgtttcttcaggtgtaaaatgggaatgaaaaataacttctgttgttgtgagcaacaactgaagtcccctagactagttgtatatatatttatttgagacagggtctcactctgtctcccaggctggagtgcagtgttgccatcatagcttactgcagcccagatctcctgggctcaagtgatcttcctgcctcagcctcccgaatggctgggactacaggtatgtgcctccacacctggctaattgttttatttttggagagctgaggtctcactatgttgcccaagctggtcttgaactcctggggtcaaacagtcttcttgccttggcctcccaaagtgcttggattacaggagttagccacccatgtaccatcccagcatttccttattatcttgcagagtgaacattataaactcaaattccccaaagtgacgattgtatgcatagaacattggctccactgatatgggaagggcattcttttgagtctgaagcacgctgttttcatggtcttacctttactggactcttccctagccccttcacgctgcgtccccctaccccgcacctctccccacctccccgccttttccgttaggtcctttgttttcttttatggcaggtttagttactgttacctttcttcccatctttgttacgaaaaaattgttaaattagtaagtgcttatatagcatgatattgctatatt

SEQ ID NO: 32690 - DNA, 1190 bp, Homo sapiens
agtggctactcatgaaatccaatgactaggaccctagaatgtcattttggctcctctactccttttgctcaatgtattcgtgaaagcatgactacaaaaggtgttaacttaaatacaacaacagtatctcagaagcaggactactgacgagaggaaaaatgtggtacagacttttaacctctggcttgctcccttttaatcaccaaacaggaaattcagaataagcagaaagtaggaccaagtgatgacacccctcgaaggggcccagagtccctgcccgtgggacatcatgacatcatcactgatgtcgccacattccagaccacacagggcttcatcgtaactgcttctagagatgggattgtgaaggtgtggaaataaaacctactgatttgtataaattttaatagttataaatataatactataactcgagaaaaggcatttctagagaacagattcatttgcttaattttcaaaattatgtctccatattactgtttcatgactgactgactaaatgacacccaaaatggttaagatgtacttgactagtttacttatgcatctctttgcaagaatcagccagccaacaatgtctgggatttttattgtatatgttatagaggtgagaaatgtaaaatatgaaaatgaatatgtttattttgtattgaaaaagatggttgaaaagatggttgtaagctattatagtataaacacatttttgctattaaaaatgctattcaaagcagttaaactgtattcatgcatcctaagagtttgtggttttggtggtatttttaaatggtaaatttaagcagaggaataatccctccattaagcagaggaataatctctccagcagcatttgttctaaggtgaagaaatggagtccatgtcacaaggaatcagtgacagaaccaggtgttaggtccaaatctctggactctaaatattgtgctctttctgctctaatatttcctgtgtgttttacagtctgtcttattagttatttatttaacactgtagaattgatttcctgcatattagttatacaagtgtgcctcctcttggccatcattattttttatgggctgtaccataaattctgacacttggcccaacaggttgcttttatccagtatagactattgaatgcatgaaaaagaaaaaagtacaccaaaaatata

SEQ ID NO: 32691 - DNA, 1057 bp, Homo sapiens
tcagttcccagtcctgattttcttactgaattatgactggtgatttggactacctagatcttggctctgccattttcttttttcttatttgagttaaactttcagtttgtctctttgggactagttcttgaaaaattgctgtttttctaaacttttgcacagctttttcaacttatttgtttatagtattctaaattatattttctatgttttcttcttgtgctaccttatttctggctcattcagcttctcaattttaggggagatggatgcatttggtattcgttgaaattggggtggtagtaaaatatctaaatggagttctatcacagtgaaaacttaaaacaatatgagcagtacaaaagaaagttgtcaatgttagggttacatgttttggagtcactggtagtgttgaaagtcagcgtttttgagtggctatgaagtaaagggaatatgaagggcaacaaaagcctgatgtctgaatcttaggaagttaaatttttggaacaggaagagaggggcaagaaagggaaagagaagaaaccatttaagttaatattataaactacaatgaaagagaaaacttatgaaaagaatatgtaggcctctctcagtgagacaaaaaccctactagcatgaaaacctcataatgccattgatgcactctcatatagtgccctctggtggaatgcaattgatacctctttcctggaggtttttttacaatatatgtatcacaagcctttatgatgtacatatcctaaggaagtaactaagaatcaactcagatttagtttcaagactgttcagattgactttctttataatagcaaaaaattaggagcaaactaaaagttcagcagcagttatcaatgaaaaacattgataattgtgttttttaaaattaggtttaagaaaagcatatggggtttctattttggaatggcagagtaaggacctccaaaaatctgttcctccataaagcaatgagaatactggcaaagactgtcaaagtcaattttctgagaactttggaaatcagctaacacctttcagc

SEQ ID NO: 32692 - DNA, 1048 bp, Homo sapiens
gagcaagactctatctcaagaaaaaacaaaacaaaccttaatcttgacattttcttttccttatcagtcattagttacctcatggggccaccctagcccctcatctcttctttttaccttgctaaggtataggttttgacactgccatgggtaaaaggaaggagtgggaaggaacagtttccatagcctttctacttcctgcttcctacggttcttgtaatcccttctaccactactgctccttcaatgccagcccccgttactgggtgccatgataaaaatcactaaaactccctgacccgtattcctctgaaatgttagtgcttcgtatattcattggtctgtcagtgatcccctcatttgtctgagtggaaaaagaggaacaaataatcccccattttatgttatttctggtgccagtggctttaggagactcctaaaggttaggggacaatcctctgttcaagagataagcactgctagtagaagggagagcaggccagaaactctgaggttcttaccagaaataacagcagaacaacaccagcttccggttttttgaaagccagcaatgactttaccagagcagtttgtgatttccatatttttgactatccttaaaacaaatttgagcaacaggtgttattcctattttatagataagggaatggagacacaaggaaggtagttaacttgcttatgttcatatagtgcagtaagtttcagagttggcatttgaatctaaacctatctgattccaaagcctacactcctacactgtgctgtgtggcctctaaagtaaaataaacagaggacagagagctaagacccagaagctggcttgggttttatacagacttagggagaagcccatgtgcagtttatctgctccagccccttacaagccttttctctaccttcacttctttttggtccctgtgctacctgagtttcttaggattactagtagagacttggatccaggggaggctttggagataggaattgagtccttgtttctttttttttttctttttttaattgagat

SEQ ID NO: 32693 - DNA, 1024 bp, Homo sapiens
caggtgaggaaactggggttaggagagactaaataacatgacccaaatgtatccggtctaattctcagttctcagagctcctgctctacaccttggttttgaagcaatcctgcttttctttggtcttctgggtctttatggtgagagtccgtgataacccagggtcagtgccagcaccttgcattgttatttcttcaaggcccagtatgtgatcacccaggctggaatgcagtggggagatcatggctcactgcagctttgacttcccaggctcaagccatcctccaaacgtagccttccaagcactataggtgtgtgccaccacgcctggctaatttgcggtcttttaaaatagagccagtgtatttgaatgtgtatggttaaatataattaaaatacatgtgtcagtaattataaaagtttaaaatcaacatttgtttctttacagtattttttaaatatcatagatgctggtacagatttgtgtaaagtgaacttccaagtgtgctgtggtttatggacttaaaaggggaaataagcatagatctactcagactttagaggtgcccaggaaagtaagagacttttcctaataaagatttgctcattaaagtggggatattcatctagaattttgacatattatcaggatatggcccagagtttttccatttttagggcgagcaggcgttatagggtatttacatcttgcttacttagaggtaaatttttattctattcagagcattgttgaacctagcaggggtggggagtgggacccaggatgaagggaataattgtgtttgattgactcaaagatctcaactgccataaggtacattttgatttcagagatgttggaaagcaaggaaaaagtaaggttattttaagtttaaggtagttaaactttacgttcagtgctattcactgctaagaaggaaaagagtacagtctttgaccggttgtgatcatatgttaagaaacacatatgttaagtgggaggcaaggtaggagaagaaagtgt

SEQ ID NO: 32694 - DNA, 1028 bp, Homo sapiens
aagagatccattgctttcctcagattcttagtggtatctcctacttagaaaagtttgtaagaatctttgagttgtggacagcaatatattagtccctattttaataaatggggaatactgagccatggtataacctcctctttatgtgtcagggccatctgtaatatatttgtatataattttttactgctttctaggatgatggagtcacaaatcacttagcagtcaggttctgaaagatcctttaaatcgtatgtaaattgcctttgtagctttcatctggtttacttttctattctcaaatctattttaattccttttcttcccttggtataggtaactcagatgattcaccgtgagccagataaacgtttagaggcagaagattacttaaaacagcagcgtggcaatgcctttcctgaaatattttacacttttcttcagccctacatggcccagtttgccaaggaaacgtttctttctgcagatgagcgtattctggttatacggaaggatttgggcaacattattcacaatctctgtggacatgatctgccagaaaaagccgaaggagagcctaaggaaaatgggctggttatcttggtatctgttataacatcctgcctacagacccttaaatactgtgattccaaactagctgctttggaactgattcttcatttggctccaagattaagtgttgaaatccttttggatcgtattactccatatcttttgcatttcagcaatgactctgttcctagggtgagggctgaagccttgaggacgttgaccaaagttcttgctctcgtcaaagaggttcctcgtaatgatatcaatatttatccggaatacattctgccaggcatagcccacttagcccaagatgatgctactatcgttagactagcctatgctggtaagagtttattgtccaaatattagccacttagatattttttaagttaatgactataatactgcttgtttttctgatttgtttgagaattgcaagtatgaactttgct

SEQ ID NO: 32695 - DNA, 1047 bp, Homo sapiens
agctgggcatgtgcagcaggcagaggggatagtggaggaaagcctttgggttctgccttttcctcttcactgcctggctttaaatgaatccttgctggtccctttgcaattgaaactggcagcatcaacgcaggctgctagtgttgtcagggtgcataaatgtactgcaaaaaccctgttgggatgagggttgatgaaaacaggactggccagctgatatttaacatccactcatccacctcttccacatcaaactccctgggatggcagattttaatctaggtgactattgcccacaggagttgcccggcagagtggtaccaaaaatagtagcctatcgaattctgtggtatctggagcatccagctctggggtttattccttctctgttcttaaactcacatggagggattcagctcctgcttaaaacacattaccaggcagggtagattaaaacagaaacatgatttcccagggtaatataactgtctcctaaagacaacaaacgttgactggaacttatagagcaagagcttaaataaacaacaaatataacttaaagtgagaatgtattagcaatctgaagcaggaaaagaatgtttcagaggtatatacatatgtgaacatttatcaaattgtacactttaaatatgtgcagtttattttatgcaaagtataccacaatgaagctgttaaaaagaaaactaaccacttactcacaaaataaaatgcaaatctaacaatatcaccctatttaacactcttcaatggtttcccaattatcttaggataaaattcagtctttagaatgtggcttggaaagcttgcatgatctggtccctactcaatacatcctttccatacccaaactctcaaataggagacccagacatctcaatttctttcgattcttgggtctgcctccaagcatttgcattctgttgcttgttagcatttttcccatattccacccctacacatacatatacacatttacctggataattgctttaggattctgcttagatatccttttcatgaagctct

SEQ ID NO: 32696 - DNA, 1027 bp, Homo sapiens
atgtagtagcgagtatttctttgattatgaataatagctgaaaagtctacctttaaagaacttaattggtttcactaagatttttgccttctctcaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatcggtcctgtttacatttttgttgggagaggtgattactttttagttttatcactcaattataagatcagtgtgttttggttttgttttgttttgttctgtttaggcagggttttgctgtgttgcccaggctggagtgcagtgcagtggtgcgatcttggctcactgcagccacgaccttctgagctcaagtgatccttccacctcagcctcccatgtatctgggactataggtgcccaccaccatgcctggctaatatttgtatttt

SEQ ID NO: 32697 - DNA, 1053 bp, Homo sapiens
aactgtagtacatacaatgacattctgatgtagttgtataaatagttgataaccagtaacatttattactcagatttatcgcctacttcagtaaaagattacttccaaaaactctattcactctcaatcgataatagtttgccatcactgaagatactcagaagatacaccaaagagttctgaaacgggagtctaaatacattttgagaaactggcatcagaacaatgtctagtcccttttgaactattaacacactagtgaatatatttccagcaagtatatttgtataataaacacgtcctttaaaaaaatctttgaaatatggtgcttaaataactttcttttgtaaccttaaagtatctgcccaggcattaattaaggtatgaatttggggaacattttataggtttgtgttttaaatggtaaaacttgctatgtcctttcactccattatttacgttcttccagtgactccgtagcaggtaaattagtccttccttgcctatgggttttgagccacttcctagtgggcagccaactttgttaacatccactcacttcttgggagcttttgtttcctcagagtacagggttaccaataacttttttttaagattccaaagttagtaaagatagtcttagagatgaccaacctatttaattggcattagctttttgttttgctgtttggattcactaaatgtattaatgaagactaaagaactattgtttacagcataataagtataaatgtatgttctaaagtacggttcattcgtgttcattcctgtgtcctatatatcatttattttcagatttgcctggcttttgtctgtccttcccccacattttcttaaaagatttagactggtttgctgatagacataaaaagaatgaggtagataattgagggagtcttggtgcaggcagggaaataataaacctgaggtaagattaaatacacaaaaatacatatgggctgcagacctttggccctcaacttttgcaccactaagacaaaaatggttgagatgtcatttacgtttcagatc

SEQ ID NO: 32698 - DNA, 1019 bp, Homo sapiens
gtagtcctcagtccgtccttgatatgaagtcacataattttagtctgacacaaggggactccatgtacttgtcacccttttatggatccttgcccctcactcatttcccagagccagactagaattagttatattccacaaggttagctgagcatctgtagtttggctgtatataccctgagtctaaatttaaaatgtactttgtgcaaatgttgaattcagtttgtcttttgaattagtatcagttaacaattctgaaataattttctgtgaattgtaggattgagtagataagtaaatgtattgataatggagctaggtttctcactgttggaaaagggcgttaaagtatgaaaatgggaaaattaaaatgaaccctatagtgttgaattcaaactataagtatgcatatactgtttggtgggggaggggaatgcatgcatgcacacaaggaaaaaatgtagcacacagagaaacagaggggtgtgtgtgtgtgtgtcttagttctgtctactggaacattgtagtcatatataacggaatatatttgtagaatgaataagagtgatacttagtctgtaatactcagaattgtcttttaagcctgttggttacatattaaacatatctaatgccatgatgaggtacttccactgagagtttcacctgttaatgtgagagcagctgatggaaaagtgtttatattgtgagaattcatgtgttataagaagctgttccattttagtcataattcagatttgcttctttagatgtagaactattacccgttatcagagccaaaatcagagactgttagatttatgtaaatcagagaaaaccagggctagacaaactagtattctgataactaactctgtccttgaataattttggtcaaggaaagtaacatctaaagcaaggagcagtaggaccattccagcaccagtggtatggatgaagtccattaagtcagttaatacagaagatgagttcaaaacaggcctggcagtccatttttt

SEQ ID NO: 32699 - DNA, 1048 bp, Homo sapiens
aaacactgcaagtgaatggctgaggtacttccagttggatatggttggtacatctgtagaatgggatcatggcaaaattcttgccagagtgcaagattatggaactccagcttattactaataacttcaggggtctaaaaactttttctcaaagaatgggaagtaaatatcttaggtttgcagacattatgttctctcttgcccatgagagaactaacttattctgccattacagctctaaattggagataggcaatatgtaaattagtgtgcatgactctatcccaataaaactttatttacaaaaacatacggccagcacaggccagtttgccaacccctcttttaaaccttagtgagaagagaatcagaggcagcaagaggaaagagatttctcaaagaacattagggaagcaggaaaatagggaggaaatgatgacaatggaaaggagcgggacgttaaggggtagaggaaaaccctgtggagagattctattttaaaagatcctatagaaatctaaacaccgatgttaagaaattactaaattttttaggttgtgataatggtattgtggttttgttcttcaaaagtattcttatcttttagagatctctactgaaatatttgtgaatgaaatgatagggtatctggagtttgcctcacaataatctattggagttgtcagaggagaggaacagatgaaaaaaataaataggccttgagttgattattgttcaacactggatgatggatacatagggatttattgagttaatctctctgctcctgaatattccgtaaaacttccataataaaaaactgttttagtaaaagacttggatttgggatttggggattaacctcagagtgaaatccaaagagtaattggagaggaagatggattgcagagagtggatggttgatgagagaaggagaagcagtttgtgttccagtgaaagacgaggagggatatgaagggaaaagaaggtaggagaatccagtggcttctcaagggagatactcaggggatgggaattttagaggaag

SEQ ID NO: 32700 - DNA, 1050 bp, Homo sapiens
ttgttttttggttttttgtaagatcattttcatagaaaacaagattatgtaaagccatgcaccagcttcaggattaaatagctggtaagagttgggggaacaaccagccctggaatttaaagtagtgatagtcaactctggagaagtgaggacctccatttgagaagatcaccactgttatatgggctacaatacaatattctgtttaacttttactgtattaacagtggggcagggttttcctcgcatgtgtgtgtgcatatcttcatgaggtatttattacttacatgagaatgaattggactttatttgaccttttgctaaatgttaccaataactatagctcttgtagctgacatcttattattgctgtaaggtgcttttaattttaaatgcttgtaaatttataggattcgttgtccttctcatctggaactgttttgaatttcctgagtgcagcattgtattcccagctgcatacagccctagttgccactgcctcttctctctgccactgacttcccacgtctgtacatgtacacatacatgtgcatacctttgtttaactttttttttcttttttaaactcctctctctactttccttaatgcattttggaacttttcggctctatcttctggatattaatcctgttggaagggtgaacactaggggaacaatatgtgcagtgccatggttaagggagtgatgaaaggacatggatttataggctggagcagtgggtctcatgcttgagtaggctttataatctcttggaggtttagttgagcacaaattgatggaccccacccacggaacttctgattctgtaggtctggggttaatacctgagaatttgcatttctaccaagtttccaggtgatatagatgctgctggtccggaaacacacattgagaaccactgggctggaaaatagaagctcatcagttaaaccacttttcctcctcactcctctacctagcacagaattcagaatgcctttctttccttaactctgcttgaattataacatacaaacatctgtttaa

SEQ ID NO: 32701 - DNA, 1055 bp, Homo sapiens
atgcttagtttttttatgtttgtttttttaggtacaagactgtcatgtcttaaaatatacgtcaaaggaaaactgtaatggaaaaatggcaaccctgtctgtaggaggaaaaactgtatcacgttttcgtgtaaggatgtattttcatagctagaatactgcatttttcatcagtttcaaatctggatgagtttatgttttgagattgttccacagccacaaacttgcatttgtttgtgaggtaaattgtgtatttgggggaggcagtctggcacagccattttgcccaggagtcttggagactcttgagtttgttctaatacctctccctgtatctggaacaagtaattttacctctctaagctgtagtgcttgtatatctgtacaatgggaacaaaaatactacatacctaatagatttatcacaaggattaaattaggtttttcagatgtgcttggaatataacagacactcagtagatttggttattttgttattgttttatgtttcatttcactttcttcctatggaaaattgtcttaactcttgacaccaagagcatgtggaaattaattttgtgtattctggaaggagctttcagtgtttgggagaaagctgtataagaatccaaatcagattttttttaataaagcatttttttttaagtagagtactgagtttgtagtttaagtttggaaaagctgcccaatgagtatcctgtattgaataactaaaaccagaaaacctttctcaaaatggtgatggttttcagtaaacatctttaggtttactataacacattgcttatctctaagacaaacttttttttcattgtaaactgtttatgaaatgaacaaggcagaaattaggatacaacccatactctctgactgtcaaaactatcaggtgtttatcctactaactactctattttctgatagttaacttttattgaacatttattacatgccacgtgcataagcattacgcttttttcatttgttactttatataaacttttcagcctctgaggctaacgcagttaactaactca

SEQ ID NO: 32702 - DNA, 1044 bp, Homo sapiens
tcaaaaaataaataaataaaatttaaaaactggcaacaaccgaaatgtccttcaacaggcaaatggataaaccaactgatacatacttacaatggaatactactcagcaataaaaaggaatgaacagtcaatacacagaacaatttggatgaaactcaaaggcattaaactgaatgaaagaagttggtctcaaaacaatacatgctatatgattctatttacatgacattctggaaaaggcaaaactatagtgatggagaacctatcaatggttgccagaagttaggagtgagaggagcctgtgactaaaaaggggcagcaccagggagttctgtgggagatggaactgttctgtgttcttgactgtggttattccaatctatacatgtattataattcaactgtctactaaagaaaaggtcatttttaatgaataaataacaataacaacacagcaaattgctgctgaactgtccccacactgaaattgtgctgagaattttctagtttacctgtaagcagcttcactaccatacatttagccaagtttccatgacagcaggcaattagcattcaggagggcctttgagtggtttggcggtaaggcagttgctcagttcagccatctttaccttagacattaagatatccaaaataaatgatttttctgggaaaataaaatttctttctaaaatatttcaattttaactgtaagcattccacaagtatgtggttaggctggtgtatatcaaatgaattaactcttccatttaaaaatacatagagtaaagcttgtgaacaatctctggcttagagagtgttttcaccaaactataagactgtgttacacgtggacatcagataccagcttagctcctccttcttttgctgccttttcctcccctataggaggttgtggctcactggattgctgaaagccgcattgccattgagaagatccgcttgttgactctgaaagctgctcacagcatggacactctgggcagtgctggcgctaagaaagaggtgaggctaccttctccc

SEQ ID NO: 32703 - DNA, 1046 bp, Homo sapiens
ttctatgtgatgaatcagatttattgatttgcaaatgttgaaccaaccttacatcccaaggatatagcctactggatcatggtggataagccttttgatgtgttgctggattctgttttccagtattttgttgaggatcaaagacttaactgtaaaacccaaaactataaaaaccctggaagacaacctacgcaatgccattctggacataggaatgggcaaagatttcatgatgaagatgccaaaagccattacaaaaaaagcaaaaattgatcaatgcaatctaattaaactaacgagcttctgcacggcaaaagaaactatcaacagagtaaataggcaacctacagaattggagaaaatttagcaaactatttgcatctgacaaaagtctaacatccaacatctataaggaacttaaacaaatttacaaaaaaaaaaaaaaaccgttaaaaagtaggccaaagacatgaacagactcttttgaaaagaagacagacatgtggccaacaggcatgtgaaaaaaagctaaaaatcactgatcattagagaaatacaaataaaaaaaaagccacagtgagatactatctaacactagtcagaatggctgttattaaaaaataacagatgctgggctggtgaggttgtggagaaaaaggaaggcttatacactgttggtgggagttcagccattgtggaaaacagtgtgaggattcctcaaagaacttaaaacagaaataccatttgacccagcaattccattactggatatatacgcaaaggtatataagtcattctacgttaaagacacatgcgtgtgtatgttcagtacagcactattcataatagtgaagacatggaatcaacctaaatgctcatcaatgatagactggataaagaaaatgtggtacagaaacaccatggaacattatgcagccgtaaaaagaataagttgatttcttttgtgggaacatggatagagctggaggtcattatccttagccaactaacgcaggaacagaaaactaaataccacattttgtcac

SEQ ID NO: 32704 - DNA, 1046 bp, Homo sapiens; identical to SEQ ID NO: 32703

SEQ ID NO: 32705 - DNA, 1033 bp, Homo sapiens
agaacacatggacatggggaggggaacaacacacaccggggccagttggagggtgggggcaaggagagggagagcattaggacaaatagctaatgcatgcagggcttacaacctagatgacgtgtagataagtgtagcaaaccaccatggcacctgtatacctatgtaacaaacctacacattttgcacttgtatcccggaacttaaaataataaagaagaaaagaaaggaaaataaaaggacaattaaacgtcaaaaaaatggctaagatgtaaggaaggtgcgcagtttcaatcccctgcagatggctagcaagttatcccagcaccatttattgaataagggagtcctttctccattgcttgtttttgtcacctttgtcaatgatcagatggttgtaggtatgtggccccatttctgggctctctgttacattggtctatgtacctgtttttgtaacagtaccatgctgttttggttactgtagccttgtagtatagtttgaagtcaagtaacattatgcctccagctttgttctttttgtttaggagtgccttggctatttgggctctttcttggttccatataaattttaaaatagtttttcctagttctttgaagagtgtcattggtagcttgataggaatagcattaaatctataaattgccccaggcagtatagtcattttaatgatattgattcttcatatccatgagcatggaatgtttttccatttgtttatgtcatctctgatttctttgagcactgttttgtagttctccttgtaaagattttttacctccctggttagctctattcctaggtattttattctttttgtggcaactgtgaatgggattgcattcccgatttggctctcggggagtgctagtgatttttgtttgttgattttgtatcctgagacttcgctgaagttgtttatcagcttaagaagctttagggctgagactggggttttctagatatagaataatgtcttctgcaaacagggatagtttgactttctgtctt

SEQ ID NO: 32706 - DNA, 1033 bp, Homo sapiens; identical to SEQ ID NO: 32705

SEQ ID NO: 32707 - DNA, 1076 bp, Homo sapiens
tgggatcacagcctcatatacgttgacatataaaatattatattagacatataaaatttctcagcttttctagcatgctgatgtctgaaatggtgtaaatgggagaggtggcagttctttcatgctgctttgacttctggttatttttgtgtagcagctttcattgatggggtccattcttggccttgcctaatcatttttcttggatgatatagagtgttacaaaagaattattatcttaatgaatcaggaatgttctctctatttgttttctgacataggtaaagtgggaaggattagaaccttcaaggtgaaatgtcaaactagaaatttccttttataatctgcttgtgttccccttggttttaggagctgggaatcccaagtgcaaaattgcaattgttttgggaagaactcaaaatacttctctctccaggtaattaaacaattctgattgagaaacctgtgtaggaatgagccagtcttcctcctatctaggtaatttacttaaaattcactgtttggactcacaaatcataatgtaagatatgagagtaaatgtcatatatttgtatttcacaagtattttctaacaggtgtttttggaaaacattatagggagtattgctgaacattcttcgctgtggaattttcagtattagaaagtgttgctaaattatcaaagctgtttggattaaattatcagacaaattttttcagacctgtgtaatgaagtgattagatgtttagatcaaaggcaataatcttgaaatgtttaattatatatataagttcccagttaccattgttgagcagtgagaagcttcaatcaaacaactcatttattttcaaatcattgtttctgttccagatcacagcctgcatcagactatgttggtgtacgtcttttacacagttcccattccagtcatcactgcttacatgactacatgaaaacatcaaaaagacaattgtgattctgcttattatctgttttatttttcttcttagcaaactttttctaatacaatttttcttttgactagacacaaacagcacagcatgattcttgttcc

SEQ ID NO: 32708 - DNA, 1029 bp, Homo sapiens
taatgattaaattcatgaatcaatcaactgatatttaagtaacttatcctccacagacataaagtttagcaatggagctggagttctaaattcagatctttagtctattttatcatcttatctcttatatctctttattttatgatgccatctattatagaatcttgatactcttttatagattcaaaagtatctatccctttcctttatttaccccacccccaacaaccataagcttttttgtaaatgggattcctttattgcaaatcggttgtaatgctataatctttacatcttttgaatttacacattgtttttgctaattcagacacatacaaagcccttgaggcataggggatctcaggattgagcagcttcctctggtagcgtgtgtatgaatgctgtgtataaatcatagtgtatgaatcatggtgaaactagctgactggctggccttttcctgtattttcccttttctcctgatagaactaggagagacagtggtaatagggaaatttgacaaaatacgtgaaataatcatgtagcttagagggtaggcagaagcatcactcaccttaggcaacttttcaaagtacttacttgatgcttctttagctctcttctacttctcatattccttagaactgactatgattccattttgctgcttaccataaattggctcctactcttaacctccctaacatagcaatgtcccttgttcttgaagaatctctctccccacaccctcttctcatccctcctcttgtactgtcattttgctatgttgcccagcctggcctccaactcctagactcaaacaatccacccatcctggccaacaaaagtgctgggatgaatctgtaattttgatgaatattgccaaattgtattccatagggatggtattactttgttctctaccaataatgtatagaaatgtctgtttttctaaaatattgtcaatagaatgtgttgttttactaccactttgctttctaaatgacttgtaacaaattcagcacccct

SEQ ID NO: 32709 - DNA, 1029 bp, Homo sapiens; identical to SEQ ID NO: 32708

SEQ ID NO: 32710 - DNA, 1042 bp, Homo sapiens
tgaaagccacaatccaagctccttagcataacacccaaggctcccttcataatgtggtgccatccatggctcctgccacctctccctactctgtgtccacactagagacagtgataggactaatttctcagcagtgggctggcacccaccatgcagcagcatctgtctacatcattgctcattctgttcctttatctaccatacaatttcctgcccttccctggaagggccaattcctactcaataaacgcggatgcgacctccccagaagactttcctgatgtattagcaatctctacatacccctcagagaactgatccattctgtggaaaggatgcgtttcccatactaccttgttcctctaggttttaagttcctcaaagcatgacctatttgatttgtgtttgtaaataaaatcttgttaatgtgcctggcacaaagtagcttctcagtaaatatttgtcaaattaaagcttttgccaacaggtataaagctgttactctagaatggatagatagtatgccagaaatcttctatgtcaacattgttattgcactatgttggctactagcaccccgtagtattaagataagcttgcacagaattcgtaagttttggaatgtataaaataatgactttcagtgtttttattatagtgctgaattttgttttcctttttcttatcctttctattttccttgggttctttttgtcctctgaagtatctcaaatattcttatagaatcaataatgaaaatattatttttaaaacagtgtgccaacttatagtacattttcaaaagaaatgttcttatgtttgctaactttttttgaatgaatatagcaaagaaaagaaggctctgaagaaagacaccacatagaagaattgctttcattatgtaaaaaccgggtgccaacttttttaaatgactctttttatcattaaagttacttaaaaagttccaatctggaagactactctggtcttcatgttcttatgcattaattattaacacagtatgaaccttgttcttcctttc

SEQ ID NO: 32711 - DNA, 1042 bp, Homo sapiens; identical to SEQ ID NO: 32710

SEQ ID NO: 32712 - DNA, 1050 bp, Homo sapiens
ggcaagcaccaccacgcttggctaatttttgtattttttttttgtaaagatggggctttgccatgttgcccaagctggtctcaaattcctgggctcaagcaatccgcctgccttggcctcccaaattgttgggattacaggcgtgagccactgcacccggccaatctgatgtcttttattaggttggcgcaaaagtaattgcagtttttgttaaaagtaatggcaaaatccacaattacctttgcactaacataataaaagcttctatacagagaaaatcacataaaaaagataaatgacaaaaatatttgcaaatacacattcttaatatacaagacaaaaaagagcaacaactattagcagataattcacagaagaatgtaagtgttcaacctttttcacaaataaaaagaaaaattaaatgcctgttttttacccaccagaatgacagattacagagtttgatgatactcaaagttatcaaaggtatgggtgaaccaggtactcctaaactatgatacaaatgtataatccttttgcaggagaaatttagtaaatatttcgtaaattcagaaattctactttaaaaaatgtgtactataggccgtgtgcagtggctcatgcctgtaactcctagcactttagaaggtcgatatgggcagactgctcgagcccaggagttcaagaccagcctggaaaacaaggagactttgtttctacaaaaaatacaaaaacattagctgggcgtggtggtgggtgcttgtagtcacagctacctgggaggctgaggtaggaggatcacttgaacctggaagactgcagttagccgagattgtgcctttgtgcctctgcactccagcctgggtgacagagtgaaaccctgtttaaaaaaaaaaaaaaaagtactatagaaaactctaggctgggcacagtggctcacgcctgtaatcccaacactttgggaggctgaggtgggcagattacttgagctcaggagttcaagaacagcctgagcaacatggtgaaaccttgtctctacaaaaaatacaa

SEQ ID NO: 32713 - DNA, 1050 bp, Homo sapiens
ataaaataaatttagttaacattttgtgttatgttcaaatgtgaagaaagccttcccctcaaatacacaataaaagttattttaatttttttaagttgctgataaaatctaaatgtagcatatttctttaatttaaaatgctgtgtgcatttttatggacctgatgtttatgtgtttacctatggggttgataaatatctgcaaattaattatattctattatttcttgaagcactttgagatatagtttactttctaaaatataatcattttcatgaaatagtttttaatgaattttagaatgtgttgccatgtggaaatatttgtatttgtaatcatcaagttaatttagtgtgatgcttaaaataatagttatctagattaaatgggaaaaaaggaagattttttaggaccctcatatattgtttcagaatcaaggattgcacctacttagtgattgcttttcatttttcatgtttgctgcagtacggatttgcccttttacgtagacgggctttacagttagaagagcttacattaggtaaggacacacctgataatgctcggaccctcaatgaactgggtgttctctactatcttcaaaataacctggagtgagtaccatggggttaataatgaaaataattaaccattttctctttgatgcaatgctgttttacatttttgtcaagtctaaagctagaaaaaaaatgataaaaaccacgcaaaatttcatgtatgatgttatataatgagcatacacatacctaaagaccatggcattttctctactgtgtttcttttcacactcttttttttttttttgagacggagtctcgctctgttgcccaggctggagtgcagtggtgtgatctcggctcactgcaacctccacctcccattcaagctattctcctgcctcagcctcctgagtaactgggactacaggcgcatgccaccacgcccgactaattttttgcatttttagtagagacagggtttcactgtgttagccaggatggtctcgatctcctgacctcgtgatctgcc

SEQ ID NO: 32714 - DNA, 1771 bp, Homo sapiens
gggggaggttagatagatctgggatgcaagggaaaagaaagagccaggatgattctggagtttctgacttgagaaattaattaatgtagcttcatgaactgaaataggaaacacaaaggacaggcaggttgtggggaaaaggtgatgagtttagtttttaatcatggttagtttgagtagctccacgtaacgatgtctagtaggcagttaaatttatagatgaggaaaatagagaaagggccgggctgggaataatagacacctgttattttgaaatgcaagctcactttaatggttctttaaaaagtagtagagtggccgggcatggtagctcacatctgtaatcccagcacttcgggaggccagggcgggtggatcacctgaggtcaggagttcaagaccaacctggccaacatggtgaaacccatctctaccaaaaatacaaaaattagccaggcatggtggcgggtgcttgtaatcccatctactcgggaggctaaggcagaagaatcgcttgaacccaggaggtggaggttgtagtgagctgagattgcaccactgcactgcagcctggacgacaagagtgaaactcccatctcaaaaaacaaacaaatggctgggcgcagtggctcatgcctgtaatcccaacactttgggaggccgaggcgggtggatcgggaggtcaggagttcaagaccagcctggccaacagtgaaaccccgcctctactagaaatataaaaaattagccaggcgtggtggtgggcgcctgtaatcctagctacttgggaggctgagacaggagaatcacttgaacctgggaggcagaggttgcagtgagccgagatggcactactgcacaccagcctaggcaacagtacgagactctgcctcaaaaaaaaaaaaaagtagagcaattggatcccatggagcagtgtttctcaacctgtttttgctcctataaggagccattttagacattttatttgtaattgcctcccccaagaaattttaataccacacacatattgtatatcagcttgtgtatatagatatatgtgtctatgtgtactttatacataaaaagagtaagttttttcactcccccacaaatgcaattttcagtaccatatcaagaatgtatattgtaatagttaaatttcagttgcattacaagtgcttgtggacaataattgtgtctgatgccactcctcatagatactcatacctatgcttagttttactgatagtatggaacatagaactagaaatgttttaccatgtaactatctaatgtatatactgtttattttataacactgtttgttgtgattcattgctcaaagtaatgatacacatattagaataagatatattaattacttaatatgattaatagacattagttttgcttattttacaaaagcagtataaagtgttaattcctgtggtggattttaaattgtgttatgggtaattacagttcttgttgtattattaaaatttcatttttcttttctttacataaaaggttgtggcctacacttcatcttgatcccttaagtccaaaagatgcaaaatctattataattgcagaatgccactctgtagacattaaattgagtaaagagcaggtgtgtatttttcattttgatgcaatcttttactctctcatctttcctatgaaacatcttatgtgagacttaaaattcaatataggggatctgttataaggaaaactggagtttagtaattactttggtaaatgtatt

SEQ ID NO: 32715 - DNA, 1103 bp, Homo sapiens
gcagaatgaatggcagcaagtgaaagtgaatgtacttaccatcattagtgcttgaaggataacatattttcagtaacctaatataaaaactgaatatgaccacagagatacttgagatcaagaaatcacatcttagtaattcaattcttatagcatatttcctagccattagtactttataactattcaccagccagatacaaccaaaatgttgtgtaacatttttcagaaaacaaattccatgggattcaaatattcctttaattttatttttataaaaagaggtattcatttctattattttaatatttttatttctttgtttttaaattagtgatttttttgtagttatcagtttattcttgtaggtattatacaaaggctgtatgtttgaacttgccctcccaaaagtaggtgaagcccactttgggcctgggtgaccccgctgtaagatctttattttcttcattcatttttgtgtggttgttctttgtgtttaggacatactgggttttgagaacacagacttggagactaaggatttgggcagtgaggattccattccagaagaagatgattttggtgatgttctgtgggacatacatgatgaacaagagcaaatggaaacttttcagcaggcttctaattcagcccatgagttgggatttgagaaagtaagtgcttggagtattattgcaacaaagatctgtcaccacttaaaggctgtattatgattgtattttcatctaaatatagttaaggtttatgattatattagttgtctaatctcatggcttgattatccatgttgagatgtgcttaggtttgtgtcataagaaagatatgtgagattcaaatgtgcttataaagaccgaacatttttagttatggactagaatttatcaaccacatgtttattatgctaccatctgcaactcactcagaccaggattaggatagctaggaaacttgataaggatagtaaggctgaggccaggtgcagtggctcacgcatgtaatctcaacactttgggaggctgagacaagcagattgctttaagcccaggagtttgaaactagcctgagcaacatggcaaaacctt

SEQ ID NO: 32716 - DNA, 1022 bp, Homo sapiens
ccctcctaaggttgttgtgaagataaattagctaatatgtgttaaatatttagaatagttcctgtcacataagcagtataaaagtatttaccaccacttccttctgatattatggtttttctcattgttcttaaatgatttttatctagatcattgatcactcaggagatcctgcagaaggagtatataaaacttatatttgtgtagaaaagattattaaacaggtaaatatgcattctctgtaagttttcatctaaaatattttaagatcactttctatgaaattgatttttccagagaaaaccacttgcttgtctttttgaacacagtacctgaggaaggcgctgttgtttctgttgggagtccatcctgtggtatgttcttagtattactaggaccatgtattaatatctttatctctcatctatctcagaggactatttgatgcttcaatacctaagtgtaaaacatattacaaaagtgctagccaaaaactatttaagagaaagtgttcattttattcaatagggaggctcctctgtgaattttgaatttttatatattaggaaagtctctctcaggttttccccccatgttatccctaacagaagagggggatgaaagcatgcctccaggggggtgagaacatggaccagggaggggccttgagctggaagtctctatgaagtttcatgtgctatcttgaaaatttatgtgagttatatattctgcctgatattatgtctatgtttgtgtttaatataaaaaaattttaaattatatattagaaaaaaatagtaatagtgattatttattattcccctctccctcaaacagaatgggcgcagtgggaagatgtaccatgtttagcctgtggttgcccacaccttctgacacctcccccagccaaccaaaaaccctatttgagaagtaggaagcttgaagatttattattagagaaaaagagtgagccccaaaatgatatgacctctggcaacacattttgtatggtgctctctagt

SEQ ID NO: 32717 - DNA, 1040 bp, Homo sapiens
tgtttcataggtcatatgatcaacaccttaatttttagcttattttaatcagagtttggcaaatatagcccaagggccaaatctagccaggagtttgcttttgtaaataaagttttattggaacacagccacattcattcattcatatatatataaatttttttttcttttttttttgagacagagtcttgctctgtcgtccaggctggagtgcagtggcgcaatctcggctcactgcaagctccacctcccaggttcacaccattctcctgcctcagcctcctgagtagctgggactataggcgcccaccaccacgcctggctaattttttgtatttttggtagagatggggtttcactgtgctagccaggatggtctcaatctcctaaccttgtgatccccctgccttggcctcccaaagtgctgggattacaggcgtaggccaacacacctggcccattcgtgtattttctacagctgccttcatactataatagcaaagttgaatctttacaacagaaaccatgtgtcctacaaaacctgagttgtttactatctggccttttacagaaaaagttgataacccctaatttcaataatcaacattaaccttcattcttttctttctttggatacaaactgagaggtatttgaactatgtattttacatataaagttcatgtacttgatcacttgtgtaggtgttgaatcataatttacattttttgaggagcttactatttaaatagacccagtaaagtgaacaatgttcttataatgtgaatataatcatgctaatgaatcttgtctgcaagtaaagattttttttcaccagttagatatagagataaaggacaaaataagtttaataagaggctaatttttctttctagatttactgtctaaatttaacctttccaaagcattttgcttttttaattgtggaccaactctgactttaactgtgtatagatatatgtaaggccttaagtttcaccagtttccctgtagcataacccattgtagacccttaagactt

SEQ ID NO: 32718 - DNA, 1040 bp, Homo sapiens; identical to SEQ ID NO: 32717

SEQ ID NO: 32719 - DNA, 1061 bp, Homo sapiens
cctttcccagaaggtacaacctaagatcacttctcaaatcccattagtcagaactataactgggaagactggatagtgtaatcagcagccaggcagacatgtgtccaactaaaatgtagtgttctgttactgaagaaagaagaggagaatggatattggagttactagtctctgcaatgttatttctttacataatgatgtattctttgcaactatcatttagaatacttgccttatagttcactgagtggtttccagtatagccttgtgaactattcaaaaagtatttgttttataattaaacaaatgaaacatgttttctggaaataaaagcttgaaatcacagagtgaaagggtttacatattctaagaaaatgttaaagtgtgattgatactgaaaaaagaaaaatattctattttaaaatgcagtggaaaaatgtagtcactctcccatttgtaatgaactgtaagtatattctcacaaatggatgcattttggagtaaaatatggtaactgacagttccttcttaattttcattgtagtatcattggaatctgaccaacatcctggaatttttattgctaacttttaaggaaaaaaaatgaaggccgggcacggtggcttatgcctgtaataccagcactttgggaggccaaggcgggcggatcacgaggtcaaaagatcaagaccatcctggccaacatggtgaaaccccgtctctactaaatacaaaaattagctgggcatggtggtgcgtgcctgtagtcccagctactcgggaggctgaggcaggaaaatcacttgaacccaggaggtggaggttgcagtgagccaagatcgcgccaccgcactccagtgtggcaacagagccagactcatctcaaaaaaaaaaaaaaaaaaaaaaaaagattcttaatggccaagagtagctgagaaaatgctcttttataccccaacacaagtcttagtgattatttcagtattgacatactcaaatgtacagtgtttcaaaactattgtaattgtcttggcaagttagaaacaaattcctttctaggt

SEQ ID NO: 32720 - DNA, 1061 bp, Homo sapiens; identical to SEQ ID NO: 32719

SEQ ID NO: 32721 - DNA, 1070 bp, Homo sapiens
ccaggactagtgtcctggtaagaagagggaggcacaccaggagtttgccggcacggaggaaaagccctgtgaggacacggggagggcagctatctgtttacacaccaggaagaaatgtctcaccagataccaaccctggccgtctcctggattttggatttccaatctccagaactgtgagaaaataaatttctgtttaagccactcagcttgtgatgttcctttgtggcagcctgagcagaccagtaacaatattaacagtaataaggttcttactttggggcctgagatgcctgggaatggaacaggctgttttgtatatgagcatttttagggtagagttcataattctagagtttggatctgtgactttccacccaaaagtcacaaaccactgctctaatgcaaacctattatttcacatttacacctctcacctagaagtgctttaatacaggctgctttgtatcagggcttggtttccttctgacctttcaagacataaaaatcattactagcttgaggccatgcaaaaataagcagtgggccatagttgactgttccttattttctatccctaaaaagattttaaaatctagatctgtcaacaagcaaggcacccagctcaattttttttttcttttgagacggagcctcgctcttgttgcccaggctggagtacagtggcatgatctcagctcactgcaacctctgcctcctgggttcaagccatgctcctgcctcagcctcctgagtagctgggattacagacgtgtgccaccacgcccagctaacttttctatttttgtagagatggggtttcgccatgttggccaggctggtctcaaacttctgacctcaagtgatctgcccgcctcagcctctcaaagtgctgggattacaggtgtgagccaccgcgccctgccactcagctccttttctaccatcctgagtagcagtctatggcagacatacttgacaacaactcaggcataccctgggaagtgaccctgtggtctaagaagaatgtatgtttggagttccaagttaaggaatccaggagtggccag

SEQ ID NO: 32722 - DNA, 1033 bp, Homo sapiens
ggctgaggcaggagaatcgcttgaacccgggaggcggaggttgcggtgagctgagatcgcgccattgcactccagcctgggcaacaagagcgaaactccatctcaaaaaaaaaaaaaaaaagaattgcaggccaggcacggtggctcatgcttgtaatcccaccactttgggaggccaaggtgggtggactgcttgaacccagaagttcaagaccagcctggacaacatggcgaaaccccatctctgcaaaaaatagcaaaaaattagccgggcatgctgtttgatgcttgtagtcccagctacttgggaggctgaggcatgagaattacttgaactcaggaggcagaggttgcagtgagctgaaatcatgccactgcaactccagcctgggtgacagaatgagaccctgtctcaaaaaaaataaatgaattgcttaacatttctgatatttgttatttagaatattgccctattagattaaaacatactgttattggaactctgtattgcattagcctttattatgctaaacctaaacacctaatactacatgcgttaccagaattctctataaatacacctaatttcattttaaggacaaactagaatccgttaggaatgtaattttgatgtaaaccgttcaattccaaatgactttttgaaaggcagattcaaacagtgaaggagagagtgctcaacttggacacaaaatcccttaaattttcatcagattttcttcaaaatggagttgagggtatccctgctgctagaggattggtcctacagggttttcagctttgagctagttcacagcttaggacaatacaaattctacacagagaaataggtagcattatgatgtaaactgtccccctcccaccaaacaaaaaccacatgggcctgtctttatcagagctattttattttagctgaatcattttgtagattgtagtacgtttccctgaattttattactcagaatcctttgaaataggccaggcacagtggctcacacttgtaatcccagcactt

SEQ ID NO: 32723 - DNA, 1036 bp, Homo sapiens
tttctttatatgtggttttttgtaacgaattttctttactagatacagcgcttttcctattttctgtttcattttatgtcagtttttaataactggtgtttttcaaataatatatccatttcatcttatcaaatttgttggcataaagttcttcataatattcttattatccttttagtgtaataagtttattcctggctgggcacggtagcacacgcctgtaatctcaacagtttaggaggctgaggtgggcagatcacttgaggtcaggggttcgagaccagcctggccaacatagcgaaaccctgtctctactaaaaatacaaaaaaattagcggggtgtggtggcgtgtgcctgtagtcccagccactcgggaggctgaggcaggagaatcgcttgaacctgggaggcagaggttgcagtgagacgagatcacgccactgcactccagcttgggcaacagagcaagactccgtttcaaaataaataaataaataaataaataaataagtttattcctgatattgtcaacttgtgttcatttataactggcttatttaggagtctgttgtttagttcctaaatataagaggatttttttttctatctttttaatttgtgattgcccattgaattccattgtaatcacagaaaatactctataattttaattcttttaaagttattgagacttgttttatcacccagcttcatctatcttaatgaacatatcatatatgtgaaagattttatattctgcagctgttgggtgttgtgttctaaaaatatcaaataggttaatatggttgataatgttgatcagattttctgtgtatgtgggtttttttgtttgtttagttatatcaattactgatactaaaatctccagctgtttgtggaattgtctgttttttctctttaattttgtcagcttttaccccatttatttcaaactttgttgctagttgtttacccatatataatttctttgattttcacatattgatcctttgttataacacgtatctctgggct

SEQ ID NO: 32724 - DNA, 1048 bp, Homo sapiens
tactgactttataaggattaagtgatggtaaatcttagtggatcaccaagcatcttagaaagtctataataaagtattttataattaattcttaaaatggcttttgatttaagggagttttttgttttttttttgagatgcagtcttgctctgtcaccaggctggagtgcagtggcgtggtcttggctcactgcaacctctgccttctgggttcaagtgattctcctgcctcagcctcccaagtagctgggattacaggcacgtgccaccatgcccagctaatttttctatttttagtagagatggggtttctccatgttggccaggctgctcttgaactcctgaccttgtgatccacccacctcagcctcccaaagtgctgggattacaggcatgagccaccgcgcccggccctaggggagctttttgaatgataggtttattatgtagtatctcttaggcttttgggtgcggtctgtttgaaaagagatcctactgctaaaataaacggaaagaactgctgtagaacatgttagtttattatgagtctcttaataacttcagagttttactgatggtttataagaacttagtatttctactttgtttttatagtagtagtctaaaattctactggatttcttcctccttcccatcttaccaacaacatatagacgtcgaaaaaagttatttttttctcctagatgtgactgcaaaataattgtacttgcaaaaaataagaaggtttttacttataaaacaaactttacattttaacaaaactgtttaaaaaactttccggaatgttttatagtattgcctcacctttaattccatctaagcatattcattcccatgagtatatctgtaaattataagtatactattaccctttattccttatattatgaaaccaagggtcaaagagactataaaactagaacccagctctcctgacttactgaccagtaaactccctagacaaaactatgcttccttagtgcgaataagtacaattttaatacttatgtttagtaggagtcataag

SEQ ID NO: 32725 - DNA, 1050 bp, Homo sapiens
ggaagttgtttattgccctatatttgtaagaaaagttaatccatagacaatatgtaatcatgattattttatctcccataaatttatacgttttcaaaatatgtaggtcgtactctttcagatgtcagcaatatttccaacataaatgcaagttgcgtaagtgaatcaatatgtaattcacttaacagcaaactggagcctacacttgaaaatctagaaaatctggatgtcagtgcatttcaagcacctgaagatttattagatggttgtcgggtacgtctttattatataatacatgcagtagatgatatacattagcatttcctagcctgactttgaagacccttcagagttgggcttgctccttactatctatgtaaaccctccactctagctaagtagatgcacttactagaccatgtccatcctttggctgcgagagtccctctgcctgcaaggtatcttcctctgttatcttttaaaagttcatttcaggttttaactcttctctgaaccctcctaactacattaatcttttcatctgctatatttcgagagcacttagtttctgaacaacttattggattttttttttttaatttttttgagttagggtctcactctgttgcccaggctgggatgcagtggcacaatcataacttcctgtaaccttgaactcctgggcatcagccacccctcagtctcccgagcagttagaactacaggcatgtgccactacacctggctaatttttaaaatttttttgtagagacaaggtctcactatgttgcccaggtttggactttaaactatcatccaagtgtttacagtgtattagacactgtgctaatcattttatgtgtgttaatatatatataaaatcgcatttaagtcccacaaataactctaaaatggatattatcttgagggtaagacttagagaattaaaattcttgttcagagtcacacagagagacattaagtggccagttatctactccaaagtctgtattcctcaccattagagccactgctttgtttggtatttct

SEQ ID NO: 32726 - DNA, 1022 bp, Homo sapiens
caagggtttagcattagctacagagtaggaaatgctttggtgataaagttctcagctgtaaatatttctgaaataattgagaaaacgagtttggcaattctgtagcttttatgttgcattatccttcaacaccattcccatatgttaagatagataataaattagtcattttggcagttgcattccttccaaaagatggcatatgtaaggttgaatataaacatatgcaagtcatcagctgagatgtgatcatttaataaatgctaattgagcccattttacgtatctgacttgaggtaggcattaggtatatgtagtaagcaaaacaagatagtcacttccctcatggagcttagagcctatttcaaggggcacacttcagtttcccctgcaactagataaacaaccacaagaccaaacaccacagaattgtattggcatacgaattatatcggcacttttctgggcttgttttcaacaccatccagcatatcccaaatatgtctccatgtcagcaactctcattcccaatgtgattacttcatcagcacacctccctagcatggcaacagaataatgatatttttgttggtattttgccaaaaatcattgcttttacttgtatagaataatggaaagattaaaaagttcatttatctaataggcaaccaaattacctttgggtttttaagtagagattcagacttatcattttggaaaatatactatgaccagcaagggctagagttaaggaaatatatatttttcccttaaaatggttttgagagactgtatctgaaacaattactttgttttagagacatgttattgaactaggtgaacaattagtgtaattctgttttggtggttctcctttgtaaaaaaaagattataaatcctaaaaaatgagggaagcaatagtgatatttgtgttgtttttcattattcttctggtaaatttaatatgttcttttttaaccatttgattcccacagaaaaataactagatatactgatataaa

SEQ ID NO: 32727 - DNA, 1061 bp, Homo sapiens
aacctcctttcactgactttcctgtctcagttaatggcattccaaccttaggtgattagaccaaaaacttggagacaatagaaaataagctttaaaaagactttttaaaatctgctttactgacatatagtttatgaacaatgaaaagtattaattttaagcctacttgctgttcaatgagttttgacaaatgtatacaaccacacaaccaccattttaatcgagatatagaacatttccatgaccaccagaaaatttcttgatacttccttccagacaatactatccccacctcctcactccaccctccttccttgtgcaagcaaccaataagccttatttcactatagattagcttaacctgttctagaattttatataatcggggtcatataatacattatgtatctagtttttcttgcttagcatgtttttgaaattcattcgtgtggctatgtgtataagtagttcagtccttttcattgcttggtagtatttcattggataaatagatcataatttgtttttctgttcatttattttttggcatttaggcaaaatatgtttttctgttcatttgttttttggcatttgtttataatgtttttactattgtgaataaaactgcttaaaaattaagcagtgcacatttgtgcacaagtctttctgtggacctatgttttcttttctcttggggaaatacttaggagcaaaacttgctggatcacagggtatgtgtacatttaactttgtaagaaactgcctatttccaaagtcatgccatttaatgcttcccactggtatgggagaagtcagttgctccgtatcattttgaaaacttggcatcattagtgtttttaaatcattgtcttgaggtttaacttacatgcaatagtatccatatatttttatttttatttattttttgagacagagtctcgctctggtgcccaggctggagtgcagtagtgcaatctcagttcactgaaacctcagcctcctgggttcaagcaattctcatgcctcagcctcccgagtagctgggattacagatgcacacc

SEQ ID NO: 32728 - DNA, 1077 bp, Homo sapiens
gtgaacacttcttatgccaaatggctcacagctctccctctgcaaacgccctcaacaagactgagaattagaggcagttcttgtgccaagccccacagaacctacccttcctgtaccttctttcttcactatagcatctcctgctttcattcactcttcttagagatccagaccttccccttcatcctccttttcattacaagatgggcagaatgaaaaacagccatttgtactttgaaacattttcatgaagtttgttagctctaccagtggatttttaatcctgtggtagtggaataaaagatttgacttcacccagcaaacctaatggataaaatgtctttaactctgctaaatgaatttcagtcacaaagaaagaaacagaagtaatctttggtgagttaaatagattgggcaacagtgtttaatggtatgcccaagttaatccttagtgtaaacctgtagtcattttagtattcatgggagttggtggaaaggaagctctgtaatctcccatgtgatctcccttgctcctctggagagaaagtctagtggtccaggggaatgcaaagggtattgaatcagatgaagatctgatatttttctccgtgtacttgctctttgtccttggcaggttacctaaactttctctcccagcgtggatttccttgcatataaagtggaactcctaatcgctgccacttgagcggttatagagaggttgcctcttagaggtttactgatctttaagtcctcattttcccacctcctcagggtcagtgctttccatgttagtaactcctgcaaatatgaggggagcgcacagctttgccacttgtgcattggtgattgtgccacggttttataactggggtttaaaaagtgatacatgctcaattaagacaatttttaggaaatacagaaaacaaagctgaaattatctatagtcttacaacttaaagacaactcttaactctttgcatatttccatgcagacctttattatttttctccatttttataattatcttgcaaatgggaattttttatcttactttcttgtaagataagctttta

SEQ ID NO: 32729 - DNA, 1031 bp, Homo sapiens
tttaaaagcttggtattggtcctgttcacagaactgtaacaaaaacttctaccttttgagccagaagcagcttaaatgtaacatcataatgtgtgacagtatcaacattagagcaaatttttttaaagcactatatagagtcaacataatttgtatgtctactgaaaatttgatcacatatgtttaaaaaaagaactgtggttatctctgttggaagatgtttataggcttctgaaaaaatatagtttctgtatactttagacagttccttgagttctgctgaaaaataaggtgactacccagagccttacttttaaatttagttatattttggttcatattcagaaggatttgaggacctaaaaagaaggcagccacagtaagataaataaaatggtaatgaaaaagaaactgagttttttggcattgtggtggtaaaaaagaaaacaaatgagccagcagtaaggagaacaaatatttttactgtgactgaacataaaacacctcctagcttctcggcaaccaagggtgaaggaaacactaaaagttgataatctcagtagcagaagggaaagaaacagttggaatattgtcctttttggcagtgttgaaagtgcttaatggtctattacactgactctagggagaagggccaaaggtgtttaatcctagtatataatgttaacctattacttagatacctagccaatgttcttaccccagtgaaaggtttgcatcacttcagcacagaagtgagtagcagggataaatgtagacaaagccaggattttcccaagaaacggttttatattcactgtagccttaaagatgtcttggctgaaaaatgctcagagcaagcatttgcagtgttgtgtctcatgcagttttagattgtaaggttttgcagcatcccatcaggatgaattagcagtctcaggaggtccttagggaattgaatgacattacatactaaattggggttatttgatactgagcattcagtccttgaggaaagtcttgtaaaggtaggt

SEQ ID NO: 32730 - DNA, 1021 bp, Homo sapiens
caggactgtctggatccaaaacttgtactccctggccttcccttgaagctactttttaaggctctgcggtagagaggaaagttcatttttgtcttttcgtcatttctctgaggctaagcctagaaactcataaatgccattgtggatacctcattactgagctccaatgctcctggctatatcattagtttatttagtataattcaggaaaattttcatatacttagtttagatatggtgtttctgaaagcaagttaagatgtgtaatagtcacaaaaaacttttaacagtcgttaaaaccaaagatttgggtctttttactctagggctacagtaatgttgatcacatatgaccttgttatttttgttttatgttatattgtgccagaaagttttgtactataattttatgaatgttgtatgatctcattaattattacttttccttttaggtacttttgggcgtattttccatgggattttaatagatgaaaaagatccaaataaagaaaaacaagcatttgtcaaaacagttaaaggtaggatcttttttccatagtatttccatgatgctcttctgtctcaggtggctcctgccagcaaaattctgtctcagtttcccaatgtgtgccagaccttttaaatcagtcagtgttaatttagctgaaaacaaaaattgtcttatatgagcctaattgttttggaaatttgggttgttctcattaagtatagaaaaacagaagtctgttaaattaagacataagacatttcttagatattactcagttaattgcaagtcaaactgcatccacttgatttcattgttactatgtttagtgttggtatacttttgcaggtatagccatagttggaattgctggcctaagggtgtgtacatttaaaattttaatagagcccaggtgcagtggctcatgcctgtaatcccggcactttgggaggccgaggtggccagatcacctgaggtcaggagttcgagaccagcctggccagcatggtgaaa

SEQ ID NO: 32731 - DNA, 1856 bp, Homo sapiens
cacctggccaatactcctttctaagctccgagcatgttggcacatttgatttggtttgctctttctttatctgtaggccatttgatattgggccatcattgaaagaggcctgtctttcttcttcttttctaaaaagcaatctaattgaatgacatgggctctttttttgagagatgatccgtagttccctaacatatttgtgtgtgaagtttaggacaattagctgaggtgtctgagcactagtacctacatttctgaataattttgataagatgaactcgcttaatgattttggagatagaaatgaaagaaaaaatagagctctataggagttagattaaaatatcagtattggaacatcatgaattattgtgatctccgtaaggattttaggctggttttaatggctatgtgcattttgtatgtatggaaaaaggaaatttctcattgaaactgacttgtcaaatatttctctcaaaaattgtttgcagcattagtgccagcagtagttcccaagggctgtctcagccatccacccagacgactcagtatctgagagcagacacgcccaacaatgcaactcctatcaccagtaagagttaatttaattctaaagccagtttactcaagttgtctatgctgcttcccagtggtcttgcatggttagtgtacttgtgggacatgttgtgtaaatcgtatctaaagtatgcaaaattaggtatgctcttcaacttttgctttctagagcattgaatgaaacattctaaaattgaggtatcaaaaatgaaatttaagtttgctagaattggtgtggctttcgggagatttccatagatttattatactaaaagggctactaagtcacttctatagaaattcaaaaggaagatttttcaggtaactatatggaattaactattgagctgcataaagacagagactttagactgtaaggaattgtttgatggtcttatgggccatggtgaagactttacattgttttttaatcataataggaagttagctaccactggaaagttgagaatgtcggatctgatttccttttttggactggcatttattctttagtaaaataagattaagatatctgtcctctacccagtgccctattgtggttttccagtactgtctcccatgaaaaagaaccaggattttttggagaaatggctgattccaggtctgagttaggaagtgaacaagataagcctgggacatgttgctgagtcagatatcaaggaaatagctaagacttgaagagcttccactggctaaagataggaccatttgatcatcaaaatgaataatgactataatgaattaaaacgtaaaatgtgtaaaaatccacaaatttgtaataatacattatttaacaaaattgttcattatgagaggtgactaaggctccagtgaataccttactctaccaactgactacatgaactgtatttcaggttaaccagatggtgctggtggatgagagaaaatttttctttacagatgattctcagctaataaatgtggaagaaattatataattagaaaatcacatgtgcaactcctgataaaatagttgattcagaaaaagatcatcagtgattgaaaggaaaatggggaactctgccattgagggatcaggctgtcaccacctgaatacactgatgaactcagcattactaaaagtaggggacctaggtatttcgtacccaaggatatgatgtaccattcatggagcattcttttctgtccctgctgcaccccctacaagttaacctggatctgatcaaggttatagacctgacttacagtttacaggaaatactacttgaagaagtaga

SEQ ID NO: 32732 - DNA, 1198 bp, Homo sapiens
ccagcactctgaccagatgatagcctaatgaatctttattatagtctctttgagttgcaaagtatcttcgcagagttgctggagaaacagggctaactgcagcatcacaagaagaagtatcaggttggtgcagtaattgcagtttttgtcattaaaagcaatagcattaaaagcaatgacaaaaactgcaatttgcaattacttttgcaccaatctaatagataacctaaaatgatggacatcttcagggaaggcatgctgggggggcatttcattaggcaaacatgtatcttgagatctatggttgtgctgagcagaatggtttgcatattataagtgctctccaaatgtttattgcaggacatttctatcttaatttttgctatgactttctacagatgtttggttacaatagcagatagtagtatattgtattattagccatagaaaggctacataaagacttacagtcctcattgcctggatgttatatatttacatttttcagatttgtgtatgggctcttgaaattgataaacattcatatataaatgttatagattacatagcagccgtgtgtgtgtgtgtgtgtgtgtgtgtgtgtgtgtgtgtgtgtgtgttttgtttcagagacagggtctcactatgttgcccaggctggcgtcaaactcctggactaaagtgatctgcctaacagccttccaaatagctgcagctacaggcttcacaccgcactcagctttattatgtatttttttaaatcaccagtttttgaaaatacagaattattatgtgggaagtggtcagttaaaagattttgcatattaaggaaagttggagacttgattgggcactgctgatcctgtagctaagagaggcattgaaagacctatcctgctatctggtttcacccttcatgctgaatttctatgtttcacgtctccactgctgcaaaattataagaactaaggcagtgagaccgaaatgtacccacgagacaaggtttctccccactgaaaagacaaaactacatgcttgagcagcattactttgcagtaatcttgaacacaaggtttacaattatttgaacctatcatcttcttggtgtcctgtattatttagagaatatggtgtagtgtttcaagtactagagatttcccagaagttggatgaaagggagggattggggaagtagaag

SEQ ID NO: 32733 - DNA, 1049 bp, Homo sapiens
ctagatggcaggttttatggaagagtggtggtcctgttgtggacttaaaatagagggtggcttacttggttgaatttttatccaattgaaaattcttaggactgtttctgacaatttgcatttttttatagctagattatttgtacatatgaaaggctcatccattgattaatgagccaattaatgaagtcaagctgatagtatccttcttgttatcacaggtccattttgtttatttttgtctattttacaggttgaatataagctgggattccaagtggacaatgttttggcaatggatatgccccaggtcaacatttctgttcagggggaagttccacgcactttatcaggtaagtaagagtcttcaaagacagagttaacatactttttcaactgcatcccctatggccccaaaacagaagtttactgatgtgtagtgtgtattacttgataggcataagatgtatgagtactgtgaaaagtaatttttgtaaatatttgcactgtgttcttaaaccattctctcttttctgtccttctggaactctctgtgctccgccctccctgtctctttttctgcattgctggtacttacctccacatgagtccctgtgcctgatcttgtttccctttgattaggcaccacatttcaccctgtggcccagatgatctttgcacggtcatgtttgaccctgtgacgtgaagcccatcagtgctctccactcccatcaactgaacattccagactcaccaccttgtgtcctggatcctttaccatctgcccctgcctgcctgtctagccttgttgctgcacttgccccagagttgtagcagttccagactacatgcagttctgatcttcaagcctttgcatgtgctggtctcagtatttgggatcatcttttcctctttctgctcgtgaactcctttctattcatcctactcattctgcaagactcaagatctgcactgtcttttttctgccaccttctcttctttcatttgttaacttctattcttcctaccccttagaaccttatatttaa

SEQ ID NO: 32734 - DNA, 1040 bp, Homo sapiens
aatgaaaagaatagatgctctaatagatctgccggggtgttgaaaagaaaggcagaaatggggttcctctgtactagtggaaagggacaaaaacattgagtgtgaggaggtggggaaggcctgtaaggttggaataagacgagggaaaagagggtcagtgaggaagggattgctgagtagaactaagggcctcccctgagactggaggtcattgttgtgtaagagctccttttctgtaggatggatttccttcagcagtgctgagcagcaggagtagagtaagaaggggtggtcaggatgctagagctgccctttgagggtttggaaggagtcaaccagctgaaggtgccaatatgactgtcagtaatgttgccttctttagggcttgggctgtggagaacatgaaactaggtgttcacggctatactggagagaagggaagtggctttaactggctgctgcatcctgctatgaacacagcacctggctcataaatgtgcctcataaatgttggctgacttggagtgatggaatcagagaactagttttgtaggaatcagaggtggtgatgggatctttgatagaatggcatttttgcatttgttttggtagtgaagtaattctttagcgtgtcaggatattgaatactgaatattgaagccagggagaacatggcaggagaccaaggcctctgcaagtcctgtgtggcttattggtgttgatggcatgagaagtagccattatgagtagaagctgtgagcttcggccgggcgcggtggctcacacctgtaatctcagcaatgtgggaggccaagacaggtggatcacttggggccaggagttcgagaccatcctggccaacatggtgaaatctcgtctctactaaaaatacaaaaattagctgggcatagtggcgtgtgcctgtagtcccaccagctactcgggaggctgaggcaggagaatcgcttgaacccaggaggtggaggttgcagcgagccgatatcacgccactgcactccagcctgggtgacagagtgaga

SEQ ID NO: 32735 - DNA, 1447 bp, Homo sapiens
acagttccgtagcctttctttgtgttttttgaccttaacatttttgaaacttacaggccagtaattttgtagaatgcccctcagtttgtgttgtctgaggtttcttcatgattagattcaggaatatctctttggcagtgataccacaaaggtgctgtccttcccagtgcacaaggtgccaatttgtcccatgactggtggtggtaactccgaacactcttgtcaccagatttctcccctgtcaagttttttactttatatatagttagtaagtaatttgtggggagataatttgaaactatcttttaaaaaaatctcattcctcatcatcctttcaaccactactttttgcatctgtttttggaactagtttcgtatttcagcctgtggtgtggtgagggtagtgtgtttcctctcactggaagaggtcagacctacactggataaccattcaataaggctgttatagaaggaattcaagtatttgtggagtggttgttactgaattttaagttcccttgcaactctgaggtccagtgtttctatgaacatctttcaggcagagaagcttcttatattctccaaaaagttgatagctaattctttgttgttattcttacctttgatgttgatacatataaaaacaaataataaatgtatttcaaaatggtgaaaggtttattagagaattctgttctaggtacttctattgactttgaacagagtgtgaatatttctgggcacacttaggaaaaaagaatgctgatatgagaaggtttcctgggcaagtgtatgggtagtgatttgtgagtacaaaggcaatgtgggaagtggcagtcaggactgaacaaaataaaaccttcttttactgattcctttaaaacagttaaaatacaccgtttgttatttggaatgagctcagggccctgatgttgctggtaatgggtgtctgagtcttaggagcctgttacagggggaagttggagtgggagagagcaggtaggaggggctcgggtgaatatatatgtttgaaggggaagcagtgttagcatggtacattttgggttaggagaagccttggtatagctgtaactgtactcccatatcattcacattattttatagagcataatttctaagttacctctttggcaggtataaatattattagtgcacatttgggctgccactgctggtatgatattctttgtgaggcagaagtttcctgattttttttggagggtatgactattttcatgtctaggccagaaatgtagaagggatcctagtttccttctcctatactttctaaatctagttgattctctctaataattacatcttaaatttgtttcctacctctcttgtgacccaatgcctcacacttagtttgggccttcattgtttcttgctggattcggaagtggtcttctaactggtctccttt

SEQ ID NO: 32736 - DNA, 1025 bp, Homo sapiens
atgaatttttacttaaggtttaaatggcatatggaaactgtggatgatataataaaataatagtgttttggctgacactaggaaaccatggatgatatcatagagtaatagaattttgcggctgaggagagggacattaacatcatctggtttaacttttttgttttgtagttgagaaaattgttgtctagagagggcggttaagtaattggttgccaaaggtcattcagctacctactggtgaagccaggggaagggaagtaagaactgtgaactctgctttagttctctttctatgacatcacttttgtttttttgccttaactaatggttcttgacattttctttaaagtatcattttctttaaaacccattttctttaaaacccatctttgatgtagttgacttttatcgacagccagccattcatgcatctaatatttaagtagttacaagtaaactaagaccccagccttgtttgtgagatgtgcaaggtaataggaagatggacatttgaaacaactccctgaaatatgttttgttaagtgctataaaggtggcttttaaaataaagagagatggtttgctgatttagcacgaatgaaccatatgtacagctttgagaaaccaatagtcaacttttaaaatcatttggaaaaaatttttgaactgttgaattattagaacttgagttaggccagttcatgtggatcacagaccttgaaataaatttgaacttaaaatcgtctagggaaaaatgaattttttttgataagccttaagagttttgcaagaataactttggttttttagctttgaatttgagttgtttaaaaataaaattttgaaaaaatgccatgctttctaacaagagagcaacatttttcctttgctggaattggcaatgggaaatttaagtctggttaatgtaactgaacagctgaagtattttcatcctaaatcagaatttaaaaattctgtgcattctaatgacaaaatgctacctctttagttcgtggctgtcc

SEQ ID NO: 32737 - DNA, 1050 bp, Homo sapiens
cttagtggcacaaaaaataaggatgtactttagattaaatgaaatatgatattataaaaaggtgatactgtaaagggaacttaaatacatagtttgtcacctttctttttttttttttgagatagagtcttgctctttctctcaggctggagtacagtggtgcaatctcagctcactgcagtctctgtctcccagcttcaagcgattgtcgtgcctaaggctcctgagtagcttgggactacaggcgtgcaccaccacgcgtggctaatttttgtatctttttttttttttttttggtagagatggcgtttcaccatgttggccagactggtctcgaactcctgacttcaagtgatttccctcccccaccaaccctgtctgggcttcccaaagtgctgggattacaggtgtgagccaccataccaggcctccaccttttttatgtgcatatgcatgtgtttgtcacaactttcagaattgtaaaattcactggtggtatttattatttgcttacagcaatagctgtgtagtaatgcccttgcagggaaatcataaaatgaatgagatattgtcattagattaagagcaatagcaaggttacttttcagccaagaagctgcaggcaaggagaaatgtcagtggttctcagcctttttttgtgaaagccttaggccctttccctagaaaaaggcatgaatgtccacacatactaaaatttgtatactgtgctaggacctctagacttttggggcctttgagggactcctgatgaaaagcttaatgggtacacctgagtgtcacaaaaactggtatatgtcatattctgttttacatcctaagatctgacctcctacatgaatttttttgaaaatttgcatatattaagattcactctgttgaaaagttatgtaggtttcgacaaatgcatagtgtcctatatccactacagtatcatagacagtagtttgcacctttaaaaagtcccctgtgaatggggcatttgtatttataaatactccctcccttatattttaaataaggtgctttaaa

SEQ ID NO: 32738 - DNA, 1032 bp, Homo sapiens
tagtagtagttgacacttttaaaagtgctgtcttttgtctgtgtggggcatagaggtcatccctgtgttatgtactgtcatttccattttatagatgagtgttagtctgctcaggctgctgtaacaaagtaccataaattgggtggattgtaaacaacagagatttatttctcacagttttggaggctgggaagtccaggatcaaggctttggtagatttgatatctgctgagagccctcttcctggtttatggatactgctttctccctgtgttctcacatggtggaaggggcaaacgagctcccctgggtctttttataagggctctaatcccattcatgaggactgctcttatgagctaatcacctcccaaagggccctacctgctaataccatcccttagtggttaggatttcaacatagaaattttggggtgacacagagaaatgagaaaacaataatcttagagtaggtatgtattaatgactagcctggttttttggtagtagtagggcacacggtcctgatggaagtgtataagttctgaaacaccgaaagcttcagaagcttttaaactctggttggccttcctgtgttcctgggccctggttcatcgcttgcatttacaagcctgttacttgcataacaggctgcaatgtaggcattcatttctgcattttactgatgaggaccctgattcagggccttttggacagtgagtagaaggccaggtcttgactcagtcctgcctgagacctgaattcatactgtctctttatcagctctggaggagtgcaattaaccaaaaactcaaagagtagaaccgcaagcctcctgccacaggtgcttgtttgtggtctttattattatgctaattattcttgcatcctcccatgttctttaattgataattttcattgtactgagctctgtggaattccggagcctgtgaaggtggcatatggctgggcagtgccagaagcttgggaagaacatgctggtgggtgggtggggaatggtataaactggtt

SEQ ID NO: 32739 - DNA, 1027 bp, Homo sapiens
aagctgtggaattctctaactctagaagcttctggagagcatccagttgtatgttttatttgaagaaaaatgtggttcagggagctaacatggccaggtcagttaggagtcatgccaggactagagccccgattttctgagccatgttctgtccaccacacgaaaaccagagaaaccaaataatgagagtttaatgcgcaagatggggaagaacaagaagcagcagcatatgagctctgtttcttacttccctgcctgtggctcatcagtctttcagcatttttagaaacttacattcttggagcatacacctatcttaggttccctggaaaatattcagaagatacctgggtattcttttgcgtttaggccagtggccttctggaatactcttttcttccccatctttggaaaactctgctgcagggagtttgttaaacctcatgtaataagtgatccaaaagttttgcttatataaatgtttgtttaaaatcctatttatgtcatagaggcctaaaaaagggaaaacaggactgtttttctttaaagcatgccagctgccctgagaagagtagttagtattgaataaaatataatttatagttagaatatctgctgttgctgtttgcaaagaaataaaatagttcatctgtattttcatttacgaataagagatagtaatatgttcaatgaataatatacatatcaaataagtcatagcttagttcaagcttaggaaaatagtcaaaagagagagcataataagaattatagatgtcatttattgaataccagttttatgccatggactgaggttggaaatatacattatctctaattcttaaacaaccctgtgagggaggtgctgttattcccattttataggaaaagaataggatcagaaagggcaacttgcccaaagtctggtagcaggtaagtagggcttcatataacatatacctaggtctgtgaagttccaaatcctgtcttgtgaacttctgttcattcattcatttgacaagcattt

SEQ ID NO: 32740 - DNA, 1077 bp, Homo sapiens
agaagtagcagggcgcattttgcttaacttttgccgagatccttgtcatgggggtgtaaaccctttcccacaccaatctgtgtataatttttgccaaggtgttagggatatcttgcagttatcctatgggggacagctgtgagcctttttggttttttttgtttttttttttccgagacggaatcttgctctgtcgcccaggctggagtgcagtggcgcgtggcgctatctcggctcactgcaagctccgcctcccaggttcacgccattctcctgcctcagcctcccgagtagctgggactacaggcgcctgccaccatgctcggctaattttttgtatttttagtagagacgaggtttcaccctgttagccaggatggtgttgatctcctgacctcgtgatccgcccacctcggtctcccaaagtgctggattacaggcgcgagccaccgcgcccggccctgtgagccatttttacaaaaacttccacctgccttggcccaaacctcagcgttcttaggcacaggagctcatgaacatactgagataacactaaactggactatgcgaagggaccaactacagacctgacacaaatcctcaaggcaagacgatgtctgaagttgagcttgtaaaggaaatggcttccttccttaaaatatcacccaggctgagctctgaaaaaagcacctccagatggtgggttccaccccgctccaccaccccaaaattgcttattgtgtgagtctccatagtctcagaaactgagagtacctttgatgccagtggcttccgggctttttggattgtcacttggtagcagggagcacccataggatgatgcctatgatgagtcagggcccaaccttggaaacagggaaatccagaagtatcctacaagctagccagccttttggattagattatagcagtttcagagaaaaatggggaatcagccatggtcaaggagctaaataagcatcgtgaccatttgggccagaaattgaagggagtgtagcgttaagaattagaggaaggaacctccgaggaaggagctaccccaaagggaagcagaaa

SEQ ID NO: 32741 - DNA, 1107 bp, Homo sapiens
cctcggccacagttcataccttgaagcactgccctttgtcatcctgcctgagggagaattctatcctcactctaccatcagtgtccccagactcagatggccactccaggcctaggtaaatgcacaacaacaccggctgaaagctaggccaatacacattttctttgattactcagaaggcctagcccagtggttcccaagcttggttacctactggaatcacctggggaaagtttatttgtttgcttgtttttaaagccatgaatattttaatttattcgaatttctcggagtggtgcccaagcattggtaggtttttggtgatgcttcaggtgatttgaatgtcaggccattagtcacagctactggctggagaagtggttctcaaatttgaatgtgtatcagaacctactggagggctcataaaactggttctaacccagactttaaaatttactagttctggggtagggcctgagaatttgcattcctaacaaattcccagtgtggttctcccactttgagaactgctggcatagatcaatccgacataagtcatggattgctttaggaattgtcttaaatacaaactctgataattgttagtgcctggtttaagaaggattctgaggcttcatgactgggctcaacaagaggttttgactaatgactacatgtaagaatcacctgaagcacattcaaatcatcaatgctcgggcaccactcccagagattctaaattagaatactcaaggcactaacaaaaaataaaactttccccaggtgactccaatgagcaaccaagcctgagaaccactgggctagaccttccaggtatggagagaagaggggtatttgtgttgatgagcaatgtcttccttgggtgaggaagtaggcagctgtttgcatggcaagtgatatggtttggctgtgttactacccaaatctcatcttgaattgtagttcccctaatccccacttattgtatgaaggacccagtgggaggtaatttaatcatgagggtgattactctcatgctgttctcatgatagtgagtgagttctcacaagatctgatggttctataaggggctttttccccttttgc

SEQ ID NO: 32742 - DNA, 1068 bp, Homo sapiens
gcttagaaagtaaagccaaatactttgcacttttctcacacccctctcagctcattccttccagctcatggccatgcctcatttttaatttgtttttaatgacaggaccatgtttcttttgggcagcttttcattttccctaaacatccggagattattttcacatttgactaatagaagacctttatgtgttctctttatactatggattgaatgaaatcctcttatttcttcaaaaacgttctttctttgtggaagtcctctatcctcctgtttttatgggactatgccctataaatgttgcacagcagttacctcattgtgaaagtccatgttttcttctttctttaatttcctttttggctatctgggaatatatccttgagcatttctgtttcagaaaatgtacatcaatggaatttaacctttctaaattgtcatttcaccctcacgtttgattgatcatttagactggcatagaattcttggttcaaataatttgtccctcagaatttgaaagcattccacctttgtcttctagaatttgttgttggacctgaaaagtctgcatccatttgatttttcttcttttaaggtaaccttgttttcttctctctaggaagttgtaggatcttttattctttggagttcagaacttttgatatcactcacataaggaaaaagccaagtagacaacactgagatatcgttctcactgatcaggtgagttgagtctgataatatattttgttggacagggagaaagacactgaattctcctcactcttggtgggaataaaaattatacaaactcaatggatgcagatttaacaatacatataaaaatgagcagtatgtatacactttaaccagcacttttgacatttaggaatatattatcttgaaatactaatctatgtgtgcaaagatatttatacaaggagaatcattgtagtattgtttgtataacatcaattattttttaagccagatattcattatgagtggtcttattaaaacattaaaaatctataatttgtcaaaagcttttatgcattaatctctatt

SEQ ID NO: 32743 - DNA, 1035 bp, Homo sapiens
tcagtgtttccctcaggctattccagctctcctgcccattgcagaaatatttatcatcttgacattccacagaatctcacactggtcactgctggtccaaaaagtataaagtactttagatgtgttagtaagatacatccgtgcatccaagcacggtggcccacgcctgtaatcccaacactttgggaggccaaggcaggaggattacttaaggtcaggagttggagaccagcctggccaacatgaggaaaccccgtctctactaaaaatacaaaaataagcctggcatggtggcatgtacctgcaatcccagctactcggaggctgaggcaggagaatcgcttgaacccagtggatagggggaagttgcagtaagctgagatcatgtcactgcactccagcctgggcaaaagagtgagactccacctcaaaacaaaaacaaaaacaaaaatccttaaaaaaccaaaacatcagtgcccgaggattggagagaaatcacataaaaattcaggaacttactacatcagtgacatgtctagggcttctgtgatctagatcatatgagatatgcccttcaatgtgaaagagaagttcctataccttgcaccatctactactaagaggaagaaacatttgaggagcttccttagatttcaaaggtaatacataccacatttgagtataatgttcagatccatttatcaagcaaactaaaaagtttaagggaatcctggagaaagaggaggctctgtagaagttcaggcttcagggaaagctgctctgccacttgatcttatgacttgggagatccaacatcacagaaagtttctgaaggtttatgtgtcctctgcaagaatcacagagaaaatctcatctctcttctacagataattattctccttttgagaaatagcttcttgcttgctatttaaccttagtagtgcctgaatatctgcccatgaactccaggtgacatgtgaactaagctgctcatcaagaattgagtattattggaccactcatgtcacaaggtta

SEQ ID NO: 32744 - DNA, 1082 bp, Homo sapiens
tttctaagattttgtgtgaggtttaataccaaatatgagtctaagatgtctgggatggggtccagaagagaataaagatatgtattgtatatattaatatctgtgtctatatatatgaaaccacataacatactatcaactgagatagagaatcataagatcctacagacttggaatgaggggacccctaagagctgatgatttggttcaggctctggatggtgcctgattctcggttgagcatgctttctagcacaccatattctagtatgtagcataactccaggtaccaatgaaaattttaaaataataataagataaacataaatcctgattaggtacttgggcatgaaataagtctgccaacaattgaatcctgggtccattatcagctacctgtgagagcttttgtaacttagtaaacttcactgtgtctttgtttcttccactttaaaatggaatactaattatacctagctcatcagattcttgggaggattaaatgagaggatgaatatacatgttttaggacaatatttgctctatataaggtgttcaaaaagtgtccataataattaatatcaaaacactgctcagttgcaacaaatggtttacttcttctaatgggttctcaacacaaccagtgtgggcctatcggtacagttacaaagtatttgggcactggcctagaggtttcagctaaaaggttcaatctagattctgttttccacaggggcttgcagaaaaggactcccattgatcctaaacaaatttagataaattctattggtttacaaattgatcttatgtgagtgttggcttgtcttctactgtaatgttgccaagaagaaatcagcatcatattgggatggaggaggtacaggaggatcgattctaaaatcattgtaaagaaaacccaagaagcaagctatgccacagagagcctcgctcatctgagagagctggtataacaaagggctaagtgaatggattctgggggtaccttgggcaagtcaccttgctttgttctgcctcagatacctcattcatgaaatggggataattataatatctaattcaca

SEQ ID NO: 32745 - DNA, 1025 bp, Homo sapiens
ctttccatggcttgcaaatggctatcttcttgctgtgtcctcacgtggttacctctcagtctgtgtgttgtctgtgtcttaatctttttttttttttaacgatactttaagttctagggtacatgtgcacaacgtgcgggtttgttacatatgtatacatgtgccatgttgatgtgccgcacccattaactcgtcatttacattaggtatatctcctaatgctatccctccccccttccccaaccccacaacaggccccagtgtgtgatgttccccttcctgtgtccaagtgttctcatcgttcaattcccacctatgagtgagaacatgcggtgttcagttttttgttcttgcgatagtttgctgagaatgatggttgtaactcaaaataatcttctcttcttctaaggacaccagtcatattggattagtgcccacccatatgacctaattttactttaattgactttttaaagaccccaccttcaaatacagacacattctgtggaactagtgttaggacttccacatatgactttggacagagggcacaattcagcctgtagcaccatttctttatttttcagtgcctcattatagttggttgtttttaaaaacataattatttagatataattctgtattaccctgttcttgcattgctgtaaagaaatagctgtgactggataatttataatttaattggctcatagctccacaggttgtacaggagacatgatgctggcatctgcttggcttctggggaggtctcaggaaacttacaatcatggcagaaggtgaagaagaagtaggtgtctcatatggtgggagcaggtgcaagacagagtgaggggggaggtgtcacacacttttaagcgaccagatctcaagggaactcagtatcatgaggagagtatcaagggggatggtgttaatccattcatgagaaatccacccctatgatcccatcaccgcgtaccaggccccacctccaatgttggggattacaactcaacatgagattt

SEQ ID NO: 32746 - DNA, 1030 bp, Homo sapiens
gtatacctatgtaacaaacctgcacgttctgcacatgtatcccagaacttaaagtgtatatatatatactttatatatatatgcatatataaagaacacctttttaatctgaccttagaagttttgcatgctattctttccttgctcagcatcagctcagatctaacttattctgtactcattgggtaacattttgatgactggttcagggctctagttaccttaataacagaacagtcactgtaaatagctgtgaggagtatttcagtcattataaatagctatccccaatgggtaggttaataggttggcattctggcttaaaaatattttcctccttgcaaaagagatattagaaattggttatatatagctacaatcataaaattcataaaatagcagcactgagctccagactccggactgagagtggccccaatcccccagctttaccatctcttgttagttacaggtgtccagtcgtggatctctcatgtactaatatcctcaattgaactttgaatttgcattctttaactcagctgagttttcttctgatctgacctgatccttcatcccatagatcacaagttaagaattggaggaaatgttgagactattttttgcagaggcccagggaaggaggtggctggttcaaggtctcacagctggtggatgacaaggcagggctagaacccagctggcttctagtccagttcagtgtttccatttctctacgctctatgggtaatttgtccttgaggtttggataagatgacttgggaagttgagcctgtatcatatgtgtattcatatgcatgaatacctcatttcatgttttggatatatattcttgcaaatttggtaataaagtgaatttcagcaaattatatatcttaccatgtttcttaaagactaaagatgcaatccttctgtaaaagcttttagccttgagtatacacttggatataatagaaaaaccaaatgcctagagtgaaaagaattttctgatgaaatattaaaataatgt

SEQ ID NO: 32747 - DNA, 1062 bp, Homo sapiens
ttcctattgtttcatcttttttgggggagggggtttctttctgggagggttacacagctttatcttctaaacattgtttttttatttctgctattgtagttttgattactcaaagagctttttggtttcctgaatgttcctttcatagaaagtatcattctgttcatgtcctgtactctaatttcttctcatagtctctctgaggatattaatcactgtgttttttttcttgtaatgttttattttctctgaaagtctgtttcatccaagttatctttccccctctatttgtctggcctttatcttttgtgcaagaggctttactcaggtatctagtgatcctctgttctctgctcatatttgagagtaggtgctaaaaagctgattggaggttctgatctgtgggtttgttgactctgggctttactgtaaaatgaatgggctggtttttttccttggggatgacccagtgtcgaatcttcaggtctttattcttgggcaggtcagttccccagaaaagcatttcagtttcttgcttggaggttcagggcaggtaggcagcattctgttagctgagtgaggaatgaagactgggcgtctcagcattcagtatgcatacactcattttatctgttttcaagatcacattcacatctcaactgtgcccaatgctccccagtccggagaccctctgttttatgttctccagggaataaagcaccagttttatgctagggtagaggacatgacctgaagatcaactgttcatttaaacaaactttctataaactctcctgttttggctttacctttaccccacccccacttccaaggttcctagtatccccaaatcctgaatgtctgcaggttttgctgggtatatctggttgcttcttggtttttccctcagctggcttaggattcaggcagtctgctatgtttatttgctttccagtttccaatactttgttattatttctcatttcctttatgaagccaacaacattaattggtaatagggaacaatgtttttctaaagaaccacaaattcatggcaaagta

SEQ ID NO: 32748 - DNA, 1043 bp, Homo sapiens
tggtgtctactgttcccttctttgtgtgcatgtgtattcaatgtttagctcccacctataagtgagaacataaggtatttggttttctgttcctgctttaatttgcttaggaaaatggcctccagctgcatccatgttgctgcaaaggacatgatttcattccttttcttttaatgactgcatagtattccatggtgtataggtaccatgttttctttattcagtccaccactgataggcatctaggttgattccatgtctttgctattgtgaatatgatggacgtataagtgcatgtgtctttttggtagaatcatttattttcctttgggtatatatacccagcagtgggattgctgggttgaatgtagttctaagttccttgaaaaatatccaaactgctccccacagtgtggctgaactaatttacattcccatccaccagcagtgtatgtgcattcccttttctctggaaccctgccaacatctgtgatttttttttaactttttaagaatagcccttctgactggtgtgagatagtatctcattgtggttttgatttgcatttctctaatgattagtgatgttgaacattttttcatatgcttgttgcctgcttgtatgtctcacttttgagaagtgtctgttcatgtcctatgggcattttttaatggggctgtttttcccttgttgatttttttaagttccttatagatgctgaatattagacctctgtgaaatgcacagtttgagaatattttctcccattctgcaggttgtctgtttaccctgttaataatttcttctattgtgcagaagcacttttttttttgagacaagagtctcactctgtctctcaggctggagtgcagtggcacggtatcggctcactgcaacctccgcctcccaagctcaagtgattctcctgcctcggcctccttaatagctgggactacaggcgcacaccaccctgcccggctaatttttgtgtttttagtagagatgaggtttcaccatgttgttcaggctggtctcgagctcc

SEQ ID NO: 32749 - DNA, 1035 bp, Homo sapiens
tggaagttggatatttggttcactgaatttccttaacccatccagtgaccagaaaatctttagtttcaactcttgttgaagtttcctaatatgtaccacttgctttcctgtcccaggaagtagatttcacttcagttttgatggttaaaggaactcttgcagttcttcagaatcatgagctatcaactgttaattcttactcattgtggatgtagacagcataaaaatgtgggctaaatatattctaattatgaactggaaggacgcggtctgaattcatgtttattaccaagcacagtgcctggcatagagtaggtaccagtaaatatctgttgaaataaattaaaattgggctttgatatggttcgttcaatgtggaaaaaaataaaacattaacttcaggcccacgtagaggctctgtttattaagcattaaaaaataattctaaactcatatatctgtaatattataactcatgttttagaatattaattcatgtcattccttctttttctttccctataccctaatatatacacacaagcctccattctccctgtttccctgttcctctcctacattctcccacctcactgaggagagttgggcttcatacttctcactagttacattcctggacgattgctctaatgggtttctggctggctttctttacctatagtgccttagtttccagtgctgatggatgtaaatgtagatctctgacagaggccgggcgcggtggctcacgcctgtaatcccagcactttgggaggcccaggtgggcggatcacgaggtcaggagatcgagatcgtcctggctaacacggtgaaaccccgtctctactaaaaatacaaaaaattagccgggtgtgcttgcaggcgcctgtagtcccagctactcggtaggctgagccaggagaatggcctgaacctgggaggcggagcttgcagtgagcggagatcgcgctactgcactccagcctaggcgacagagcgagcctccatctcaaaaaaaaaaaaaaaaaaaaaaaa

SEQ ID NO: 32750 - DNA, 1118 bp, Homo sapiens
ttttgtagtgctgagtgtagaagtctttgttaaagtttttctaaatattttaagtatattcttgatgctattgtgaatggaattttaaaaaattagtttgttcattcctagcatatagaaatggaaaatgcagtggacttttgtatatattgtttgtgctatgaccttgctaaatttgcttattggtactagtagtttgcgtgtgtgcgttttttgagattttctgtaagcagaattgtgtaatccattactaaaacaattttacttgtttctttttagtcttgatgcctttttttttcttttccttttgaaccttactgcaccagctagaacaagtacaattttgaaaagaagtggcaacagcaggcatcctttccttgttcctgatctttggaaggaaagcgttgtgttttacctttaagtaaagttggctttagattttttggtgcccaccaccatcaagttaaagaagttcaatttctcgtttgtgaatttgtgtgtgtgtgtgaataggtattgtattatatgttgtggaattctcttgaatgttttgttatggattttgtcatgtttatgggagattttggtttgtattttcttttttttttttttaattttaatttttttgagatgatttagttgcccaggctggagtgcagtggcatgatctcggctcaccgcagcctccgcctcctggattgaagcgattctcctgcctcagcctcctgagtagctgggattacaggcatgcgccaccacgcccggctaatttttgcatttttagtagagatggggtttctccatgttggtcaggctggtctcgaactccccacttcaggtgatccgcccaccttggcctcccaaagtgttgggattacaggcgtgagccactgctcccggcggtttgtattttcttttgtctggtggccttgttttctttcatagtagttactggcctttaaatatgagttgggaagtgttttctcctcctctatgtttgggtgttattcctttttaattatttgttagaatttaccagtgaaggcatttagccctggagtcttcttttgaggaaaatcttcagtggctatttaaaacttttattacaggtctattca

SEQ ID NO: 32751 - DNA, 1103 bp, Homo sapiens
gttcaccaggctagtcttgaactccaggtctacaggatttttaatgtaaccttttctctcttaacaactttcctcctcctccctactgaaaaaaaaaaaaaaaatccaagtcctcaaggcattaacattgactttttatcccacggtatgcactaacacttttgtaattattatcaacactgccgccaacagtgtggttactgaaaataagaaaaatgaggattgcaaggattgagccaattttctgtgttatagtcattcgaaatagttactctttggattgttataccaccaatttgatataaaattatggttactttattttggttttcagagatttcatgtaacattttggttttgttacactattatataaaatatttacatggtttgaaagtaaaatctataagacagattaaactcagagcagtgttttcctatttcactttgttctgtctctccctcctaattggtagcccttttattttgtttttgagacaggtgcaggctctgttgcccaggctggaccgcagtggcgcaatctcggctcactgcaacctctggcccaggctcaagccatcgtctcatcttagcctcttgagtagctgggactaaggtgcgtgccagcgtccatggctaattttttttattttttgtagagatggggttttgccatattgcccaggctggtttctaactcctgagataagtgatctgcctacgctggcctctcaaactgctgggattacaggtgtgagccaccacacctggcctggtagccctcttttttttttttttttaaaaaccttatggtttatcttttcaaatgcatatatagggccaggtgttgtggctcatgcctgtaatcccagcactttgggaggctgaggtgtgtggatcacgaggtcaggagttcgagaccagcctgaccaacatggtgagaccccgtctctactaaaaataaaaaattaaccaggcgtggtggcgggcacctgtaaatcccagctactcgggagactgaggcaggagaattgcttgaacccaggaggcagaggttgtagtgagccgagatcacgccactgtgctctagcctgggcgacaga

SEQ ID NO: 32752 - DNA, 1030 bp, Homo sapiens
ccctcccatcattgttagggttctgctacctcatttttacctccttttataaattaaaaaggtatccccctgccagtttgagatcaggcttgtattcttttttggcctgattggagttatttaaaaatatggacaggctgggcacagtggctcacgcctgtaatcccagcactttgggaggctgaggtgggcggatcacgaagtcaagagatcgagaccatcctggccaacatagtgaatgtctctactaaaaatacaaaaattagctgggcatggtgacgcacgcctgtagtcccagctactcgggaggctgaggcaggagaatcgcttgaacccaggaggcagcagtgagccgagatcacgccactgcactccagcctggcgacagagcgagactcccatctcaaaaaaaaaaaaaaaaaaaaaaaaggacagagttttttttccttttggtcatcctgtagaaaatggaaagctgtgaagtatatttgaaacaaatatggttggattgagtctttatggaaaggtcttgtacttcagtcacacagtagaatgactatagttaacaatggttttttttttttgagagggatttttgctcttgtctcccaggctggagtgcagtagtgtgatgtcggctcactgtagcttctgcctcctgggctcaaatgattctcctgcctcagcctcctgagtagatgggattacaggcatgcaccaccacgcccagctaatttttgtatatatatatatttttaagtagagacggggtttcaccatgttggccaggctggtcgtgaacccctgacctcaggtgatctgcctgcctcagcctcccaaagtgctgggattatagacatgagccaccgccccgctgatttttttttttttaatggagtctctctgtcgcccaggctggagtgcagtggcgcgatcctggatcactgcatctttcacctcctgggctcaaatgatttgtgcctcagcccgagtaactgggattacaggcatctgccaccacacctggcta

SEQ ID NO: 32753 - DNA, 1049 bp, Homo sapiens
aggtaactgggtggggggagtatgggaggtatgtgagccaaagcattggagggagaggaggatttacgtaggagggaagaagaaaagggtactgtatgtgtgtatgtgttgtcggggagtgagtatgagtatgatgagaggtggagagagggagaatacttaaatatgtaaaccttctggtaaatttggaagcatgaaaaaattgacataagtagaaatattcaagctttcattggactttattttgtcacgtttatagaaaatttcaatatacaggccaggtgcggtggctcacgcctgtaatcccagccctttgggaggccaaggtgggtggatcgcttgagccaggagttgtggtcccacctacgcagaaggctgagttaggaggattgcttgagccccaggaggttgaggctacgatgagccatgacactgcacttcatcctaagcgactgggcaacagagtgggaccctgtctccaaaaaaaagaaaaagtttcaacatacaaagtagaataaaactctcacatacatacctgttacctcaacatgatacctagtgaaaattaattatacccaaatgcaaggcttttgatacaccctttatagacctggccatacgtcttggaatcatcaaattttacagctgtgaaaagaacctagatatttagttaatagctttaagaaactgagggccaaatcacttaggagcacactattaatatatatgacattgttttactcaaaatttgtcagacttggacagttacagaattactgattgtagtggatgccatgatgtaatacccaaatccccacttaaggcttaaagaaattcattcttttagctagtgggtgtgctgctgaggctgtgagacctgtctgggaatcatccttggctgaagagagcaactcattcatggtcacatgctttcgttgtgagtagtgtgcctccaggttctggttcattaaagtacctggctccttgggcccagcataggacaaccctaaggagtcattcagctttagagtttcttttgggtcatctga

SEQ ID NO: 32754 - DNA, 1055 bp, Homo sapiens
atactcgacatctttaattttggagtttaattttggtgctataattcagagatttaaaaaaggtttgagaatgccttgctaagtgatggcaggcttagcacagtggcaggcttagcacagtgtttggcatatagctgggtcccaggaattatttacatatgtaatggaggaaggagaaatgttttattcaatgaacataggctaaacaattcactcttcatttggaaaaggtgaaaaatggggaaatttagataaattgattatgaaacggttattgttccggccctatctcagacttgttgttgttgttgttttttgagatggggcctctgtcacgcaggctagggtgcagtgatccgatcatggctcacttgcagcctcgaactcctggactctaatgatcctcccacttcagcctccttagtagctgggaccacaggcatgtgccaccatgtctggctaattttgtttatttttcgtagaggcagggtttcactatgctgcttaggctggtctcgaactcctgggcttgagtgatcctcctgccccagcctcccaaaatgctggtattgtaagtgtgagccactgcacctggcctatctcagacttttgacatcagtgagagaagtgtattctcccacttttttttttttttttgagacggagtcttgctctgtcgcccaggctggagtgcagtggcgcgatctcggctcactgcaacctccgcctcctgggttgaagtgattctcctgcctcagcctcctgaatagctgagattacaggtgtgcgccaccacgtctggctactttttgtatttttagtagagatggggtttcaccatgttggtcaggctggtatcgaactcctgacctcgtgatccacctgcctcggcctcccaaagtgctgggattataggcgtgagccaccatgcccagccatgactcaaattcagcatagttactctcataccacaagagaaatagagtgtacgtgtttatttgggttgatcagcatcggtttattgctattacattcccagaaaattttataaatga

SEQ ID NO: 32755 - DNA, 1079 bp, Homo sapiens
gggttcgagcaattctcctgcctcagcctcccgagtagctgggactacaggcgcccaccgtcaacgcccggctaattttttgtatttttagtagagacggggtttcaccgtgttagccaggatggtctctatctcctgacttcgtgatccgcccgcctttgcctcccaaagtgctgcgattacaggcatgagccaccacgcctggccaggaccatagaattctaatgatgtgatcttcaattattttgtgaaatcttattacctggataagagtcaggattgctttatcttgtttggcagttagagaacagttgttgattcacaatatttctggtcagttaaaacattttcacaggttagtcgatagtattgttcattattttctctgttcttacagactcttagtagttttgtcagttattgagttgaaatctgaactatatgtgttttcagtttctcttcagagttttatcataagtttttgctgcatgtattttgaagctctgttggtaggtttatgaaaccttttggaacttatggaatatagttaaaataactaccattttaataactttgatttttctagcctgggcaacatggcaaaaccctgcctctacaacaaatacaaaaattagctggacatggttggtgcgtgcctgtagtcacagacccttgggaggctgaggtgggaggattgcttgagcccaggaggcagaggttgcagtgatcgaggtcgtgccactgcactccagcctgggtggcagagtgagaccttgtctcaaaaaaaaaccaaaaaacaaaactttcattttaaaaatttttcatagaggtggggcctccctgtgtttcccagactggtcttgaactcttggcctcaagtatttttctcctcctaccttggcctcccaaagtgctggggttacaggagtgagccaccgcatttggcttaatataaatttcatttttaatgttgtttactaattctatcatctttcattttctgggtttgttgctcgcactggtttttcttctcatcatgggttatattttcctgcttctttcttggcctggttaatttt

SEQ ID NO: 32756 - DNA, 1049 bp, Homo sapiens
ccacccccccctccaaaaaaaaagaaaaaaagagttgtgtcccaagttattctggtagcatccttgttttagtttcctctaaaagggtgatttttgtgtccatatctatagtattttagataaggttagatgaagttatcttctatgatgacttgaatgatttttctgtttcatttgtaagatgaggttgttggattaaagcataacttttgctatgaatttgatttccagactttttttttttttttttagctttgttaaaaatttgctgaattgggctgagcacagtggctcatgcctgtaatcccagcacttcaggaggctagggctggcggatcctttgaggtcaggagtttgagatcagcctagccaacatggtgaaaccttgtctctattaaaaatacaaaaaataagccgggtgtggtggcgcatgcctgtaatcacagctacttgggaggctgaggcaggagaattgcctgaacctgggaggtggaggttgcagtgaactgagatcctgccactgtactccagcctgggctacagagcaagactcagtctcaaaaaaaaatgagttggtggttactgtttccaaacctagacctcacataaaaatccaaatttttaggcacttcctggaaaagtatgaggttttgcaacagtggaagcattgaattggaagcattccattattggctagcatcattggctagatttgagagattggcttttttctttggtggtaggagtatgtcctcctcagtttgtccttggtcacacgtgacctttgtccccccccccccctttttttttttttaacctttatctaacttgctcctgtaagaattcgggtttgtaattctcaggaatgaaggatttatccaggccccttcttgtacgctggaggttgttcagaaccatggaattcttttttttgtttgtttgtttttttgagacggagtctcgctctgtcgtccaggctggagtgcaatggtgggatctcggctcgctgcaacctccgcctcctgggttcaagggattctcccacctca

SEQ ID NO: 32757 - DNA, 1074 bp, Homo sapiens
ctgcatttgtggattcagccaaccttggatctaaaatatttgggaaaaaattgcaactatgctgaacatgtatggacatttttttttggtcaggattctctaagcattacagtataacaactacttacatagtatttatattgtttaggtgttataagtaatctgcagatgatttaaagcggcagttccctacctttttggcactagggactggtttcatggaagactatttttccacagggtcaggggatggtttcaggatgattcaagcacattacatttattgtgcactttatttctattattattacattgtaatatgtaatgaaataattatagagttcactataatgtaggattagtgggagccctgagcgtgttttccacaagggtcccatctgggggtgatgggagacagtgacagatcatcaagcattatttcttaatgagtgtgcagcctagatgccttgcttgcacaattcacaatagtgtttgtgctcctatgagagtctaatgccactgcagatctgacaggcagagctcaggtggtaatgcgagcagtggggagtggctgtgaagctttgcttgctggacccagttcacttcctgctcacttcctgctgtgcagcctggttcctaacaggccaaggaccggagcctgtccataacctggaggcttagggacccctgattagaagaatagaggaggatatgcttaggttatgtgcaaatactatgttgtgttatatcaaggacttcagtatctgcagattttggtattcaagcgagatgcttgaaccaatcacccatggatatctagggacagttatacaatggtgttgaagaactgacaaaacctggcagtttgacacagacatatgggaaaaattgaaggagtcaaaaggtcacttagttcatatcagaaatgaagtaaggaaggatgttgatttttggggaacctgaagagttgaggtagtctaggtttgaagtaatgtaaggatagcctagttaaagaattcttcagggatttttagcgatatggttgtggtaattgagctaaatattctgcaaaac

SEQ ID NO: 32758 - DNA, 1050 bp, Homo sapiens
tgcccggcgtttcagaaaggcagagaaccctttcataccgctttgtgcagcggcgttaacgttcaaaatggtttaattcgcctcggttcatctggtggtggtggtttaagtgggggtaagatgcatgcacaaggctttttttttttttttcttaaacctttgccgcgggagctgattacgtacctacggcggttaaaagtggttaaacatgatcaaaacatgcacatgtgggcacatgtggcgtgtttgcatttccccaaactggtgttacgtgggagtggtgggctaagctgatgaacccacagctggagaacccggcgcggaactttgccccaggttcctccacaaatgctttgacggtttgacggttaacagcgagccggggaaggctgttggtactcgaagtgctttttagctggtgagacttttacttaccactttttcattttgtggtttaatatactttggctttgtcgagggttattttagatgtttttgttaaaaaaaattaactcgtggtgggtaggatactttaatttttaagatagaagagatatgctaaattgtctaaggaaaatatctcaaaagtgataatttgaatgttaactgtgcgtgtgtaataattacttgcttttcgaaaaacctggactgaaacgttaatacaaaagaaagggcaactgccaaagcagtaatatgcatgctccacttaatattctatcctaaattttgaagttttgatgatccacttgtttagtcagaacctgggaaattcaggcacgttaaggtttccactttatttaaaagtagataaaggaagaagagtaatttgggacagttgtggctgaagggagaaataatattcatttgaggtttatccagcattctctatctagatcctgaagcaagacactgaatgggtgcagaagaggtggcggtggtgttttttgcaagacaggtacttaaggtcataaacatttaagtaactgagtaagtcattaagtgctactctgactggtgacagacacttaacaccttagaggaatagtcgcc

SEQ ID NO: 32759 - DNA, 1025 bp, Homo sapiens
ctcagtttgcaacaggtaagaaatttggagagagggagacaaagaatggaaataacattattgcacttctctgtgcttaatatttgctaggtatctcatctcatttaaactaggtcattttatatcattttgtcagtgcattactgtggatattttctggtacaaagacataggttaggtgtcttttcttttggaagaaaatcctagagttcatatttcaaatagatgcaatcctaaggtgatttattcttggactagatgaaatgtcaaactggaaatttaaaaagtagtaatttaagaagaaaaatataaaaagtatttcatgaggaagggcaccaggagataagaaaatgtttttcatgttgcgtaaataagatttctaataaatgcttagtaatttaaaatgatttcagggggcctagtggatatatatatgtgatatgtgcatatataaaaatacataatatatatatgtttgtatttagtttatgataaaagtcttatatcagtggcaaaaggattgggactattcaataaatggtgatgggtcagctgactgtgtatttgaaaaaaatagctgtttatagtcctacctaatgtgtacccaaaataactactagatggtttatatataaaaggacaaaaataagggtttataagaaaataagaggatattttttaaatcctctttctaaagaagtcacagagttcataattgatgatccgtataaatttcttttcttttttctttttttttctttttttttttttttttgcagagatgatgtttcaccatgttggccaggctggtctcaaactcctcggcctcaagtgatccacctacctcggcctcccaaagtgctgggattatagacataagccaccttgccccagccaatctgtataaatttaaatagattaaatagatgtatacatcaatcagcactttgagcaaagttaaaaaaaaagtgacagatggaaatattttcagtcctacataacaaatcctacagatcagtaggaaa

SEQ ID NO: 32760 - DNA, 1027 bp, Homo sapiens
ggtgatctgcctgccttggcctcccagagttctgggattccaggcatgagccaccatgcccggccagcaaactcttattttttgtatttatcttttttttttttttttttttttagacaaggactttccctgttgcacagattggagggcagtggcacaatcacagttcactgcatcctctacctcccaggccctcagcctcccaaggagctgggaccacaggcttgcaccaccacaccgcagctaattttttaaaagaaatatttcatagagatggggtctcgctatgttgcccaggctggtctggaatcctgggctcaaatgggatcctcccaccactgccaaccaaaatactggcattacagacataagccacaacacccagctgaatttatcttttttcagatatctttttaggttgttttaatggcagttaatggggagagattagatgctagtatttaatacatcatcatgaactagacatgaacacattcttcagactgagtgtaatgtagggggcgagtttcaatgtagtcacattttggctgggcacagtgactcacagctgtaatcctgtcattttgggaggcaaaggcaggtggatgacttcaggccaggagtttgagaccagcctgggcaacatggcaaaaccccatctatactaaaaatacaaaaattagctgagcatagtggcgtgctcctgtaatcccagctactcgggaggctaagatgggaggatctcttgtacctgggaggcagaggttgcagtgagccgaaatcatgccactgcactccatcctggatgagactgtctcaaaggaaaaaaaaatagtcacatttgaaccaatagtggttattggtttttggatagattgtgacttattatttatttacttttattttaatttgttttttggagacagagtcttgtgctgtcacccaggctggagagtagtggtgcgatcttggctcactgcaacctccgcctcccaggttcaaccaattctcctgcctctgcctcccg

SEQ ID NO: 32761 - DNA, 1027 bp, Homo sapiens
ctagcaaagtcatacataacaaatcctcctctccctactttgtgatggtacatctatcacgaactaaatatgtatgcagggatctactgttgtttgaaatccttttacattttggctctaacaccatgctctttattattgtggctttataatatatgttctaaatatagggtcattttctcctctttgtcttttttttcaaaatctagttaccttcttgtgtctgatttttgtttgatatgaattttaaaaatatacttgtcaagtgcctcaaaaactttgcctggaattttgaatattagaactccattgacttctatgatgaatttaggagagtttaaagtactttgctatgttatatcacttatgcatgaaaatgctggaattctcatcttttttaaagagaagtattcttactatgtttctcatgctggagtgtgttaacagatgtgatcatagcacattaaaactgctaactcctgaactgaggtgatcctctttttttttttttaatttaacttctggggtacatgtgcacaatgtgcagctttgttacatatgtatacatgtgccgtgttggtgtgctgcactcactaactcgtcatttacattaggtatatctcctaatgctatccctccccccaccccacaacagtccccagtgtgtgatggtccccttcctgcgtccaagtgttctcattgttcaattcccacctatgagtgagaacatgcagtgtttggttttttgtccttgtgatagtttcctgagaatgatggtttccagcttcatccatgtccctacaaaggacatgaactcatcctttttatggctgcatactattccatggtgtataggtgccacattttcttaatccagtctatcattgatggacatttgggttggttctaagtctttgctattgtgaatagtgccgcaataaacatatgtatgcatgtgtcttaaagcagcatgattataatcctttgggtatatacccagtaatgggatggctgggtcaaatggtat

SEQ ID NO: 32762 - DNA, 1049 bp, Homo sapiens
attgcaaatatctgctttaaaattttgttattttttggcttaacctgttgcccaaagccaataagataataactggagttgtgtatatgtttttacattctttttttcccaattctcatttttcccttactcagttaattcatattaattcatattagtgtctgttattctgttagttacagtcctaaccaagtaaacatgaagcacagtttgttttttctgagagtgttcttttctcattattaggaagagagggagatattttacccaattttatcttttttcaaaagattaaaaatataatttgttgaaaaatacctatgtagaacatacatcagacacagttcatactgtgttttgagagtatcttcttcctcattatcaggaagaaaaagattttttaccctgtttatcttttttaaaaagttactgtaaaaatactgtttattattcaaacagttatataatgttagactttttttttctaattcgccaacctttcgtagtatcctctgcatttggtcgttgctttttttcttttctttatactttctgttccttttcgtcttacttctttctgtgtacagtaatgcccatttacttgattgtcacatgcataggaaattcagcaatttggaaaaaaaaaccttgaaaataaagtagaaattgcttgtaaataaccaactttgctgtcataagaattaacgaatttacttttatgcagaagttattatctgggtttcccaaggccaagagagaaggagaagcaataagttaattgagggctgatagtattgtgaaatgaccatttaaaagaagaagacacaaaaattagtttacagttctcaagatagagcacaacctttggcttctctgtaggggcaagctacttttctttaatctagaaacttgtgtgcattctgtttaaaaggttaattgtatgccatttactctaagaacataagaggagtgctatattatagaaatacgcagaatattttgactcttaaaacattgttttattttgtgaacaatgcactttaactcat

SEQ ID NO: 32763 - DNA, 1050 bp, Homo sapiens
atattaaccttaaatgtaaatggactaaatgctccaattaaaagacacagactggcaaattggataaagagtcaagacccatcagtgtgctgtattcaggagacccatctcaagtgcagagacacacgtaggctcaaaataaagggatggaggaagatctaccaagcaaatggaaaacaaaaaaaggcaggggttgcaatcctagtctctgataaaacagactttaaaccaacaaagatagaaagagacaaagaaggccataacataatggtaaagggatcaagtcaacaagaagagctaactatcctaaatatatattcacccaatacaggagcacccagattcataaggaaagtccttagagacctacaagagatttagactcccacacaataattatgagaggctttaacaccccactgtcaacattagacagatcgatgagacagaaagttaaaaaggatatccaggaattgaactcagctctgcaccaagcagaattaatagacatctacagaactctccaccccaaattaacagaatatacattcttctcagcaccacgtcatacttattccaaaattgaccacatagttggaagtaaagcactcctcagcaaatgtaaaagaacagaaattataacaaactgtctctcagaccacagtgcaatcaaactagaactcaggattaagaaactcactcaaaactgctcaactacatggaaactaaacaacctgctcctgaatgactaatggatacataacgaaatgaaggcagaaataaagatgttgtttgaaaccagtgagaacaaaggcacaacataccagaatctctgggacacatttaaagcagtgtgtagagggaaatttatagcactaaatgcccacaagagaaagcaggaaagatctaaaattgacaccctaacatcacaattgaaagaaccagagaagcaagagcaaacacgttcaaaagctagcagaaagcaagaaataactaagatcagagcagaactgaaggagatagagacagaaaaaacccttcaaaaaatta

SEQ ID NO: 32764 - DNA, 1067 bp, Homo sapiens
attgatttcttgaaggcttgtttatttatgtacaagttatcacttaccatattgacatgagtagtttatcaaatatttacagagcaccacccttatacgagatactccaccagggtatacagaagttatcaaggcagtctctgccgtaaaaagtgttaaagtatgtgtaatttttaaaggcatcttcattgtgagtaagaaagaggggaaatacattaatagttcagcaaagggcttggtgccatgataagtataataaaactggttactatttaatgactgtttagtatgtggcaagctgtgtgctttacatacattagctcatttaatctttgttaacagtcccatcaggcagatctgatctttatcttgtacattgcaaactgagatgaaagggtttaggtaaatttattccagatcatacagttagcaagtgtgaaactcaagattgagagtcaagctgtgtcacctggagtgtgtgtccccagccacaagacactgtgggaataacaagaaagcaagggatgctgatgcagcccaggctgtgtgtctctgtatatatgtgtgaatgtggggaggttgtaaaaaagtatatcctacaaaaaataaactctgatgtgagattaaagatgagtaaaaggaagttagaaggatgagaaaggcaaaaggtaacatattatgcaaaaagaccttaagacaagaaagcatggttcagtccgggacgtagaggattctgtggctgaattgtagagcatggagatgagtgaggattggcaagagattagactatttgaaagtaagagagtttgctcattttgcagccttaaagtaggtgaggcaagcactgatgatgtgctttatataaattttctcatatagtcctattaatcaacagacctgttggattgggttttaatttgaaagcaattagtagtgtttaaaatttttccttttgaaatttattttcatggttcaaaataaaaaagtttaaaagttgtataataagaagtctttgcctttctgtcttcccatccatctacacatagttaactgctcttaactagttt

SEQ ID NO: 32765 - DNA, 1095 bp, Homo sapiens
attgtgatcagacattctctgtcccttagggttagtaagctttgttttagtgtcaaagaaaagtatggacttttatagtgacattggtttcttctagcctccgaattatagatgagttacatgccaaatcgcttcgtatcatcaaatggagaggaattctcaagctgggcttgagttttactctatgactataccaaggaaagaggaaagcagctgtgggtttatttaaattctacctgttaacttgtaagtgttagaactgacagttacatagtaactgtaatagggcttgtatgcatttctgagctattaatagaatggataaaagtgttttaataattttctaatattcattgactgagaagcttgaaagtttcaagaagtattaaaatggccaaagaatgtataaggattgtaattataaacaaatgatactgagacattagatgagaggacacatatactattgattaaaatgaaacttcatgacaaagatggggagaacacattgaaagacagaaatactgtaatgaagttaaggagtaaaattttgtggaactaagcaaatataaatacttgaatagaattaatacttgagtgtataatacaagaaatgtgttaatagctgtgactgctacagtgcaaaatattgggtacagaatttaaaatcatataatattctaaacatttagagtctttgcctgaagataaaattggaaaactgaaaatagcagttgtttaaacaagatagatgtttatttctctcatatgtaaaagatcatagatacgtggtcttttccatggggactggtggattgtgaaataattgaaattctcaatattttaataatcattaaagtatattttattgtaattttagaagtatacctgttgatgtttttcaaaactggattttccatttaaaaaggaagaagctgctaaggcagcacaatgggaggcagccaactctaggtctttattccaagcaccctctggatatcctcctgtgctgttttcattcctgttgcctgacgctggtgggcattctgggcctaatgcttcttgctagtggtgaagaccagacatatctcacct

SEQ ID NO: 32766 - DNA, 1082 bp, Homo sapiens
ccaggctggagtgcagtggcgcaatctcggctcactgcaggctccgtctcctgggctcacaccactctcctgcttcagcctcccaagtagctgggactacaggcacatgtcaccatgctcggctaatttttttatttttagtagatacagggttttgccatgttaccctaggctggtcttgaactcctggactcaagtgatcctcctacctcagccttctaaagtgctggaattacaagattgagccagcacacctagcccaatctctttccttttaatggctgcatgtataccacattttctagtctattattgttgggcatttgggttgattttatgtctttcctattatgaatagtgctgcaatgaacatacacatgcatgtatgtttataatagaatgatttacattcctttgggtatatacctgttaatgggattgctgggtcaagtggtatttctgcctttagttctttgaggaatcacggtcttagatacaatttttgaagagataattttggagaaatttccagacaaatttcctttgatccaaagtttgttctcaggagtgagcaagataagtgaaagtaatttcatagctgtaaatagtatagtataactgaagtattaaggaaattttgaaagatttcatcaaggaatgtctgatcgttttctttataatgcagttaatgttgaaatacacagtaaaataaattctcctggtaaattgcattataaaatttaccaggagaataaaaaggtgctttttaaaagtttgtattggccgggcgcggtggctcacgcctgtaatcccagtactttggggaggccgaggtgggcagatcacaaggtcaggagatcgaaaccatcctgggtaacacagtgaaaccccgtctctactaaaaatacaaaaaattagccgggcgtggtggcgggcgcctatagtcccagctacttgggaggctgaggcaggagaatggcgtgaacccgggaggtggagcttgcagtgagccgagattgcgccattgcactccagcctgggcaacagagcgagactccgtctcaaaaaaaaagaaaaaaaaa

SEQ ID NO: 32767 - DNA, 1107 bp, Homo sapiens
acttaaaaaattgaaatattgatatttatattttgagagagagagacagagagatgcaaaagcctaaatatttatggcagcgtcaaactattaacagtggtattctgcagatgggattcagagttaggatgagataaagtgaaacttttccttgtattcttatatattttctgttgctcgaaattttctttttcaaaagcctagaatttgttttcttatgtcttaataattaaacatacacatactaacacataacagtgcattagctgtttgttggcaatagttctcactgtttaagctgactgcagttggcagcattattaaacaaattgtacttttctgactcttggtaggggcatcaataaacaatactgctgaagaataggttagtttcactaatgggtcagtaattatattctagaaccaacctgctcctatagttgcctggacacttgtaagcatcaaaagcacttggagattttgtccacacaagataaatacgaaacatagtatttgcattgtagtatcttaacatgaaaatagaaaattcaggttgatcttgagatctaactggactctgccacttactaagtgtgcgactgtggacaagtttatcgggttttcagatctttcatttcctcattcataaaatcaggaagataacatgcttcttacaaggtttttgtgcatatgtattatagataacatatgtaaactgacacatagtctatactgaacatggcctatttggattgtagtgaggagaaaaagcagtatgattcattgttctttagtagagacaaataagattgactggatccgggttggcaaatactgctagtggttcagatgcctcttttaaataaaatgttgaaacatagccacacccattaatttgcatattgcatatggctgcatttatgttatgtcaccagggttgagtagtagctatagagaacttaagacccataagcctaaaatatatactgtatggttttttgtttttttggtttttttttttttttgagatgtagtctcactctgttgctcaggctggagtgcagtggcgtgatcttggctcggccaacctacgcctcgtgggttcaa

SEQ ID NO: 32768 - DNA, 1224 bp, Homo sapiens
agcacttcgggagatcgaggtaggaggattgcttgaattcagcagttcgacaccagcctgggcaatatggcgaaacccaaaccctgtgtctctaccaaaaatacaaaaaattagctgggcatggtggcaggtgcctatagtcccagctactggggaggctgaggtaggaggatggcttgagccggtgaaggggaggttccagtatgctgagatctgccagcacactccagcctggtgacagagtgaaatcctgtctcaaaaaataaaagcagaaaaaataaaagcaaaaaaaaaatgacagaaatactgcatgtttgtaggaattgagatgtaagaaatgagtctagtaaactgttaattccacataacagcctgcattaaatctgatcattgtattatgctatactaacctacatcaataatcatatcccagaattttgtacttagtataacagtttttgcattcttactaattccgtgggttttttatatctcattgatgagagtgagcttgtcagtgggaaacactagagaaataaagaggagaaacctgatcagaggcatccctggagtatatttaatcaagatgattgccttgggcagctggcaggcatggtgctccagtgagcagtgataaaagtgtatggttatgattattctgatacttttatacttcacttaacttgttcttcccctaattttacagtctgtgggattctgaaaaaccttctgttgggggaatactccagttcttgaaccatcctcaaagtttttcaccacctagaaattaattttcttatagtagtgaagcataatatttatttaatagtaaatatgctactgtataataactaccacagtttcatattataaaagtacattgtcatgacttagcctacactgtgttattggtgtggtttactgtgtccttcaggtttgtgataagcaaatgctcacaacatgattatggtctgtacaaatttagccaaaattgaaatgggtgtaatattaaaaaaattaagtatcgaactttgttgtgcaaaattgatgattctttgaaaattattgtttacgaatcacataattttaaggttggtaggtctagtaaattgtaaactgtctatacctttgctacacggtcatattaagtaaacaaacatctttcctcagttgtcaagaatatcattcaggcttggcgcagtggctcatacctataatcccagc

SEQ ID NO: 32769 - DNA, 1048 bp, Homo sapiens
ttaagtgtatagtttagtggtattaaataggtccatattgttttgcagccatcaccgctgtatgtatccaggactctttttcatcttgcaaactggaaactctatacccgttaaataaaaacccttcagtgcccccaaccccagcttcaggcaactaccattgtactttctgttcctatgaatttaattactcttaagtatcttatgtaattggaatcatacagtatttggtgttttttttttttatttttttgcgactcgctaatttcacttagcataatgaaagcaagtttcattcataacatctgtcagaattatcttttttaaggctgaataatactccattgtttgtgtataccacattgtgtttatccatttgtcagtttgagttgcttccttgattgaagtactgtgaataatgttactatgaacatgggtgtataaatatgtcttcaagacctcattttcagttctttggactacatacccagaagtaaaattgctggattgtatggtaagtctattcttaattttctgaggaaacaccatatttttttacactgtggctataccattttacatccccaccaacagtatataagggttctgatttctctacttgttactttctggattttttttttttttaatggagtcttaccctgccacccaggctggagtgcagatggtgtgatcttggctcactgtgacctctgcctcctgggttcaagtgattctcctgcctcagcctcctgagtagctggaactaccggcatgcgccgccatgtctggctaatttttatatttttagtagaaatggggtgtcaccatgttggccaggctggcctggaactcctgacctcagctgatccacctgccttggcctccaaagtgctgggattacatgcataagccacagcacccagcctactttctggatttttttattatagccatcctaatggatgatgagtgttatcttactgtggttttgatttgcatttacctaattactaatgatattgagcatcttttcacgtgcttactg

SEQ ID NO: 32770 - DNA, 1035 bp, Homo sapiens
taggtgtgtagcaggctacaccatctacatttgtgtaagtacattctacaatgtttgcacattgtaaagaaaattttctgagaaaatgcatcattagataatttcttcattgcacattgtggagtgtttattcatcagttgatggagaaaagagaaatacagtcaagcaacatatgactggacacaaatgttaataataatatatgatttcatgtatatgaaaatgtttaaaataagcaaatccaaatagtagtgattgtcagggagtaggggtggggaggataatgagtgatttaatggatatgggatgtctctttggtatgatgaaagtgttctgaaattagacagtggtaatggttatgcaaattggtgaatatagtaaacctactatattgtatagtttgaaagggtgaattttatagcacgtgaattgtatatctcaactttaaaaaaatgataacagtggttctatcagttagggttgaatttggcattagataacagaaaaccagactgcacttgctttataaaacagagctttatttttccttcataataagcagagttgcagtgttgctggtattgattcactggcgtggtggtatcaggacagatgtctctatgattaatttttggcctgtcactcatgtttgcatatggctgttgtggctccaagcattggaagcaagaggacagggaagcaacattgactgtaccaggaactccaaaacagtcttcacatcttaatggttggacaatgccaaatggtcactcttttctggaagttgactggggacaagatagtggtaagggaattagattttggccagaaagtttctgccacagtgagctttcctgtctaaatccttattttaactgttgtcacttaatattcacactttggaaggacatctactgttggttacaattatgaaaccaacttgaatactttttagttgaacatttcagtagtcttaattatgtttaaataggtttcacaatttactgtttttagtttagtttccggctcccccc

SEQ ID NO: 32771 - DNA, 1576 bp, Homo sapiens
gtttaaggtctgtgtctagactgatgttttttgcttgtggatgtcaaattgttctagcactttttttttttttttttttttggagacagggtctcactctgttgcccagtctggagtacagtgtcgtgatcttggctcactgcaacctccaccttccgggttcaagcgattctcccacctcaatctcccgatgattctcccacctcaacctcccaagtagctgggactgcaggcacatgccacgacgtccagctaatttttgtattttttagtagagacagggtttcaccatgttgaccaggctggtctcgaactttggacctcaagtgatccacctgcctcagcctcccaaagtgctggaattacaggcgcgagccaatgcaccccgcctgtttgggtccagcactgttttttgaaaagcctatcttttcttcattgtattacctttgcttctttgtcaaagatcagttgactgtatttgtgtgggtgtatttctggactcccttctcttctgttgatctatttgtcgtattgttttgccaacactacatcgttttgattactgtagatttatagtaaatcttgaagttgctacggttagttttccgactttgttctgttatactacttcagtatcatattggctactttagacctttggcctcttcagtaaaccagaatcgctttgttagtattcacaaaacaatttgctaggattttggttgggattatgttgaatctataaatcaagttgagaagaactgacatcttgataatactgagttttcctatccacaagcatgtaatatttctccttttacttagttctttaatttctttcatcagagttttatacatttcctcatatatatcttgtacatgttttgctagatttataccttagcattttatgttttggggtgctaacataaatggtattgagttttaaatgtcaaattgtttgttcattcctggcatataggaaagcgattggcttttgtatattaactttgctacaatcactttttagttcaaagagttttttggtcagctcttgtgtggattttctgcaagacaatttcgtctcctgggaacagagactgttttgacttttttcttcccattctgtatgccttttatttccttttcatatcttactgcattagctaagacttccattacattgtcgaaaaggtgagggcatccttgccttgttgcttatcttagtaggaaagtttctagtttctcaccagtacaacattatctgtagtttaaaaaaaaaaatcacgttgaaggctgggcactgtggctcgtgccagtaatcctagcactttgggaggccgaggctggtggatcacctgagtccaggagtttgagaccagcctggccaacatggcaaaaccccagctctacaaaacatacaaaaattagctgggtgtgttggtgtgcacctgtggtcctagctacttgggaggctgaggcaggagaatcacttgaacccaggaggaaaaggtggcagtgaacctagatcatgccactgtactccagcctgggagacagagccagactccatctc

SEQ ID NO: 32772 - DNA, 1463 bp, Homo sapiens
attatagaagattaaaaaaaacaagtcacctggttccaacaagttcatcaaatacatctagactttttgatctgttcagttggttactttcaaaattgggttcatggattagagctgtttttcaaactagatttattatgttactgttctttaccttatgatctttaagctctgttcttgttgcctaacctttgtaaagccagttctcccaacaagatgatgttggcctaacggttcgaggcgattgctaatgcctgtggctctaataagatggaattcaattctgaactccaggcaaacctgccatgagggtttttccttttgtcctctttgtaactaacttgtggcttggatccctgacattgactgtcatattttctccctgatgtgggaccagagacaacaaggatacatccatttccacactgagagacaattaaagcctaaattcaggatagttgatgctttcagagaaagagtttgaggaaaagggaaaaatgtgaaaatcgattatgtgaattggagttactgtgacacccaactaatttggagttgaggcaccaggtaggggaaaaacactcagagcataaagtgcctgtgccaggaattatcttccaagcccagctgccaaaacaacctgctgtaatcttaaggccagttttgcctagtagctgctaaaaccacctgccttactctgtggctagttttacctactgctgtcactcaccaatcagagcttaccaatacttgagaactctcactagcaccaatgagctttctattaaaacaatatacataacatttatctttcctacttaaaccccaatcttctttattcttcagacatactaaagaccacctcagtctttgtgtttgttccaagttgcacttctggttttatatattcccagctgaaatattttgcttagagatttgtctctatactttgattttgatactcggcatactagtccccccaaccctttgcagtcatggatctttttactgcctttttcgttttgccttttccagaatgtcatatagttggaatcatacaatatataatcttttcaaattggcttctttcacttaataatatgcatttaaagttcttccatgtcttttcaagacttagagctcatttcttttagcacagtttatctgtctattcacctaccgaaggacgtcttggttgcttccaagttttgtcagtcagttgtgtgtaaagttgctataaacgtgtgtggacatatgtttcaactcatttgagtaaattctaagaagtacagttgctggatcttatgaaaagaatatgtttagttttgtaagaaactgccagatgtgaggtgtctgtttaaggtctggctcatcattattgggttcattttcttggtgagggcttttgtttgtttgtttgtttgtttgtttgtttgtttttggagaggaagtctcattctgtcgcc

SEQ ID NO: 32773 - DNA, 2040 bp, Homo sapiens
agaccctgtctttaaaaaaagaaaagaaaagaaaatgcagttgactaattctagagatagtaataatatttgatggtgtggataaacagaccagaaattcttaagtatttgaataaagcagtggtctcagcaaagacattttcttcctataaaattaagtaggctattgagacattaaaggaagtcattctttcttttttatttcaatagttttgggagtacaggtgatttttcgttacatggataaattctttggtggtgatttctgagattttactgtacctgtcacccaagcagtgtacactgtgcccaatatgtaggcttttaaccctcacacccttccaaaccttcctccactgcccaaatccccaaagttcattatatcattcttacgcctttatgtcctcatagcttagctcccacttcgaagtgagagcataaccatatttggttttccattccttagttacttcacttagaacaatggcctctacctccatccaagtagctgtgaaagacattatttcattcctttttgtggctgaggagtattttatggtgtatatatactatattttctttatttcatccactcattggttgatgggcacttaggttggattcatatctttgcaattgtgaattgtgctgctatatagatgcatgtggatgtgtctttttcatataatgacttttcctttgcttagatacccagcaagatacccatacaaacggaatcatttgatatgtaacctttttagcctggcttctttacctttacccagcagtgggattgttggatcaaatggtagttctacttttgtttaagtaatctccataccgttttccgtagtggttgtagtagtttacattcctaccagcagtgtaaaaatgttgcctttttaccacatccatgctcctctgtttgttggttttttgactttttaattatgactattcttgcaggagtaaggtggtatctcattgtggttttaatttgcatttccctgatgattagtgatgttgagcattttttcatgcttgttagctgtatatcttcttttgagaaatgtctcttcatgtcttttgcccactttttgatgggattgtttttttcttgctgatttgagttccttgtagattcaggatactagtcctttgtcagacacacagtttgtgaatattttctcccattctgtaggttgcctgtttgctgattattttgctgtgcagaagctttttagtttaattaggtcccatttatttttatttttgttgcatttgcttttgaggtcttagtcatgaattctttgcctaagccaatgtctagaagagtttttctgatattgtagaatttttgtggtttcaggtcttagattttctttctttcttttttttttcccaagacgtaatcttgctctgtctatatagttataatgtgtatttcataagaaaacagtaaaatatggctgtggacatctgacttctgctaaatgcacctgatgtttatttattgaaacatttgtggtgcagtcccatttctataaatgtatcttctaatccctatattaacacaagatacacttcctgggaatgtaatcaggctgaagatgttttaatctctttatattctgttcctcttagttggataattccagatttcaaaatgcctgggttgtgtctaattccagggagctgaagtaaacggagttttccagtgagaaaaagtacattgcattatagcagaagatggtagtcagtatttgtgagagaatgctttattttctactttaggctattgacattagaaataattggaattgttaaaaatatgatgtctggtgccctcccaagattttctgaatcaaaatcaactgtgaccacacattagaatcatctagggagttaaaaaaaatgctggtggctggatctcatccccagagaacctgatttaattatttagagggtaaagatagtgattcttaaactgttttagaatcacctggaagatcccaaactgagtgtgattcagttggtcgg

SEQ ID NO: 32774 - DNA, 1025 bp, Homo sapiens
gtttcgccatgttggccaggctggtctcaaactcctgacctcaggtgatccacctgcctcagcctcccagagtgctgggattacaggcatgagccaccgtgcccggcctcatatgtgttttttaatgcacatgtgaagccatttctgttggatatatatctaagatcgaaatctcttggtcataaggtatgttgttagtagaaaaggccaaattgttttccagagtggttttactgaacttttcttccaacagcagcatgtgagaattcccttttatattctcctgagtgcacattattgccaatcttttaaaattgtagccatttttgatggctttaatttgcactatctctggctactaatgagtttgagcatctcagtgctgaccattttgatgtcctattctgtgaagtgattgttctcatcacttatctatttttatttttaattaatgcatattttgattcataggagctttttatatattcttaatataaggcatttgtcagtttaagtaggttacttatgtcttctcccattctgtagtttgcctgtggtgcctttttatatggtatcttttggtgcagaaaagttctctgtaggctgggtgcggtggctcacacctgtaatcccagcacttttggaggccgaggcagttggatcatgaggtcaggagatcgagaccatcctggctaatgtgatgaaattctgtctctactaaaatacaaaaaattagctgggtgtggtggcgtgcgcctgtaatcccagttactcaggaggctgaggcaggggaatcgcttgaattgggtaggcagaggttgcagtgagccgagatcatgccactgcattccagcctggcgacagagcaagagtccatctcaaaaacaaacaaacaaaaaaagttatctgaataggtacatacgtcaggtttttttccgttaaacagtgcttttttgtgttctgttttaaaattttttttcttccttggaggtaatggagttattcacatcatctataaattttat

SEQ ID NO: 32775 - DNA, 1030 bp, Homo sapiens
ttccttgacagatacgttgaggtataatttacataacataaaattctcccattttaagtgtacaattcagtgatgtttagttaatttggaaaactatgtagccaacactacctaatttcagaatacttctatcaccccccaaagaagaaaatctgtgcccatttgtagtcatttctcattttctaatcttagggtactactaatctattttctgtctctatagatatgcttttttgggacatttcataaaattggaatcatttatatgctcttatgtttggcttttatttagcaatgtttttgaggataatccatgttaaggcatgtttcaatactttcttgtattttgaagagttcttcattttattaatttgtttacttcatggacatttgagtttcaaacatttggctgttgtgaataatgctgtgaacattcatttacaagtcttggtgtagacatatgtttcattcctctttggcagatacctaggattggaattgctcggtcatgtagtaaatttatgtttaatattttaagaaaccgctaaattgttttccagaatggttgtactgttttgccccctccctgcctgccttttttttatttgaggtagagccctgctctgtcacccaggatggagtgcagtggcgtgatcttggctcaccgcaacctccgtctcccaggttcaagtgattctcttgcatcagcctcccgagtagctgggattacaggccccccccaccacacttggccaatttttttgtattcgtagtagaaatggggttttgccatgttggccaggctggtctcaaactccggacctcatgtgatccacccaccttggcctcccaaagtgctgggattacaggcatgagccaccacgcctggccacctctatttatctgaatatttaagataactatttgattagaattcagtatcacatgacattagctgttaccatagaagaagaatcatagatagcatcacaggattctattccagctagtaaaaaataataaaatacaa

SEQ ID NO: 32776 - DNA, 1052 bp, Homo sapiens
atagagtgactcatttgcttagggtaagatttttggtaaaggttcactaagaaatttagaagcttccttagttgatttaaaatacgggaaaaaatatcactagatttacacagaaatgttgaggaacatctagatttgcaattataatactttaagtattagactacttccatttggaacctttctagttcactttaacaagacaatttgaattgtcagccaggagcatttcattttctaaaataagaagaaatgatactttggtatagaagacctattcatgattttttacataggtttaatgtttttttttgaacagacattcacagtctcttttcagccttatagagctctctggtattactgttctgtcccaatgtatcatcccctcctgcctttattttcttaactagctgagaaccttgtttacctctcaaaatatgttcatctgctttgcatttttgtcttttcattgcatttgtctaaaacccaaccacatcacttcatctttctgacttctgtgtacctggctctgagctactgagcacagctggagaaaataacaaacttgcagactggagccactaagtattcatgctctccaatcttttttttttttttttttattgatcattcttgggtgtttctcacagagggggatttggcagggtcataggacaatagtggagggagggtcagcagataaacaagtgaacaaaggtctctggttttcctatgcagaggaccctgcggccttcctcagtgtttgtgtccctgggtacttgagattagggagtggtgatgactcttaacgagcatgctgccttcaagcatctgtttaacaaagcgcatcttgcaccacccttaatccatttaaccctgagtggacacagcacatgtttcagagagcacagggttgggggtagggtcactgatcaacaggatcacaaggcagaaaaatttttcttagtacagaacaaaatgaaaagtctcccgtgtctacctctttctacacagacatggcaaccatccgatttctcaatcctttcccc

SEQ ID NO: 32777 - DNA, 1077 bp, Homo sapiens
gatggctaagaaatctattgtccattgtctgggagagttcctggtgcctgaatcacactgtatcaaattctaattgcgtgtttctgtctatgtaaacttgggcaacttctttaacctttctaagtctcagttttctcatctgtaaaatgggaataataataaaagtattccactgttgtgggctgcacaacagtgcaaatacaaaagtaaaaggagttgcccttctccctgtcagtgtgcgttaaaaagttagcctttggccaggcacggtagctcatgcctgtaatcccagcactttgggacgctgaggtgggtggatcatttgagctcagaagtttgagaccagcctgggcaacatagcgaaaccctgtctctacaaaaaaatacaaaaattagccaggcatggtggctcgcatctgtagtcccagctactctggaggctgaggtgggaggattgcttcagcccaggaggcagaggttgcagtgacctaagatgatgccgctgcactccagcctgggtgacagagtgagactgtctcaaaaaaaaaaaaaaaaaaaagttaggttttaaccactagactatattgtgttgtgcatagatccaaagatcatttatcttaaaagacatatcgtaatctaagtaaatgctgaggttactttctgtaagcaaagaattttagttaattggttctcatcagcaggtagggctagcaatagattaaaactttattaatgaggccgagcgtggtggctcaagcctgtaatcccagcagtttgggaggccgaggtgggtggctcacgaggtcaggagtttgagatcagtgtggccaagatggtgaaaccccgtctttactgaaaatacaaaaattagcctggcatggtggtgggcacctgtaatcccagctacttgagaggctgaggcaggcgaatcacttgaaactgggaggtagaggttgcagtgagctgagattgcgccgctgcactctagcctgggtgacagagcaagactctgtctcaaaaacaaaaaatttattaatgagaatggtcagatgataaggtactctggttaattgagag

SEQ ID NO: 32778 - DNA, 1033 bp, Homo sapiens
tggtgtatgcctgtaatcccagctacttttggtggctgaggcatgagaatcacttgaacccaggaggcggaggttccagtgagctgagatcatgccagtgcactctagcctgggcaacaaaatgagaccctgcgtcaaaaaaggaaaaaaaaaatgcagaggcaaggctgggcacagtggctcatgcctgtaatcccaccacttcaggaggccaaggcaggaggattgcttgggctcatgagtttgagaccagactggacatcatagcaagaccctgtctctacagaaaatgcaaaaattagctgggcatgatgttggccacctgtagtcctatctactcaggaggctgaggtgggaggatggcttgaacccaggaggtcaaggttgtaaggttgtagtgagccgaggtcacaccactgcactccagcctgggcaacaagagcggaagtccatctccaaaaaaaaaagggagtaaggagggagagatagggtaggaaggaaggaagaagggaagttagctgccccaccatggaaactggaattggagagtgcaataataattgaggggagtttggttcctaggttagtgtcaagagttctgaccagaaactgcaggcctggtggagaggacgagttcactgtgtttagattccacatgtaagtgagatcatgaggtatttgcctggcttatttcacttaacataatgtccaggtttttccatgttgtcacgaatggcaggatatccttcagttaagattcagcaaatattttgtgagtacttattatatgtgtggcagtggtatacaaaattgataaatatgtaggttcttctcttaaaaagcttctattctgttgagagagattaaaaacaaaacaaaaaacacccctaaagcaacaaaacaaaccaatagggttaatgaaatgtgggtgggaggaggtgggaagcataaaaaatacaaaagtaaaaggagatgcccttctccctgtcagtgtgccccctgctgccccacgtaacaatagatcctttttatg

SEQ ID NO: 32779 - DNA, 1051 bp, Homo sapiens
cttagcaggaaagcagggaagataatcttgttccatcaagggggagaggtggagctattctgagagggtgtcatggagataagatccgttgacagaataggagtgacaagtcacagtggacgcaatggggtttgcccatttaggagagtgggaatattcaggagccccatgtatggagactgtgatacacagtgagcaagagattgataatatgtagtggggccctggggagaggttattgaacatgaagtcataagacatcatgccttaattttgaatatgaggacaatattttttctttatatgatagttaaaattagacataactagcaactcaacactctgtgtggcatttcctgcatctcacctctcccctcccactacagcataatccctcctcagtctggttctctttcttttggccaggttctacctcccttgcttccctaagcaggtctttccccggagtcagtcatcctgttggtcctgcaataagtggcttccaaaaaatggaataaataatcaaattcttctactctgacacccatcttctatttctttctgaaaatgaacttggattagttgaattgcttttcacaattcaattcagtttcaagggctctacagcctcttcacaatttcttgcaaatttatttccatctacttgtttataaaaggtatttgtttcagagacattgttctcctttctccatcacactcacatcttggccaccccttagagccactaattagctagagctattattttcttgtttgcattttaaaaatacaaatagagctcccatattattcagaatgcaaagttgctatgatgcatatttgaagtaattatctatattaaaagcaggggtttaatttatttcatctttaggggtgaaaggatgtcacatttataattatatttatattctgacataatataattataattctgtaattatattttgatatacattgatttttaggacagtatacaagatattcttaatacaaatgcagcaaaaggatatttataatttaatggcaatat

SEQ ID NO: 32780 - DNA, 1029 bp, Homo sapiens
tctcctttcgtgggtctgaaacatctcagggttccatgagtggcaactggcttctctctctaagagctctttgtctggcctgacacggaataaaagtacctagcatcaccaattctcccacctctcttcctccctctcttcctctctactttcttccttctcaccttccctccctctctccctcacccactgttcctttcttcctccttactttttgaaaaaaatgtgctttccgcccccacccccatggccatatttacattcctctgttattaaatgttagggaatttttacattgcagaaatttaccttaaacccctcctctttcctgattccaggccatccccaccaaaatgtctagctctgaaattacacgctatatattatcttgtgtcagatgatagtttacacatataattctatcatatttgtttaaatataaattaatggtatatcttcttttgcaatctcattggttttgactatttgatgttcagggaattatctgtctggcagaactgaaattagtgtggttgatgtgttgcagcccaggaagttactactcaaatgctccctgtggtagagacagtaggtgctcacccaatagctatgtgctcctacatctcccagctcctggggccatatggctagttgtggccaacgcactgtgagtgacatgtgttcctttcagattgaagcagttaagaactgttgtgcctccttcaagcctttcttctcttgccccagcaactttgaagagtgtagctacaaggaggctgctcttcccacagtggactttatgtgggcaggaagtaaacttttgttgtgtcaagccattgagatgtttaggtttgtttgttgcagcagcagacattaactactctgactaatagagttcctgaactctagtctctgcaacacagtaggcatgcaagagatatttgttaaatacatgattggatgaacaaatgaatctgttccaggcaggaggaggaccaggtccttttctatatatggagccataataac

SEQ ID NO: 32781 - DNA, 1052 bp, Homo sapiens
aataatgctaaaaataacaatagtactaacattctgaagtaaaatttactaggtggagtgctgttgctcttcaaggaacagcagtagttgaggattgtcaagtaccctgaagcacaagggacaataaatgtgacaagaacagctcctgggtttgggggattattcaacaacgattagattggttagagacagtgcacttttgtatgtatatccttgcttaagagtagagaaaataaaatgtaagatttttgaatatgtaacatggggtgttagagtgaatgcgtcttcactgatgcagggagtgtttggccggggtccatctcagaaaggaattcaagagggcaaacatgtggcatgtgtactgctggttcccagtcagtcctatgacaggcattgccacttgatcatgataatcttccattcctgagtccttctcagcatagtcagttgggattggcctgagttggcatttaagatcaaacaatttgttgtccctggctccaaaaaggaacacttttgtgtgcatttagtacctgatattcaaaaactccctcctcaggaagcttcctttggtctcctgacatggccaggtcatggcaccaaagctactagcacctttcactacaccacagagattttagtgaaatagccacatatatatataaattttttaaactactttttgcaatgtgtatgccctggaactcagacatgaatctatgcacactagcttagaggacaatagaagtatccctcatccctactcaaacttgttctttttcacttttcttctcacgagatgggacttcccaggacgttgctcattccttatgttttccaagtccacaaaacccacatgatacagtggatatttctgtgggagttggacctacacatgatctttaatagaggcctggcctgggtgtccatgttttgattcagatgcattggctttaagtaatagtaaatcccaactgaaattgacttaagcaataaagaaacttaccacacataaggccgggcgcagtggctcatgcctgtaatcccagcac

SEQ ID NO: 32782 - DNA, 1071 bp, Homo sapiens
caaacacatatatgagtaaagggaatagtgtgatgaacccatgtgctcatcactgggcttcaaatattatcagctcaactcaaggtcaatcttgtttcatctattaccacctccaactcacccagacttcctttgacctttgggtggtcctgacacctggagaggccttgaagttctcgtaggaaggtgatggaggaaacacactgcagggagcaaaaggggtctggtggtggagtagggtagctgggggagggggcaggctgggggtgttgtcgtacaaaggaagctgctcaatgaggaagctcaggagagctggagagctgatgctaccagatcagcccacaatcttgatgggatgggagttgatgagtaattgctccaggcttcctgtgcttctgtggggcacctctgagttttattctgcacagtttctcagagtcccttgtgggattgagtgctagttctcactagtatgcagttactattattaatgcatagttcatcggccttcctcttttctgtttcatttttctcactcccttacttctttctcttatgagcacctctgaggtaaattaatctgcacccaagtccttgtttctagctccacttttgggggaatgcaaatgtaaacagtaaatgtgtttggacttgtgtgcacacactggtgatgattatcaatgagaatgtctctgttcttgaatgttcatcattacgttatatgtttccaaatgggtttttctatctactttggagggtttgactaacgtattactttggtgtttctatgctgtgttcaccccttcccattttcaaatatattttaaaattctttagtaagttgtattaggtctcaatagaaacagaactagtaggatatatggatagatagatacttatgggtatttattagccagtttccctaataaatgacaggggatttattaagggaattagctgatgtgatcacggcataggctgtctgcaaactggagaatgaaggaagctggtagagtggctcagtctaaatccgaaagccggagaacctgggactgttggtgcaggtcctgg

SEQ ID NO: 32783 - DNA, 1020 bp, Homo sapiens
agactcaggttttcggcatctcagggagtctgcagcagtgatccagttcctttacagggtctatggattctctctccaactagtatttgaatgccattgtgcttaaccagaacacgtatgttattattagaagcaccaatgaaatctattattaaataaaaacacacctattattaaattagccaagcattacactattggaatgctgtttgtgtagagtaagttagaaaaaaaaaatagacaactagggttattttaggaagaatggtcactactttgattgttttcaactactgactactctaactttggccctatattcagatttgattaagacattcctttctaaccttgcatgaatcctcatcttggattcagatgcctccctggaccctcccatgggctctgggtggatgtcaaaagctcgagcaacttccaataggtcttgaaagggtacttggattgtgtttacagcagtttagttttttaaacattgttagccatggacagtgtgtttggcataataatagtaattgggagtacaaaaatgagcaagctgtggtctcttatcctaggattcagtcagatggtagaaaagcatgttccaacgaagtcccttatgctatgatgtggtcagaattgtgacgcagtcctttgcattatcctgctgtgcacattttgatggggctcccaaaccctgaaccattgcactttcagcaactttgaagccgctgcttacccttctctgatcctcatttcatgccccccagtcctgcaagaaaagcaccaggcactgatcacagactcccaggccagcagcagcaggtgtgagaggcttaggggaaggagaagaagggtagcctctctctgtaaaggtgaactcctgtctcctctaggatgcaaagggaatctcgattcagactctcagacacctggaatccctgctgagagtccagcgggagcagaaggcccggaagttttctgaatttctgagtctgaggggaaagcttgtcaaggaag

SEQ ID NO: 32784 - DNA, 1045 bp, Homo sapiens
ggtgcgatctcggctcactgcaacctccgactccctggttcaagggattttcctgccttagcttcctgagtagctgggattacaggcacgtgccaccccacccagtagagacggggtttcaccatgtttgccaggatggtctcgaattcctgatccacccacctcggcctcccaaggtgctgagattacaggcgtgagccaccgcgccaggccgcagactttttgatgtaagcatttaatgccatgaactttcctcttagcactgctcttgctgtatcccagaggttttgataggttgtgtcactattatcgttcagtcaaagaacttttaagtttccatcttgatttcgttgttgacccaacgattattcaggaacaggttatttaatttccatgtatttgcatggttttgagggtttcttttggagttgatttccaattttattccactgtgatctgagagagtgcttgatataatttcgattttcttaagtttactgagacttgttttgtggcctatcatctggtctatcttggagaatgttccatgtgctgatgaatagaatatatattctgcagttgttgggtagaatgttctgtaaatatctgttaagtctatttgttctaggttatagtttaagtctattgtttctttgttgactttctgtcttgatgacctgtctagtactgtcagtgcagtcttgaaatcccccactattattgtgttgctgtctatctcatttcttcggtctagtagcaattgtattataaatttggaaactccagtgttaggtgcatatatatttagaattatgatattttcctgttagactagtccttttatcattatgtaatgtccctgtttgtcttttttaactgctgttgctttaaagtttgttttgtctgctataagaatagctactcctgctcgcttttggtatccatttgcatggaatgttttttttccgcccctttaccttaagtttgtgtgagtcctaatgtgagtttaggtgagtcttctgaagacagcagaaacttggttggt

SEQ ID NO: 32785 - DNA, 1028 bp, Homo sapiens
gtgagccactgcgcccagcctagtcctacgattttttaaaggccttcttccttctgaagctgatgacttctttgactttctattgcactttttaaagtgcactttctattgcactttttaaagtctgaatcatgggccgggtgcagtggctcatacctgtaaccccagctctttgggaggctgaggcgggtggatcacgaggtcaggagtttgagaccagtgtggccaacatagtgaaaccctgtctctactaaaaatacaaaaaattagccaggtgtggtggagtgtgcctgtaatcccggctactctggaggctgaggcaggagaattgcatgaacccgggaggtggaggttgcagtaagccgagatcgcgccattgtatttcagcctgggcgacagtgcgagacactgtctcaaaaaaaaaaaaaaaaaaaaaaaaaaaaagaaagaagactgaatcatgtaatctcgaaagacttgattaaatagggtaaagtgtacctcttgttgccttagtcagattctcacttctgcaagaactgaaattctatgttttattttaaaaaataataaaagtgatagaagatgatgataagaagtttgaatagtacagagaggtagaaagtgaaaaataaaagtcctgtaatctctattttcacttcccagaggcagccattgctaatagcttcttgtctatctttccagaaacagtctatgcttatgaaataatatacataagtgaatcatacatatgaattataaatgagcatattttattcattataaaactaattataacaaatatgagtctttcatatgtatgtgtgtgtatgggtgtatatatatgttgactctccatatctgtggatctgcatccacagattcaacaaactgcggatcaaaaatatttgaaaaaaaaaggatagtttcttctgtactgaacatgtacagagtttttttcttgtcattattcctaaataattaagtataacagctatttttatagcatttacattgtattaggtatt

SEQ ID NO: 32786 - DNA, 1073 bp, Homo sapiens
tctgtctgatcagacctggggcacacccaaagaactctcctagcttgggatccggtcaggaagaaaccaggacggtccctttaggagggtgggcagggctatctgcccggggggtgcggccgcccctgcacagcaggctatcgattgtaccggaggcagggtgtggggaaaccggggcaagtccagcctctcagcaaggccaggaagccattcacttggatcctggattttactaacggattaaacgtggcattcccgccttcccccatccgttacagacctaaaaatagctcgtccgagaggggccgggagaggctccacctcttcttgaggtggggcggggcggctgtagtaggagctggaggcaccagagaccccaagccacgagctgaccgacgcaccgaggagctctctgtccgcggtcccgcaggttggcggcactggagtgggccgggcaggctctgcctccgccgcagagagcgcccggactgcgtggggctggggaagcatcccgggaacggcgggcggtgagcattccgggaaccatctctgggctgtctggggcggtggagcaagtctggaggcgggacgtggggcgagtatgggagccgccacctcgagacgtcttcccgccgtccccggctccaggagaccccacggtgagcgggccgcgcgggaaaactatgccaggaattcgtcccgggagcggggcgggtgggtagcttggctgcagtccgagggatcagcgattcgggaggttaaacattagcgggggcgaactccctgccggggtgcagcggggcgcgggaggagccggctgcgtgcgtccgcgctgcccagggcgcgcccttctggcccggcgcggccctgcagcccggccccctcggcctgctccgaactgcggcgcccagggagggaaggacccgtgcgcgggggacgaatgacgggatgccccaagactcggcttcactgggaagacggccttgggtttttactttttgaaaaaagaaaagtgatttgggagggcttgatgatctgagtgccgtaggtaaaggaggattcttttagtaatg

SEQ ID NO: 32787 - DNA, 1034 bp, Homo sapiens
tataaatgtatcgtattgcttgtatctttctcaaacttgcttctttgtttaacatgctttgaagtctgtgttgatacatgtaatctaatctgttcatttgtgaatagtattccattatataagtatatcacaactgcatattaatttcattgtgtctgaatgaattatactttgatttcaaagttaaaggaatagcttggattcacatcgatttcacaaatttcatgaattacattgacagctaaaacttacatcctgaatgtaactgttacaagtctgttccctgccacttggctctttcttattctaaactgttggaatggaggtacaaaataggctgtcttctctgtggcaggtgtgggtacaaattggaaccacttttgggaagctgtttatcaggtttttctattttatctcagggatatcatttatgcatataatacacatatttctttttcggcttaaaacaacaataatttgttattttattaatattgggagcataaggaactagtctctagtcaacagttagaaagtaactgaagtgtgccagcaaccatgtgtgggaccttagaaagcagatacacccttatttgagcctgcaaaggaaggagactgcagtccaccatctttttaaaaaatttccctagataactttttaaaatcgtatatattgaaggtgtacatgatattttggagacctgtgtatatgtctttgtatttgcagtatttaaggaaattaaatatagcttatttttctgcttcaatctaaggtcattttgagtgccccccttataattcatctacaatcaggagtatatatcatgtgagaaatattgaagtctataaattaaaacaggtacgtaaaaagcgcattacagcagacttgaaaacattttaaagtaattctgtgccaaaatgtattttggtcatattggtatactactttcaagaagagcaattctgtatttttaaaatgtggatcttgagtttttaggaggttcacagatgaaccttttttttttctttttttg

SEQ ID NO: 32788 - DNA, 1002 bp, Homo sapiens
ggaaatcacttatttatcctggaaaaaggattcattccaggatgatgaaaggtgactgctcctgtagagacagggacagtgtgcacagtgcatgacacagagagcaaaactgtagacgctggtcatgttttcctctatttcaggaagaagtcttaaagagagtttaagggatggtggaagatatttcttcctatttctagagcatctcccatctcagcactctgtcttctgcagatttgaatatttcaggagactcttaagaacttcctttgtgctcacattcagaaaatattccccaagagaaaggaacaacgtacctgctctttgacctcaatgttatgttccccttctagaataagagtgacggcttgcataatttgctttccatgagtactcattattttatctatatgctgtaaaacaatgggaaatccataattatcaaagaaacaaagaccacaggacgaatacaaggcttctaaaagttaaaacaatatgattcacaactgcttcatgcaaaacactatagcatatagaactagatgccaaagaacagtgtttattatattttgaagctgcagtttgccttcaaatatgtcatacacacacacacacacacacacacacatgtatatacacattacacatacatacatacatacataaagttgacctgacagaatatgaaagcacaatcattgggggtcctcaaacccaaatatattaaagaaaaaggaagcaaaggccaagtacggtacgctcacgcctgtaatcccagcactttggggggccgaggtgggccaatcacctgagggcaggagttcgagaccagcctggccaacacggcaaaaccccgtctctactacaaatacaaaaaattagctgggcatggtggtacacgcctgtaatcccagctacttgggagactgagaaagaagaatcacttgaacccgggaagtggaggttgcaatgaccggagactgtgccactgcactccagcct

SEQ ID NO: 32789 - DNA, 1035 bp, Homo sapiens
tacaggtgtgcacccagctaatttttgtatgtttagtagagatggggtttcaccaggttggccaggctggtcttgaactcctggcctcaagtgatctgctggccctggctgcccaaagtgcagggattacaggcgtgagccaccaggctcagcttgtttttgttttaaagcatttttactttgtgcctaggcgagttttcttttgatttatcttcctttgattttgcagcatttcttgagcgtgtagcttgatgtctttcatcagtttgggtacattcttagctattatgtcttcaaatattgtttctgcctcattttctcttttcaatttgcccaggagtccaattccattagtatttatcattgactaccctatgtctttcatgtttattctttatgtttcttccttttgtcttttgatactttattctggatattttctttcggttattgtattttttagttttagaatttctagtgtctttgctttggtttccagctttctgctgaaattatctgttttgtgtctctgaatatattaaatttacttattttaaaatctgtgtctgattttgggaacaagatagaggtggtgtttgcataatattgtgaatgtcctaaatgctactgaattgctcactttaaaatggttaattttatgttatgtgaacttcacctcaatttttagaagtcagcatgtctgataatttgactctctggttctcagtggattactttttatagcctgctgtttttgtaggtttccttttatgctgtttttactcctggtgtgcctggttgttttttactgagtgctgagctttgtataggaacagttgtagaaataagttgagatctactgtggtgttattttaccctagaggtaatcatgattgcttctggtagacatctaggtgtactagtaatctgggatcatcttaatccagctttagagattgtgatggtttgaaatatacctcagtcccaaagaaaactagtgtatttctagttcatcattattcctagggtgtagtg

SEQ ID NO: 32790 - DNA, 1050 bp, Homo sapiens
tatgtctaaaactgagttctttttatagaaatggcaattttataacattaaataattaactccctaattttaaaaaactattaaaacttgggtgtttattgtgattaaaagaaatgaatcttatgctggtaactaatgtttagttgtatgagttgtttctgatctttactaacattatgtcattataaacattgagtccttattttagtggttttgctgacacaacactatatatacgtttgcatatgtgagttcaggctatctaaaagggagcagtattcatcaggcagggtctggaagtcccctcagtgtgtgctggcagtattggaaggatcagatgagttagtataaattccatggagtccgagagaattaatcagagatactagggggctctagtatgaggacagaggcagttggtgctctgaccttgtttatgtgccagcttggggcaggcagtagtagagctgctggtattgaccatagtttcagagaagacattgtttgacaaactcctctaccattagaatgctaaatttttaggttggctttgtttttttttgtgttttttttttgtttgtttttttagacagagtctcactctgtttcccaggctgatgtggtgtgcagtggtgtgatctaggctcactgcaacctctgcctcccgggttgaagcgattctcctgcctcagcctcccaagtagctgggactacaggcatgcaccaccacgcccggctaattgtttgtattttagtagagatggggtttcactatcttggctaggctggtcttgaactcctgacttcgtgatccacccgcctcagcctcccaaagtgctgagattataggtgtgagccactgcgcccggcctaggttggctttgttaacaaggttgctttcctcatcaatagtatatttataaaatctctctaaatggaggggtattttggaaatactttctatatgcattggttttgaccttgctcttagatatagggcatgtggaaatctgaagctctttaaatcattgacttattggtgtgaaaaag

SEQ ID NO: 32791 - DNA, 1030 bp, Homo sapiens
tgtgaagaccacccacactccccttggctgatccacatgttctctcatacggttttggcagctctgtgttctcctcacaattaaaaaggaaacagaggtatggtttgggtctcactctacacgcttggaggctgaaaaccttttttgcttctgttcttttctcttgttcagggatgacctggaccgagccattgaggaatttacactgtcctgtgctggctactgtgtagcttcttatgtccttgggattggtgacagacatagtgacaacatcatggtcaaaaaaactggccaggtgagctgctcctcaggatctgccaagggccttagtaatgctatttcttatgtatagcataatctcttgtgcaactcagccagattcttttgtgattcttagtgtcatatctttgtctttacttcaatttctcactacctctcgtttcatatatagtctactacatgtattcatttgtttgcttgcttgatggtaagcatttatttgtttaaaaaattactaaaggctgtgtgtggtggctcacgcctgtaatcccagcactttgggatcccgagccggccggattacctgaggtcaggagtttgagaccagcctggtcaacatggcgaaaccccgtctctactaaaaatataaaaattagccaggcatggtggcaggcgcctgtaatcccagctacttgggagactgaggcaggagaatcacttgaacctgggaggcggaggttgcagtgagccgagatcgcctcactgtgctccagcctgggcaacaagagtgaaactccatctcaaaaaaaaattattgaaaaaatttttgtagttaaagtggcctgttcttcaatataagaaatagtatttgggatacatttgtacctaacagaaggagcggataatgtactggatgtattaaatttaaagattaccaatgctattcatatcctttgcccactttttgatggggttgtttgtttttttcttgtaaatttgtttgagttcattgtagattctggacattagc

SEQ ID NO: 32792 - DNA, 1098 bp, Homo sapiens
tgggaatccacaatagtatccatgcacacggccttctagattcctaccagtaattttggagcttttcagtgcaccatatggacatgtaattacctaccttttccttttaagctttcagttagcttgttggttcccccaactgttatttacccccaagacagctacaatgttaaacagatgcctctgagtatttttgagaaactccccaggaaaaaggcagttcatgctaggtgaggtctgagtcaggtcaaataaacatagtattgtaagtgggatcttcctggaaactaccagagaggccaaagaatgacagttctgtgggaatcaggctttgaaggagctccaacttcatttttctttcctctagtggctgtcagacatgcattcaccatgattgtgggctatttgttgtcaaggctaccacataactgggaagggggttgggactaggccatggtaaaacaaaacagattcacgttggggtgtgtgtgtgtgtatgtgtgtgtgtacgtgtgtgtgtgttttaaataaacacttattggattgctgcaagcctttgttttattttcagaactctaaaatagttgatttcaacaatttttgtcagtattcttgttgcttttatggagaagtagatattcagagtttgatatcatttggctatagaagtttgaaatccaaattgactgctttcctcagaagccttgaggatattattcatttgtcttctagtctcggtttttaaaaagtctgttctcggtctggttatcggttctttgtaagtaatgtcttttttacaccttagtgcatcaaaaagtttctctttgcctttgtctgcagtacaatctgtgcgtgtgtatttcttttatttcttttttttatcaccattttcattgtgccttttcaaagaagtcacatcttttagtttctgaaaactttgaacatttccttcagtattgcagttctcccactctcattgtctttttctgcagctctagtagatttatattaaactttcctgttctctcctttatgtctcttaaccttccatattttctatcttttcatatcttatcattataacagttttactcaagt

SEQ ID NO: 32793 - DNA, 1051 bp, Homo sapiens
taactataaacaagcataatatatttaatagaaaaatagctgctttagtttttttctgaaccgtttataacatttatatggttttggtgccttctcctgtttcttgataccagcactcttgatttttatgatttgagatttgacaaagtaattcagttatccaagacccttatgtgtccctccatgcctgcttgatttcttcatttcttccttcctttcttttttttttttttgtgtgtgttttctacctgcttgatttttaactgaaattaataatgtattgctattttccagtaaagtgtacttattgtcttaatatatttgggctcaatgcagacctatttatttcatctagaaagttgtgggtggtactgtcattactagtgttattgagtgaaggtaaaggtatactataatgacagcaattttattcaatttctttattaagtaggtaatttccagaaatacacgaaccttacttcaccaagttcatataagagtaaaatcaggaatgagaactaaagttattcctttgttttctaaggaaattgtattaatagatttctcatttctgactctgtactcagacattttttttccctcccaatctggacttcatagtgctgaaactaatgcttgtcagaaaaaaaaactaccttttttctttctttctctctttctccttccttccttttcttttctttttcttcttttcttcttttttcttttctttgctgagcttctcaaaggcaataagctctataatgttgtgctcttaattttagttttatttctgaatatggttttcttattcatatatttttttccactcttttttttactttcttgtgttgttctagaaccttttcttatttttaacttgtcttttctcattcattcagtcttagtttttaaacctctcagggaataacaaaataagtattccttcctttttcaaatatgtacatcactttttaagtaagaaaaaaattggaatagatgctaatcagggcattagtcaattgtttaataccagtcagatttcatagat

SEQ ID NO: 32794 - DNA, 1047 bp, Homo sapiens
tcattttgcttttaaaattcatgtttctgttacaaagcatagcaatgccagatcttatgtagtctaagtacaaatgtagtcatttacacttaaaattctacaaatatgagagccaaaattcattttctttaatttttttaaacagattattgaaaaggcagctgagattgcaagcagtgatagtgctaatgtgtcagtaagtatcaagagttttaaatggccctttcttatggagttgtgcacattattaggtatctttgcctcatagtaatgaactcacagaagaccgtaactcatatgcaagaacagtctgtgagtgtgggtaagtatgcacatgatagtgttttgttaaatggcagcccaatttgtgggtgatctgggttcagtgggcaagcccttttctgatacaagtacaggtttagcaggtaatctataagggattctgtggcacctcatagattaacaatgctgtcatagtgaatattatttagtttaatgaggagactgtatttctctcaggtaacaaagcagatttagtaataggcacacacatcatcatgcaagtgacccaaatttcttccatcttagtgctctgccatatttaacatgtattttctatttcatggtttaatattactgcttcagcttcctactttactatattccagccagcaggaacaggaaaaacaatagtagtggtcacaccccattcttattcaggatatcattagtatgtatcatttctgcttacatgtcattggccagatcttactgaccatgcctaagtacacacgcatctgagaggtgcagtctttagccacgccatcagtcatgcgcttggctaagagtaagagattctagtactaaaggaagaagtggagaatggatattgagggtcaaatagtagtctctgccacatatactattcccatttgtttctatgcagatactacaaataggttactttgttgacttgggttgctatatttatatctatatctacatctatatatctatatctatatctacatttatatatctatatct

SEQ ID NO: 32795 - DNA, 1165 bp, Homo sapiens
acgtgttttcttggattattaaagatttctcattttggctgggcgtgatggctcacacctgtaattccaacactttaagaggcttaggtaggtggatcacctgaggtcaggagtttgagaccagcctgtcctacacggcaaaaccccgtctccactaaaaggacaaaaattagctgggtgtggtggcgggtgcctgtaattccagctactcaggaggctgaggcaggagagtctcttgaacctgggaggtggaggttgcagtgagccgagatcacaccaccactccagcctgggtgacagagtgggactccatctcaaaaaaaaaaaaaaaaatcattttcacaaggctttttagtccatattctattttattcatatactatttattatgaaatgttaattgagttttaaggttcttcttaaacgtaataaagatagtgagcatttttctatgtatatcttgttctcattttagaagattattttggaaatcatccagaactttctagaactaacattattgaaacaaaggacatgtgcatgtttacaccttaaagttattcttagcatatttatgcaatggtatctttttcaacagcattatcctgtagcgtgggtaaatacgatggtttttgactttaaaggacaattgagaactggagacataatattacacagctggtcttcatttcctggtaagatttacattcttatccttagtgttaaagcataactaacttttggcatgtggactaggtaatatttatgaatcaccgttctttcaatttaataaataaaattatcattttgtattatttattctaaaatagatttacacaaattattttaatattatcataaaattacttgtttctgagtagatttctttacaaattttgttttggtttaaaatcggcctatattttattttattatttattatttttttttattttgtcgagacaaggtctcgctatactgccaaggctggtctcaaaactcctggcctcaagtgatcctcccaaagtgctaggattacaggcatgagccactgttactgacctgtattttaaacggttattttaacaagttagtattttaaacatacttccaacaaataatgtaccattattttgctagtaacaagttaactctagtattaaca

SEQ ID NO: 32796 - DNA, 1066 bp, Homo sapiens
tgggattacaggcatgagccactgctcccagcagattatgaatcttttagttaacctatgaggtagggagggagtgggagtaggggggatgctaggtcttgtttgaagatagtctgttattgaggattatgtttcctacagagttaagaacagaacttcatgaagcagagaggagtgtcagtagtgttgaaagctctttagacaggttagttgaaaactgaagaaacttttttggatttgacagttaggaattcattgatgatcccagcaggggccattttaggagactgtttatggctgaaaatcaggttgcagtggagtgaagagtaaagaggaggtgataaaatctaaatatttcagctatttcatttattaaacccatatgtaatatagctgcagtcatcacttccttaagcactggagttatagttagggtaaccatatatcctggttcaaatctcctatagatcaattaatgcccaattatttttatttttgtttttttgaaacggagtcttgctctgtcacaggctggagtacagtggcaccatcttggctaactgcaacctctgcctcccattttcaagctattcccctgcctcagcctctcaagtagctgggactacaggcgtgtgccacctcgcccagctaatttttgtatttttaatagagatggggtttcaccatgttgaccaggctggtctcgaactgctgacctcaggtgatctgcccgcctcaacctcccaaagtgctgggtgggattataggcatgggtcaccatgctgggcctttttttttttttttttttttaaaagacagagtctcatgctctgtcacccaggctggagtgctgtggtgtgatctcggctcactgcaacgtccgcctcccggtttcaagtgattctcctgcctcagtctcccaagtagctgggattacaggcacccaccactatggtcggctaatttttgtatttttagtagagacggggttttaccatgttagccaggctagtctcgaactcctgacctcaggtgatctgcctgcctcggcctcccaaagtgctgg

SEQ ID NO: 32797 - DNA, 1308 bp, Homo sapiens
cgatctaggctcactgcaagctctgtctcccgggttcacgccattctcctgcctcagcctcccgagtagctggggtaattacaggcgcccatcaccggtccggctaatttttttgtatttttattagagacagggtttcactgcattagccaggatggtctcgatctcctgacctcatgatccacctgcttcggcctcccaaagtgctgggattacaggcgtgagccactgtgcctggctgagatggttcacttttaaacatcatctcccacttcctaattctgatcatccttttcttgggggaaaactttaaattcccgagtaaattcccttgtcttcatatatatcttcacttgtggtttcaggaacttgatgggaaacctgcttctcctactccggttattgtggcctcccacacagccaacaaagaagaaaaggtaggtcagacatcatactcaaacctccctctaccccatcttcctccccatcaatatctggaggatacgtaggcctctgtggtttaagtgacatcagtttcagagcaggggctttgaaatgggaagatgctctttttgactattaagaaaatcttagttctcactttgaatcatgaacccacggataactttcctttaacagtactgtaaaacttaattaccctcttccttttgtctgcagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaatgaaggtacttgtttcctttctcaataatgaaaataggcttctagttttagaaggctgagccgaaactacaccttgcctagggatcagccccactgtcttttctttgtataactaaatctgcattttcaaatgttgtcaatcacatttttcttagagctgaatatccaggctgtaattctctaaaccctttttcttgacctcattgcatcattccacaggtcttgccccgattttgtctagcagctacccatttctggagtc

SEQ ID NO: 32798 - DNA, 1048 bp, Homo sapiens
ctggttctagagcacgcatcctcagtgggtgtaaacattgacttgggggcttactctttatgaataaagcatagctatacatatgtatatgcattatatatgtatatctgtggtattaaaatttcattgggggaggtgattagaaaaatgtccagaaagacttctagggagggtgggtgaaaatgaaaaaaataaaaaaggtgataaacactgttctagagcaagagggaataggctactggtcctctgtgtagcacattcagtgtttactgacagctctcctttcctgtctccctttggtctttccattgctaggctaaatagcatagccacataatagctggccaccctcccaaataatgccacataaaattgttaagtgaatacttatcatcttgatataagaaggtaaatgttgtaagaaaccaagtatgtgcagtttgtcatatccactcagaaatccaaatcagttgtctatgattttgttgtgttgcagattttctggtctgactctggagagctagtctgtattgctactgaggaatcattttttatccttaagtatctgtcagaaaaagtcttggctgcacaggaaacacatgagggagttactgaagatggcattgaagatgcctttgaggtaattgcatcagcacaactttcgctttcagctttgtttttaaatgatttatattcttacaacagactttactgattttaacatttcgttataaattaggtgtagggagacagcatttaaggatttctggtgaaatgtgaaaaattaaaatcgtaactcatagatcaaaatttaaaataaatatgtttaaaagaaatttgtactttgattttaagaattctttagacttactttgatatctttcagtaaagaaattatagttgttttggtcctaagactatttagtcagtgatttaaataagctcccaaatggtaaatcatttattgtgcagatgtcctagattttgtgaaatacttaatatttcattgtcatgttatgaagggtctaagtttagatcagtattcttt

SEQ ID NO: 32799 - DNA, 1024 bp, Homo sapiens
tgtttaatcattcacctattgtggacatttgggtcattttcagtttctaaagtggtttgtaagccctagtaattcatgtcatacacagtataaaaccctttcatcatttgtccaactgtaaggagttctctgatctcttaggaaaacagtacatcagataatcttcaaatatttattttatatttttgcataattactgaaaaatatttgaagatatttccaacatttggtagaactatgatttagtatataacatgttatgtttgccttcccttttttctcccaggtatgcaataagagagagcaacagcattgtaaagatatttaagaactttaaggaaaaaaaatcatttaaaccagattttggagcagaaagtgagtgtgatctacatatgatacatttttaaattctttgtaatggctcaaaaatgcctaagcaaaactctttttatgttccctttaggtatctacggcggcttcttattgggagtcagatctgtaaatggcttagccttctatgactgggacaatacagaactcatacgaagaattgaaattcagcccaaacatgtgagtttcccctccattgttgtttttggaatatttatttttgtgatgagttctgggtccctaaggccaagaagtgtcttttgtaccctgctctccctcttcgattatcaaaagccatttaaaatataaaacagcacttagaatttaaataacttcttatacttttgaaatacacattgtctacggcctcattaggatacaacaatcctgattttctgagcaattggaggtaagtggcagtgccattttgacaggaaaaaagcatgctttgagaacaagaagtcagagaattcttgacttggaaatgccttcttccacatagttcagaaaaccttttcatacattttgatgatagctgcttgaacttgaggtgaccatctccagtgacaaagtgtttacctttagaactgcccgctgctttgacagttttcactgtcaggagattatctttgga

SEQ ID NO: 32800 - DNA, 1025 bp, Homo sapiens
actgttggtccagtgcatgaggcactacctgatacactgtcaggctcctggtagatagtaagtctttgttgaatgattaatctgtctttgattctccctgttttttccctgtgtttatatcaccaacagcatttaccactcctatattgagagcaaattcttgagagagccaaaaaggtttttggaagtaaaaaggtttttagatgtacttgaatttcaaataaggagatgctatatattctttgaggtggtacatgcagtggtttaaaaaacatagtattttaggatttgaagccaacttgctgattaaattatataggcaagccttttaaccatgctgagcctctttatttatctgaagtgaagatgatattattgccttgcctacatcacaggattgtcaaaaagataaaataaaattagataaaattgtgtatgaaacctataaagtaccatataagtattagtcattagttatactttcctaatctacgttgagtatttgtatgtattgtgtgtgtagcttttcttactctttatttgcatcagtcatagcccctaacatggcgttgaaccttggctatttcttctgcagctgctttatttttactgctcagcagatccctggatttgttggctcctcatgagcttttgtggatttttctgccgtgttatagatcgcatgttgtgtctactctcagtttctgtatcatagtcagctggtagtgattctacaggttagagttgaagtgcctactcattcagcctttgtctaaagaatctttgaactctggcttgaaaagtcagagtaggacagttcttatgaaccggtccctattacttttttagtgcacatggttaatcaatcagtaagattatattgtgtttcttagttatttcatttttgctctctgatacaaaaaaggattagaaaatgatagtttgactttcagacttttaagaacaggcatcaaagaaggagaacaaagaggtaccatgatctctgctctttctaggagggtctc

SEQ ID NO: 32801 - DNA, 1033 bp, Homo sapiens
gaaaattgtgagacatgctggcttatatgaaaaccctcaccatggttcctgcctggtacataatagactcttcatacctgttgactccatagagatttaaaaagaagttaaaatttgtaatagtaatttatggggcagaattcagaaatgaagtaaaaagccttgattttgggaactagcaaggaatgttaagatgatgatttgaaagtggaaaattggagctgggagaccgaggtgggtggatcacaaggtcaggagaggagttcgagaccagcctggccaatatggtgaaaccctgtctctaaaaatacaaaaattagctggacatggtggcaggcacctgtagtccccagctactcgggaggctgaggcagaatcccttgaacctgggaggtggaggttgcagtgagccgagatcacgccactgccctccagtctgggcgacagagcaagactctgtctcaaaaaaaaaaacaagaaagtagaaaattggagagaggaagggactgatgacagtgaaaacatttttgaggagattgaagagaagagccagagaactctgatcttttaaagtaagaggtaaaggttgttgctgaaaatgaaggaggcgtgggtagaacaagacttgaagtagtcaatgacccaaatttgataaaaatccccaaaaaagatgagtaaaagcattgtgaggtgttttgtctcaggaagttgtctctgctagatcttctttttatattcaaaagtaaccttaaatttctgtcccattcatgatcatcatagaagatcacagcaataaagatttgacagtaactcaacttgccaaatgagcttttaggttgtgtttaagacctgttgaaggggaaatatattttaaatcagtcttttctcagcatgcctcctagagagaattaagcccactgccctaaggatcattgtatatattgaattaacttttctcctataatggcattttttggagaatggagaaaatagttattcaaataattatctgttctgtaattcaaaggaagaa

SEQ ID NO: 32802 - DNA, 1048 bp, Homo sapiens
gggaggcatgtcactgtcccattgtaagaagagcatgtggacagcgcatgctgttgtgcgtgggttggaaaatacatcctgccacaggtctccaacatgtctgactactcctctgagaaccacctggaatgacacagaagctttctgttttatttattaaattttttgataggtaacatatttacatgattcaaaagttaagaaaaataaatatgaatatattcaatgaaaatattccctctcatctcatagcttctacctttgcctccccatagacaatcactgctatattttttatatgctttcagagtttatagatattttgatatttcactctttttatacaaaacaatatttcatactctctgttctacattttgctttttttttcacttaaaataattctggagatgacttatcaatacaaaaaggtctctctctctctctctctctctctctctctctcctgttacaaatgaatagtattctattgtgggctttacttgagatcactaaattagttttctatgggtaggcactgagcagtttccaattttttaccgttacagacaacactgcagtgaataacatatgccatctttcatgggagataattaggaagccttcctcaagagctcaagccagcatggtcatcctcttcccacagtgccttatacctcattccatcatggcacttaccatgtctcctttcatcagaccatggctcctagagattatggactgtggctactgtaacttatttccatactgcctagcacagggccctctgtgtccacactttgccgaagacgtctgtgccaaggagggaagaaggagggagggaggcaaatgagtacaggtgtctcaggggcctgtgtttcgcctcctcttattgcatctgtaactgcatttcttagtggcaggtaccacttaaggcctgtgtggtttcttcctcaatctgtcactgaaactggaatctggttctaccctgtttggcctggcttcgtgtacagggtgtatcccagaagactccagcctgaagcctagt

SEQ ID NO: 32803 - DNA, 1050 bp, Homo sapiens
tttgacctgggagctatggagtctaattttgcaaacttctcacccagcagagtaccaggccaaaaaggcatgaatcagtaatgaacaaataaatgaacataaacccaagaggcagatttttcatggtatatgtgcacgtgtgtgtgtgtgtgtgtgtgtgtgtgtatgtttaaaaggaatacgaaggtaaggaaagatgactaatgtatttaagcatttgctgagggccaaatattttcatgtatgtcgcagcttagtggtgaacaccatagtcttgtagtcagataaaattgctcgtgtgactttcccatgtatcaccaaagtgctctaaacctgtttttgcatctgtaaaatgagaatcactgtagctaattcatagggctgttaggagcattaagcaagataagcatatgaagcactgacctcagtatacaacatgcagtatggtaagtgcccggtcaataatggctgccttattattatatttattaatcttcccaatgatctccacagtggtaaggaaactgaaggccctaggcacagaagggtggcatggattctgaactgagtcccatctggaagcaaaggcactctgcagacactaaccagacagcttgtgtgaaatgaaatcaactttatgtgcatttcattcgttacttaaagcacttgactaagtgaaattttaaaaagaaaaaaacctgcaaaattataatttgtgtgcctttcaagttcaggtattttatcatctcgataaatcttccatacatctatgttaaaccactttgagctgtcaaagctcttaaataaagtggctcgtcctcaccagtgtctgtctttgctcgtttatcatggttccccagtaaagatggacagatcccattttgcggggcaggcctcaggatggcagctcctgccccattggtttagctgtgcagttctgcatgatggtatttaacaaaccacagtggactcatgattccttcatcattgtgtctcccacatacacatagacccatgtgccactctaggaattaggaatagaaaggcaat

SEQ ID NO: 32804 - DNA, 1021 bp, Homo sapiens
tgtgcgtcctgcagctctttgtagttagctttgagatgctgagccatttcactccacagtgtagcaaaacaattccacttgcagaaggtttgacaatgttatgcatttgcaataggaaatcacacctccaggagttcgtgccctcagtgaatacatgcttccagagttaaacgtagtgagccctttctaagtcttgcttttaccgtaataaaaattcaaaaattgagaaagtgatatccattaccttactttcatcatgttagaggaaaagcctctattaaggccattttgctttaagccacaggtgaaccccagaatttgcctcagttcacctagttaatcaacacaggggcaccaattgctatgtgtctgctctgtgccggtgagctttatcatcctcatcctttttcaaaggagaacactgaagttcagaaagaggaggcaatcgccaacagccatttgttgagtgctggggccagggtctgacccggctctgtgaggtgccccgggcagagttctctcctcctatgatcctgtggggaagtaaccccagagagttggcctgccttttgcttccaaggatgtctttgactctggtccctcacacaccaatcaagtctgagtttggggacctgccaccatgtccacaaccgacattaactcagaatcctttccatgcacagaatccaccttgggtcaccttccctgctcagagactccctagagccaaactagtcccaaacccagggattcatggtggacttcagcccaggacacaggctataggcatcacacagtcccttcccaactatccctgcgagactccactgcagcttctcctatggcccactctggagtcagagattgtcccaggctggccatgaataggcctttcaagcccagagaagctgagcttcccttttctgcagtcacacccctgtctgagatacagaacattacccctacctagagaacaggctagtgctatagcagataagccaaccctatcactgaatggaag

SEQ ID NO: 32805 - DNA, 1032 bp, Homo sapiens
gtaacagagttagggctaaagtttgtgggtttctatcatctgtcagaggaatgttgttttaattgggaaagtgttttatttgagatgtcattcccctgacagagcagaatgactcatggctctctaaatggtagcaatttctagcactatagctggatttaggcccccattctgttacttaaactatagaatacaaaactattcagacctctccagcaccaccaaaaaccctttactttgtttcctgatgcaggtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacaggtatgttaactgatgctttcatgtgttgtccctgattaaatgttgaatccaaacttgttaaaacctttcttatagaaaattgcaaaattttagaacatctgtgcttgtgtcgacaaactgaaacctttaacactttaggaccattttttcaaaaattagattaaatagtttgtttcataacattatgaacttacatctatacaccacacattatatactattacatctaaattggctcactcagcactgaatttggctcttcagagagatcttgtaattcccagtacctagcttagagcctagttagagtaagctagtaaaagctcaatgagggagttttaaaaaatcttctcttagtgccctgtggatacttcaagggaaactttgggcaatttacaaaagaaagtaggtacatcctggccgggcgctgcagctcacacctgtaatcccagcactttgggaagccaagacgggtggatcacctgaggtcgggagttcgagaccagcctggccaacatggtgaaaccctgtctctactaaaaaaatacaaaaaattagccgggcgtgatggcacatatctgtaatcccagctactcaggaggctgaggcagg

SEQ ID NO: 32806 - DNA, 1050 bp, Homo sapiens
tggagtgcagtggcgctatcttggctgtctgcaacctccacctcctcggttcaagattctcatgcctcagcctcccaagtagctgggattacaggtgtgtaccaccatgcccggctaatttttgtatttttagtagagacagggtttcgccatgttggccaggctggtttcgaactcctgacctcaggtgatctgccctgcttggcttcccaaaatgctgggattacaggcatgagccaccgtgcccggccacattttgttttaagaaaatcagttgcacaattacaaggtagggaaactttatttgataataccagttcagtcatgttaaaagcaaaataaacaaaggacctgctgtttaaattgatttcaaactcaggatgagttatgatcttggttggaaaaataataagggttgtaattaaactgtattgcaggaagtttggcatccagattaggaaaggtaatactttcaatctttgctgatcaaacagtttttatcatttgtgcacctgttttgtgccaaggactaaactagatgctgggatacaaagctgagagacgtagcccatttataatagaattgcaagtcagtaataacaggttttatgagaagccagaagaggaatatccagaatttagaccacaggggatgggacagcttttaacaagaaggagatgcatagagcagaggctttggaggtggagctgtcggcttcactactatgggaccttgtatttaatctcaatctcaatttcttaatgtacaaaatagggtcactaataatctatttcacactgttgtctgtcctaagcatcgatgaggaaaaaatatacacacatacatacacacacataaaatgtatatatatgtgtatacttttttcctcattgatgcttaggacaacagtgtgtatgtgtgcatatatatgtgtgtgtatatatatatacactttatatgcgtatgtatatatgtacatacgtatatgtatgtatatgtaggaaacctctgaaacactctggggacataataattgctcagaaaatggt

SEQ ID NO: 32807 - DNA, 1032 bp, Homo sapiens
tttatttatttatttatttttaagatggagtctcgctctgtcacccaggctggagtgcaagtggtgcgatcttagctcatggcaacctccgcctcccgggttcaagtgattctcctgcctcagcctcctaagtagctgggattacaaatgcgtgccaccatacctggctaatttttgtatttttagtagagacggggtttcaccatgttgatcaggctggtctcaaactcctggcctcgtgatcctcctgcctcggcctcccaaagtgctgggattacaagcgtgagccaccgcgcctggcaacagtagcttttaaaattataaaacaagtgcatgcatcttcataaaatgtttttttaaataataaaatgtataaaacaaatgcttcctccatgctactcatcagtgctaaccactattaaatttgtagtttctcttggcagactttttatgaatatataaaaatatatgaaaaatatatgtatatgtagtttttcaggtaaatgtaatcgtgttctcttataataggacatttttccatggcaatacgtgcttgtatttttagggactatataatattccatcatacacatgtaccaaaagatgtttaaacacttaaattgtttgtaggtctttgcttttctccacaatgctccaatcccaggacatgtagaattgttcttatctgcctagtttattagagtatatttccaccagaggaattgctagtcagagggtatgcccattgtcaatcatgatgtcacagaagccagacattagcttgccacttaggcaacagagggtatttgttgaaatggaaaaaagctttaaaatgtgtagaattataggccgagcatggtggctcacgcctatgatcccagcactttgggaggccgaggcaggcaggtcatgaagtcaggagatcgagaccgtcctggctaacacagtgaaaccccgtctctactaaaaatacaaaaaattagccgggtgtggtggtgggcacctgtagtcccagctacttgggaggctgag

SEQ ID NO: 32808 - DNA, 1050 bp, Homo sapiens
tttactaaaacttaccatctggccaggtgtggtggctcatgcctgtaatcccagcacttagggatgccaaggcacatggatcgcttgaggtcaggagttcaagaccagcctggccaacatggcaaaaccccatctctactaaaaatacaaaaaaattagccaggtgtgctggtgggcacctgtagtcccagctactcgggaggctgaggcaggagaattgcttgaacccaggaggtggaggttgcagtgagctgagatcgcaccactgcactctagcctgggtgacagagtgagactgtcttaaaaaaaaaaaaaaaatgttgctgggcgtggtggttcacgcctgtaatcccagcactttgggaggccaagtgggtggatcacgagatcaggagtttgagaccagcctggccaacatagtgaaaccccatctctacaaaaattagctaggtgtggtggcaggcccctgtaattccagctactcgggaggctgaggcaggagaattgctcgaacccaggagatggaggttgcaatgagctgagatcgcaccactatactccagcctgggtgacagagcaagactccatctctaaggaaaaaataaagaagttgaaaacatcatccaacatgtaatcaatataaacattattagtcagatattttatagtttttttgtgctaagttttcaaaatctgatgcatattttatacctagagcacatctcagtttagatgctacattttcagcaattgaagtgaaatatagccctaccaaaatgataaagttgtgtttaatgggaaaatacttcatttactttagttttaaaatatgttaattaaaattaaattaatttaaaatctaggtctaaccacatttcaagtgctcagtagccacctgtgtctagtgagtgctgtattagagagcatggaaatagagttgtggggtagggtgggcagcagcatggagctgcgtcaggaacctattgcagtaattgaagccaagatgttggccgggaccagagtgttagcagaggagtaggtgagaagtgg

SEQ ID NO: 32809 - DNA, 1050 bp, Homo sapiens
taccagatggtttttcttcagtgtttctgttccactgttggctttcctcagtcccatcatgcctccatcacagagggggagtctctattcatatccttgccccttcactagtggttgactgatgctgcttgttactcagtgctaggcttatggtggtgtcataggtggttttctattgtcctggttcagccttagctttaggcagtccctgttcatttgaaccccaggggtggtacttaatctgccctttcctgagcagtagcaaacctctgcttggcatcagaatcctgggccaatgaggattctctcctgctctcccagaaacaagatgtttgcttctacctctcccccagcagcaatagggtatgtgagaggtgggaggtttacttgaacccaggaggtcgaggctgcagtgagccatgatagtggcaccacactccagcctgggtgacagagcaagaccctgtctcaaaacaacaacaacaacccaaaaaactgtcaaggtcatcaggaacaaaacatagccaatagccaagaaactgtcacataccagaggagactaaggaaacatgatgactaaatgcaatacaaataaaaaaataaatattggcactgtaagaaaaaatagggcagcagaatgggtaattcacaggagaagaaatgcaaatggctaataaaaatatgagtatgaattcaacttcactagtaattaaactcaaatgtaaatgacaaaaactgatttttgccagtgacattagcaaaggattgtttttgttaatactagcatttggcaaggttgtagagaatatgggaactcagaataatacagcctctctggaggataatttgcgcagtatcatatcaaaaggcttaaaattgtacaaattatttgacttagccatgtctgtgccgttgatttatcttaataaagtaaaggaagatctgtgggaagatttagtcaaagggtgcctatcacggcattgttaataataatgaaaaattgaaagtagcatgataattaacagtatattgtgatattcttgtatggtg

SEQ ID NO: 32810 - DNA, 1030 bp, Homo sapiens
tatttctttgactaatatatgtcttactggaagaatgcttatatcagaaatctggcccactggcttggtgcagtggctcacacctgtaatcccagcactttgggaggccgaggcagaaggatcacttgagcccaggagtttgagaccagcctgggtaacatagtgagactctgtctttacaaaaacttagccgggcatggtgatgtgtacctgtagtcccagctattcaggaggccagtgtaggaggattgcttgagcctggaaggttgaggctgcagtgagccataatcatgccactgtactccagcctgggtgacagaatgagaccttgtctcaaaagaaaaaaaagtattctgacccaccagtacaagaacttacacaggaaccagcagtatctttcaatatgtctctttgaacaatatcttgtggtatatagagatacatgctgaaatgtctacggatgaaattatatgatgtctggaattggcttcaaaataatccactaggagaaggagggtaaagtgggtggtattatagataaaacaatattgtcttaagttgattatttgtttaagttaggtaatatttctgtggggtttcattattcctttcctttctcttttgtgtgtatttgaaatttttcattataaactgtaggaaaaagatctattacaatacaaatagctatgagagaaacatcagcttccttaaagggtttatgtctaaggtgggagacgtactctagagcagaggtccccaattcccaggctgtgagctcatggcctgttaggaaccaggctgcatagcagaaggtgagcggccagcaagtgagcattagattctcataggagggcgaaccctattgtgaactgcacatgggagggatctgggttgtgcagtcctttagagaatttaatgcctgattatctgaggtggaacagtttcatcctgaaaccatccatctctctccacccccatccatggaaaaattgtcttccacgaaactggtccctggtaccaaaaaaggttg

SEQ ID NO: 32811 - DNA, 1076 bp, Homo sapiens
ggagatagtagcattcttgcaaattggcaccaagttacttctcaacagctgcaaattgctatctccagaaggtttcccaccctgccctcctcttttggatattgtaataaatttgttttggtacttgctggagggttacttggcctttttgagcaaatcactgttttctttggcttattttttttttttttttttggttactcagggaaatgtatgtgctcagatattgtctgaaagtagcttgctaccttccatgagatggttcctgaagaaacattagattttagatgttttggagaagttattcaagtttttccctctacttgaggtgatcatttctgaatatacctcctttcaagttgtatgtcactctttatttatttatttgtcactgtttattaatgagtttgtttccagttatggtaaagaattgtgccttaaagagtacaacatataggggaattatttgtaaattgctttactgttccaatgttatatgtattaaagtctaattgctttactgttcctatattattatgtaggaatctttgactgggaattaaacaaaaagggaatttgttataaagatgcagggatatctcaaggaatttaagagtgggaattttatgggccctcagaaagatccaggcccagaaactagaaatccagcaggaattgaagcagtatttggttttcatttctcatctctctcagcttgttactgtgtacctgcttcatttctccctctgtctgtctgtccaaatcatctttctcagttccccagccaggatggtggaacatggccccactcagcatttccatctatatgttaggggaccagcctgttcagagagaggtgtgaagaaagggaaggaggcaggccaggcatggtggctcacgcctgtaatcccagcactttgggaggccaaggtgggcagatcacctgaggtcaggagttcgagaccagcctggccaacatggtgaaaccccgtctctactaaaaatacaaaaagtagccaggcgcggtgacagacgcctgtaattccagctactcgggaggctgaggcaggagaatc

SEQ ID NO: 32812 - DNA, 1081 bp, Homo sapiens
agttgctcaagcctgttatcccagcactttgggaggcctagggaggtggatcatttgaggtcaggagttcaagaccagcctggtcaatgtggcaaaaccccatctctaataaaaatacaaaaattgctgggcgcgatggctcacgcctctaatcccagcactttgggaggctgaggcaggtggatcgcgaggtcaggagatcgagaccatcctggctaacatggtgaaaccccgtctctactaaaaatacaaaaaatcagccgggtgcagtggcacgcgcctgtagtcccagctactcgggaggctgaggcaggagaatcacttgaacccaggaggtggaggttgcagtgagctgagatcatgccgctgtactccagcctgggcgtcggtcagagtgagactccgtctcaaaacaacaacaacaaaaattagcagggctgtagtggtgcgcgcctgtaatttcagctactcagcaggctgagacaggagaattgcttgagcttgggaggtgaaagttggttgcagtgagccgagatcgcgccactgcactccagtctgagcgacggagagaccctgtctccaaaaaaaaaaaaactttatataaacgtaatcatactgaatgtgttagtttttaaattctgttacatttataaggtttatccatgttgttgcatgttactgcaattaattaattttaatagctatttaactatagctatttaactatactctgcccagatctcttcatattagaatacccattctccacctgcttaggctcacagctgcatcccttattgggaattgcccttggccctgaatactgtcttgcccaaggttatgcttcctcccagaggtgtccctgtggccagtaactgtgtgttgcttggatataagatccaacctaacttgtctctatttgggacaactccaaagggctctggagctccatgttgtatcagctgaggccccatttgcaatatcattggttcaatttcttccctaagtccaatcctgctgccttcacttgttataggtatatctccccagagcacttcccaggaaactttctgcatgatag

SEQ ID NO: 32813 - DNA, 1050 bp, Homo sapiens
gagttactgctatttggtgttggcatatagtccttttttatctcataaatgtgtctttttcaattttaacaataaaaattaattagataataaaatcatgttaattattttaaccagtagttttgagacccaaagacccatactattgacttgatctaatgctgtttttactaaatcttcttttccttaataggtagaaaatctttatcctcaaattggctgggtagaaattgatcctgatgttctttggattcaatttgttgccgtaataaaagaagcagtcaaaggtaattggatttataaaaataacaataatctttatggttttttttttgtaatagttttcctcaggcttctgtagttgtggttttcctaagttatacatatatatagtattttattgggattacagtttcccagtatttttcaacggaaatttgtaattcacagtgagctcctttgtcagggaaaggtaacatctgctgtgtcctctggtttgtctcttttcgactgtaatataaatgctcgccatttcctcattccaggttatagctagtgctgttttgatttcctgtttggcacaaaataccagaggattataaacagaagttacagtgtatagcttctactctcatgggtttacaactgagttatttctattgtaaaatgagtttttatttgtttttttctggccatttgacataaagtgctttcctggccaaagctatggtctaagtcttagttctttaagaatgttagaaacattcttaaacattgacaacatctcaaaacattgaaatggccaccttgcttgagaacatggcaaagattacttgtaaattctgaaagatcttttacttcatttttctggctgaactgcttcttctcatctttttggtttgaaatatttcagtctatgcaaaagttgcaagaatagtacaataaactcttgtatatctttctcatagattcaaacatattttgtaatatttaccattttctgcaaactgtttttttctttctgaaccataggaaaggagtattttctcc

SEQ ID NO: 32814 - DNA, 1076 bp, Homo sapiens
aatttaatttagttctgatctgatcttaattatttcccttctcctactgggtttgggtttggtttgttcttgtttctctagttccttgaagtgtgaccttagatggtctgtttgtgctctttcagactttttgatgtaggcatttagggctatgaactttcctcttagcaccgcctttgctgtatcccagaggttttgataagtcatgtcactattgtcgttcagtttgaagaatttttaaatttccatcttgatttcatttttgacccaatgcttattcaggagcaggttttttaatttccatgtatttgcatggttttgaagcttccttttggagtttatttccagttttattccactgtagtctgagagagtgcttgatataattcaattttcttaaatttattgaggcttgttttgtggcctatcatatggtctatcttggataaatttctatgcactgatgaatagaatgaatattctgcatttgttgggtagaaggttctgtaaatatctgttaagtccatttattccagggtataatttaaatccattgtttctttgttgactttcctgtcttgataacctgtctagtgctgtcagtggagtattgaggtcccccactgttactgtgtttctgtctgtctcatttcttagatctagtagtaattgttttataagtttgggagctccagtgttaagtgcatatatatttaggattgtgatattttcctgttggacaaggccttttatcattatataatgtcccgctttgtcttttttaattgctgttgctttaaagtttgttttgtctgatataagagtagctactcctgcttgcttttggtgtccatttgcatggaatgtctttttccacccctttaccttaagtttatgtaagtccttgagtgttaggtgagttttttgaaggcagcagatggttggtgaattcttatccattctgcaattctgcatcttttaagtggagcatttaggccatttgcattcaatgttagtattgagatgtgaggtaccattccatttattgtgctgtttgttgcctatataccttggtt

SEQ ID NO: 32815 - DNA, 1020 bp, Homo sapiens
acttcaatctatttaagcctttgtctcctaactgaaacattatttctaaatatttctattcaataagttttttcttttttgagcaacttaagtgaattttgaagattgctccttccagtctcgttccttttcacattttcctgcattacctaataattacctcagcgttagaatttgaatgtattaattgatttaaacatcatgtagactaaagtcttaaacatctaagactcagttgtagttgcagaaaaaaattaaagtcacctctactgaaccttggtttcaatttaagatttttcttgcttttcaaaggggtaactaataaagattgaagggtttttttcccgattggtggaggaatgaagaactattgatgcaagtttttttattgtttctttctatgatcaggtacctgctttcattttagactgctacttccaaactaagctagattcttggttttaatgagaggaggcagagagagggaggcagatggaagaagaaaaacagttaaataagacatacccagtcactgcatttttggactataccgtatctttctagcacaaggaaatagataaactgtaaggtcttttttactcactttttatttatgtgttctatttgtgttagtcataactgtttatagtggttgtctaatttttacttttattatatgagatagagctgtgcagatcttcactcaagttagttctgtcacgcttcttcccattatttagagcacagttttttaaagcaactgtacaatttctcagccttatgagcttgctgtatttcttggtatcatgttgcttccaaattttgtttttactgtagaagacaattaatttattgtagagaagtggctgtgaaagtcgttctctgtctttaaaaatcaattgcagaagttcatttgtcatttttctagagataaattatagtactcaaactggcagtgctcagtatatacattttgtaagctttgtcagtgaaaccatcagttttgcaggagcttccttt

SEQ ID NO: 32816 - DNA, 1009 bp, Homo sapiens
cagtgagccacgattatgccattgcactccagcctgggcaacagagcaagaccttgtctctgaaacatatatatatatatatatatatatatatatatatatatatatatatatatatatatatatatatataatattacaagtaaacctatatgtttattaatccattgtttattaaaaataactttcacctaatagacatctgtagaacatttcatccaacagctgtagaatatacattcttttcctcaacaaatggaacattctcaaggataaaccaaatgttaagccacaaaacaagtctcacaaaattcaaaagattaaaattcaatcaagtatattttctgaccataatgaaataaaaccagaaatcaataacaagaggaactttggaaactatacaaataaatggaaattaaacattatgtttctgaatggcccttgggtcaatgaagaaattaagagaaaattttaaattttcctgaagcaaatgaaaatggaaacacaacataccaaaacctgtaggatacggcaaaagtagtactaggagggaagattatagcaataaatccctgcatccaaaaagtacagacacttcaaataaacaacctaacagtgtgtcttgaagaattagttccagcagtcacactactgggtatctatctaaaggaaaagaaattgtataaaaaagatacctgatttgtatgtatattgcagcactagtcacaatagccaagatgtagaatcaacctaagggtccatcaacagatgattggataaagaaaatgtggtgtatatatacacaatggaatattgttcagacattttaaaaaagaatgaaaccatgtcttttgcagcaacatggatggaactgaggccattatcttaagcaaacaactcagaacagataccacatgttctcatttataagtgggagctaaataatgtgtacatagggatatagagtgtgaaataatagagacttggaagggtgggggatgggcaggga

SEQ ID NO: 32817 - DNA, 1033 bp, Homo sapiens
ttaaagacacagttcatctttttgtagaacaaaaaagtttaattgacttttgacagtcaattctaaaatatactcttgtttttttttttttttttaattttggagacagagtctcactctgtcaccgaggctggagtgaagtggcatgatctcggctcactgcaacctccacctcccagattcaagcgattcttctgcctcagcctcccatgtagctgggattacaggtacctgccacctcgcccagccaatttttatattttttagtagagacggagttttgccttgttggccaggctggtcttgaacttctgacctcaggtgatccacctgcctcagcctcccaaagtgctgggattacagacatgagccaccgtgcctggcctaaaatgtacttttcttactcatacactcattgagttactaaaaatttttgaactccctcaatctctcctatttcttacgtctcgctttcttttaaggagtagacttttatagtagagttgcgttgttttatctatagaaaatgaattgattattttgcctttttcaactttttatttcatgtttcacaaatttgccctttgtattaaaatgctgttgctttgccaacacagcattctcttgttcgaactaattgcagaataagttaagaactgggctctggagctgtctcccctaacaccctgagtttgaatcggtttttcaatattaataaccttaggcaagatacttaacctttccttccatacctctgtttcctcattggtaaaattagaataaaatagtacctgcctcagagtgtcctcaaaaagataaactgagttaatattgcgtaaactacttctaataatgcctagctattattaatgcctaataatgcttagatgtttttattaattattatttaaattatcctatcacatactgaagagctgtgattatagtctagaaaatcaccactagatgactctttttctctttaggaaaaaatataaggctcagagccaagagtttaatttttgaaaggtca

SEQ ID NO: 32818 - DNA, 1040 bp, Homo sapiens
tgctggtctcgaactcctgacctcgtgatctgcccaccttggcctcccttaagtcctgggattacaggcgtgagccaccgtgcccggccaagattctgttgagcttcttactctccttgctgtactggttctatttaggttcaaacttaatgactcttgctccaggaggggcaactgtccttgttttctctagtgtagtccttctcgctgcttagctcttcctcactggaacttggcagcagtcagtctgcattccactggtttttgtgtgtgtgtgtgtgtctttttttttccccccctaagaaaacgggctctgcaactttttgggaacctgtacacacaaaacttacctgtcagtaatccctggctcccccaccacaattcagtacttaaacttcaccagtcttccagccatatgcagctaactttagagacactgtgcaggaatagcccagacacaggaagttggtagaggccataagttggatgaaagaaaggaaatggggataagggagtaggaagaactaaagagagtcattggcagtagacaggaaatcagagaatagaggagagaaaggattgagatcacaagggaggaaaaacagatgggcaggatatgaaggatgttataacatggaagaactatagaaaagcaaatgggtgcatggaagagaaatgacatctcattttgaaatgtatcttgccattcattttatgttgatttacaatttacagggccaggaaaattctctgtgttggactgctttagacaaaaatgaaggcgaaatgataacttctaagggtaagtatgaagtatgtgttttgatatgttactactttgacaggataattgttataccttttatttattattactaattttgggtggaacagatttctgtgatagcatataagcatcaacttggatatgcatttatcaaatcattaggtggaaaaacaggctattcataattgtcagtcactatctttctgacttttttccccagataatttagaagatgagactgaagatgatgacc

SEQ ID NO: 32819 - DNA, 1052 bp, Homo sapiens
agcatttctaatggagggtcctgccttgcggctcttttggcttcaatatcctcttggcggttcctttctatttcccgttcctttctgatgaccccggcagtgtaagactgccacctctttaggtttctgtacagccaataataatttcctaatggcttcctgatgtttgataggtgttccctccaaagttaggaattccctttctctccatattgctgcatgggcatggaggactaggtaagcatatttagagtctgtatatatatttaccctttttccttctcctaattctagtgcccaagtgagggctattagttttgccagctgagcactagttcctggaatgaggggattattttcaagtattccattatcactgaccactgcataccctgcttttcaaagtcctttttctatgaaggactttttgtatacgaattcattgtatgtatatgaatacgaatgaattgtatacgaattgtatgcgaattcagtatacaaattgaggtcaggatccgtcaagggaacctctgaaaggtcccctcgagcggcttaggtttgagcaattacttgttgacagttatgttctatcttttcttcattgtctggaagaaatgtggctgggttaagagttgcacaagtgcacagtcgcaacactggcccttcaagtaatagagcctgatatttaagtaaatggttgtctgagagccacaagtctcctttagcagtgagtataccattcacatcatgaggtgtccacacagtaagatctcttccctgtattattttaactgcttcagatactaagactgcaactgcagccactacctataaacaatgaagccaaccctttgccactacatcagttttcttactcaggtatgccacggttgcaagctcgtccctcggacctgtgtaaggactcctagagctattcctgtttttttgtgatatataaagaaaagtcttgccctattggcaagcttaacactggggcttgggttagggccttctttagggcctggaaagccacttctgcttcaggtgtccat

SEQ ID NO: 32820 - DNA, 1025 bp, Homo sapiens
tctataacttaaagtataattaaaaacatatatatataaaacataacatgtatataagttgtaaagcataataatagaatgaacatccattaatctagtctaacctttatgtcacccctctatccctggaggcaaccactattcccaattttgtgtttttcattcctttgttttttaaaataaaagaggctttttaaaaaaaaacaaactttttttaaaaaaaaaatatgtatagaaggaatgtacctcaacacagtaaagaccatgtatgataaccccaaagataacatcatactcagtggtgaaaagttcaaagcttttcctctaagattaagacaaagatgcccactcttgccacttatattcaatatagtaccaggaatcctagccatagcaattcgagaagagagataaataaaaggcatccaaattggaaaagaagtcatcaatttttttctatttgcagacgacatgattttatatactgaaaccctaagactccaataaaagactattagaacaaataaatgaattcaataaagttgcaggatataaaggcaacatacaaaagtaagtagcatttctatacactaataacagagtacttgcagataaattaagaagacaatctcatttacagtagctacaaaaataaaatataatacttgggaataaatacaaggcaaaagacctatacaatgaaaactataaaacattgatgaaaagaaattgaagaagacatgaacaaatggaaagatatcctgtttatgtattggaagaattaatattattaaaatgttcatagtgcccaaagtgatctacagattcaatgtagtttctatcagaattccaatagcttattctttctttccttttttttttgttttgttttgtttaaaaattctggctgggcacagtggctcacacccataatcccagcactttgggaaactgaggcaggtggatcacttgaggtcaggagtttgagaccagcctggccaacatagtgaaacctagtctctact

SEQ ID NO: 32821 - DNA, 1028 bp, Homo sapiens
ataaaaataaccaggaaatttttttgacttttcagtgagtatataagtatatggattatcacaaaataaatatactcatgaaactgccaccacatcaagaaatagaatattatttgagctctataaccccactacccttcatcccagtaatcactattctcaccctctgtctcaaagttaactacatcctagcctgaaaatttttcagcaaaaccaatttataacttctttactaggtattaaactttatatagatggtgttgtaagagatatacctctcaataatccatgggtcaatgaaaactttcaatggaaattgaaaagtactttgaactgaatgataataaaaatggcatatcatatcctgtgcagctaaagccattcttaaaagggatttaaatttttatttgcatatattcgaagaaaataaaggttcaaaattaacgagttaagtatctatcccaaagagttagaaaaggaactaaaaaagtagggagagaaataaaaaagtagaagaaaggaaataataaagcaaagagcaggtggctagaatttgtgggacagattaactgagagaaaaaagttaaacagagtagttcctatctgcataggaattgtgttcgctgaataccagcctgcacatgaataattcagaattctatgaggccaagctaggaataactgctggggaaagaataaacatgcagaggctataagaacaatttccagagctcacacgggattgagattcattcagattacaggattgagagttattcagtccaccagccagattaagaggcctcattgcataatatggagcattcagtaaagaccttaaaagggccacaccttagaagtaggactaaattagtcctaggctaaaaactactctatatccatactagaagggcagtaaaacaagctttaagatgattacactgatcttcaagtaaccttactgcctgccagatcaaagcctaacactctttaaagcaagacaacaaaatctaaaacttgacaatgta

SEQ ID NO: 32822 - DNA, 1058 bp, Homo sapiens
tgatttttgatatagttttttaacattaaaagtgttttagtatctcctcatgtatatttttcactatgatttatgcttataatttgtctagatgagaagtgcagtctgctcattgggttaaattctacaactttaaatattcagataaatttattgaagttaaaaggattgatttttttaaaagttcaatggtcggtagtaaattgaaagaatatactttaagctgaatgtgagttgaattctttgataggtataagtaatacagaaatttaaagtttaaagctagtcagaaagcctttagtaggcccaattaaagattttcattactcccaatttctcctcatgaatatattttcaccctctgcttttaaaaaaatgtatttaatctcttaaaaaatttaaatgactttgttaggactgacgaaatatgcaagatgacatgcaaatacatgaagcattttatatgaaaaaaatccatacaactataaattatttctatttagaaactactttttggtaccctaggtacacatgcatattagatacttgactttggacaaataacttctttgaaccttagaaagtgcctagacttatactaacagtctttataaaagcccagaggtatgcatatttatttcctagataattttttatacttagaaatcttttaaacatcattttatgtcttatgactagcattattaaagaagtgattatttagcattattattattagccttattaaagaagaattattactgttattattattatttttgagacagagtctcactctgttgcccaggctggagtgcagtgatgcggtatcagctcactgcagcctctacctcctgggttcaagtgattctcctgcctcagtctcccaagtagctgggattacaggcgtgcaccgccatgcctggctactttttgtatttttagtagagatgaagtttcatcatattggccaggctggtctcctggccttaagtgatctgcctgtctgggcttcccaaagtgctgggattgcaggcatgagccatcacacctggcca

SEQ ID NO: 32823 - DNA, 1035 bp, Homo sapiens
gcctgtaatcccagcactttgggaggccgaggcgggcagatcacgaggtcagaagatcgagatcatcctggctaacacggtgaaaccctgtctctactaaaaatacaaaaaattagccaagcgtggtggttggcgcctgtagtcccagctactcgggaggctgaggcaggagaatggcgtgaacccgggaggcggagcttgcagtgagccgagatggcgccactgcactccagcctgggagacagagtgagactctgtctcacaaaaaaaaaaaatttttttgaatagttgatattacatagtatgttttattctaaatatgtttcatgttttaaccaaatttatattgcatatgaatatctctctactatattcataattatagaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactggtaaaacaaacttcttgtttcttggggttgggtttcctgtaatgaacttggatttactgtttactcattattcacttgactcatgtaaccttagaacacaaacttttcactgaagtagttaataaatttattttctattgagtcaaatgctaggtacggtgctaagcactgtatatatcttagttaatatttacaatagtcctgtaaggtaaaggctattatgcctattttaaaaattagaaactgacactcagagaaactgaggctcttttttgtctgaagccaaaactgactttcctggggacacatgattagaaagtaccagaacacatttgtgtacaactcaaaacccagtgtttggctgttgaagacagggtctcgctttgtctcccaggctggtgcacagtggcatgatcatggctcactacagccttgatctctatccggggctcaagtga

SEQ ID NO: 32824 - DNA, 1126 bp, Homo sapiens
gcagagttaccacaaccttcaatttgtgacaaatgcagtatctgcaacgtgcaataaaactgggtatgcctgtgttctaaactattatgtttccattgtgaagagaatgttttacactcttgttagtgaagtttattctttaaaagtcaatcgtcaaggatttagcaaatgaattagcacttcggatatacttgtttatttaatatcttttttgtttatttcaaagaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagaggtaagtaatttttcaggttact

SEQ ID NO: 32825 - DNA, 1128 bp, Homo sapiens
gaggctgaggcaggagaatcacttgaagctgcgaggcggaggttgcagtgagccgagatcacaccactgcgctccagcctgggcgacagagcgagactccgtctcaaaagaaaaaaaaaagaaaaagggccgggtgcggtggctcacgcctgtaatctcagcactttgggaggctgaggcgggcggattacctgaggtcaggagttcgagccagcctggccaacatggtgaaaccccgtctctactaaaaatacaaaaattagctgggtgtggtggcacacgcctgtaatcctagctacttgggaggctgaggcaggagaattgcttgagcccgggtggcggaggttgcagtgagccaagatcgtgccactaactgcacttcaccctggccgacagagcgagactctgtatcagaaaaagaaaaaaattcactctttttcttttaccactatttgagataataagtggggaaaatgtatgaacattttacagtgctatatagaaataaattgtgacatatatgaaatatatgctattatttataagtaactgtcttactacaccctaagttgttttgtcagaagtgatggactttgctaatcactcacacataacccactgtgaatcctctaggtagagttaatcattccctgctttgggtgtacatgatacttgcttttgattatttatttatttatttatttatttatttatttatttatttattgagactgagtctcgctctgtcgcccaggctggagtacagtggcgcgatctcgactcactgcaatctccgcctcccagattcaagcgattctcctgcctcagcctcctgagcagctgggactacaggcgcccgccaccacacccagctgatttttgtgttttcagcagagatggggtttcaccatgttagccgggatggtttagatctactgacctcatgatccgcctgccttagcctcccaaaatgctcgtattacaggcgtgagccaccatgcccggccgcttttgattatttaagtgcattcctctcctctccccagcaactattctgagttctttgaagcagaggatcttgttttacttgccttttgaatttattaaattatttgcgtctgtacccat

SEQ ID NO: 32826 - DNA, 1046 bp, Homo sapiens
tgccctcacttggcccccttacaaaattctgacacaagaagcaggggacacttagaatcagaaaactcaaaatatgtaagaaggagaagaaatgcattttcctcttaatcaatgacagctttattggatcaccttgagaaagaaaagcatccattcagattgtgattgcttagaataaagctataccatctcagtacagaactcaatcccttatgacagtaagaatacagtaactgcttttgataactacagaaaagatcaccttgaggaaagtctggacactgtaagcttacaggtaaatcaggttttccaatagtgaccatgtatgatatcattttaattttaaaacatgtagtcaaagtagctttaatttaacctaagttttaaataaatgtaatcgagttcaatatcaaggtaagcaattctgaatgagaacaccacaaacttcatgacttgcttaaattttaaatttaaaaagaaatttttaagagacagagtttcactctgtttcccaggctggagtatggtggtacaatcatgactcactgtagccttaacctcctaggcttcagcagtcctccccactcaagcctcatgagaaactaggcacatcccaccatgcctggctaatttttatttatttttttgtagacaaggtcttgctatgttgcccaggctggtcttgaactcctggcctcaagctatcctcccgccttagcctcccaaagtgctgcaattagaagtgtgttccaccatgcccggcctgacttgtttaatagcatggtattggttcttaatacaagaagaagtaaaagtagaacagtggataccactgaggaaaacactggcttgaagacactaatgaaatattcatgtgaaaggcaaatattaaaaacagtaaatttattttagactgagagattataaggtttatgtatttgtaaaagtaataatgctttctcaaacatttactttttaaaaagtacttggcggtttaacttgagaaatatgaaaacttgtgaaatgaaaagagaaaggtaattaaa

SEQ ID NO: 32827 - DNA, 1035 bp, Homo sapiens
ccctggtgaagatgaggccacggggactgcgggatcagacatgggagggtggacccatagaaacgatcgcgggaacacagccagggagggctgagaaccgggaccagctttgtgagtgaagggcaaggagacagatgacagttaagatgaggaggggaaggagagagccagtgacttgcaggccagacagcaggccccaccaaagcaggagaagggcatgttggacacccaccccacttccagactgaccttcggaggctgagaagcagccggttcccaatgggcccgggaaagggcgctcaccatcagacacaccacaactttttgactcagttaactgagtaaatttaattccataaatttacagctgaagtgaggttcccaacttctggaacaatggtatgtctctcccttccaaacatcttctgagctctttctctcccttttttaaaaatgcatatttaagctattatatgtattttaacattaaattacatatgttttaatattgccatctgcttcagattctttctggagttaactagggggtacagattaagagtatataaataggctgggcgcggtggcttacacctgtaatcccagcactttcagaggccgagacaggcaaatcacctgaggtcaggagtttgagaccagcctggccaacatggcgaaatgaaatctctactaaaaatacaaaaattggccaggcatctgtagtcccagctactcaggaggctgaggcaggagaattgcttgaacccgggaggtggagcttgcagtgagccaagatcacaccattgtactccagcctgggcgacagagcgagagactccatgtcaaaaataaataaatagataaataataaattaacagaggagttggtggggcctgttggaagagcaatattacaactgtggatattcacccaacaagggcaattctgttaccgtggttctgtttagttcttcctagcatattgtcacacagaaacaaataattagcaagtatttctgaaacattcttaagatg

SEQ ID NO: 32828 - DNA, 1048 bp, Homo sapiens
tacacatatatacagacataaacagtgatcataattccaaaacttggttttatttttaagaagaaatatatggccatttatttaataatggaagattttataagtctgttgaatgttttataaagtaattttaaaaattgtgtttctgaaacatttaaaccattatgtaattcttgaaattatattgatcattttctctgtgacatttgtaaatatatttgaccaaataattccaacttaattatacttgcagattacagttaagcatctcttttccattgttcttccctttgatcatttaaatgttaagtttgatttttatttgattttaatgtgatttttggcttctgtcaattgagttcttaatcactgtgtttgaaatcactggcagtttctcaaaggagaaaaatataatgggaaaattaagtcctaaatagtttctatgcaagggaattattgtattgaaggaatttcattggaattttcttctattaaagaattaccttaccatcatttgttaccacagttcttttcctttatcttcttctttactttttttaatcttctctgcaaaagtttttgtgactaatttcttttttttttttttttgagacggagtcttgctctgtcacctaggctggagtgcagtggtgcgatttcggctcactgcaacttccacctcccgggttcggtccattctcctgcctcagcctcctgagtagttgggactacaggaacccgccaccatgcctggctaattttttgtatttttagtggagatggggtttcaccgtgttggccagaatggtctcgatctcctgacctcatgatctgcctgcctcggcctcccaaagtgctgggattacaggcgtgagccaccacgcccagcctttgtgactaatttctaagtagaaaaagttcgccaatttttttaataacctggaaagcattttattagtaagtggtaagaagtcactggacccaaagaggaaatattttaatacaatttaaagccatcttaagtatgaataagcattattcacctatc

SEQ ID NO: 32829 - DNA, 1056 bp, Homo sapiens
ccttagagcaaaaagagaactccaaaaggattgcactgggtgtcttatggctaggcctggaggtaatgggtgcatcactttcatctacattccattgaccaggacccagactcatggccccaacttaactgcaagagaggctgggaaatgtcgactccatgtgtgacctgagaagaaacaaggtttgggagcatctcctcagcctctgccacagtcaggtcatggaaaaacacagcaaggtggaagtctggtgacctgagttctgccattgtctttctgggtggccttaggcaagtcatcataaccgctgtcagccatttcttcctccccgtaaggatcttaataatacttgccctgtacttgtgagtttacatttttatataaaagtatgtgctagtaataggagtcatggcctgcactattattttaagattataaggatcgcagtcatttattcaatgaatattttctgagtactcatagtagccaaagcattggacaaactgtagacccacagaccaactgttctctgtagcttacattctgatagtgagacagatgataaataatctgtgaagaaataagagggctgtgtgatctaagtgaccaggggtgctcaggataggcttctctgaaacagtgactcttgagctgacctagatgatgaggtggagtgagacccgtgtatatcagggagaaggctgtgccaggcagaggaccaggctgtgcaaaggcccttaggtgggaaccagctcggagggctccttgaacagaaaagtggcatgacagccaagttgttgcttgaaggagaaagatgagagataaggggatatatcatgcagtgtcttaacctctctgtgcctcagtttcttcatctgtaaactataaagttgggccaataataatatcaacttcatagggttgctgtaagggattaaatgaaatgatacgtatatagtgcatagaaaaatacctggcacctgatgttcactaagtgtgtgaactataattaaggtgaagattttattctaagtgcagtgggaaagttttgggtgg

SEQ ID NO: 32830 - DNA, 1028 bp, Homo sapiens
ctctatcatatcaatgcaagaatgggaaatgtctgattttaacttttgctttaagaaaggtgaatcctagttgttaccaccaaacttccagtccttcgtgttggactttctgatgcgaaagtacagcctgcagattggaaatttagatgtgtccttacattatagtactttaaaatttttatagcaatttcttagacagctgcattgttccaacacactgtattggctatttaaatgtaaattaagttaaacatttagtttcttagtcatactagccacattcaagtgctcaatagccacatgtggatagtggctgccttactggacaatatgtaatatagtatttctgtcatcacaatttttcttgtggacagtgctgtgctattaatagaaaaattttatgcttaattttactcacgtaaaatgttgaggacagaggtgctctgtgctgcttagttgtacttctgctttgcaaatagggaagctgctactggttctttgtagttgttggagctgtaactggaactcaagactcttgactcagctttatcaccaagagttgatggccttaacaggtcttaggttttttacttttactgtatgtgttctcaaaaatgtatgcttagagactaaattagagaatttgggtgttaagaaatagttgaatattttgtaatccatgatggggttgagagtttcttagtttactgtaggagttgattctggggactataacctaaaaggcatctgcataaaatcccctaattctcaaatacggggacgtgggtatgagttaaatgtgatttgacagctaaggtatatataatcctttggaaagtagtgactggtcttctaagcaggcttggaagaacaatagggttggggtgaggcataagtcaccctaatttatttaagaaccagaaccaataactcccacctgtattaagccctgcagcaagaaatgaaactccaaaagttgacatcccaccacctggacccctctattacagtggttcttctgcagtttg

SEQ ID NO: 32831 - DNA, 1079 bp, Homo sapiens
cgggagtgctgctgaccttcgccatgagctgcacggcgcacgtgttcagctgcctgtcgctgcgtctgcgcgccgccttcttctacctggactacgcgtccatcagctactacggcttcggcagcacggtggcctactactactacctgttgccaggcctcagcttgctggatgccagagtcatgactccatacttgcagcagcgcctgggctggcacgtggactgcacgcgccttatcgccgcctaccgcgccctggtgctgcctgtggccttcgtgctggcggtggcttgcactgtggcctgctgcaagagccgtaccgactggtgtacctacccgttcgcgctgcgcaccttcgtcttcgtcatgccgctcagcatggcctgccccattatgctcgagagctggctcttcgacctgcgtggggagaaccccacactcttcgtgcacttctaccgccgctacttctggctggtggtggccgccttcttcaacgtgagcaagatccccgagcgcatccagccgggtcttttcgacattatcggccacagccaccagctcttccacatcttcaccttcctcagcatctacgaccaggtgtactacgtagaagagggcctgcgccagttcctccaggcgccgcctgccgcacccactttctcgggtactgtgggctacatgctgctgctggtggtctgcctggggctggtaatcaggaagttcctaaacagctccgaattctgcagtaaaaagtgagcctccgccttggaggagactactggttcgcccatctgtttggagtttctgttgttgctattgttggtttgttttcaaatttcattgtgttttcttctttgctcaaggaaggtgctgcaaaaccatagggaaaaagttcactgctacaaagggatcccaacccactggaggctttgaagtagggaggttggcaggggtggtcaagcgggagggagatagtcacttgttcttgcccctggaaaaaattcaggtgatgtctttgacatccagggatttctcaaaggcagtgagtaaaatcccaaataaagccccaaagagtttgct

SEQ ID NO: 32832 - DNA, 1029 bp, Homo sapiens
catcaaggcagttcctggacatattgcagtagctgaacagatggcaggcaagaaaagtgcttaaagagtcactggagcacaatttcaagtgatgtctcacatccgttgacagttggagagtgatagaggcaaacagatcatggggatatattactactcagaaaggaaggatttggctcaaagataacctaggaaaaagatatagtaggacttgttcagaaaagagcaatggatacagaggggtgactgcaccttagacattcaaaaggacaagcaatgaccttcaggacatatcctgggtcaggaatgtagcaagagtcactttgtcacatcttaagagaatcatgtttgtcacggggcactacattcaataccatattgacagtaagaatacatgatattagaaagggatgggtacagccaagcacttcctggctcagaagtatgactgaggacacataagaaggctgagcctgctggtgagaagatggtgagagcagctgtggagctggagaattgagagacacaggaaatgaagtgagggctgatagctaagcagaagcactatctccatccctttacaggccctacagaggcctaggaaggagcagtagagttcaaactcaaccttagttaggtgtgtatatggaattaggtgaactggttgggaacttagacttgggaatcagaggcctactcagcaacctttcttcctccctgctgctaacagaactcctacactgtttaggtattcacctgttacacacatggttctctcatttaatagtaaatccctattggtgagacctggtcccttgccagagagtgattgtgattaggcatgtactccagttctggccaatgagacttgggggatgtctcttgagggcttctgggaaaggttttctctctcctagaggagatagccctttagtctctggaggctcttgtgtctctgtgtagtggctggaacaagatgctgcagccatcttgagaccacaaaggcatcagtctgttgatctaatgaaa

SEQ ID NO: 32833 - DNA, 1037 bp, Homo sapiens
caaatagtgatgtatgtactcaggtggttaggtttcagacagactcacagtgctttggaagcagcaagaaattagcaagcaagtgcagttgtaagtcagtttaattaaggaaaaggtgttttaagtgggaaagtaatcataaaaggacatcgaagcatcatccttatgctttctgtagtcaaaataattagagaagggcagaaaatataaatatgtttaataaaagtttgaataatttcatagatcacatatttacagttatttaagggacatgagttgtttgtgggcatactatttagtttttaaaaatagtttttggccaggcacggtgtctcaaacctgtaatcccagcactttgggaggcctagacaggaaggtgacttgagcccaggtgttcaggccaggctgtgcaacgtagggaaatcccatttctactaaaatttttttttaaattatctgggcatggtggcacatggctgtggtcctagctactttggagactgaggtgaggagattgtttgagcccaggaggtcgaggctgcagtgagccatgagtgcaccattgcactctagcctgggtggcagagtgagagccccatctccaaaaacaacaacaaaaagagtttttaatagaaaaatataaatcacataaaatatgtaatgtgaaaatagatgtttttttttcatttattgaggacatttggggtctgtaaaataaggaaacaatttttgaagaacagtaatataaaccattggaaaatgttgagtgtctctgtgtggtacatttttcatcacagaaaattggccatgggatttaaaaaatgtattgtcttctccccagaatttttttatttgatgccaggcatggtggctcacgcctctaatctcagcactttgggaggctgaggcgggcagatcacctgaggtcaggagttcgagaccagtctgaccaacatggcgaaaccccatctctactaaaaatacaaaaattagtcgggcatggtgatgggtgcctgtaatcccaactacttgagagg

SEQ ID NO: 32834 - DNA, 1070 bp, Homo sapiens
tagctggaaaaagatccctgataacttttctatgtaccacccttagtttttggaaataggtaaaggaagaaaaagtgacagactgagaatgaataggcagagagatggaaaaaacagtagagagaagcaccaggaggggtagattcatacagctggatggtgaattttgcactgatttgttttgctaacttaaaacttgttggattacataaatttctattaaaaaagaaaacactgcattcgtattaatttaggcattatttttcttgatgacaaaaatctgaataaaaaaactagttccttttaataaaggacattaaatatcagtagataatagctttacttgtagtttatttagagatactttcaagggataaatacttttctcatctttttgaaagttataatttggcaattgttttctgacaggaacatttggttacatacagtagatgtatggttagatacagtaaatgatgtttttgccaattttctaactctctgggaacagaagtggagaatgttgaatcccattcccctgttacacacatttcttcacctggtgaactcatttgtcctcagttttagggcgaattcctcacaatttttttcataaacttccaatttaaaataactttctctgttaaaacctttcatcctcttcgtgttgttgaacttattcttagttttactgcagtttccattttaaattgtttgtggaattatttgccactgtctcccctcacaactgtattgtaagacccatgaagacagggattgatttttccaaaaatgtttattgagtgacttccttccaaaaatatttattgagtgcctactgtgtatcaactaggatttggggatctattaggtttacattctcttcaattccagcatttacttcgtttaccattatgtctccaacatgtagcacagtgcctgataaacagtgaatgtcagtatctgttgaaagaataaagatgaaagccctttgaggagtatttgcagggctcaaatgtggtgtggagtcaggggttaaatctgtagttgaggaacatgaacttctcctg

SEQ ID NO: 32835 - DNA, 1036 bp, Homo sapiens
atatatatgtatgtatatatttgttatttatgtatatagacattcctatcattgtcagaaaaagattaaaaagggacttacagtgggacacatatctactgaataatctttgaagtttgtggggaaaattaggtaataaaaaaagcaagatttgcaaagcagttctgcaaagagaggttgtagtaataaagagcctgtggcaaggtcctgccttggtagaggaggatgaaagtaggccttgtattttctagtaacttacataaagagagaaaaaccacatttatgggatttttgtttgctaggagataaaagtcaactggttgtttaggaaactcagcttttttttgtagtaagcagagagagaaattagtctctaatctcaataagaagacaaggtacaacatcatgaaactgacttcagtacctcccttgcagcaattactgtgacctagattgcttttagaaagaatacagtgaaaatgtgagtcactggagatgtagactaaactattgctaattcagttgtgtgtgacaccactgtttattaaaccattatttgtttatggtgttatgttgtgaatctttttagacagcactttccaaaaataattaggaaaaaaaatcaacttcactctataaatgcttgtgttctccatattatgtaaagggaaaaataatttttgctattatgccaggaatttactttgtagataagagttagcatcggggcagttgaaccactagtatgaaagctcattgctttgatcacaagcataatataattgtttagttctatttttaaatctatgttcagtttgaaaattcatgaaatttattaatagtgtctaatatatgatgaattctttctttaaaaaatataggagtgtattttccagttgattatatttcttgatgcattcccataagaaaggaaaaagaatacattttgtcattatattattgtttcctttgtaagtcatgttccctgtcttcccctgaaggtgtggtacccacagcccctgaacagcctgcaggt

SEQ ID NO: 32836 - DNA, 1089 bp, Homo sapiens
gaagctttttttcttttgctgtttgcaataaatcttgctgctgctcactgtttgggtccacactgcttttatgagctgtaacactcaccgcgaaggtctgcagcttcactcctgagccagcgagaccacgaacccaccagaaggaagaaactccgaatacatcggaacataagaaggaacaaactccagatgcgccaccttaagagctgtaacactcaccgcgagggtccgcggcttcgttcttgaagtcagtgagaccaagaacccaccaattctggacacaatactacatgtattctccagtgatttgctttttctgttgtgctataattttgagatacatctctgtccacgtgcacagctataatttgttttcactacaggatattattgtatcatgtgaatgtaccagaatttatttattcagtctaccattgatggacattaggcaagttttcattcttttaaatatgaatagtgttatcaagaacattcttgtctatatcctgtgtgcatgtgcaagagtcacttccaggtacataactaggagtgtctaaatttctagaaagctgtagtcattttccttaacaacagggattaccatcattaaggaatatgactaaccccttgaactccttttactggcccagaattgggtctgactttttggtatgccccagaataaataaataaataaataaatatttattatttataattattatatatttgtattattttatatttaaatattaatatatttaaaatataaatgtaaaaatatataatatatattaaatatatatttaaaacatttttacataatatatattatataaaagtaaatatatatgttttaaaatatatttatatgtattttttaagcttggagacacatagggcaccgtacaacaaactccagctccagaggtgagtggagatggtccaagactggttaaactttcacccgtcttggcaagacaatcatttcagctgggaatctgcatactggctcgtaccatggcagttttcattgagtcagctcagtgtccatattgatgactcactaatacgttgtttgaatgcttt

SEQ ID NO: 32837 - DNA, 1050 bp, Homo sapiens
atatctaggaatacagctaactgcggaggtgaaagatttctacagtgagaattacaaaacactgctgaaagaaatcagagataacataaaaacatggagaaacattccatgcccatggataggaagaatcaataccattaaaatggctctactgcccaaagcaatgtacagattcaatggtattcctatcaaactaccaatgtcatttttcacagaattagaaagatatgattctgaaattcatatggaacaaaaggagtgcaaatagccaaagcgatcctaaacaaaaagaagaaagccagaggcgtcacactatctgacttcaaactgtattataaagccacagtaactaaaacaacatggttctagtacaaaaacagacatatggaacaacagaatagaaataaagctgcacacttacaaccatctgatttttaacaaagtcaacaataccaagcaatggggaaagacttcctgttcaataaaaggtgcagggataactggctagccatatgcagaagactgtaactgtacaccgtcctttcatcatatacaaaaatcaactcaaaatggattaaagacttaaatgtaagacctaaaactataaaatccctagaagaaaacctaggacataccattctggatgtaggccttggcaaacattttgtgattaagtctccaaaagcaattgcaactaaaacaaaaatagacaagtggcacctaattaaactaaagagcttttacagagtaaaagaaactatcaacagagtaaatagacaacctacagaataggagaaaatatacaaactgcacatctgacaaaggtcgaatattcagaatctgtaaggaatttaaacaaatcaacaagtgaaaaacaaccccattaaaaaatgggcaaaggttatgaatagacattttttaaaagaagacataaacatggtcaacaggcataagaaaacagggtcagcatcagtaatcatcagagaaatgcatatcaaaaccacaatgatatactatctcatagcagtcagaatggctattattaaaatg

SEQ ID NO: 32838 - DNA, 1051 bp, Homo sapiens
taattctttcaacatttcatggttttcagtgtacaagccttgcactttttaattaaatttatttctaggtgttttattatttttggtactattataaatgtaattgatttcctgcattgttcattgccagggtatagaaatacaattgatctttgtataatggtcttgtatcctgctgcattgatgaacttgtttatgcttcctttttaatgaattccttagaaactttgatatgactttaaaaatgtcacattatttctatttcagatggctttatttcttttttctaacctaatcactctgggtagaacatccagtacaatgttgaaaagaaatagtaacagtacatactcttgtcttgttttggtcttaagggaaagcatttagtctttctctgttgagtatgacattagctgtggagtgcttcacaagtttcttacgagatcaagaaagttctatatttctagattgttgagtatttattgtttttatcaataaagagtagtggattcttttgaatattttttctgtcatctattgagattacatagtttttgtcctttattttattaccatgatatattcattgattgaggttttttttgtttgataaaccattttattactacaataaatcccacttggtcatggtgtattgtggtatattgtggattcagttttcaagtattttgttgagaatttttgtgtcagtattcttcatggttattagtgtagttttgttgtgttgtctttacctaattttgatataagggtcatactgaaataaaataagttttagaagagtttgcgaagggttgatattcattccttattaagtatttggtagaatgcacaagtaaatcatctgtacctgggtttttttttttgtgggaagtttttttggttactaatttagcctcttattacagttctattcaggtttcctgtttcttcttgagtcagttttggtagtgtctgtcttctaggaatttgtccatttcatctactgtatctaattggcatatggtagtttgtagtattcccctataat

SEQ ID NO: 32839 - DNA, 1032 bp, Homo sapiens
tataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgtatatttgatttttgtttttaaacgaaatgtgttcagatggtattttgagcactcattcagttaaatgatggtacatttgaagcaggatatttccctgaccccttcacaggactcgagacaggggtgccttgtttactcagcctgccattctcaactcctcctgggagggagtgcacaggcaaacaaggcaggaactggagtgtacaagcactggaactggctggccgctttggcatgggcaggaacaaactgtgcaggccctgtggtagcatccaggtggggttgcctgcgattcctgaagccccagaagatgtgttaaca

SEQ ID NO: 32840 - DNA, 1101 bp, Homo sapiens
cattactagcttcaaatgcttcaatgacagctattagcagaaaaatactaacatgtacaagaaaggatttgtattagtttatttcaccacagtagtatttcattacacataatccctaaaactcagcagcttgcaataagtgtttatactcatgcttatgggtgtgtaggtcaactgtgtttcagtggatgtatttaagcactgacttaggcgcatgttaacctcaatctgctccaggtagatttgttctatggctgtagcagcagcagctacctgagtcatgcttttctagtggcttgtcactgaagatcataagccaggccaaagcacttagccaagtttaaggacactactcatgtcatatctgctaacacccgttgttcaaacaagtaacatggccaagcctaattatgaaggaacaggaagtatactggccctacagaaggagagggaatgaaatgaatatttgatgaacagtattatgctatcagcttcatattagatgtttatttctagtattttacaaactatccacttgtactcaaataaaatgagtcaagtatttttagattccccacatttatttagctgaaaaggacactcctctgttaatacaactatatgtgtacatagttttgtgaatttcagctacattcagtccccacctgccctcctagaggagttgccttagtctgagcaaagtccattcaaccctatatgatggccctgggctttcctcaggcagaattgtaaaattaggaaacttctacttcggagctcatttgttcatacactcttcatcttttattcacaccccactagttatccactctcaacctcaacccttggcgtggggcatttcatcaagttacttattggtatttgcctttactccaaactgctaatcttttctaggtgcttagcatttcatgtttggcaactcacagtgggtagtaataagccttttcatcatatttaatctttcagtctgtgtaaactgtgcttctcctaaagcagaagtctaataggagttttgttcattaacttcctgatggcttctagaaatgtcatcaaagaaacatttcatatttatatcctttt

SEQ ID NO: 32841 - DNA, 1002 bp, Homo sapiens
catggaaagaattgagaaatagtcacttgaagaattttccatagagttgacaatggaaactttgacacctcaaagcagaaattatcagtatgagggaccactaaggaacatgaaatccaccagggtgtcactgggcatggaaacttgaagtaataaaagagataaaagcctgttccacagcaggggcaggagtcattctaaaacagagaataactcaagaggcatttcataggtgtactatgtggaactaattcatggatttgatatcaattgaggatgaaaaaaattttggagataaacttgatgtgttattattctgatattacattggccaagttaagaatcttggaggaaaaacacttgatttgtgtcctcttgaccattatgatagtctgctttttaaaaagtaaggtatcaaatactaatacacatctaggtcagggatcagcaaaatataatcaatgagctgtagttgattatataaaatatatatgggaagttaatgacttgaattaaggtcatgttggattttagttatgtataggaaaagaatggagagttttcagcaaacagacagtaattgaatctctaagaaggttatcttaatggtgagtaagagagagcctagtagaccttttatccaatataggtgataagagagtctgtctccttcaaggactcttggtagggggaaaaaatatggccacatgaaactgacataccaagtcagctctgtctatgagcttgaaatctgaattcctgccactgttgtgtttcaggaatctcaaaatatagaaactgatcctgagtagtgataaattttatatggtcaactatagcccacagattttttttcctgccctctcaactagattttcattagtattcaataaatatgtttttaaaaagcagacaatcctaatggtcaagagtatagacactggagccagatgcccaggtttgaaacccatcttcacaacacttatctatgtgactttaaca

SEQ ID NO: 32842 - DNA, 1124 bp, Homo sapiens
tagcttttaaaatacctctaaaatacaaggcttttaatgcagtttgttatgcacgttttatttatttatttgtgtatatattttgagacagagtcttgctctgtcacccaggctagagtacagtggccacgatcagtggctgagtgcaaccttgacctcctgggctccagcagtccttccacctgagcctcctgagtagctgggactacaggcgcacaccatcacgctctgctaatttttgtattttttgtagagacagaatctcaccatgttgcccaggctagtctcaaactactggactcaggcaaaccacctgccttggcctcccaaagtgcttgggttacaggcatgagccacagcacccagccctgttaatgcatattttaaaagctacttaataaaagataaaaacctactttatttgatggctttattctttttattttgtaaattatagctttaggattcaatttggaaagtggttggggctctggaagagctggaccaagctatagtatgccagtgcatgctgcagtacagatgacaactgaacaggtgtgcttctcttttattttgtaatctaaaagtgaattttaaatgttgcaggtttgtatttaaaagaacaggatgaatatgtacgtgtgggtatttgtggtcttcaaatatattaagttataatgaaacatgttatagaataaatagaatatatatatgttaacattttatataaaaagtactgataaggaataaatccatacgtgaacatttgtacccaacatacaaaacacacacgttcctgtttatgcacggcatatttttgtatctgaaatgttttaaatgttcaagtagtaattttaagaaaaaaattgaagctgagacttaactcctttcagtaattttgcaaatgcagtgctaaagatttaactccaaattcttcacattgtctaatttgtaatttaggatgagttatgctgaatttctttgaaaaaaaagtatataaagtaattaatgcagatcaatttaaaaataacattaaaacttttttgatgtttgtatctaccagtgttagtccttttatctactaattgtagttaccatatttaccctgcttattgttagaagga

SEQ ID NO: 32843 - DNA, 1074 bp, Homo sapiens
ttgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcaaagttatggaatatcgtggaaaggatactagttgtgaaatggaaagagacaagttatagtaccccaaaagcaaaacaagcaggagatgcaagagatgccccaaaaggacaaagcaacaattttctgttgccacctttataccggaagactctgttgtagaagaaaagaaggctttggtgcaccttatgtgggaggaggaggggcagggcatgctgatgctgagcgtacaggcagacaagagcgtagcctgctgttgcctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgctaaaaataaataaataaataaaaaattaaaaaaacaagggacctaacaaaactcagcagtgttactgtatttttaaaaaatatttttatagactcattttcaggttattaaatgtaagagaaacagatacccctcttttttaaagtaggtaaatcattgatgatttatattaccaatttttagaagtaattttctagtaagcttgtggcatcagaaaatacta

SEQ ID NO: 32844 - DNA, 1049 bp, Homo sapiens
caagagtgagcattccatgaaacagaaagtaggagccatgagttggtgccggaaactggtacatcatatttaccatattctattggtcaagcagttgataatgtgaattttaaataggaaattttatgactcatggaaagactttatttggatttcatttaatgtatcaaatgggtaccccagggtggctattgccttgaggaaggtgctttatttccactaatgtataaaggaaggtgccaggcccatgaggtacaactaatgcttattatcaattttattttattcttccccttcaggtgagtggagtgagtgtcaaggacagaggactgaggtcccagcttgaggtgcttggagggacagagaagaatcagggtgaggaagctgtcaggctcctcttttcccttttggccctgtgactttattagcttaactaatacttcatagtgtttgctatgtaccaggcactttacatatattaactcaattatattcccatcggggactgtgttacaggtagaatcttaattaaagctactgctactgattcttaataatggcattacttgaagagattattattaataggcccttgccccatttgattacactgtgtgatatacagttgtcccttggtgtccggaaaggattggttccaggaccctggaagatacaaaaatttgacgacgctcaagtcctttatagacaatgtcatcatatttgcataaagcctatacacatcctctcttatactttaaatcatctctagatttacttataatacctgataaaatgtaaatgcaatgtaaatagttgttatactgtatcattgtattgttttttatttgtattcatttttacaaattgttgtactatcattatttattttgaatattttcaggccaatgttggttgaatcccaggatgtgaaacaggtgaagatgaagggcccattatataccttgtcgctatttaaagatgtctcaaactcttggaattttgatgtttttgaacatgtaacttaatggatcctccttcatattattgta

SEQ ID NO: 32845 - DNA, 1040 bp, Homo sapiens
caagtgatctgcctgcctcggcctcctaaagtgctgggattacaggcttgagccaccatgcccagccctacatgatttctttctttctttctttctttcttttttagatggagtctcgctctgtcgcccaggctggagtgcagtggcgcgatctaggctcactgcaagctccgcctaccgggttcacgccattctcctgcctcagcctcccgagtagctgggactacaggcacccgccaccaagcccggctacttttttgtattttttttagtagagacggggtttcaacatgttagccaggatggtctctatctcctgacctcgtgatctgcccgcctcggcctcccaaagtgctggaattacaggtgtgagccaccacgcctggccccagccctacatgatttctaaactgtgtttatgaatatatacacacatacgtatggtatatgatcagtataactgtgattattaaaaatatgaaataggagctaggcttgcctaatatctgaggaaaactagacgaaaaagaccctgaaacaaaagcaaaacaaaaaaattcctttatacattgtgttttgaatgattggagtagctcagaactgcctgtgaacaagggcaaaagtggaagttagccttggatttagagaaagttgctgtgatctctctgcccatccccccaaccacaaccactctccaatccaaagcagagtgcatcttcatttcactttgggtagtcaatgaaaatgacagctgaaaaaaatgtgtaagtagtaggctggcctgctctgatgctatccctggaagtattttggccaagtgactaagagaggttaagaatttgtcagtgactattgtctttaaggataagcaatctgccaagagttctctgaatttcttgtagagttttgtttaaagttggaattaggtaaatgtcatacactttgttacacagcctcaaaaggcagtgtatttcagtggattaagtagaagcttgaaaaatgatggtgactcacttggagttacttttcattatgtctgt

SEQ ID NO: 32846 - DNA, 1026 bp, Homo sapiens
ttcacatcccttatgatcaggaagttctgtcagctgctatattaaagtcctcctgctataacttactcagtcttctctgtacttatatgaatttgattaagtatcttcttttccagagtttccataatcatagattactctcacatctttcttccaccaacagtagaaaatattttggtggaaatgttatgatactacattgcctctaacttaaatatgttcacttttaaaaccatcatgactgttatattcaaactcaaatacttttcttagaacaaatgaacctaactccaccattaacgtggttagttcagtaagctttatacattttgaaagtaatgtttgaattataaaagcagaataagcccattatttttcagctttcaaaaaattatataaagatgagaaaaaatactatatggcactaaaatgtgtatttaatgatttgatcacagagtagtaatggctctttgttctagatttttacagctcctctctacccaggaactccatctataacttaagtatgcacaacagccatgagtccaaaagttttgacataccataatgggcgaatatagaaaaagtaatttcatatccttagtgggttaaaaggcagtatcaataatacaaatatctatgttaatgtgctctaaaactgggcttttacttgagttgttgccattctaaacccaagcaacttttgaataagatgaactttttataattataatgtaaattatgtttgttatcattagaaatattaccaattatatgaccaccagagtgagagactgtgtttttttattgtgcttgagcctaagttgacattttttagttgcaaagactacacttttcattttcttctcttgcagttatcatatcctctgttgcagaagagtctgcccagcagccaaaaagggaaataacacaaaaaagatttgtgccttatctcaccaaccatatgaggccttttaacttttaaaattttttttactctgctctgttacactaagctataaacta

SEQ ID NO: 32847 - DNA, 1050 bp, Homo sapiens
tttggttatatgtctgttgcaaaatcccttctctcggtttatgacttgttttttcaccatctttaggtatcctttgaagaaaattgagttttaatgtagttaaattttaccagttttgtctttatggtttgagccttttatatcatgtttaagaaatcttctataccataaaattggtatatattctcattattttcttttcaaaggttttaaagtttacttttcattttgaagtctgtaattcatctgaaacttaatttttgtgtatggtttaagataattataaatattatgtattcagcatggttattaaatagttactgtgctcttatttcatttaaaatcaagcttgcaagtagaagtctcaggcaacagattaaaccagcagtgactataaagctacaccttaatcaaaatggagatcacaacaccaaagttctgcagacagacccagccaccctgctccatttggttcaacaactggaacaagcattggaagagatgaagacaaatcactgtaggagagttgttcgcaacatcaagtagtaccagttttaaggttttaattcatttgaatcacttatgaattgatgatatacagcaattacttttcaaaattaattttttattaattcatgatgataaatacatagtattcctcagtatctattccaagatactgaggtcataatcagaagctaagctgggtgcagtggctcatgccagttatcccagcactttgggaggccgaggtgggcaaatcatgaggtcaggagattgagaccttcctggctaacatggtgaaaccccatctctactaaaaatataaaaaattagccaggtgtggtggcacgcatctatcagagtcccagctactcaggaggctgaggcaggagaatcgcttgaacctgggaggtggaggttgcagtgagctgagattgtgccactgcactccagcctgggtgacagagtgagactccatctcaaaaataataataataataataaagtaaaaataaaaataaaaaagtaatcagaagctaaagtaaa

SEQ ID NO: 32848 - DNA, 1024 bp, Homo sapiens
tttacgggctaataggtggaaagaaatgtgtcttgagtctcagataagactttagactttggatttttgagttgatggtggaatgagttaagactttggatactactgggaagagatgattgtattgtactacgcaagaggaacatgtgatgtggcgggagaaaggggaccactcgtacactgctggtgggaatataaattagtatggctactaaggaaaacagtattgaggttcctcaaaaaagtaaaaatgaaaccaccatatgatccagcaatcccattgctggatatgtgtccaaaagaaaggaaaatcagtatattgaagagatatctgcactcccatgtttactgcagcactattcacaatagccaagatatggaatcaacctaagtgtctatcaatggatgactggataaagaaaatgtggcatatatacacaatggaatactattcagccataaaaaaaaaccctgttatttgcagcaacatggatggaactagaggacatgatactaagtgacataagccaaacccagaaagacaaatatcccatgttctcactcgtatgtgggaactaagaaaactgatctcatggaggtagagagcaaactggtggttaccagatgctgggaagggtggaagggagcagtgaagggaggctggctactggctacaaaaacagttagaaggaataagttctagtttttgatagtatggtaaggcaactatagttaacaataaagttatgtatttcaaatagctagatgagaagctttgaattattcccaacacacacacaaaaatgatcattgcttggggtgataaatatcccaattatcctgatttgatccttacatattgtatgcatgtatcaaaatataacatgtaccccataaatatgtacaactattatatatcaataaaaaattgtaaaatgcaatgaaagcagtacagggaaatttatagcactgaatatatatatgttagaaaagaaaaaagagctaaaatcaataatctaagctt

SEQ ID NO: 32849 - DNA, 1049 bp, Homo sapiens
tcctgctgacaccttggttttggccctgtgagacctgtgtcaaacttctaacctatagataatatatttttgttgttttagggcattaagcttttgttgatttgttatcaaataaataggaaactaatacaggtatatttgggttatctttaaatgtatagacttgatgatttggaatcactgagctttcttatcaatcctttgaattgttccaagtagtagatttatattaatatcccatattttattgccgtagcacttagtttgaagatgacaggtcaagattccaaggtacagtttgtgatcatggaccaaactggagcttagtgctctgtagcaaattaacctttatggccttggacttgtgatgaaatggtaaagcacatattagaatgcctgaggttcccatcctggtccttttattagctatgtaactttatgtaaaacacttatctttatgtttgttttctcaaaggcaaaacacaaacattaacataattatgtattagggttgttgtgaagattaaaagagataatgcaagtagagtaatttacatggtgtttcgcacatacaatacctcttaaccaatttttacctagtaaaactagccgataggcatacttacttatcacatggtagaagactggctaggaggctattctctaaccaaccttatgcttttgtcccaacagatgatcagctgcatgcttacaaaaggctagtggcagtggtcattgaacctgtttgttttacttagggtaattatgtaatttagttaaatattcagcagtccataaactgtgagtgtaaaagacttctggttttatttgaaagctaggttgaatgcattagaaatactttaaaaaaaaagctagttgctcccctcaacccatccccagtcaaaaagtggttaaattgggtatgggtaaaaaaactaaaagactggacaaatgtagaaagcaaggatgaaagcagaatccagtttttcccccactaaaatacttgaaactaaaaatggtagaaaatgcttcatgtaccatggcaattt

SEQ ID NO: 32850 - DNA, 1023 bp, Homo sapiens
aggcacataggtattcaataaagggtatactattaatattgccactttaattgtcttactgtggaatttatcagttttataatcatagaaatttattaattcatagctctttttggagttccagtgttttttaagtttttaaaggaactagcagtttttgtttgtttgtttgtttgtttgtttttggagacggagtctcgcacttttggcccaggctggagtgcagtggcatgatcttggttcacaggaactagcagtttttttaaatacagcagctttttcaattaatagtggcttagacaccactgtgaatgcttgaaagcacttttgtgagtttttttccactacatgaatatgttagataaaaacttataaaacttttagggacaaaagacagttaaattcattgcctatcccacacggggtaacaaccttggaagacatatcagaaataaagcaattatctggatggatagtctggatgaacatgacacataaaaaaggtgctgatagttcttctgaaacaatccctttaatgtcctagtcatttaaaacacacattcaggagaagcccgaaatagaaagctttaatgaaaattactaagttttgtccattaccttgaatttggttactatagtatctaaattacattctgtaacaaatgcatatgtacatgtgttagaatcttgtgtgtggaatttggtgagacttattagactcaactattagaagactaaaggacctctgatatatctgcaattattgtttttaattataattacatagatctatttacatggactttgaggacagatagttatgcaattcaatcatgactgatttctcatacaaatcaacctttgagtcacatcaccttttgaaaacgcctactaaaaacaaaacagttaatgtagctgaacaggaactgactgtggctcaaagctgtgccaaggctctaaggctcattttattgaggtagggagatcagcctgtattatccatgtgagctcaatgtgatcaca

SEQ ID NO: 32851 - DNA, 1033 bp, Homo sapiens
taggtctcagtaaaactggggagctggttataaggcagactatggactctggggttccactctggagatggagagtccataagcccaggaatcccttttcagaaacaatcactgagtcagtctgattcattttaagtggtgtatatgctaccttttgagaaaaaatgggttagggaataggaattaacctgtcttaaaatatactatgcataatgaaagtttttttttctttgactagttgtcaggcactggttgtgaatatggttgtacatacacagggatgtacaaatatgggagataaaggatttggggctattttggtagttggacataacctagaaattgtaaaactataataaaaacctggtatcagtttcttgacctgttaaggccaaaagacggggcaaatgaaaatttggtggttgagttgtgatgatttgagattttacaataatacacattcacactttacatgtaaagaactattagggtaaccaattatagaaggcagtgaccaaaattctgaaactcttaattaatctgtaagtaggtgaaggggcagtgtgtatgtgtgtgttcagagaggaggttgtgggtagagaaggtggtaaagggtgagtgtatcactaaaatagtatataatgaaactattcattggctttctacccacaatttcattagaaaaatacttagggaaatacatacatgcgtactttgctttgtacttagttctaggaatttagcatatggaaatgaagctatacaaatttgtataccagaatgtccatcatgctgcattacttatgacatccaaacttggaaaatatctacaaagttcagctttttaaggggtatggtttgaataaatgattttaagtccataggacaaaatagtcattgaagaatgacataagaatgtttaccaatgaatgttaataatataaggatataaacatgtcacatgacagtgcacatacatacagtattaatatacatgtattttacatatgtatttctgaaggcaatatattaa

SEQ ID NO: 32852 - DNA, 1043 bp, Homo sapiens
aacctgtgtctcctttgtatccctctgttggtggggaaaggtgtctttctttctgccctccccccccaaaataattctgttcacttttgttttgtttccttgtgtactccagcattggttatagtcatgggaaaggaaggtgtccacggaggcacacttaacaagaaagcatatgaactcgctttatacctgaggaggtctgatgtgtaagcagcctctccccatctacctagcaactgtcttcatcaacaaccctaattatggtcacaatgctaccaaactgtagatggtagctaatttttctttacctattttctaatgtcatgattcctgtttgcccaatggatcatttgtatgttaaccactgtatgtaaccaacccttatctggcaacataattgcagcacaataatgatttgcatgataccttgaaattggggggagggggcatgccaagttgggcatcactttgtcttagcaattaatgggatattgattactaaaataagttaatattaagcaaggtgccggttgtacaatctctgatcagtgtcttttcagcactttgagcatttacttggctcatttagtcttccttttgtagcgcatggttgggaggaaaaagtgcatgcatcattccttcactcttctctttttcccgccccccctcccttcgcacataggcatttggtttgcttccatctttttttatgcagtgcctgtttttttttaaccaattaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataa

SEQ ID NO: 32853 - DNA, 1102 bp, Homo sapiens
cagggcacagcagcagcagcagcagtgactgtgaagggtggatggagtagctccaccaagacacccttcctccaggagggagtgtgctacttcagctccagactgagggggcaggctccgctacaactatgagaggtagatagaggtttctgacaaagtactgttttcccaggagggattgtacagctttggccccagagggaagggtgtaatagctgcttgcagctcagcttggggatgtgaggccaccaggtgaaggtggtttggtgccttagtctcagggatgaaggcatgccgtagctacttgtacccagagcaagtcacactccaacatttgttcatttgctccaagataacatagtgcggtagccctgagggccactaggggtagggcccaatgtcagctccttctctgggtgggaagcacagctgtggggactccaggtggctccctcagctggtcttagtgcttgtgagaactgcaggggaccccaatggtgaagactttccatgtccaaggtgttgatgggggctgctgggatcctcctgcttacctttttgccatggggagaggtttctcctggttctctgctgatgcagcctgacgtatgtggtggtggagtccctttgtttccttctattctctatgtggctaccctcagtttcagtgctcacttggttttttgtcactccttcgatgttctctggtgctattctttagttatttttgttaaaatgtagttgtttgttgattattttggctgtctttgtggtggggatgagtgtcagaggatttcactctattttatcccattttaactatttttaaggggaagcctaatttttaaaaaattgtggttaaaaaaaaaaacaaaaaaacacaagaccgggcatggtggctcaagcctgtaatcccagcactttgggaggctgaggcaggtggatcacaaggtcaggagtgcaagaccagcctggccaacatagtgaaaccccgtctatactaaaaatacaaaaaattagccaggcatggtgatggacacctgtaatcccagctacttaggaggctgaggcaggaaaatcacttgaacccaggaggtagagg

SEQ ID NO: 32854 - DNA, 1043 bp, Homo sapiens
atattcccttcagcaatgtatcagagtgacggtatccctatgtggttactttttataatgtactatatatgattaaaaataataggccgggagtggtggctcatgcctgtcatcccagcactttgggaggccgagatgggtggatcacgagatcaggagatcgagaccatactggccaaaatgatgaaaccccgtctctaccaaaaatacaaaaattaggtgggcgtggtggtgcgtgcctgtaatcccagctactcgggaggctgaggcaggagaatcgcttgaatccaggaggcagaggttgtagtgagctgagatcgcaccactgcactccagcctggcgacagagcaagactccatctcaaaataataataataataataataataataataatttaaaaagtgtattctctagtttttggtgccagttctgtgtttgtttctttgttcaagttgttaattatgttgtttacatctagattcttatcagttttttactttttgatagaggtttatggacttgtaaatttcttccaatatttctgtatatttttctttaaatattttgaggctctgttaagtatattcaaatttagagatatctgtctgatagattgtttctttttcattatgtaacatccatccgaatctctaatagtgctttttcacttacagtctattatatttgatattacggttacatataatctttagtatatatatatatatatagatatatgcacacacacagatatgtatatactcaaatacatagttggccctccatatctgtgtgcatctgtgaattcaaccctccaaagattgaaaatattcagaacaaaattccataaagtttcaaaaggcaaaacttgaacttgccatgcctagtactgtgttgaatttacatgaatgaaatgatatgtaggcattgtgttagatgttgtaagttatctaaagatgatttaaagtatatgggagaatgccatatactttattatatattcaatatatatatattgaatatatatcaggttatattc

SEQ ID NO: 32855 - DNA, 1050 bp, Homo sapiens
ccaacgagaagcacagcaagaacatcacccagcgcggcaacgtcgccaagacctcggtaaggaaagagcgggcgcccctctgcgttccgcagccggagctgagtccgggtccctggggccgcgtcgcgttttctcccggatccggccgaccgtgggctggtgccgtggaggggtaggggcccgagtctgcgaaccgccagactgtgggggctcgggaacggaaggggagacctgtgaggtgagggggccggcgaccggcgtgcaggcgtgggagcctggggtccgagtggtttctctgcatctgaaatggtggattttcgcttttgcagagaaatgcccccgaagagaaggcgtctgtaggaccctggttattggctctcttcatttttgttgtctgtggttctggtaagtggcttgggggctcccatcaggtagagtcttgggttgaaaggatttgggatgacgtggtgaccggtcagtagtgagtcctacctgcgtagttctcaacccacctgccgaggactccacataattctgtttcgtctgaaccaaattacttgttccacatatgcacagagggtggtgctccagaaacttctcccagcttaatttgtactcacaggagatcaaaaaggaggtcaggtcttggtaatgatccagttggaataaatgttaagaccggacaaaacctaacgaaatgagaatttagaatgttttgtaactccattatcagtctttgcaaagaaaattataaatatgtactatagatgttagaacttgatttaacatataccagaatctaatgtcttaatgtcaaaattgagtatattttataaaataaagcttgtgcaaagaattgattcactatagaggaaattacctgattggcattttaatgtgtgagtcaaatgtttttaggttaataaaagaaacgtttgatacatggtttaaaaaaaaagtgtcggggtagcctgctgtcccctaagagtaacagacacttgcctttgcaaatagattacaaaaaaaaggtctttcctctcttcatttatc

SEQ ID NO: 32856 - DNA, 1051 bp, Homo sapiens
ttctcttccactgatttatcagttttaccagtatatccatataccacaaccaaactgtcttaattacaattggcttactttttttttttttgtgacagagtctcaccctgtcagcgggctggagtgcggtggcacgatcttggctcattgcaacctcccactcctgggttcaagcaattctcatgcctcagcctcccgagtagctaggattacaggcatgtaccaccacacccaactaatttttgtatttttagtaaagatggggtttcaccatgttagccaggatggtcttgatctcctgacctcatgatctgcccgcctcaacctcccaaagtgctgggtacattttaatatctggtagtgtcagaactccagataacttcccctgccctgctcttcttttacacaagtttccaaaatattcttgtgtgttcatttttcaacaccaaccttacagccagtttatttagttaaaaaaaaaaaatcagttagcatttaaatttagttttagactgacaagagagaaatgacatctttataaaaataattcttcttagtaaaggtcatagtttgtctctctgaagagttttaaagttttcttctcattggccctatatatttgttcttattatttttgctatatatggaatctttcatttttttaaagtagctgttatagtgtgacttcatctacatgagcagagatgattttgttttctttcaaaactgtatatattttacttctgctgattatagtgactaggtatttcagaatgttattaaaataaagtgaaaaggggagccatccttgttttttctctgacttcaatggaaatagtttttttaaaacatagattaccctacttacacatgttcaattcaaaatgagaaaattaggacgctatcagtattttaaaactattattttaaagttttagttcattaaaacaacagatgaagtggtaacattcttggatattattattttgagacagggtctcgctctttcacccaggctgaagtacagtgacatgatcatagctcactgcag

SEQ ID NO: 32857 - DNA, 1028 bp, Homo sapiens
agccaacaagcattccaaacttttgcatattctgagatgtgccagtagatagatggtttgaacatatgagagggcttttctatttaaggtgtttaaagtttcactcttacaaggctctctccaaaactataaagaatatgtatgatcaagtacctgtaatggattatgctacaagaataagaatcctacagatattaatttataatcagatcaattcagctctgcaacaaagtaccacaaaacttttttccccttaaagggatgccataatgcttccaatatgatcagacctctgataacttttcttgtccctcctcactgattctgaatcacttttatttccgctaaggtgctgtatactcttgcccctggcctttgtgtacagcagtctcccttaaccatggtttcagtaaccaagcgtcaactgcagcccaaaaatattacatggaaaatcccagaaataaacaattcataagttttaagctgtgtgatgaaatctctcagcatcctgcctagaacgagaatcattcttttatccagtgtatccacagtgtattcgctccccacctatttttcactagtagctgtgttggttatcagatcgactgtcacagtatcaacagtagttgtgtttaagtaacccttattttacttaataatggtcccaaagtgcagagtagtgatgctggcaattcggatatgccaaagagaagccgtaaagtgctccctttaagtgaaaaggtgaaagttcttaataaggaataaaaaatattgtatgctgatttgctatgatttacagtaagattaaacctatccatgaacttgggaagaagaaaaaagagattagtgctagttttgcagttgcgccttgaactgcaagttatagccgtggtcattcaacttaccacacaagcattgtaccatctcacattgtcgcaaaaagggtgaatacaacaccattagatattttgagagaccatattcacatatcttttattacagtatattattataattgctctattttc

SEQ ID NO: 32858 - DNA, 1035 bp, Homo sapiens
gattgcacaaatatatgatcagatttcagatcatacagtatttgtctttcctgtctgacccacttcatttagcataatgccttcaaaattcatccatattgtcacaaatggcaagattttccttttttaatggctgagtaatattccactgtataagtatataccacattgtctttatctgttcatctgtcaaaggacacaagttgatttcatatcttggttattgtgcataatgctgcaatgaacatgggggtgcagatatctcttcaggatactgattttatttccttttgatacatacctagaagtgggattgctggattatatgacagttttaatttaattttttgaagaccctcaataccctttgccataatggctgtaccaatttacatttctaccaacagtgcacaagggttcccttttctccacatcctcatcaatagctatcttttgttattttgttaatacccatcataatgagtggggtgacatctcatcgtggttttgatttgcagttccttaacgtttagtgatgtggagcactatttttctgtacttggctatttgtatgtcttctctggaaaaacgtctgttaaggttctttgcccatttttaatgagattatttgttttgggtttgttgttgttgctgctgttattgagttgtatgagttctcatacgttttagatgcttgcctctcatcaaatatatggtttgcagatatttctcccattctgtagcttgcctttttggttgtttcctttgctgtgcggaaacattttagtttaatgtagttccacttgtttatttttgcttttgttgtctgtgctattggtgtcatatccaaaaatcattgccaaaatcaatgtcaaggagattttttccctatgttttcttataggagtttgacattttcaggtcttacattaaaatctttaatgtatttcaagttaattttttgtgagtggtgtaagacagggatcctatttcatagttttgcatgtggatatccagtttcccaacaccatttat

SEQ ID NO: 32859 - DNA, 1030 bp, Homo sapiens
atgttatttcttttttgcttgttcaattgcttaagttctttatagattctggatattagacctttatcagatgcatagttttgaatattttctcccattctgtaggttgtttgttcactctgttgatagtttcttttgctgtgcagaagttctttcatttaattaggtcccatttgtcaatttttggttttgttctaattgcttttgaggacttagtcataaattctttgccaaggccaatgtccagaatggtgtttcctaggttttcttctaggattcttatagtttgagatcttacatttaaatctttaatccatcttgatttaatttttatatatggcaaaaggcaggagtccagtttcattcttctgcatatggctagccagctaccccagcactatttattgagtagggagtcctttccccatgacttgtttttggtgactttgtcaaagattagatggctgtaggtgtgtggctttatttctgggttcactattctgttacattgatttatgtgtctgtttctgtaccagtactatgctgttttagttattgtagttttacagtatagtttgaagttgggtaatgagatgcctccagctttttttatttttgtttaggattgctttggctattcaggctcttttttggttccacatgaattttagaatagtttcttttatctgattctgtgaaaaatgatgttggtagtttgatgggaatagctttgaacctgtatatttatttgggcagtatggccattttaatgatattgattattttaatccatggacatggaatgtttttccatttgtttgtgccatctatgatccctctgagcagtactgtggttctttttgtagagatttttcacctccttagttagctgtattcttgggtattttattttttttcatgtggctattgtaaatgggattgtgttcttgatttggctttcagcctgaatattattggtttatagaaatgttactgatttttgtacattgattttgtatcctgaaactat

SEQ ID NO: 32860 - DNA, 1034 bp, Homo sapiens
tgatggggttgtttgattttttcttgtaaatttctttaagttctttgtacattctggatattagccctttgtcacatgggtagattgcaaaaattttctcccattctttaggttgcctgttcactctgatggtagtttcttttgctgtgcagaagctctttagtttaattagatcccatttgtcaattttggcttttgttgccatttggtttggtgttttagtcatgaagtccttgcccatgcctatgtcctgaatggtattgcctaggttttcttctagggtttttatggttttaggtctaacatttaagtctttaatccatcttggattaatttttgtataaggcataaggaaggaatccagtttcagctttcttcatatggctagctagttttcccagcaccatttattaaatggggaatcctttccccatttcttgtttttgtcaggtttgtcaaaaatcagatggttgtaggatgtagtattatttctgagggctctgttctgttacactggtctgtatctctgttttggtaccagtaccatgctgttttggttactgtagccttgtagtatagtttgaagtcaggtagcatgatgcctcgagctttgttctttttgcttaggattgtcttggcaatgcaggctcttttttggttccatatgaactttaaagtagtttttttccaattctgtgaagaaagtctttggtagcttgatggggttggcattgaatctataaattaccttggacagtatggccattttcaccatattgattcttcctacccgtgagcatggaatgttctttcattctgtttgtgtcctcttttatttctttgagcaatcatttgtagttctccttgaagaggtccttcacatcccttgtaagttggattgctaggtatcttattctctttgaagcagttgtgaatgggagttcactcatgatttggctctctgcttttctgttattggtgtataagaatgcctgtgatttttgcgtattggttttgtatcctgagactttgct

SEQ ID NO: 32861 - DNA, 1036 bp, Homo sapiens
aaaagttatgaattatacaaaagctttaggaggaattttagtactcctttacccaaaataaatagtggtaaatttccttctgttcttagctctgagtttgtatttatttataagtcattgtgatcatgtatacttatatatttttaatatgctaattgcttttaaatgggatttttgttctgattttaaaataatacatcctccctggacaatatttggaaatgtagcaaagtaaatcatgttaccattgttccattttgatatatataaactttaggtattattttatatataataaattttaagatattatatacaataaaattaaccaatttaagtatatgattcagtgaattttgtcaaacatatagtagtgtaattaccaccaccacaatcttgatacagaacttttttttccccagagatggagtttcgcactgtcacccaggctggaatgcaatggcgcaatctcggctcactgcaaccttcgtctgcccgggttcaagcaattctctggcctcagcctcctgagtagctgggattacaggcacgcgccgccatgcccggctaacttttgtatttttagtagagatggggtttcaccatgttggccaggctggtctcgaactcctgacctcatgatccacctgcctcggcctcccaaagtgctgggattacaggcgtgaaccaccacacccagctgatatagaacatttgtatcacctaaaaatttcccttttacccctttgtagtcaatccctcacccccacttctatcccctcgaaacccattgatctgcgttttgtcacttttcgttttgccttttctagaatttcaaataaccagtcttttgtgtccagcttctttcacttaatgtaatacttttgagatactgatattgttacatgtattagtaggtagttcctgttttatcttctattcagtagtatttgcattgtatagttataccacagtttgttaattcatttaccagttgatggacatttgagttgttttcagtttttttgctgttatg

SEQ ID NO: 32862 - DNA, 1023 bp, Homo sapiens
tatttcagtctccagcaagaattgcccatcttgttaaggtgactgactttatgtgattatcttaaatctacatgtaagtcagcatgtggtcatgtggttttgttctaactgttaaatagattaacatttcttgctctatttcagcagagcaaataattttgaaaaaatgattcctggtttttctgaattgtgttttgaggtggtaacagaccagccattctaaatggctcagtgtgattgcagtgtgaattttaactgcactttagttattcactcataaccacactttagttgattgctcactaaatgttttagcttttgagccatcgcttgtgaaactccttgtatcaggtaaattagtttcatttattatgttatttggtaatatatctgcctttgttgaacatgtataatttttccaaccttaggaattaagaaaggaactagatattcttctgcaagagaagattgaaagtcctcatcctgtagactggaatgacactaaatccagagactgtgcagtactgtcagctattatagacttgatcaaaacacaggaaaaggcaactcccaggaactttccgccacgattccaggatggatattacagctgacagcttttcaggggtggtctgaaaagccagtttgacagccattcttcatcattgtttaaattttggctggatgccaaaccctgggacatgaacaattttcatgtgtaaggtagaagccttcagtaggtagtaaagacttaatgtgcatgacttgatgttatatgtagagatatatatatatatatatatataccataaaagcaatatgttctctgatcatatactctgctgtggtcatgcccactctttgggagtatattccctttatatatattgagtattgtaccacttgagaaattcctttgttctgttatacaaaattaatctttctgctcataatgattgatgataccaccagtaaaaataggatgtttaccccaaaacaagtgtcaattaagaatttgaacac

SEQ ID NO: 32863 - DNA, 1029 bp, Homo sapiens
atacaggtaattaacattaactatttaaaaataaattattaaacatctccctgttgaataatactaaagacttttacaaattgagataaaatgtgtatgactatcaaaaaaaaaatgacctaggaattgagagattgaattagaactgtcaacatgaatttaaacagaattcttaacttttcattttttattcatctgggtcatactctgtaaaatttttaagttgataattttacagttattttgtaaatcaagggctgtttatcagtattatgattgtcatagtaaaatgtataaactcttggtatgaatcacttaattattttaggtacttttttgttatttattcttcagtggtatagtgtgcattaacattaaggaaaagaatattctgccatttttctaaaatgttgagtaattatacctgcaagaagaagattagttacatgatttaaattattcatactgatagcattttttcatatatttttaaggaaattatgctctgtcctcaaatataaatatatttttttgcaaaaataaactgaattattctctggaatttttttagattccgggatttgtttggtttttaccaagctcttctatcagtttttcaagtagtgtaaaaaaagaaaatcctctagaagacttctttttaacaaactgcattttaactttttttaaagggtaaaagtttacacaaaaaccgatggcctggttgctgttcatcctaaatctgttaatgtggagcaaacagactttcactacaactggcttatctatcacctaaagatgagaacaagcagtgtaagtgaacatttaaaataattaaggatctgattatcagtctcattgtatttttatgattgtgtagttttaacaattatatacaaaattttttttttgttgtgtcttattcctgtgacgtgagtaactttttccctctaacaaataacctattcttttaattttcaggtctgtaatgatggatctttgtattttaattagttaggacagttatttgat

SEQ ID NO: 32864 - DNA, 1030 bp, Homo sapiens
aggtgtctaagaaagtcaggtgtcagaaaaattaggtggggaaagtcacacctttcataaaagggatatatacttaaatataaccaactttatgtttcataatctctaaaaggaattccttaggaaatatttctgttatgaaaatacaagattcatctggtcattcactttcctttctatttaacttttctttaaattgtactaaagttaattgttttataaagaatttctatactatgattctgttattaggatgcatttcttctatcagtatatatacttaatgggtgtctgcaatcttatttatttagaagactgagtattgaggcaagggaagtacttttctatgttacttgaatgctttgtaataagccatgtatcattatttaaaaaaaaaacaaaaccttaagcttacctgccatttttaaccatatttaattctcagtaatagaaatatggatgtggattattttctttatgcttttctatattttttaaaaaatgggggtggaaagtaattttaaaaattctattagtctttcacaaaatagagtaatccttaaacatcagtggctattccttacaacatgcaaactttttctgtgaaaagtcgggtaatattttaggcttacaggccataagatctcagttacaagcattgacctctgccattgtagtgcaaaaacaaccaaatgtagatgaatgggtgtggctgtgttccaataaaatgttattgacaaaaacagcttttgtagtttgccaacccttgctttaaaacatgtttgctaaagtgttttcataaagcagggatagcttacaactcaatttatctattagtgtatggtttatagcctcaatgtgtgaaaggtattctagttctatttgttaccattgctccctagatgctgcataacatgaaaggacagtttgctgagcatcttcttggagctggatttgtaagcagtagaaatcctaaagatccagaatctaatataaattcaggtacagcaggaaacacagtgtaaataag

SEQ ID NO: 32865 - DNA, 1041 bp, Homo sapiens
atataaaagtctccaaagaattgggttttggcattcattctctttttttttttttcaccttggacatttcttagatgcgtaaagtttctgcaaagtttcatagttcaccaaggacctttatatttgtccagtctgttgtgttttattctcattctttgaagcaactgcgtcatttgccacattggatcaccttataagcactgatgaattttatttactccttctgagctcagccttacttaccaatttattcttctgtttagtgtaagaactttcaaatgttcattacaaccaaactatttccagttttcaacttttttcgtaaaccatttgagttttaataactttgaaattttaagataaggagaaattcataataattagtatgtgagggtttggggtaagagaaccagagttgtaggaagagacataaatgagctttctttgccaatcatattagggctaattttataaatgcttgttggaaaaggtctagaaggatatgtacgaaaattttaacaattaattaggtctaggaaggggggtattgggctagaggacacctgtggataactttcttttatatgtatttgttgaacatatattacttagcctttattttcttcagtatcaaataatttttgcatatgctttcttatgttgacaaggatgcttttttctttgcacaaactagagagctgtagtacacatggatgaacgacgagaagaacaaattgtacagttactgaattctgttcaagcgaagaatgataaagagtcagaagcacagatatcctggtttgctcctgaggatcatgggtacgacaagaaatatttttttaaagaataggcaaagagtaacactttaataataaaaataacatctttattttcttcgataagtgaattttaacctttacgtactttttttccttatgtagattaaacagatttagaaaatgacttttaaaaatttagatggcatgtttccataggaaagctaaatggtatgaataatagtgtatctggatatgagatgta

SEQ ID NO: 32866 - DNA, 1049 bp, Homo sapiens
actgtaggaatagcagatataggttatattctaactaaacagatacatcaaaaaaccttaagaggacttttagtagagacattttatgtcctgacaactgaaattagccactcattttcacttcaaaaaaggaggtaacatatagttcatttgctttgcttcttcaggtttgttgttttatcactgatttctcatatttattacattaggttatcctcctacccatgtaaacttatttgagctttcacaaagcatgtaatactgattagaattagaatgtcttacaaaaccctgtctcttgtcttaaagatgcttatgtcttgttctcctgggacacatactcctctacccaccctgggttttcaaactttatgttaaactttgttgtgaccagctattttggtgtttgtttaattgggatagaatacagtgaagagaagataagagttgcactgtacagagtaagggaagtattttgtgaaattacttgtatatgtgtgtactgggtcattagttttactgtggattgctataaaaaataaacaattgaaatctattgctctagattttacagtattttacacattgctgtctgctttcatcagtctccttaccctagctcctgcttccctcttttttccccaaaaatcaaaaccaaacctcaaaaaccaaaaataccttgaagatcattcccaactgcctagttgttggatacagtagtaattttttcagttctctgccttacttacgtccattttatacttctgagtccttttttaacacctttcttcacttcataggagtggttttctcactgtgtgctcctagtcttttgtttgttctcttgattactcctctgacttattttcttgccttggccccgtgaatgccagacttggtcatccgtctgtcctcatctttggaggtggtattatttgtaaattaagagaattcctgtgtctctgtgatttcaactttgcagaacactccaaaatttctatcataactctaaaaacaaaacctctcagagatcaatttccatatattca

SEQ ID NO: 32867 - DNA, 1034 bp, Homo sapiens
tttttattaatgctggtcatgatcctttaatataatttcagaaacagcaatttgaaaatctctgggctagaaaaatacgcggggccttgagatacattgagtctttctaaggactgtagcaagtcattaaaacattttaaacaaagaatgaaatgactggattttaaatgtttaaattcactctggtagcagtataaggaatggattgaagagaggtaatcctggttcagggggaccagtgaagtagcccttgcagtaactaaggtgagaaatgacagcttgaattagcacgttggcagtggagatggaggggagtggacagattaaagtgatttaggaggtagactcaaaatgattttgtgatgtattttatctgaagggacgagtacagtgttaatgatgactcttttatgcctatctgtaaggatcaggcttgttggaagaaggctcagctatggacactatgagtttgatattgttatagggcatacaaatgaggatttgcaggagggagagggctgtgtagatctgatgcctagaaaaatctagactggagataagtatttgacagttaatgggctcatgggtagtagttggagtgtgggagtgaacagtcagaaatagagtgggcccagcctgaattctatagaccattgcttctcagacttgaatgtgcataggaatcacctgacatcttgttaaaatgtaggacactggtgggatcagagattcgacttttgttacaggctcccaggtgatgccagtgttgctggtctgtagatcactcaggctgtcaaatacggaaaatgaaaatttaaggacaggctgaggaaaagaaggttacaaaataatctaggaaagatcagctagagaagagaaaaataaggtgtgtgttgttttgaaatctaagagtagtgtttaaaggagagaagagcgtatcaacaagaagtaattgatagtggcaagcatgcacaaatgatgtaagagcagagaatgtctattggatttatcaacaaggtcgttgatgatcttaa

SEQ ID NO: 32868 - DNA, 1032 bp, Homo sapiens
agcaagacacacagctctgatttggcctcaaaatggcaaaagaaccctatgaatggaatgttatgggtcttttctgttgaggagctgcctctactctggttgaatccactctctagtgctctgctttttgctattggtataatctgacattattataaagtcttctgtgcgtggtgttttctttgctgtagttctcacttccttttttctcgattaaaaactgccaggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctaggtgtgtattccttgggaaggagtggttctctgtatattctcactatgccaccatcttgcctaattctctcccactttcaacttgcacagtggcactgaattatcaatctgaaggacgaatgatgcagttaaaccgagccaaattcaaggcaaatggcaattgtggctatgtcctcaaaccccagcaaatgtgcaaaggtgtgtattaatttcatagtcataaatgcaggtgtgtgttaatttcatagtctaaatgcaggcaacctttattaaggaagctgtttagaaagtgtgataccccagagtttttcaacttttttttttcaaaaagataggttaaggtgtttgaatgtgaattagaattcttgtcaccactacttaatatttggttagccgtgatgtttagaatgttatcttgagaggtcgtgtgtgaaagagggacatggatagcattgggttatcacttgaaatccagtgccccatataagctggactgctttttaaggtctgagcccaatctttcagaaactatcttaagtaatgtgagtctgtgacctgctgggaagcttcaattccacctgaaacaattttatcaagcccttttactcagtgtagtccaattacaa

SEQ ID NO: 32869 - DNA, 1030 bp, Homo sapiens
tcatgcctgtaatcccagcactttgggaggctgaggcgggtggatcacctgaggtcaggagtttgagacaagcctagccaacatggcgaaacccagtctctactaaaaatacaaaaattagctggctgtggtggcgaacccctgtaatctcagctacttgggagtctgaggcagggagaattgcttgaacccaggaggtggaggttgtagtgagctgagattgagcccctgcactccagcctgggcggcagagcgagactccacctcaaaaaaaaaaaaaaaaaaaaaaaagaaagaaaagaaaaagaaaaaaaaaaagggctgggcacggtggcttacacctgtaatcccagcactttgggagactgaggcgggcagatcacctgtggtcgggagttctgaccagcctgaccaacatggagaaacccggtctctactaaaaatacaaaattagccaggtgtggtggcacatgcctataatcccagctattcgggaggctgagacgggagaatgcttgaacgaacccaagaggcggaggttgtggtgagccgagatagcgtcattgcactgcagcctgtgtgacaaaagtgaaactccgtctcaaaaaaaaaaaaaaggaaaaaagagttgtgcaactataaccactatctaatttcagaacattttcggcaccccaagaagaaaccccaaacctattagcaattattctccatttctctcttccaagcatgctgtggcaactaatatttctgtctctattgatttgtctgttatctgttctggacatttcatataaagggaatcatatatgtgacctttgtgactggcttctttcatttggcgtaatgttttcaagattcattcatgttgtagcattatcagtatttcatttcttcttattgccaaataatatatcgttgtatgactataccacattttgtttatatattcatcagttgatggaaatttgggtcatttgctttttgggggctgttacgaataacgctgctgtgaacattcatgtacagg

SEQ ID NO: 32870 - DNA, 1050 bp, Homo sapiens
agtttctttctttaaaattattctaaaaagctttcagaagaactggaattttttctcattgaaagataaaataacatttatggaagctagatcagctgttttataaactcacagaacatagagaaaaatgcctttttaggttgaggaaagtaggatattcagttaccttctgaagttcacacagccagtgacagagcccagaccagaactctgtttgctcccttctttgtgcccacaaaactgtgggcagatgctgttatcaagctgccatgccataaactagatctctcagcacctgctatgtaccaagtcccaaaataggtgttgggtttgtgctgagaattaaacaaacataccctttacttctgccctgatggttttaggaaatctccctttccttactttttgacaaacattacctgcatcattttgcactttttccacatagaaatgaaattgttttcagaagctaatctctttcaattactcagatttactctaatctgtggaagctggcaggaaatcagttcacattttttatgtacctttttactaaaaagattgtcttgcaaaggacctggacttttttttttgttgttgttgtttttgtgcctgctaattcacagttcaatgatcagtgtcccagaatagatgtgttcacaaaagagtgcaagtgatattcttgtatgaccctaatctcggcgaatggtcatgattctgtatgtgaaaatctgtctcaaggttcttttgtagcaaagagtgatcagagcaccaagtgtgcatattactgctagaagtgattttgcctgttggtcctttcaaaggctagaacaaggaaatatatgcaggtatataaaaacatacacatatacacaaacatgcaaatatacatgcacaaatatgtatatatgtgtgtgtgtgtagattgctttctgtttatatatttatagtcatgtgccacatactgacatttcagtaaataatggaccacatatatgacagtggttcctgtgagattataataccatatttttattgtaccttttctgt

SEQ ID NO: 32871 - DNA, 1050 bp, Homo sapiens
agaatgatgggatggcaaaaggatatgatcaaatattggtaagctgaggggaacttagcaaggcttgtttgctcagattcctcttggtgtctctgtgtcttcgaggataaggatttttttttttttttttttttcctgggcatagggaaggcacttttggaatgaaagtcttacatcctatgttacaggaaggtcaggtaattcttttatgacctgcttcaggggagaagggtgggagaggtcagagagtcattcctgcttctgatatttcctcaaaggtcaatgtgccatactttggggtggtgtatccctgaacccctttttatatagtgtatatttatgtatatacatgaaataactcaaatagaatcatgttctatctgtagttttgtaacttttttgttcacataaaaatgtgtcttaagcccgggagtggtggctcacacctgtaatcccagcattttgggagcccgaagggggtggatcacttgaggtcaggagttcgagatcaacctggccaacatggcgaaaccctgcctctgctaaaattacaaaattagccaggcgtggtggtgggtgcctgtaatcccagctactgtggaggctgaggcaagagaatcacttgaactcaggaggtggaggttgcagtgagccaagattgtgccactgcactccagcctgggcgatggagtgagattctgtctcaaaaaaaaaaaaaaaatctccgataactttttttggcaaaattagatttatgatattctttttaatcacatcataatatatggttaacccaccatttatttaattgagccccatggacatttagatttttttcaatttgtttttttttttttgaggtggagtcttgctctgtcgtccaatctgaagtgcagtggcacaatctcggctcactgcaagctctgcctcccggattcatgccattctcccacctcagcctcccaagtagttggtactacaggcacccgccaccacgccgggctaattttttttttgtatttttggtagagacggggtttcaccatgtta

SEQ ID NO: 32872 - DNA, 1055 bp, Homo sapiens
ttagtccccactgtcctgtaagtgctcagcaaccagctccattgccctctgttggtcatggtgacctgaagccccatggtttcagtcccactcaccacagtgaggcctctgggaaaatgggaagggtaatgctattgatttgggggaaaagaggcttttcccccaaaactaccttgcgcaatgcttattcctcatttgatggttaccagtaggcagcgcagttaagcacagtctgaaccttttctaagggcacaggtgtaacagagcaacacgctgctgctgtttcttggttggaggggctgtgaaggccaggctcttacagccctcttttggtcacaaacatcttattttctgagttgttttgacttgaagaaattagggtgattattttggaaggatacatgaaattattttcacagttaaattaacttgatattgaaatgcaagttttcttggcacccgtggatggtaagcagtagggagtctgctttaggcttagttattgatgctgttagaacaactcaaaggaatttagaggagacgtggattgcagcctataatacctttaagttaaaaaaaaagatggagtcaggaatgcttcaccatggagttgttttgtttgtttgttttttgagacagagtctcgctctgttgctgagggaggagtgcagtggtgcggctcattgcaaactctgcctactggcttcaagtggttctcgtgcctcagcctcctgagtagctgggattacaggcatgcaccaccatacccggctaatttttgtagtttagtagagatggggttggccatgttggccaggctgatctcgaactcccggcctcaagtgatctgccccctctcaacctcccaaagtgttggcattataggcgtgggccagcgcacctggcccaccatggagtttctgctataatttatcttttgatttattcatcaactacttagcatttacctcttgccaaacactggcaggtatgggagatatagcagtaataaaagcatataaaaattcttaccctcatggaacttacattccagc

SEQ ID NO: 32873 - DNA, 1354 bp, Homo sapiens
attttgctgtaaccccttgatgcccatctttattcagacaggaacatttacaggagttctactggctgaatgtcactgccgccacagtggctcagatttgatttctaaaaaaggagcctgttcttatcaacagaagaggagaatatcaggatgttaatatttttcacttgttcagattcagagacagtaattataagtataaacatgacagcataaaatcaatatttgaatttcctttcttggaaattcttatccttctccttcaaaaaattgtttctttaactgcatgctttttggaattagtacttttatttttattttatttattttattttatttttgaggtggagcctcgttctgttgcctaggctggagtgcagtgaagcgacctcagctctctgcaacttccgcctcccaggttcaagtgattctcctgccttagcctcccgagtagttgggactacaggcacctgccactatgcctggctaatttttgtatttttagtagcgagggggtttcgccatgtaggccaggctggtcttgaactcctgacctcaagtgatctgcctgccttggcctccctaagttctgggattacaggcatgaatcaccacactcggcctctggaatcagtacttttaaacttcttatactcacttcaataatttctcaaattggagattaaatagctctgagctccagagactacaaacaaaaagaggttggagctgtggttctggggtgttggagaatgtaacaccacccttcatattccttcatttttcccatgtaatgttttttccttttctgcactacaaggtactgcctctgtatgtatacctgtctgttgatattattggctctcttcattccagtgactgttttttccagtgtgtgatccagccacagaaattaattcaggatgtgacctcaagttgcttttcttttctgggcctgcatttcaccatatcataacaatcagggactgggcaggatctctggagtagaacttgccactggttggatgggattgactaagaaagaaagaagagaagaaaaattactcaatgaagtagaccgaagcacttggttgccactcattctttattctccaatcatacgtttatttgtttatttattcagcaaatatttactgaacatgtgccaggtactgttggatacactgggaaatacaatgatgggcaacaccagacatgatccctgctctcatggagcgtacatgctgaggcatcacactggcaggtccaatgaaatggaaatgtggaatataactaatggaatgattttgaacagttaaagatgaatttcaggggaactatgttacgatatcaa

SEQ ID NO: 32874 - DNA, 1034 bp, Homo sapiens
ttgtccattgtcccttgataccttactatgtcccatgaactagtaattccttttccaccaaggaggcaggcgtgtgcattacattttaatttctggccagattttcttcccattccaacattctccaaatgctgttagcaatttggagaacacacacacctctcagacagtttttaccatgatatcttgcaagtaaacttggtcttggtgtttctgaacttggtccaagtagctcactcaaatttcatttcaaagtagccatccaccatcttatacccaaaggagtgacactttgctctgatcatctctaatctatacactccagaggctcctgctggagggacaaggtatgcattttttgaataagtaatgtttcatttagttgtctcctcctgtctcttctccttggttcatagtagagttggggtgaatggtggatgtgggaagaattagagtcttgtctgtcctgagtaattcaactctaggttctttttatagggaagcggaatgtcagggaggaactggtgctggatgtggagtgttgctctggactggggacagtggatttggagtcaggagatgtgggtttgcaacctgctgtttccatttagtcttatttgttaataatgtggaactcacagggctattgtaagggcttttttttttttaaagacaagatataaatggaaaattgtgtaaatcatgaagtgatttacaaataatatattattaataaggaatgtaaagggagtattggtttttatggaaaaggatactgaaggagattgggctctggtggtgataaagtagagagaaagaggtggagacggcagtcagggtgtaatagacaaattcctctacttagaaaaaaaaaagggccccttcttcccataaagttatttatttatttatttatttatttagtgacagagtatcgctgtcccacccaggctggagtgcaatagtgccacctcagcttactgctacctccgtctcttcggttcaagaaattctcctgcctcagcctcccgagg

SEQ ID NO: 32875 - DNA, 1147 bp, Homo sapiens
atgtagtacaggcctggtgaggtggcttatgcctgtaatgctagcactttgggaggccaaagcgggcagattgcctgagctcaggagtttgagacctgcctgggcaacacagtgaaaccctgtctctactacaatacaaaaacttagccaggcgtggcagcgtgtgcctgtagtcccagctacttggtaggctgaggcaggagaatcccttgaacctgggaagcagaaatttcagtgagccaagatcgtgccactgcactccagcctgggcaacagagcgagactccatctccaaaaaaaaaaaaaaaatgtagtacaggtttgctgggtgcggtggctcatgcctgtaatcccaaccctttgggtggatgaggtgggtggatcacctgaggtcaggagttcaagaccagcctggccaacatggcgaaaacgtgtctctactaaaaatacaaaaagtagctgagtgtggtggcacacgcctgtaatcccagctactcgggaggctgaggcaggagaactgcttgaacccaggagacggaggttgcagtgagccgagattgtgccactgcattccagcctgggtgacagaacgagactccatctcaaaaaaaaaaaaaaatgtagaatgggttgagtatcccttatccaagatgcttgggaccaaaagcatttaactgagcaggacagtagcatcatcaggataccagtattggctgttaaacaagaacaataacaaataatggcagatttttttatttttctggtgtggaattttccacttttggtgtcaggttggcactcaaaaagtttcagattttggagcagttcagatttcagatttgtggtttagggatgctcaacctgtagtctcttaaattatgtggaaaacaaaaagtggagttacaaactgttgttacaataatattagtgtttataattgctcatgtatttacttttaccaagatctttatctcttcatatggcttcaagttactgtctagtgtcctttcattgcaacctgtagcactagttttagcatttcttgcagggcaagtctgtggtaacaaactttcttggcttgtatttatccggaaatgtcttgaattcttcacttctgagggtcagttttgctggatataatattctt

SEQ ID NO: 32876 - DNA, 1047 bp, Homo sapiens
cattttgtgagggttttatcatgaaggaatgttgattttatccaatgctttttcagcatctattgaaatgttcatgtttgtatggcttttgtcttttctttgagatggagtctctctctgtcacccaggctagagtgcagtggtgtgaccccggctactgcaacctccacctccaggttcaagcaattctcttcagcctcccaagtagctggaattacaggcacccaccaccacgcctggctaatttttgtatttttagtagaggcggggttttgccatgttgaccaggctagtctcgaactcctgacttcaggtgatctgcctgccttggcctcccaaagtactgggattacagtcatgagccaccatgccaggcctgtccttcattttgtcaatatgatgtatcacatcgattgatttatgtatgttgaaccatccttgcatccctgggataaatcccacttggtcaaagatctttttaatatgttgttgaatttgatttgtaggtatttctttgaggatttttgcattaatgttcatcagggatattgacttgtagttttcttttttgatgtgtctttgtctggttttggtatcagggtaatactagccttgtagaatgagtttggaagtattccctcttcctctattttttgaatcatttgagtaggattggtatttatttttctcttaaacgtttggtaaaattcagcaatgaagtcattgagtcttgggctgttcattgctggcagagtttttattacagctttgatatcattactttttattatggctttgttttcattacttgttgatctgttcaggttttggatttcttcatgttacaatattggtaggttgtacatgtctaggaattatctatttctctaggttttccaacttattggcatatagttgttcatagtagcctctaataatcttttgaatttttgtggtattggttgtaatgtctcctttttcatttctgattttatttatttgagtctcctctcttcttttcttagtctggctaaaggtttgtcggct

SEQ ID NO: 32877 - DNA, 1071 bp, Homo sapiens
gccttggcctcccaaagtgctgggattacagacatggtccactgcacccagcccacattttctttatccattcgtctgttgatggacacttaggttgcttccaaatcatggctattgtgaatagtgctgtgataagcatgggattaaaggtatctctttgatatacggatttcctttcttttggtatatatctaatagtggaattgctggatcatatggtacttctatttttagttttttgtggggcctccaaactgttctccataacggttgtaataatttacatttttcaccaacagtgtacgaaggtttccttttcatccttgccagcgtttgttattgcctatcttttggataaaagccattttaattgggatgagatgatatcctattgtagttttgatttgcatttctctgatgatcagtgatgttgagcaccttttcatgtacctgtttgccatttgtatgtcttcttttgagaaatgcctattgacatctcgtgaccatttttaaatgagatcgttagattttttttcctgtagagttgcttgagctctttatataatctggttattaattccttgtcagatggatggtttgcacatattttctcctgttctgtgggttgtctcttcactttggtaatcgtttcctttgtggtgcagaagctttttaacttgatatgatcctgtttgtctattttttctttggttgcctgtgcttatggggtatttttcaagaaatctttgctcagtccaatgtcctggagagtttccccaatgttttcttgtaggagagttatagtttgaggtcttagatttaagtctttaatgcattttgattttatttttgtatatgatgagagagagaggtctagcttcattcttttgcgtatggatatccagtattcccagcatcagttatcaaagagactgccctttctccaacttatgttcttggcacctttgttgaaaatgagttcactgtagatgtatggatttgtttgtgggttctctattctgttccattggtctatgtgtctgtttttatgccagtaccatgccattttag

SEQ ID NO: 32878 - DNA, 1081 bp, Homo sapiens
aacattgacccctcacagcaatgatgtgtgacaagacacatggagcagtgccaaccaggaaagctcccccaagctttggtgtccacagtttttattcagacatcatgcttgactgactacatagctgaactcagtctctagctcctctggaggtcaaactgatatcccaagactcaaagcctccactgtaaatgagtttgtgtgatccaaattctcaagataaaggacattcttatcaggcaggatatgctgagggtttagagattaccaggggcaaagaaagagcaaaggccagccctgacttaaaatctatgttatataacccattactcagcttcaataataagtatatctccaaccaccttccctttccatattgttttccattaaaactatgtggaggccaggtgctatggctcacgcctataatgccagcattttgggaggctgatgtgggaagattccttgagcccaagaatttgagaccagcctgagcaacatggcaggacattgtctgtacaaaatattaaaaaattagccgggtttggtggcacacccctgtagtcccagctactggagaaatggaggcgggaggatcacttgagcccaggaggtcgactacagtgagctgtgatggcaccactgcactccagcctgaccgacagagcgagaccctgtctccaaacaaacaaacaaaaatttagaaacataataaaatggcaaaaatagtatcaagactacatgtggatatcctaatttttgtattttaccccatattccttatcctctttttgtctttatctatctagccatacatataaacacataattttttcagaactatttttcacaattattcagaatacattgcaccaatggagctcctgtaatctcttaattatcccttaatactccatgcattttcaaaaaacaagaacactctcctatgtaaccacagtacaacccccagatttaggaaattcgtattcacacatttttatcatttaatttacaaaccccattcaaattttgatgatagacccaattagattcttgctaagtatagaatctaatctaggat

SEQ ID NO: 32879 - DNA, 1041 bp, Homo sapiens
acattagatgaacttaggaaattttattatggtcagtcagaaatcattaaaaatgtatatatatattggcagttatgcttcattttaaccagattgatttgggtcaattaaaggcttaagttcttttaaacctaaaactttcaaattggtaaatttggatttttgaccccgtttactataacacattggactttttgaagtggaaatttagttgtatttatagccatctaccatccctaccagtactgaattttcagttgttttcacttaatattattagaaaaccataaggcaaaatgtacctcgtataacttgactgttgtaccaggtataataatatgatgctcacttgtaactgtcatgggtcagtaataaaattgaggttcttgaagaacttacatatgcatggaggaaaatatttcataagtcacgaattaaaatacttttttgtttttatattgcagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacaggtaaaaatgaaataaaaccttactaaataagaaagggtaaaatgaggaacattcatcaataccactaatatctgagcgtagaattatatatatggaaaaagatttgaaaagcatcttttttcaatattatttatatgcacttttatctttttaacctcctaacaggtttagatacagcttctttcatatggtaggcacacggatttctgtttttgttgttgttgttatttaagctaaaatggaagtcaactcaatgtttctttctctatagattattgcttgggttagaatatgccctactggtttggtggactcctaaagtagaacatcaagggggattccctatatattactatatcgtagtcctgctgagttatgctttacatcaggta

SEQ ID NO: 32880 - DNA, 1014 bp, Homo sapiens
gcactgaggcaggaaagtacaaaaaagtacaggacattgcctaaattgtggaactgggtttgggaaatcgtgctgagaaaggctgtgactaaattagtaagattttctttaattactatgggaaaagagtttaaagtttgtcctgtaagtaatggagggtaagttctaaaaaatttccctgtttctctgcatgagtaaaacacatgtaagtttttctcttttttcttttttcttcttttttttaattgagatagttgggggtcgggggggctgtctcactatgttggccaggctggtcttgaactcctggcctcaggtgattctccccctccttggcctcccaaagtactgggaattataagtgtgaaccaccccacctggcctaagcttttttgtttgtttgtttgtttttaacttttgtaacaactagaaaacaagtaaaatgaccaatatcaggaataacaatgtcaggaatatagtgaaattcttcattctgtcagtgatgatgaatttaggggattctgttttgaaatttaagcaactgaacttctcagcttctgtgctaccttggaaattcacagtagagtaaatgtccaggtatgtggtggtggtaggaggtgtcacaactacactattttcctgcaatcttattctcacagacatctaaccttatgtacacctcctcaaactgctaatgagtgagccactattactggtgaaatgatggtgatagtactttttcctcagttgtttggttgagagataattgctttgcacccaggtagatttgtctcagtgttctggggttccactcctgctttatgaataattcactgctggccgggcacagtggctcacacctgtaatcccagcactttgggaggctgaggtgggaggatcacttgaggtcaggagtttgagaccagcctggccagcatggcgaaaccccatttttgagactctgtctcaaaaataaataaataaataaaataaaaaataagtcacgactgggca

SEQ ID NO: 32881 - DNA, 1024 bp, Homo sapiens
gttcttcctaaagctagtttgtcccatgcccaggaatgaactaggacagcttgatggtcagaggcaagatggagttggtcaggttagatctctttctctgtctcagttataatcttgcactgacggtttcactttcattatcttccaactaatccttgaattgcttcttgggaaggtgtcaagagcctggacactggttggggttgaggccccaccagcatttggggacctccctaacccactggtatcaataagacctaacaatcctattcctaggtatttgcccaagagagatgaaaagatatgtttacacaaaaacctgtatgcaaatgtttatagtgacattactcatacaaaaaatgggaaacaatccaaatgttcttcaactggtcagtagataaatacactctggcatatccatacaatggaatattactggggagaaaaaaagaaggaggtggggatgcgggacaatgatatcaatgaatctcaatgcattatgctgactgaaagaagacacactcaaaagctacattttgtatgattccatttacatgatattttggaaaaagcaaagctatagggagagaaaatagatcggtggttaccagaggttggggaatgggtggagaggttgacttcagatgggcacaagggtatgtactttttggagttgacggacctattccatatcttgattgtggtggtggttctataactatctatttgttaaaactcatagaaccgggtgatgggtacgccaaaatctcagaaattatcactaaacatcttattcatgtaaccaaacaccactcattcccccaaaaacctataaaaaaatatatattttttgagactgagtcctgctctgtagcccaggctgtgagtgtagtggtgcgatcttggctcactataacctccatctcccgggttcaagcaatcctcccgcctaagcctctcaagtagctgggattacaggtgtgcgccaccatgcttggctaatgtttatatttttagtagagat

SEQ ID NO: 32882 - DNA, 1029 bp, Homo sapiens
acagttaagctttgggactctggaagaaagcagccatctaaacatttcagaacatgtaccaggtgttagctgtgaccttcaatgacacaagtgatcagattatttctggtggaatagacaatgatatcaaggtctgggacctgtgccagaacaaactaacctacaccatgacaggccatgcagattcagtgactggcctgaccttaagttctgaaggttcttatctcttgtccaatgcaatggacaatacagttcgtgtctgggatgtctggccatttgcccccaaagagaggtgtgtaaacatagttcaaggaaatgtgcacaactttgaaaagaaccttctaagatgttcttggtcacctgatggaagcaaaatagcacctggcacagccgacaggtttgtgtatgtgtgggataccacaagcaggagaatactgtatgagctgcccggccatgctggctccatcaatgaagttgctttccaccctgactagcccttcattatctcagcatcgagtgacaagagactgttgggatatggaatggaagactccaaggctacttgtctttgagacctcagactgcataagtgacgtcaaatatttattgcccaggctagcaccctcccttcagatgacgattactggcaagaaacagaggaggtggtggccatattccaaaaaccactgctatcccatttcaccaggatgactaaggcaagctccccgtggcctctaaaatccacctgcctgatttcaggaactgttttgttttgttttttgagacagagtctcgctctatcacccaggctggagtgcagtggcgcatctcggctcactgcaagctccgcctcccgggttcacgccattctcctgcctcagcctccgagtagctgggactacaggcacctgccagcacactcggctaattttttgtattttcagtagagacagggtttcactgtgttagccaggatggtctcgatctcctgaccttgtgatccacccgcctcggcctcccaaagtgctg

SEQ ID NO: 32883 - DNA, 1033 bp, Homo sapiens
caggtactagtaatcaaaaagaaaatttcttgatatctcccactagcattttcagatttagaatttaaccatgaagtacatatctagaactaatgacagaaaaatcgcattttaaaataatattacagttcttctgtaaacctcagagtgatttctgtgtggggaacttgctgaccagaaaattaaatgagaattttgtacatcctcagatagccaaatagagttaaagggccactcccacaccacccccttcaaaaaaaaacaaaacatgttttctctctttttacagatattgacacagtatagtctcacaatttttctcaagtgggatattaatgagggtaagtagccaatagtggcagggctagatacacctcagatttcgagtgcaacaagggtaagccccattaatccatgcaaagaactttcatgcatatagtttagtgcatataatatgattatagaaccagaagttctttctttaacattttgcttttcactaggcaagtcaatttacccagcatattctgaatagtgacatagcatttttcacaaagccagtggttgactttcatgttaacaatgcctcaaaaataccaaacattatattataaaatcccagtgctaattaaacaatgaacatttgccttcctgggtattttacaggtttacttaaaaaactgagcatgtgtatgtttatttgtaaagctcaaatatttaaacttgcagaagttgtgcctacaagcagttgaaagtataaagcaggttttaataaaatgtagtaaaaaatgaacacctaattgcagatacattgcattttctttgaagctaagtttccatagcagtgtagccctctctttcataaatcagctgcattgtcactaaagattgggtattcatccttttactgtctctacttgtaagtggacataacattagaatcctaatagacattctggataagttgtacaaggccattcttggggccaagcaacagtaaatatttgaaaggtaataaagcaaatacctagaa

SEQ ID NO: 32884 - DNA, 1054 bp, Homo sapiens
agaaaatgctaacactatcactaaaattgaccagcatattcgggggatagcaaaaaaaatagttaactctaacattattggagaagtatacatatgttgcttttctacttgaattgccctttctgaatattggaattcaatatacaaaagttaaatgtcaatgttggcagtaaatccttttgtcttttttaaaaaactagaaaaatcgcagaggtgtatcagactctctgagtttctctaactattataaaatcatatcattacagccatgaagaaatttagatgtcatgaagatcaaattcctcattttatagatgaagaaacaaattcagacaggataattaatttatttttaaaatactattattattattgccagtactatgcaaggcactagtattagtctgaggattcagcagtgaacaggacagatgtggtctcttgccctgaatcaccacaaagttaatggaggagctggaaccggaaatgagcctctagatttcaaactaaaagacttccattaatcaactactgactctataccagaccctaagtgtttcacctaacattaagtcttataaccttcactaatttagaataaggtggaacatgccttcccactcccgatgtctctcctgtgtgtagggagctcttttaccataataatcttggctcctctttgttgcctcatttactttacccaaggggagagtgacttatctgagttaggaaagagtaacagcatgagtaatccagccccttcccttctcttttttttgggtgttgggggactgagctgtctgaagggaatgtttgttcgggtttgctcttccaggccctaaggagaacaggagcagaaggagtcctcttcagatcttgtgattgggtaggcaagtctcctactggggtttaaaattaggaagcccactttcccacaggtatcagttctctcatcaataaaatctcaatgtgtgtttgtgcaagagagaagcatttcataaaaataaaactaagcaactggtactatcatatttgaaccacctaaaaccagcca

SEQ ID NO: 32885 - DNA, 1031 bp, Homo sapiens
ggccgaggtggtgaaagaggcatgggttctggagttcaactggcctgcattagaagtctagtcctcctactcagtggccatgtggccttggacagaattgcttaacctctctgagcctgagtttcttcatctgtgggttgacaatgataaacatttcccttgtgtgattgttgtgagattcagtaatgtatgtaaagagacattagcacagagtaggaggtacttgatacatcttgctattatctcttccttaaaggcatagcccaattcctagcaagcagaaaggctgaccctggtatcttgtcctaggtggatctcttgtttttcctaaacattagtgccccttatggcctgtgttattccttgagcaattaaaacacatcactctatgctggcaagtgtcatttatcgtgtttggcctgattcgccaactagactccaatcagagccaggactgtttgttatacttcattgtatccttagtcttaatcagggacccaaaacggtaggtgctctcaatgactgtcgatgacaattattaactgaagtcagttaacaagtatttatggagtatttactatgtgtcaggcagtgggccagattccaagaatactgaggtaaaagaaacccagcccctcactcagggagctcctgctgtggctaaaagctttgccaagacatgaaaagttaatgtacttttctgagcatctaattcccagggaatgactttgttgaagtaatctggctcactgtgtctcaaacagaaggcaaaagccaagtatgcaaccaggaagctttttacactggggagtacatagcattgcatttagtacccaaggacgctggggccattcaggaccccacaggctgttcttacctcctgctcctgaagagcagcccaacagctctcattcccatcaagataacagcctgcaagtgtgggggacagcttgctgctctcctcaccatgagaggtcagtgcaagaccttggacaaacccggtcagtgatggattccccttgtgagtcatt

SEQ ID NO: 32886 - DNA, 1313 bp, Homo sapiens
agtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcaggtaggtgtatatttcccattttgttctgtaggataaatcacacaaattttcggtggttccaatacagatttagcaaaaatttaatttaaaacattctgttcttatggtttagattccgttgccaactcgtccccattggtttcttctttttggtactacagaagaggaaatccaggaaatctgcatagaaacacttaggctttataccagaaaaaaggtattctctatttactcgtttgtgccaacatgctaagagtccaagctactctaaggaagaaatactaacttttttttcctccaacagccaaactatgaattactggaaaaagaagtagaaaaaagaaaagtagccttacaagaagccaaattaaaagcaaagggattgaatccggatggaactccagccctttcaaccctgggtggattttctccagcctccaagccatgtaagatgtatttagaattaaaatgacttgggggcactgaaagtgtgtctttattagagagcttttacatttgaaagttgcatagagaaaaatgatgttaggaaactgctgctatgttctctcatggcagtcaaccaacatggaagcggaagcatggtactttgagttacatttagaaacaacttttggccctctgttaaatccagtagttaacatgttgttattatatcttttaaaagcatcaccaagagaagta

SEQ ID NO: 32887 - DNA, 1035 bp, Homo sapiens
gtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttc

SEQ ID NO: 32888 - DNA, 1028 bp, Homo sapiens
aattttggccatatagaatgcatgaaaaatcagtatgatcttatgaggactttatagtactgtaaatcttaggagcactttagttgttttgtttgtttgtttgttttaccagtcaaatagcagtgggagattgtataccaactttagtgacactgatattagtaagttctgataacccactaccatcggaccagcctggagcacattactttggccagtggaaagtctcttggagagactttgaggtttgtgatgacaaatcatgctatcgttaaagttaaatacatatatatacacacctagaatataagcagaatggaaaagttggcagggatgaattcaagaacattagagtgaatttttttcattacagaattgttagttcctttaggaacttagtctcgtagatgtatatatttaattagcataacttggacagcacaagattaatgctttaacttgtttgcaggagtttaaaaagctggtttctgttgccaatagttggttggaagggaaaatggagatgccacaaataaaattttttggatgtgcaaaacagttttgattttatttcttacaaactataggactccaagccccctgatccttgatcagaactacattaacaccaaaaatcaagttatcaaagcagagaggagggtgctaaaggagttgggattttgtgttcatgtcaagcatcctcataaggtgagttgtagagtacagaaattgggttcgtaagtattaggacttttctaaaaattttattttatatgaatttatgtttctatctgagtgttaaccttggttttaaaaagcattcttttaaaggttcaggcttcatcgaaaaacattcttttggatgttgagatttatcagtaaaatgacagtcaaaaatgtaggttcaaatcttaaatcttaattgtgtgctcatagagaagttatttttgtttctgtggttaaagtcccagtttttccacctagaaaacagagatgtaaagttcctcattccaaggaataaatgtgta

SEQ ID NO: 32889 - DNA, 1022 bp, Homo sapiens
agttgttaattgcatggaagcctttttttaaagcaggatgtaaaagtgtttctatgcatattacaagtttactcaagcacgtaacttgtatatgttattaacttcaactcttttttcccttgcaaccgactatacagcgaccagctacatttaccaaagcctgggtgatgtggagtggtacatagagatgaagctgtcgtcatggcaacagtgagtgaagtatcgaaaatccccaaggagaagccagtgctctgagaataggtcactggaatcggggactaacaggttggccactggtgaaccatttagaaaaactcctgtttcttgttataagcttttgtctttgctgtccaagttattagaactatagctttgtatttatttttgcataggttaatgtcattagaaagtactatcagtattatacattggttaggtaaagcatatcacttgtcttaatgatgctatttgttttaatctagtttattcataactttaaattgtagtgtgactttgacaattacagtggagatacattattcatgttgcttgtaggtcattggtctcttcagcctggctacacattgagaattagcagaggagctttttaaaaagtaccagtgcttagtccccaacctggattgtttggcctattcctccttcagttttttgtggttcgataattatcttttaagttgacaataaacagctaaatttagaggggggattgctttttcattgttctagtttccaaatatttacttttgagatgcagcgtattaaaattttcaaagactggtttaaccattctcattagtaaatacaatgtattttcagtgtatccatagataataaaagttggataggtaagaattggaagggtgttaagtgatgtcatttagtctaccacctttctacagtataattctgtggctctacaaggtggccttcagtttgtttaaatacctataaaggatgtttctacttttaagtaggcattacaaatttttgtatattgcttg

SEQ ID NO: 32890 - DNA, 1060 bp, Homo sapiens
ataatttgaaaaaagaaacataattaaccggttatctaaagtttgtagaggcagttgcatttatggacaatcctaacagtgctgtgaagccaggcctgtggcttaagattaaacaagaaagggagtacatttggctcaagtgtgagtgtattctgtaagttatttttcctctcccctctctggaagactgaaggctggaagtttaaacactgtagtttaagttaatattgtggcaaagttctgtgtagattatgtttttctactcgaagtcccagttaattctttatcaattgaggttggcttttgttagagtacttctcaacattgaactacgataaatcgaataataccggatctgaaaggactgcaggatgataaagtttgaagtttgaagtcaaagggattaaacaggtattttgttttggttagatacagtctcagtgagtgggttagaaaattaacaagtaagattgattgggttgcatttagatagggccatttatttgatgttgtaagaaaatacagagactgaaatagtatctcctaggtgttgtggtaacataattttatgtggacctatgtgttcctgtgaggcagtaccaaaaagtttgttgcaggacttcctgcatctacaggtgacttccagtacatgctgcagaatgatatatttggtgtagaatagtttttgcattcactctttaaggaattgtagtgatgttagacaaattgtactgagtttgaaaggaagttattaaaaggattataagttgttctgggggttgggtatgttggttagtgctgttagtattctatatgagtagtccttattggctgaatctgtaagttggcagtaatggaactattcagacaagcaaatattaaagcaactttaagatgactagtctattctgtgagtctacagacagttcttttttaaaaaaagagtatcctagtcaaaaagtctgcaacagttttcctacatactttttctcccccatcttttctcattcaccttaactgtgtccagggatagagtactttttaaattctaaaatatctt

SEQ ID NO: 32891 - DNA, 1030 bp, Homo sapiens
ggtggcgtggggggaagcgtgtggggtttgtgcgcgcccttcccagatgttcccattccaccgaaatgcatttttcaccagcgggaggatgggcccgcagcccggatggcccgcaggcggacgtggaagttcgcggggccgggctgcaggagggggtgctgaaccagacggcgggactaaagctagcctctagcgcagagtttgccgggagggagaaggggcagaggtggaaagcttaaccctccggtcgcctaggtgtttggggccgccaagacccctcgaactccgcagagcccctgaatctttggatcttaggggccaaaacttcccattctctttcaaggtagaaggaagccaacgaaagctgaggtccaggctacgctgcttctcccgggcgaggcgtttcggtttcttggtgtgttgggggcggggggggggggcggcgggggaggtggggatctatatttacacaattcctttagtgttttcaatcacccagtactcggttctcttagagcaaaaatcctttggtgctagctcagtgttaggaaacgtctttatctcaatggcagagcgttctataccaattcaaaggagttcaacaataaaattgatttggcacttggtgcctgcagtaactggtgtactgccatatttttccaattaagaaaatatgtggcatgcgtggaatcacatatttaagcaagcaattaagttgtttatgacacggtctgttcctgtttagatcagtaattggaaatttggggacaaaaatagagattttattaagtctatggatcaacttgaaatttggacatctcctcgaagccccaaaactttgagtggcatccactgtgtagatgacatgtaatagacaaagccttcccacctcattggcagaatttgaagggtgtgttttcatatttaaatttcaatacaatatcagtaaaaatactttgctattaaattggcccataatgtttactataatgttccttcctaaagaaaggacaaatgtccacaaaactaa

SEQ ID NO: 32892 - DNA, 1046 bp, Homo sapiens
tcgcttgaacccaggaggcggaggttgcagtgagccgagatcgcgccactgcactccagcctgggagacaagagcaaaactccatctcaaaaaaaaaaaaaaaggcatgtactatatatgttgccgcagttagacaatgagattgtgtatgacagagatctactctgtcatacatactcttcctttacaggaaacctgtaaaggaagttttgaaaacaaaggtaggagaatggagcccactgtactaaaaataattttaatttctcacagatgcaagcagtcaagaaaacacaggaaatctaagaacaaagcattggtgcctccaagcttcctagtttttgtcgttttacattgacagttcattcacaacagctgtggctgtgagtaagcatgtctttctttaatggtgacacagctgtacaaatcttccagcttctggtccatgaaacagctatgacaatcacttagcctgccccctgctgcctatctcacaaaacagcaacgctgtcgggttttcagactgacaattcctcttctagaagaaacaaaagttatggctaccaaaaaattcgttaagattttgcttcaactgataaatttctccaggaatatatagatggattgggagagggtgggggtaggggacaaattcaggcactcagtattccttccaaggcctaaccataaggactacagaaggctacagcagattccaagccagctcaagaattcaaggcgtaagtcaaagtttatctcccagatcagcccttgaagcttttaaatcttcaggtggattctggccccaatatggtcctgcagtgggttctacaacaggaatagaagctctagggttaaacagggcttttgtgcctgccgtatttcagaaggtaaataaaacaatgtggaaaactgtgtaaatttattattctcttatctttaagaatcacagttccacagtcttaaatgcctattacattttttgtaataatagttcttgaggaaagtgctgaatcttgtattctgagtgttggggaactgtctctttc

SEQ ID NO: 32893 - DNA, 1030 bp, Homo sapiens
acctgggatttcaaaggggaggtcaggtacaatcaagattagagaaggtgaagaattgtaggaagagtccaaagcaacagtaactggtctaaaaagttgtttgatttggctgagagatgcaaaccacaggcctcctttgcctcaaacttgcctaataactgtgctttgttagttgcatgctctgggaacatagagactaggaagcataacaaaagcaaggcaaagccaaggatttcagtgaaacacttcctgttaatacacagtatctagactgcactttcaaaaagcatcacggtaatcatagctcttaatctttcgggttagtcaagtcagatttaactatgatactttcctcaaaccctcttctagaacaaaaaggttgagagagttttattagtagcagcaagacagaatcccaggtgtacaatatacagtcaggcctctccatgggttctgcatctatggatacaaacaaccgagaatcaaaaatatttgggggaaaaaaatggatggtagcatctgtactgaacatgcacagatttttttctcgtcatgattccctaagtaatataacaactatttatataacatttagattgtatttggtattataagtaatctagagatgatttaaagtatatgagaaggtatgcataggttatacgcaaatactacactgttttatgtcagagacttgggcatccgtgcattttggtatctgaggggaatcttggaaccaatcctccatggatactaagggacaattgtaatgactctcctcacctttaatctgctctatagagatcctcagggccactttttatggcagtcacaagcaaagctgtgctttcagaagagtgaagtcttgagttataatccaacatttagcttttgtgctcagcttaatacagattatttcccttagcaatctaagttttgtgttcaaattactatagtcatgccatactgaaactatctgttttttccctctactgtacagtacagaaaaaagctttaattacacaatcac

SEQ ID NO: 32894 - DNA, 1022 bp, Homo sapiens
ttattattacagttttattataaaggatagacacagagtttctgtgccctcttctctcaggacacatcaccttcccagctcatcagtgtgttcactaaccaggaagctccgctgagctttggcgttcagaatttgtatggggttttattacattggcatggttaattaaatcattgcccacatgatgaaccagtctgcagcctgcttcccatctccagagactgggaacctgaaagttcagaccttctaaccacatgcttgatctgattatcagcccctatcctgaagctatctaggggcccaccaagagtctcctcactagcaataataaagatactctaatcactcaggaaattctcagggtttttgaagctccaggacaaagaccagataaattattgattgtaccagagtagcatattaataacagaaaactgagtagcacataacacgttgcctggcattatagtagacattcaacatgtttttcctttgcggaatatgatggtctattgttggggcttagaaactgataccccaaaatatggtgctttgacatgctgtgctgaagttcccttatctgcctcaacttcagacccaccaaagaagacaacaattccctctggtcccttccctgagttttccttaactaaactcatattgcaggaagaaatacagaaagctgtcaacacacctgggcagacttttgtcacaaaccattgtgtgctctgtgggcccaacagactgttccaggccactgtatgttcttcatgcccactgaattcccctagaaatcatttactacccgttctaaaaaccatccacacttccccatctccatttcccttaagaaggggaagaagtggcttttaaccatctgcaccccattgtatggtagggtaatcactctctgattctcccccatgcaagctaataaatttgtatgccatttctcctattaatctgccttttgtgagttgattttcagttaaccttcaaaggacaaagaggaagttttcctt

SEQ ID NO: 32895 - DNA, 1023 bp, Homo sapiens
gtttacttttaggataaggttcaaatcacttgcatttctttagctgtatattaactgaatgttagcaaaggtaaccagaaatactaagtagtatttcttttctaagcttaaatgtttgctacagataatctcaaggcagaatatttattcatgagtagaaaattcagagttcatagaagtagccgtgggtaagtttcagttaacagcaaaagtcaacttattgttactttagtaataaatgtacctttagaacataaatcttactttaatctcctagtaggcagatggatttacttttggcttcatagatttttcttttaagactcattatttgacattctcactttgtgacaaatgacttatgaataattgacagaattctttcagagatcactggccttttggaagaactacaagaatttcagctgctgttactactgagacagtgtgcagcagctgaagtgctatatccgtttttcctttcttttctctttcttctatcaatttgttgcctgtagatgacacagatcttcagagaaattctaaaagcccatcccactatccaccatggaagattttttctttttctttcttttcttttttctttttttttttttagacggtcttgctctgtctcccgactggagtacagtggcaccatcttggctcactgtaacctcctcctcctggactcaatcgatcttgccacctcagcttcccaagttgctgggagtacatgtgtagagccgggattttgccatgttcccaggctggtcttgaactcctgggctcaagtgatcctcctgctttagcctcccaaagtgttgggattgcaggtgtgagccactgtgccagtctgaagatttgaattctttcccgagacccttcaccagtgccctcccagtgcttcttccacttccttcaatttttctgttatctccttcccatttactacctgtggattcaccatttcagatgttccagagtctaaaatggaaacttggaataagttgtttaatataa

SEQ ID NO: 32896 - DNA, 1032 bp, Homo sapiens
tctatctcctgacctcatgatccactcgcctcagcctcccaaaatgctgggattataggcgtgagccgccacgcccggcccaacaacttaatcttttattagctttgcttaagagggccaattaaatcaaagccctttagttccctttaacagggactggagttatgatgcatgtgttacgacttttggcccactgtccatgcaactctaagtgcaggttgatttgctttccagaaatcccaaaggggctgctcttggatcaccgaagagccttacctatatcaaatcaaaaagacattctgggtcagattagactatgctcctggccctacagattgcacataaactatcataaatacagctttttcagggaactagttctaaaactcttacctgctgagaataagtcttaacactaagatgactgtattatatcaatttattattagaatcagacttatacctagcacaattaactattgtgtgggcaaagaacatttaaagggcatagtagaggtaaggagagacacatactcagctagagataaaaatactaagttgcactgattacttaaaatactagtcacaccataaaagtgccctgtagtttcaaaaacacgtaagcaatgaaatgttagccattatgtgttaaactacttaatctcatttctgtgatgtgaatatttttaaccccctttttgtagatgagggaactgacaagtgacttgtccaaggccatatagctgtgagaaaacccatgcattctcttttcagagttcatgctatcactcaactttaaagtaggccaagattaatgttggtaagggtttgtaatctgtaagaatgctaaaaacgtaagtatatatatcattttagatttgacattttgtatcttgccagtttttaggagaacttttcattttgttaagtatgcatgaatatagttgagtatatgagtaactggttcttatgctgctgttttgtatttttaccagcaggaagattgcaaaagttgatgtatgtaaatcttga

SEQ ID NO: 32897 - DNA, 1040 bp, Homo sapiens
taacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgatccaaggcgataaggaagctgttctccagtattttaaggagcttaatgatacattagaacagaaaaaaaaaagtttcctaacggctctctgtgatgttggcaatctaattaatcaagaatatactccacaaattgaaagaatgaaggaaatacgagagcagcagcttgaattaatggcactgacaatatctttacaagaagagtctccacttaaatttcttgaaaaagttgatgatgtacgccagcatgtacagatcttgaaacaaagaccacttcctgaggttcaacccgttgaaatttatcctcgagtaagcaaaatattgaaagaagaatggagcagaacagaaattggacaaattaagaacgttctcattcccaaaatgaaaatttctccaaaaaggatgtcatgttcctggcctggtaaggatgaaaaggaagttgaatttttaaaaattttaaacattgttgtagttacattaatttcagtaatactgatgtcgatactctttttcaaccaacacatcataacctttttaagtgaaatcactttaatatggttttctgaagcctctctatctgtttaccaaagtttatctaacagtctgcataaggtaaagaatatactgtgtcaca

SEQ ID NO: 32898 - DNA, 1645 bp, Homo sapiens
atgttgcctgcagactgcgcctgcgctgcgaggctccgcgaggccccgcccggtctgggcacctgaagcccttcggggcagaggagggcggggactcggggcggctctcagcatccgcctggagctcgtggcgctgtgtttccgtgctgtggagttgcctggtccgcttcctccccgcggtgagtctaaggacctttacggatgcggagaaggtggttctgagtcctttttcttttcctgtagcacagtctggtgtgcctagtgtgttgggcggggagtcctgggggcgcgacgatggagggagtggcttgggacctgcactcattccctcttgtcccatactggagtttggggagccactttcccgtccctccactgtggagctgcgttcctgtgagggaggaggccctctgtggtggcgagggtgagctgagcggacgccgccgagtcggtcagtcccgcggggttggggacgggcgggtgccgaggtggaggcgcgttaggagggaggcctgggagagtggagctttgagaaggggaagggaagagtactgccattttgagcccctttgtgggaggtgctcgcaggacttaagtgaggtaggtgcagttacccattttacagatgtgaagcctcacttttgagaggtatttggtaatactgacccaggtcccacagcattgaaatggcagaacagagagatgagcaaactatactaaatcagttataatttagagctggcaaggtattttactcccatggatgcttttgtcttgcagttaattttaagcactctaaaatgaccgtgaatgttttttctgccatcaccattgttgggtaatattgtcgagagctcataagctacttgacgttgtgaaaagaggtcctttgtgacagtctgtttggtcagagttaggattttcaaggaacaagcgatacctctactgcagctccagcaactgtgttggtgtttgtggcttttctgaaaacacgatgaagcatcgtgaagataaatatcaaagacagtgaactaacaaccatttttatgacatgagacaataaattgaaaacattaaagataacattattttaattttagaataagaataaaagattctggaggagttggagaagagtgtattcagcccccaaaccacgagatcaacaaagtaggtaatctgggagattaaataaatatgaaaaacaattaagtttttacagagtgtatgatttaaactacaaagtgaaatttagaagtcttttgaaaaaacattgtgttggcggtgtataaaactccaaccattttatcgaaggagcggagcataaagtgaaaaataaacaactcccttctctgatctgtaccttaaaagtagtcacttaactcttttgtacatccttctagaaattttacaagaatgtgtacatctcaaaacacatgcaaagttgttattttatacatacagatctgcagaactacacaaaactgcaaattaagttacctggatactttttcactatgcattcatgtattggtctttttaaatgagtaagtagctatttaatctggcaaggtgaaattttgattttaggtgatgttagttttgacattgcctttcactaaacacgttgatgaatatttcccac

SEQ ID NO: 32899 - DNA, 1025 bp, Homo sapiens
ggtgacagagtgagaccccatctcaaaaaagaaagaaagaaaaaaaaaaccttctataaactgtttcaattttctaaaggatggtaagacagtgttggcattcatcatctctccagacctttttttaagggtaatgggattagtactataatactgtttatatatattttaaaactaattatcacattctttttcttttttttcacctagattgatgaagaccctagccttgttccagaggcaattcaaggcggaacatttggtttcaattcatctgccaatgtaccaacagaagggttccagttttagaaagatgttgtggaagttaggtacaatgcagcactgagatatatatatatatatgtgtgtgtgtatatatatatatatatacatatatataaaaaggtttgatccatcaagcttggctcatgggatctgctgctgcattaaatcgggaaagaaaatgtgaagatttcatttggaatcacagaaaatgcccaaatgaggtcaagatggcgagtgggtgcgagtgagaatgagtggcaaaatgtaatgaaaactttacatgaatgcttatttaggttgttcaaagtaaaaagggctacaggtcacagatcgtcagtgcctgagaaagaacattgacttactctatatcaattgaggggaaagtgcagtaccgtcatcttcaagccttgtaagcataaaagagaataggctgcccatataagtcaaaggaaaatgagcccaggccttgctatgaagcagtgtgtgaatggacaatgttgaatgaatgtctggctcagtgatggagagccaggttcatctttgaaatctagggctcttcactcatgaagcagactcctagtcctggagtgactgtgtacgagagcgtggttgtggtgctgtatgtgaacgcatgcaagcttgattcaccttcagggggctgataacctagtaaatcatcaaaatgagatcataagtgttaatgtacactggacatgaaaacaaagactggtttagcagca

SEQ ID NO: 32900 - DNA, 1050 bp, Homo sapiens
cccccgtctctatatattaaataaataaataaatcctgcgcaacatagtgagaccccatctctctatatttaattaattaattaattaaattaaaaatagcatacagcctccattaacagcctccttaactgatttcataatttcttactcttaaagggaaaaatctttgaaggaagtatttcttatggcaaagaaatgtttaatatgaagttgagtgattcctttattttaactttacgttgtttttttctaagttcgggaaaaaggaaactaaatttaaaagaaaaggaggttagattaataatgtgggcacacttaacatgagagagatgaggtcatatttctatactcgaaatttcaaaatcagaattattccagtgagataacatggcacacaaagtttacctatattgcattattttatgttgtttttattcttcaggtggcttaccttatccaacaaaatgttatcccacctttttgcaacttgctgactgtaaaagatgcacaagttgtgcaagtagtactcgatggactaagtaatatattaaaaatggctgaagatgaggcagaaaccataggcaatcttatagaagaatgtggaggtaagtttattataagctcttattccacatcttaatgttctctttgtaactacctttatttgccgactaatatagcacatctatatttttctgtcttagatattcaagtaacagaataaagtaaatattgtattctatatgtgcagtcctgctcagcctcttgcatatgcttaggtaactgaattgctgccatatattgaacaggcactgtgataagttactgggaagacagtggtaaacaagacacagtccttgccctcaaggcatgtagtctagtcttgataaatatgaactgatttaatgtgctaattaccctaatagaaatgtacaacaaaatgggatgcctaatccattctggaagaagcaggaagtgcacctgagctggattttgagagatgaataaggattaataaggtaaaaagggatgaaaggtgttccaggcag

SEQ ID NO: 32901 - DNA, 1074 bp, Homo sapiens
tgtgtattggccatgattctttagtaaagaacttgtcttgttttttgttttgttgtttttttttagacggtctcgctgtcacccaggctagagtgcagtgacacgatatcagctcactgcaatctctacctcccgggtttaggcgattcttgcgcctcagcctcccaagtagctgggactataggcgcacgccactacacccagctaatttttgtatttttagtagagatgcggtttcaccatgttggccaggctggtctccaactccccacctcaagtgatcaggtgtgagccatccatgcccggccaagagcatttctttatcagctattgtttattaatactttgaaatacagttcatttaggataggcaagataaatgtttgattctttgtccttatcagtcattttttagaatgactcgttccctaataaccttgaaagcagaccagagtagatttttttttagtgtcatttggaaattatgaatttttaaaatatattttgcaagttttaataccttttagttgttactctttttgatactctgtttgttcctgaccaacaggaacctcttagaattggtgacctgtatcttttatgttatcactagtttttgagagctacaccttttggatatgacatgattcccaggcctatcttacatgttttctgatctagaactggaattaactatttttctatggtatcttgattttgttttgtagagaatggtgtttaaggatcatatttcagctataaaggtgatcattgttataatgttgtcattttttctaggcctgaatcaacaaaataaatgataggcattgtagaaagtgaaagatgatgagttcaggaacatgagagttcataaaaaatgaatcatgaatgaaagggagctattaaatattattggatatttaagataacagggtttttaatttttattcctatgattttatatttacatctcttttatgctgaaaatcttcctaaaaacattagcataattacttatttttcttacattttggtatgtatagatctgtggatacatgtcaatatacattattt

SEQ ID NO: 32902 - DNA, 1224 bp, Homo sapiens
aggctggggtgggaggatcacttgagcctgagaggcagaggttacagtgagctgagatcgcaccactgcactctaccctgggcgacagagcaagaccttgtctcaaaaaaaaaaaaaaggatttcacatagaatgtcatctcattgtgcatttcagactgctgcacttagagctgtgggcaacattgttactggaactgatgagcaaacacaagtagttttgaactgtgatgctctttcacacttcccagcactcctgacacatcccaaagagaaaattaataaagtaagtactattaaatactacttaatagatagcacttaaaatgttaacagtttctatttgtaaaattagagtcttagaaatgtctgtaatattgattcttaatacaaactgtcatttagacatcaagagaaaataaaaattttactctccataacaagcattaataattttttcatacataaaaccagttatgaaaagtgcaattttggctctcttggaaatgatgaaatagagataattgggtgttgaatgttgtatgactggaaatttttaatatgtatattatgtaattcttataagtttagtgttttataggtacttaatagagagtgtgtatgcatgtgtgtgtgcttgtggtggctatggaaagggggcactgactggtgatgctgatattggagtgcatctgaggctgttgtagaaataacatgggttgttgattacaacattgccaatgattataacccaagaacagctcacctaactagcctggcaccctaaaatctctaacaggttcattaaaatggtcctgtgatctgatccaaaagagcctagtatacattagctaatactaatattttttagagtaaaacttattagttatctatgattataacgcgtaaggccaccattattttgtcaaaagtagcaccaactgtgatgtaaagggtaacataaaaagattaagataggccaataaaacaatcaaatatctggttccacttttccttgagagaaattatgcagtgaatgactattacaaataagtatactaaaacaatgcactttgttttttatgtctccattgttgtggataattgatatttatctactttggctaagattcttcatcagaatagaatagagaataaagcacattatgtgagggaagggcactgaatcttatttacagctgttttaggatttgtatttgtatta

SEQ ID NO: 32903 - DNA, 1033 bp, Homo sapiens
aatggcaaagcattattttcaccttttaggagtttcggggtgtctttttggttttttttatcttatttttttattttctcttgggtgtcctaagcataacattagtttacagttttacgatttttttaaagtcagggtcataaaaacaagaaaaaataaacaatgccgaattgtttctgtttttcatagagacggggtttcaccgtgttgcccaggctggtctgtaactcctgggctcaagcagtccacctgccttggtctcccaaagtgctggggttacaggcgtgagccactactccctgcctagtttattgttttaaaggttttacacttctccagcttgtcttgacacagagttcatattctggaaaggctttggaagtagttttaggcacaattattattcccatgtctttgtcaataatttgtgtatttatttgcagcagttacagttgtttgtcatactgccctttggtcataacttctaattaggacctaacgtactaggaaagatcaaacacatggcctgttgtacttaaagatgtaatcgttaaaaaaaatggtaggctacttagtagaagttgattacacaggcttttttttttttttcataagtagcagctgtagtgaagtacgtattttttgttttaattacaggtctcacagattgacctatgattattttaatgtcttgatctgcagctgtaggggacttccactatttaagaagttgctggccgggcgcagtggcttacgcctgtaatcccagcactttgggaggccgaggcgggcggatcatgaggtcaggagatcgagaccatcttggctaacacggtgaaaccccgtctctactgaaaaatgccaaaacttagccaggcgttgcggcatgcgcctgtagtcccagctactcgggaggctgaggcaggagaatggcatgaacccgggaggcggagcttgcagtgaaccgagatcgcgctgctgcactccagcctgggcgacagagcgagactccgtctcaaaaaaaaaaaaaagt

SEQ ID NO: 32904 - DNA, 1062 bp, Homo sapiens
tatacaccaccatggaatatctctaagttctataaacaaagtaaaccaaaacaaggtaaaaaacaggatagatagacgtgtcagaatcatggtaaatctaacagtgttttctatgagataaggaaattgtgggtgagcaggagggctcctttggctttttttcgctttttttttttaaatagttgaatttactaatcttgtacgtgtgttattttttgtaatatcatcggttcatatgaggggtgagattatgggctcttttattctttgtacctctgtatttttataaaccttatattatagtttttaaaattgtgatatagccaatattgtattaataatttcaaagagatttttcatgttttgcaatatgaatgggaaatgaagattgaaaatcatctacatagtatgatttttattatgagtaagatttgactttatatccatatggctaaaagaaaagattagaggtgtatattgaaatgttaatagtggttttctctggataatggaatttgaggtgattttaaaaatattttcctttaatttttttgtagactatgagaagacaacgaaatgaagttgtagttgaattaaggaaggtgagtctgattaatattgggtacttctaagcataattctaacaacattatagcattatatacaagatgccaaatatatattatgtttttaggtaaaatgtataacctattgtataactaaattttatttactaaatttagttaaactttttaaaatctcaactgctaagcatttttctttagaaaaaggagagattttgactaaatttgacaggcttttgaagttgaaaggatacaactagttacttgttcattatgcaaaaacagatataaagaacttaaagtataagtcattgagatacagttgtattaaatagttctgctattaatgggcagtagtaagtccctgaaaagaacttgttgcaaacttcttcaacttttaagtattatagttgagaatatatttataaatttgctccaagcattttaagtgaagttgaaatggcccttgatttttgta

SEQ ID NO: 32905 - DNA, 1076 bp, Homo sapiens
gataaaagacttaaacataagatctgaaactggtaaactagaagaaaatagagaaagttttataactttggtcttggcactgatttcttggataagacacttaaaagcaaagctataaaagcaaaaatagacaagtggaacaacatcaaactgaaaagttgatgtgcagccaaggaaacaatcgagtgaaaagacaacctgcagaatgtgagaaaatatttgcaaatgatgtatctgataaaggattagtatccagaatatataaagaactcctaaaactcaacaatagcaaaaaccaacaaccctattttaaaatgcgcaaaaggcttgaaaagatatttctctaaggaggataaacaaaatagccagtaagcacatgaaaagatgctcaacatcagtaatcattagggaaatgcagatcaaagcaactataccatctcccacccattaagatgactactatcaaaacaacaaaaacaaaataactgttggtgaagatgtggagaattcagaatcttgtgcattattggtgagaatgtaaaatggtgaagctactatgaaaaacaggatggtggttcccaaaaagtgaaaaatagaattattatatgacccagcaattccacttctgagtatatatccagatgaattgaaagcgggaactaagatacttgtacactctagtttatagtagcagcatttgcagtatccaaaagtggaagcaaaaggttatttaatgtataaaatagatagataaaatgtgtatgtacatacagtggaatattatttagacttaaaaaggaaggaaattctgacatattacaacatggatgaaccataagcattatgccaagcgaaatatgccagtcacacacaaaaaaatactgtataattccacttatacaaggtacctagaataggcaaatgcatagaaacaggaaaaggaataatggttgccaggggatagagggaaggagatagggagttgtttaatggatgtagtgtttcgtttttgcaagaccaggatagttttgggagatttgatgcacaacaatatgaacattcttaatgctgccgaa

SEQ ID NO: 32906 - DNA, 1034 bp, Homo sapiens
ccaacaacttggataacctagatgaaatggataaattcctaaaacacataacctgtcaatactgaatcatgaagaaatagtaaatctgactagacctataagtagtaaggagatttaaaatctcccaacaaagaaaagcccaggatcattggcttcactggtgaattctaccaaacatttaaagaattgatgccagtcctgctcagactctttcaaaagatggaagagttccaaactcaaggccagccctactctgatactaaaaccagaaaaagacattataagaaaagaaaactacaggccagtagccttgaggaaaatggatgcaaaaatcctcaacagaatactggtgcaccaaatccaatagcacattaaaaggatcacataccatgaccaagtggaatttatgcctggggtgcaaggatggttcaacatatgaaaatcagtatgatacaccacattaactgactgaaggacaaaaatgacacagtcataccagttgatggaggaaaagttcagtaccagactttgacaaaattcagtgccctttcatgataaaaacactcaaactaggaatagaagaaaattatctcaacataataagggccatatatgaaaagcccacagcaaacaacatattcagtgatgaaaaactgaaagcttttcctgtaagatcagaaataaggcagtggcggtgtgtgctggctcatgcatataagtccagtgctttggaaggaggcctcagtgggagaatcacttgagcccaggagttcgagagcagcctaggcaatatagcaagaccctgtctctacaaagaaaaaataaaataaaaactatccaggcatgcaggcatgcacatggagtcccagctacttggaaggctgaggggggaagattgcttgagcccaggattttgagactgaagtgactgccactgcactgcagcctgggcaacagaataagactctttcaaaacaaaacaaacaaggatgctcacccttggcatttctcttcaacatagtactagaagccct

SEQ ID NO: 32907 - DNA, 1050 bp, Homo sapiens
gtggtccttccccgcctgcccccgccgcacccctccgggcccggagccggctcctcccagcgtcgttcgcttcccctttccgttcgctctttccgccccggctctccatcgccccttctgattggtcgaacgcaccggagcctggttagccaatgggcgagccgggctggaggcgatgggcgtggccgcagcgccggggccctcagatcgaggctgcctccccctctcagccggcagcacattccgtcgccttgccgccgcccggccccacagttgtctttgccggagctgcagtcgcgctggggttagggcgggggggcgggcggggagaggagaaggccgcggcggaggcaggtgagaggaggaaggaagcggcggcgcggcgggcacagcagctcaggcggcggcccggttcctgggagtgtcggtgcggcgcgttggttggggcggatcccgcggggcccgggcgggggaaggagtcaccggcccggccatggcggacaacgagaaactggacaaccaacggctcaagaatttcaagaacaaaggccgcgacttggaggtaaactcggggacgacgccggaggggtgggggctgtgggcctggggccggtctccgccgggaccccgagtgtggggattaggggcgggagccgcctccaggcctcggggaatggcgctaggggccggcccgtctgtgacgcctctgctagcgcgccgggaagtttatgtcgggcctgctccgcctccgccggggagcgaggtgcccgggtacggccggcgcggcctaggcctgcccggcggagccggcccggcgcgggtgcgaggggccgggccgcgcggcggggaggccgggcgcggcgcgtgcggaggaggcgtgcgtgtgcggccggtgctgccccggccgggccgcggccccttccccggcagtggcggagattccggctctcgctcgggcaccgacgtctggcgccgcgggaaggagggcggtgggaatgggagggtgagcgtgtggcgaccgagtggggctctgaacttcctcagcgaggc

SEQ ID NO: 32908 - DNA, 1049 bp, Homo sapiens
aacatatcttctttttaaaggctgaataatattccattttttatacataggtgcttttagtactaaaaagaagcaactgtgtgaggtgatggatatgttaatatgctcaatggtagttatcattttacatgtatatgtatgtcatgtgcatgtacatgcataccaaaacatcatgtacatgtttgtatactttaaatatatacaataataaataaattagatagatgttttttgaaagaaactatttcaaattgtactacgtactccctcctgtaaatagagcacagtgaacagtttcactatgtgtgagtgactcatgcctgttataataaccacctttattataagaaatagaataagaaagaggcctcaaatagctgatatagtgtttatgatgatatattccccctcagaaattcactattctgattagtacttaatttttctcctttattctggtcttgcccattctctgtcatcatttcttgattttaatcaattgtcttgtagctctctgccattttctttctatctctagtctctgtttaacctttcacttcttttttcagtcaacatgcttttttgtcttattgtttttatcattttcctatgcataaagtttttgttgttgttgttgtgctttggctttgatggccatttggtcagatatctctttttcttagctctcactaaccaatcttgtagtggtttttgttttttattgttaaccattaaagtcataaggctttgttgactgctgaatccattcctaatttgagaagttagggaagacatccgacagatgaatattaagcattgctatataaaaagcaagtattctaggctgacggtgattacactttatattctttaacctgtgctgtcatttgtggttaatataaagtgtagccaaatttgatagttgtaaactgtttcagcctttatccaacagcccagtaggtcctgtgagtttagtcagtatggatcattttgtatcagcataccttgttttacttacgatctctgaaaaattgaaggcaaatatttac

SEQ ID NO: 32909 - DNA, 1034 bp, Homo sapiens
ggtaagctggcaagctggagacccaagaaagctgatggtttagttgcagtctgagtccaaaggtctgagaaccaggagagccaatgttgctgttccagttcaaaggccagtaggctcaagacccaggaagagccaaagtttcagttcaagtctgaaggcaagaaaaaagcaatgtctcagtttgaaggctgtcaggcaaaaagaattttctcttagtcaagtgaaggtcagcccttttgttctaatcaagccttgaactgactgaatgaggcccaccaacatgatggaagcaatcccgtctatccatgccactgatttaagtgttaatctcatcttaaaacactttcacagaaacacccagaataatgtttgactaagtatcttggcactctgtggcctaatcaaattgacacgtaaaattaatcatcatagttgacaagggagtctcatcctgttggcaagacttgccgtagagggaaagggaacagcaaaagaatctagaactggcctatgaataattttgatttagaatttaaatcacaggaaatactctattgtttttgaaatgtgattgtgacatcaccagtgaggtcagtctttacagtaattttggttctgaatatgaaaacccttaatttttaaatttggcaaatcagtggtctattttgggaccacctcccccactacctccatgaaagccaaactttatagcaggggagtccaatcttttggctttcctgggcctcattggaagaagaattttcttgggccataacagtaactgatgagctttaaaatgtatatatatatatcgcaaaaaaacccatgatattttaagaaagtttacaaatttgtgttgggccccattcaaagccatcttgggctacatgtggtccatgggccacaagttggacaagcttgttctatagcttaccaacaagtaggcctaaagagggaagatgaaatatagttcattttaaggggaaaatagcctacaaaagtttaaccttctgaagagtcaattgaggctgttg

SEQ ID NO: 32910 - DNA, 1029 bp, Homo sapiens
aatgtcagataaatgaatagagaaactggatatatcctagagattggtagtaagatataccaaaataatttttatttcagaaatagcagcagtcattaaggtaagtaacgtactcttaggcatgagtagtgttttctaagactgaccaaatagcctctaaatccttgcctttgggggatataggttaaataagaccaagaatactcatggggccagaaggctggctggtgagcagcagcaagaagggtcatcctagagcagtagttctcagaccagggacactcttctggagtacagtgaagggtgagagggtaggggattgagtgaaaacataatccctacataagtatctttaaactagaaagtctgataattttcttcagcctcagtggataaaaaacaaagaaagctgggaatacttgcagtgtcactatcaatgcatggttttggtgaaaccataggtagatattgctggggagaaaagatttagcgcaggtctttttctggaagaggctgtgacatatgtggtaactttgaagaacctaaggagactcacttggaataaatagtaacattcatcttttggagtttgggcagtgggaggagtggcagcagccaggcagcccagctttgtgaaggccctcagcatgccatggcccacatgcatctgatatgcgccttccccacttccaggatgcccaagaggacggtcagctcagctgatgggacagtgagggaagatcccaaaaggagattgatgtggttgtcagctaaacctgctctttcagtagtggaaattgaagccccaaaaggtagcaggaaaagataaatcttcaggcaaaaaagtgcaaacaaaagagaaaagagtaggaaagtgaaaacaagccaaagtagctaagaataaagatttacctgcagaaaacagaaaaactaaaactgaagagagtccagcctctgaagcaggagagaaagaagcccagtctgattaatatcgcataccatgtcttatcagtggttccccgtctctct

SEQ ID NO: 32911 - DNA, 1053 bp, Homo sapiens
tgtttaatttccttgtgtttgtatagtttcaaaaatttctcttgttactggtttctagttttatttgattgtgtttagagaagatgtttgatactagttgaatgttttaagacttgtattgtgacctaacatatgatctgtccttgagaatgatccatgtgctggggaaaagaatgtgtattctacagctgttctatggaatattctgtttaggttcatttgtctatagtgcagatttagtctgatgtttctttgttgattttctgtctgaaagatctgtccaacactgaaagttgggtggtgaagtctccagctattattgtattttgctcagtctctctatttagttctaataatatttgccttatatttctgggtacaccaggactgggtgcatatatatttacaattatcatatcctcttactgaattgacccctttatcattatataatgaccttgtctccttataatttttgtcttgaaatctgttttgtctgatacaaatacagctgctcctactctttttttggtttccatttgcatggaatatcttttttcgtctctttattttgagttcagatgtctttataggtgaaatgtgtttctcgtaggcaacaggttgttcttgttttttaatccatttgccactctttttcttttgactagtttagtccattcacattcaatgctattattgataagtaaggacttacctctgccattttgttacttgttttctggttgttttgtggtcttctcttccttttttccttcctttctgtcttccttttagcaaaggtggttttctctggtggtatgttttaattttttgctttttatttttggtgtatacattgttttttgtttcgaggttatcataaggcttgcaaacactatcttattacctattatttcaaactgatgtcagcttatcactgattacataaataagcaaaaagaaaactaataaaatctctatacttcattactgtcattttttagcttttgaaataaacaagcaaaaagaaaactaataaaatctctatacttc

SEQ ID NO: 32912 - DNA, 1054 bp, Homo sapiens
ggagtgacgcgattttccaggtgccgtccgtcacccctttctttgactcggaaagggaactccccgaccctttgagcttcccaagtgagacaatgcctcgccctgctttggctcgcgcatggtgcgcgcacccactgacctgcacccactgtctggcactccctagtgagaggaacctggtacctcagatggaaatgcagaaatcactgtcttctgcgtcgctcacactgggagctgtagaccggagctgttcctattcggccatcttggctcctcccttatacatttcttcacacctagtagataaatccttgacatattttttcaattgtatatttactttaattttgcttctgctattttgagtgaactttttggaaatcaaaatatattattgcaagtctttaaatgataacagtgtcaaaatatattatcgcaagtgcttgaaagacaaaagtgtttaaatgatatctgtggtttgttttaggttcaggaagatttgactgaagagaaaaaaagggaactggagcataatgctgaagagacctatggtgaaaatgatgaaaatgtatgaccgggatacatatttctattgagcacttgagtgtttgtgggtgtgcatgtgtataggagagatatatgtatttgggatacgtaccagtgggtaatggtacctctgagttaccactgaatttaacaggcccacctgaaattaggaaaagttgtgacaacatgaaaagtaggagagacagcagcactgttgcttacatatcatttttcttccttttttttcctccaaaaatgagtaatttttcatcctgtttttagagagaattatttatcactaactctatactatctcttagtttttcttttttcttttaattttaagactgatgataaaaataatgatggagaagagcaagaagttcgagatgacaaccgccccaaaggccgagaggaacactacgaggaggaagaagaggaggaagaagacggggctgcagttgctgagaaatcacatcgaagagctgaaatgtagcggcacccaatt

SEQ ID NO: 32913 - DNA, 1034 bp, Homo sapiens
cctccaaacatttttgtaaattttacagtctctccttctggcctcttccttcttaagaattcagtatcttaattaaatttaacaataaaagaggaggaaaaagatgtaaagagctcagctgaataaaatgcatttggatagagtttcttaatattttagtttgcttttcattgtaaacttcgggcatcttgttgttaattagatataagtagcgtttattgtggtgctgcttacggtgtagttgattattgtggtgctgcatgtggtgtaattggtgaatgctgcttgttgtagccgttttatcacagcattccgctgcataaacaactgcaatatttaagagtctgatacaaattaggccaagaccctgtatttagtctcattatggaccagtaagtagttcccaaattaaaaccctggttcagagctgcttctcagccaggtgtcttgcaaatgtgtggttttatccctatggggaaccccatgggaggatggacatatggcagactgaacagacacaccccatcactggagatcctgtgcagaaatcatgagctgtgctctcacacacacagttccctcgactaggtctgctttcttgttcttactgattttgtaagcttttcagagctgatgataaaatttgtgcttataccaggaaaacagaaaaggatgttgctctttaaggtcactggcaacatttctaataacatgcactttaactggcttgatctttttgttctttggtttctcatcctaatcaagacccttggctgtcttgtcagaaagagagcagcagagaaaatagtgaccttgaatattaagacattgggcaagaaaaagatattcatccaggcttctcatataacaggatgtctagactaataccactttgttttattatgtccaatactaggaatctttgagggattaaaagagaaaagttcaccttggcttcttttttaaaaattcagaagattaaacataaaattttaaccagtgtttactgattccttttcaattttatattatga

SEQ ID NO: 32914 - DNA, 1033 bp, Homo sapiens
tccgcctcctgggttcacaccattctcctgcctcagcctcccgagtagctgggactacaggtacctgccatcacgcccagctaatgttttttttgtatttttagtagagacggggttttaccatgttagccaggatggtcttgatctcctgacctcatgatccctccacctcggcctcccaaagtgctgggattacaggcgtgagccaccgcgcccggccctgagtcacctcttgaatgctttgctgcttagaaatttcttccaccagatccctaaatcatctttctcaagttcaaagttccacagatctctaggtcagaagcaaaatgccgtcagtctctttgctaaaatataacagaagccacctttgctccagttgccaacaagtttctcatctccatttgagaccagctcagactggatttcagtgtccatatcattatcagcattttgcttaaagccattcagcaagtctctagggagttccaaactgtcccacatctttctgtcttcttctgagcctccaagctgttacagcctctgcttgttacccagttccaaagtcatttctacatttttgggtatcttttcagcagcaccccactctactggtaccaatttactgtgttagtttgttttcatgctgctgaaaaaaacatactccagactgggcaatttacaaaagaaagcagtttattggacttacagttccacatggcttgggaggccttacaatcatggcggaaggtgaaagttacgtctcacatggcagcagacaaaagaagagaatttgcgcagggaaactcccctttttaaaaccatcagatctcatgagacttattcactctcatgagaacagtacaggaaaaacctgccccatgattaaattatctcccactgggtccctcccaccacatgtgagaattcaagatgagatttgggtggggacacagccaaagcatatcacagggatacgataatgagataaagtaattcagaaattctcgccctcaatcgaggttctgttcttttg

SEQ ID NO: 32915 - DNA, 1050 bp, Homo sapiens
aaaatctagatgccatccaaatttgatccaggtgtgggtgaggccccttaggtatccatacaatctttaactataattcttcaagtatgcttcctctttatctgtagatctgtgaaaccagagtcaaattacctgccctcaacacagccaacatatggtggtaggacaggcataaaatacctagatattcctgtttaaaaaaaaggcagaaatgtgagaaaaataggagtcacctgtcaataggaatttgaagtctgttgaggcaagtgctcctgtagtaggtctcaaagcctgggaatagttctccagggctcttgactgtaccatttggtttcttggttccactctgagtcatctttcctttttcgtgaaaggtggcatatgtttgcagctgagtggttttctcagcctgcttcctaccggtagaattttaaggacccgtggcctttttaaatttagtactgcttctaccccttttggtccaaataggcagtggttctgctgatacaatcttctcaaaaagtttgtgggtctcctgtgaaacttctttgaattttctccattagccaaaagccacattcatatatctcttggagataagtcttctctactttgggcttgtgccaagatcggggagagacaatgcatgcccttaaatttcccaaaggctcattatgaggctctgaggaacccttaggaggttctgtcatctgatgaaatagtactctgagatatcacttttgatcattccaagattttaacaaaccgattttataagacaccctccgcttttgtctttagaccatgtttttctgatagtgtcctggaattgatcttatcttaaaagctgtttcttaatttcaacattatttgctgtctagagaagctaagaattttcgtaactatcaagtcctgcctcctttttgtttagcagtacttcccccaatgtatctctttcttctcatagtttaccataagacagtaagaagaaaccaggtgacatcttcagcactttgctggtaaatgtccttaactggataagtcagttca

SEQ ID NO: 32916 - DNA, 1035 bp, Homo sapiens
gaacttcagcctcttcgtgttttaatttgggttagcaatgtctaacttgcaaacttgtatggattagaaatagtgcatctgaagtgacgagtatgagtcctggagaatattactactaccatttattaggtgaccagaactactgttgttgaattaacattgggcttctttttattttgcccagcctttactacatctagtaggtaagagtgttattagtgctggcctaaaagtggctcctttcactatgtgccctacttggctgaaactttttgattaagatattctcactctgtcttttctacccttttgagccgttcttggggtggaaaaaacctgaaaatgctttacatgatagcaactaagagttgttgtttttcattttgacagccaatggttcttcttttatcattaaggacaaagtggttttgctacttttgccagtagatggtttatgggttttatagctttattttgaagtgaaagttatatatcatatagctttattataaaagaaaaatgataaactatattttctttttagccagtgttctttggagtgaattttagtagaattttgaaaacttatttgagaaaattaaattatttttaatccataacatttattgagtacctaccatgttcgggttcaatgctaagcttattacatgcattatgtcatttaactgtgacactagcactttaatctgaatgagcaatctgaggcttagagaggttaattaacttgccagtgtcaagatctagcctgatgaaactaagcttagaaacctaatgtaactttttccatagtgcatcattgccctcaaaattattttagtgtctctcatgacagtattaatggttttaagaaagtaggttaggtgggtcatatggggattcatgataaaatttagaatcagaaataacgggtgtactatttgatgcagcatttccagggtacaagaaatttgctgctggtatgaaagatgattttggttgatactagagttgattttatgtggcatgtagatgttg

SEQ ID NO: 32917 - DNA, 1032 bp, Homo sapiens
tgcagatacaatatgaagtttgtcagttgtatagatagattcaaatgaaagtgatttgattagataacaaatgaaaagaaaatttctgtgtttttcgttggttcattttaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggtacagattttcccatagtacagcatcatggttacattatgcatgaaacgtacatttcctttgattaccaaaaagcaaatattctatctttgaaatattttagaatccaaatggggtcagatgcctttctaaaaatgttcatatctttactgtatttatgaccaaatccaaaatagttaagcaagaaagcaattaatttagctgcattctgtatagaaattttatgacaagccccatcctacacttatctttccttgactttgcaattctcttacttttgtacagttagttcatcatgtttgtttacaaatatttatgtattacctcagagtcattttccgtgtctatacttttgtcaatgtaattatattttaagatttttctgaaaagtgaattctattttttgtccccttctatgtctagtaaattgttaggtgtagttaattagcaagtcatctcatgttgtaatttaatagtaaaatgaggatcagaaaggaagtgagttgccaaaggtctacaccaacttactggcagatttggaaataaaacctgtcaatttaaattcaacaaatgaatgagtgaatgaatggtactcaaatttattaggctctacaacattgtatcagcactatggtaactaaaaataaatctatttaagggtccataaatagcaattaaaagagcctcagtgtttttgttacaaaataaaggaagtcggtacttttttgtttgacatc

SEQ ID NO: 32918 - DNA, 1028 bp, Homo sapiens
acttttaatattatttttggttatttgcacattttatttccaaatgtttggctttgagtacatctgcaacagactctcttttacttacatttctatcctttcttcattcttttatattttctttcttttaaattggctgattatcatgctactacattccaaggaactgaggagacagtcttttcctaagttataatttacacattgatgtgaaaaatcacttaaatcttctgttcttcatcttctattttgctttcaacaagtgtttcatatggttagatttcttctgcaatcaagttttcatcctttaaaaactacatatattccttattaaatataccaaaacatgtataagcaaaatatatatctcctttaaccaagcaaaatgatatttttaagcgtatataacttttgtgtctcctggaagagcttctaacccactgaaggttttcccagtgactcttgtcagaatttgtcattaagagctagatctttttagttttccattaacgttcttaactgttctgactactgatggtctgagtcctatgctaataaaaatcaagtagtgaatttccaagtacattatcctttcattatccttttgttatttagtgattcatatttgagtaaatatcttttctttgttattaacattatacaaatgcaagagattggatttttacaggaaatggcctaatttttagtaattaaactaagtttaaggatattgttttatagcaagtagtagttaataaaaaggaagcatctgctttgctgtaagatttgctagtaggtagcatttagctttcttgtggaaattaaccttgattcaaacattccatttaggtaaacagaggaaattcaacagagttataacaatatttaatttttatttccaaagcttttactcaaggtacagttacatgataagcaaaaattactaagttagtacaaatgttaatttctcaaaggatagattgcaataaagataccaacacagaagtaattttttgtttttgtttcaa

SEQ ID NO: 32919 - DNA, 1049 bp, Homo sapiens
ttaaggttgactacattaccaatgagtcattttaatagagaacaagtcacactgcttggtttatgctgagctacaggtctaggactgatggggagtcctgggggaggggactcagcagataacatactatcaatgtgagcttatgactgcttagttgacagcttaaaaagagagaccggctgctggactgaaggaaatataatatgtccttttaacgagctgaatttgaaaaactttttgaggaaaaaagaagcaaggtattcatgaagggctttgtttatcacagttgccagtctacatctttattagcttgtaagaggtgccaagtgtagatatttgtcagtttactgtggagtaattctgtccttttaaaaacttttagtggcatgatattgagatggccctattgttacattcttgtttaattgttgactttgtgttgattttattattcgagtaggccccacctattgttttagaggtcaacgagctttttcattgcatttcatctgaactgtagcccctagtcaactgcactttcttcttaggcaaacattccgcagcagctgggttggaaactatcattccacacatcacagcaaatcttagacaacttgagtttaattattccctgttgactggctttgccattactaaaatctcttttaacacactagcattgagagtggaagtgtagggtttcttagctctcagcacaatagcttttgcattaatatctcatggcttatttcatagagcaaaggcctacttgtggtctttaaaatttgtttaaacataaattacaaagaaaggcatgggtgacacatagctatatatagagaaaagaaagcacatgagtagccttagatactttgtaaagagtgaatatttcttaaaaaataatttttttgcctttcaagtgaatgttaaagggatttttaaccacacttttgtttttcctagttttcagaaagcatttatgttttattactctgttaaataaatattgtgggcgtagtatattaaaaattgaacttttcattttactt

SEQ ID NO: 32920 - DNA, 1051 bp, Homo sapiens
tgtagagggaggacagaacaatgctagaatgaagccatggtctctaggcctgggcagagaagctcagtcccgggcagatagtgtaagctgtctggggaagaccttactctaaagcaatagttttaatctttagtataatgtttagagtcctctaagacctaattgcccaaatatctgacttgactttgctctacattttgcctagactccaaactaagatcgctttcattttctgttgctcggcattatgtctgcctaaattttttccttcagattgcccacatccactttactcattagaactctgctaaatgacaagtttcccatggttttcttaattcccttttgaattttttttagacaaacctagatcttgttaaaaaacctcccactgtgtcttctgttattaaaaaataattaaataaaaagtgagtttggatacatctatcatataatttgaaattacacatgaatgtagagacgaaaagtgactttgaaagatcaattctcaaattttgatttaagaactgtgctattagctgaaagaatatgaaccaagtccattcttttgacctttgtaaagtcgaacctagtcaattattgcagcagagcagggaaccaaagaatagctttgaattggttagacccaaactgatttaagtttgcatgtggttaaatacgacattagttaaaaataattaatgctgtctttgacctttgaaatgaggaaggacattcattgtcctcccccagctcccactccattcatgtaaatctacttaactctttgcattgcctaaaacagaacacaacgttttactatatcttgatattaaatatctttaaaaacataagcagagttgtatgcttcttaaatggatggctttccaccaattttcactcagatatttagatatacagatatactcagatatttaaagtatacagtttccatggctcacagctaacctttgaaaacatgtaaatatacagtgtatgtttcatgaaatgacagagtaacgctaggatgaaactatggtctcaacttatc

SEQ ID NO: 32921 - DNA, 1025 bp, Homo sapiens
gcaacacctgcagctactcacattgctggtggctgaaataatccaggtccacacggagagggcattacaatttcattgtgctgtttgtgcttactgtttaagcctttctcacaggagaaagcattagctaagtgtacagtagataataaaaagggggatttgggctcatctgttccccttaaatctgtctaataaaatctctcctcataattagtatctgactccttttctaccactggctggcatctagaggcaggtagaggcacaaaatggcatttgttttttagttgtcccatttcatgactttatggatcatcccctctttgagccttcatgacctaagttctgagacttaggaaactgtatacttcctaagattctcttctgcagaagttataatagatttcagatggaagatgtttgggatctcaacaggacaaagaggacacatcattttaaggcaataataacaagccattcttcatccttaattgacaacttaatttagattttagacgagtcccttttagtgatgtcctattttaatttcaaccccaaatgctgataatcatgaattcaaaaacacagtctataaaaagttccatcaaatgaattttggtttaggcatgaagatttagggtgggggttggggaatgaggctgaaacccagctagaggtcatttcttcctcatctatgctggaacagctcagagttcaggggattcatactcttttgactttaattgctctggggccactgaggcaaagcaatggtgctgtatttgtctgggggtcaaagaagcaatcacaaaggtcttcagaatattttcaaacatttgggggagatagatggtattcagacattctataatcataaaaccagtttctagatagttgtcgaatttcctaaactacacttgctgaagtttatttggttattgaaacatttagcttaaccagtcatgttctttctactttatgaaaatgtagacaggaaattatcagcaaattgctcgtttagaatt

SEQ ID NO: 32922 - DNA, 1048 bp, Homo sapiens
gggtatgctgccaccaggtggtggcaaatccttcgagtcacgtgttattgtaatttaactttttttaacccttttaaataaaagcaataggaaatctttctttaaacaatatcttactcagaaacccaatatataaaatagataaaagtcaacctagatcctatggtgaaagtgggacaggaggttcaaagccaaaggtctgtgctcatatctttcctctgatgatctctgaggaacctcaggaagacagtttgaaaatccccatctcaattataatgcacatattttacgtaacattaagatagaaaacatttttttttaaataaagaaaactaagcaatagaaaagataatcttctagagcaggaagaaagaccgagaaagcatttatcagagcaaatggaggaaaaagagggtgcttgtggatccggatcaaatgtgatgtggtgagtgaagcaggcatgggcaagagcatgaatataagcccaaactgctgagaactctgtccaagcagaccaagctctgtttgggcacagtcaggacgtactggagattttggaagaaggactgaggcaggagggtatgattgtcctgagagtcaatgattgactgaacttcttcagatttttagattcatcattgtccaataagctccttagagctggggctgggatcccagagtataaggtcatcaacttaaaggctgataagccttgagctgtatttggttgtttgtttgtttttctagtggcttctctcccatgtgatgagagaggacagaacagactgcatagctgcctgtttacccagctccatacaatggggacatttgagcagagaccaggctactgcttctgcccctcttgagtcttgtcttggctaacatttttactttgtttgtgaccttacgccagtgccctcccaaatgatcaatacattagttaaaagcaatgtttttctctgtgtttggctaactttcccctgaaaacacctgcctgtagaaattgcaaactctcccagaaactattttctaaaatgattattttctc

SEQ ID NO: 32923 - DNA, 1067 bp, Homo sapiens
ctataattccattacttctttgtgaatcaagtcatgttatgctccttgtaactggctctgggaaaagctggtaaacaatctttaggggaactaggcgtggatttcagttgaaaactctgcccatgtagctaattcctatttgctcagaatgccctgagtttactgatggtctacaaagaacttgtgtggatgtaatcttgctggcaaatccacaatacaacataatcatggcttcttacagagcaagtttattgcagctgttgagggaccataactaaaccttccttctgcgtccaccagcctgccgccaagaatatttctttggcgttcttgctcttctcactcccactcactctgttctcacagatctgggagtgttataggatgccacttgtctgtcctgctgattttctcatgtcctgcctgaaaacttaacctaagatcattgttgtgagtaagagggcaatgacttaggagtcccatagctggagggggaaagcaagggccactacagactgctggggaggcatctatgtgggtctggtcaaaaaagtgacttgagaatggtgaggctcaggtttcatttcccttttcactcatcaggtgtttaagttactggaacctattcttgagtgctaaaggtgttctatctgaacagactatggttgaatcaggccagagcaaggtcagttggttcaaccaatatgttactgttgtatgagagctgaaaggcctgaaaaaggaaaacaaacaagcaaacaaaccatcaaacaaaacctcactttcttcctccacttgtccatgaatatacttgtgattgtaatacttgttttttattctctttgtgcagtcatttctaaagttctgtgaaaaggtgtctttgctttgttttgttttggtggaggtagagagcagcacgggcaatgtccctggtacaatttacccagaaactgagtatttatgttgactttaaggagaagaagaagaaatgaagttttccccagatatttgaggataggtaggtaacattgatgttcaaacataaaaagaatttgagagaatgctac

SEQ ID NO: 32924 - DNA, 1022 bp, Homo sapiens
cagcacgagaaacagaactaaaagttcatgtcttagtttagggccacttattgagcgaagccttgacaaatcataatataacccaacaaggtgttggagtggctataaaagctaatagaaccccaggctccagtatagaagtacagtgacctgatttaatggggtaatggttagctctgttgtactctcctctggttggaacccgtttgggttatcgtctttgtttggggacactatgttttgagagagagattcatgaactagaaagcttccaaagaaagggcacaaagatagcaagaagtgagatcatgtcaataaatggaaggacctaaggatattttagaagagaacacttagaaggtacatgaggactagcttcaaatatctgaagggctgtcatgtgctaccatgattagacttgttcattgtttttacatcagcaggtgtgaaattaagactatgagtctaaaactttaagagggtatagaacatttgaacaattataactgttttgagtcaactgggttaactaaaatgttgtgagatagtataaccataggtatttgataaacgccgcaagatcattttataaatgttttctatttgaatgatttataagagaggctatcatctaagattctaaggtttcttcttagtatgtaaattatgattatttactataaaatatcattcattttcttactgtgagagcagaaattcaatctttagtggcttgcattctctttattaacagagtcaaatctgtaattatgacagtgggctaggctgctcttaaacaaaggttatgacttcatggcaataggctgagggccaagagataataatcttaggctgacataaatctgaaacaatccatgaaattgttgaaaaacattatcagagtgcactcagttaggctcacctctgaagcacagcacaaacaatgagtcccttaagttttgcaaggtttctatgagggactcgtggctgtctcagacatgtgagggagtggaggggaaagg

SEQ ID NO: 32925 - DNA, 1048 bp, Homo sapiens
acagcctcagaaactggaaaaaaaatcacttcggtggctccctgtgttcttcagaaagaaatccagtttcattagtttgatatttaattaggacagcaaccatgagtagtgtctttcctctttcctttccaaaaatgtctcttccactgtcttttctagtgccatgtctcatgttttggtaaaactaattgaaccttgtatctgtactgctgttcatgtttgacctcctcccttaagtgttaagcaagtcctccctgaccacgcttgtcccaccctccctccacaaaaccacataggtccacattccatctccctgaagagtcactgcccaactcttcaaggctttgtttagctaccttcttttctgagatacattttctgatcagattgaaccagttaaaccagatttaaactcttttttttttttgagacggagtctcgctctgtcacccaggctggagtgcagtgttgcaatctcagctcactgcaacctccaccttcccgggctcaagtgattctcctgcctcagcctcccaagtagctgtgagtaaaggcgcgtgccaccatgcccagctaattttgggatttatagtagagactgggtttcactgtgttagccaggatggtctcaatctccggacctcgtgatccacctgccttggcctcccaaagtgctgggattacaggagtgagccacctcacccggcccactctttgtattctaacagcacttttcctatccatttagcatttcacaatttacttttaatgtagtagtttatattttttgtccaataagttttacttcttgagcatagactgtacatccttccagtgtcttagatatgaatgttcatggaattatattagagtggtggccttcctatcctggcatggctgtacttaccaacaggaagcacaccagctttgaagcacagacccattgccaaatcccctcatggagaccctgggttattttctggtaagttattagcccctctgagcctcagatttctcatccagttactggcagttcatttataaaata

SEQ ID NO: 32926 - DNA, 1050 bp, Homo sapiens
ggatttggctaataaaggaggacctaagagttgatgcaagaagactccttcttcctgggggcacagtgcgcagcagataatgattacagttagcctctgctctgaaatctcttttattcttgccatgcctacacttagggttttcctttcatagaagatgtgtgtgtatgtactttctatggctattggccagtcagttcatgtcacagacccatgggagatggatgctttgtgcctcctaccaactggctgagagtgttgttttcctctgacactgcagctgacctcacaggcttcccaggtgtgcatggcatggcaatgaaacctcactggttggcagccacaggtgtgcatgatttgttttttcttttttcgttgtttagattcttgtggtaagaattcagcaggtgtgtgatgccagcatagaatctccaccctggcacagaggccagctgccctcaaaaaaaggtatttcttgttggtctcgcaacactactggcctgaatccctgttttcctggaagcctcacctaagggaaagactctgactaatgaattaggataaactaatcacagatgaacatgaagcattttttcagatgagtatgagtctccttatgtgaatgtactgtacgggtaggagcaggttacctggctttgaactcaagttttttttttcctagtttgaggtagtattattgcaattatagggatgtaggaaatcctggacctggtttccaaagggatataagccatcctagagtgctgttgttgacatataaatttctgctcacgtgattgagactaaacagtaggagcacagatggagagtgatcctgtgtggagttcttccatcttcctggaatctccccaggaagtcaccaaccctgggacccaaccagttcagtatagggcaagataaatctgaaggtcattccagacctcatctagccttaatgaagggtggggagagattagctacagtaacactgtttgagagaaccagagagcaagagaaggaacgcaattgctgtcagtctaagtcagcagt

SEQ ID NO: 32927 - DNA, 1058 bp, Homo sapiens
ctgggcaacatagtgagaccccatttttacaaaaaataaattaaaaattaggctggcatggtgacacatatgtgtagtcccagctacttgggagactgaggcaggaagattgcttgaacccaggaggtcaaggatgcagtgagccgtattcatcctaatgcattccagcctgggcaacaaagcaagaccctgtctcaaaaaaaaaaaaaaaaaaaaaaggctgcaatcaagtttatagacatttaccctccagaagcaccatggactgtctctggttttggcctgggctcaagagggaccttctttcttatggaaaggtcagctgtcccctttcctacattcacatatgctctgtccataccatgaggcttgcttgccttattctttcttctatgaaagatgtcaatgaagtccagcatgtctattactcttactgctgtttgggcaacctctagtacttccaaagtgaagttggtgaagtggaaaagtctgatgtccaaatttaagaaaatttcctcaagtatgaggagtcttctgttttgctctgtctgccttggtgatcaaccagaatttgaatgtgaatcaatcgtttttcaaaggaatgttgggtgatttgtcttccggttaggaaacctcatataaattgtttatcccaaaacaaaccctcatgagtttctttcttattattaacccccatacttgcatgattattgcttccctctttggccactaagtcaatagtaaaactcacaataaaatattcaggaaagagcctcttttaatagttttgacagttgtctaggatttggcaattatagggacagagattctttatgatgcttaatattctagaatacttaattgagaccactgcatcagaatattctattctctatgctttttccttgaggataaattaagaagcagtgagaagtaataggaaataaccaattcaaatctatcttagaaggataggagttggttcagcttctttgctccctagttgtttcatcaaatgaaggtagcaacatgaagagaatttgttccaataatgataa

SEQ ID NO: 32928 - DNA, 1038 bp, Homo sapiens
aacttttgaataataatttatgtgacagactcaatctagtagtgactttgaatttttttaaattacattttcaaggatagtgttacaccaaaataaagatcatgaactttagtgtaagataaaaataattctaaaggtaggtatcttcatctgtcttaaaactttctccattaggaataataaaaacaaaataaaagacacaaagcaaacctcacattttcttctggaaaacactgtacttttgattcttagcagaaatggccttgtgaatacttacggcatttgtaaatataactaagaaagggctttttttttttttttttttcctgaaagaaagttgctacattaccatcataagtttctaaaaactcttcagggagaggaaaagaaaaaaatcctccaaaccttaataaaagttcccagcaaaaccattagggatttcaattatgaagctgttctcaagactcttgtaaaggttatttgttgaacaatttctctgtaacagtgtatgacaaattactcgcttggcactgtaaatgatgcacaagccctttaattagaatatagcactcgatatctttaagaccttctaacatttcttagttaatattattcctcatgagcctttccaaagaaatgaggacttgtttgtagaatcgaaatgggtgatggaggagggtggacagggaccttgcacagggctgggaatatccagaagccacacaaagaaaggaaggctctgaccccaacaagttttgattgcaaaggcgactctgataacagagttttttttttattatccattgcttttagccttatttaccatcaggctctcttgccacaagcatgctttttagttctgacagccctgaattatggccattgtgggatcctatctcattaactgaaatgggagaataaaacatcaaacaatcataaaaatagtttggcactgtgaaaccacttaggagcagctgtcaaacaggttggaagataaacttctaaataaaaagaatagagacagctgcagtgtcctgc

SEQ ID NO: 32929 - DNA, 1026 bp, Homo sapiens
tgtctagaatttaaagcaggaatttttttttttttcctgaggtaaacttagaaagaaaagcagaagcaaaaataaaggtaaagagatttaaaaaaaagagacattgaggctgggtgtggtggctcatgcctgtaaccccagcactttgggaagccgaggccagtgtattgcttgagcccaggagttagagaccagcatgggcaacatggctaaaccctatctctacaaaaatacaaaaaatcagacgggcatgctggcacgtgcctatagtcccagctaccctggaggctgaggtgggagggttgtttgagcctggggtggggatgggggtattggggaagttgtgtggagaagggttggaggaggctgcagtgaggcaaggtcacaccactgaactccagcctgggtgacagagccagaccctgtctcaaaacaaacaaacaaaacaacaaacaagcccccctaaaacaaaaggacattaggcatttaaaagtgtgccttattgtaataaaaaaatagctcagaccctcctctagctatttgaatctatctctaaatctttaaaatagacatttttttttaacctgtagtaattcccctgtgatttttagttttgtttggtttctagatgatagatacaccagattcctcataacttatactctggcaataggaccattaggattctgaaagtatttcttcccgttttgacttactaggctttcacatcaagcactgtgacatgcctcagaatttctctctctgtggccaggaatagaacagtctaatacatatcactttcttccctcttgcctgtcccctccccctcatacacctgtaccccatgattcctgctttcatggcagaactgtgactgtgaagttgtgttattcttccagcagtgagcttcaacagaaaggacagggctcctaaaggaataaatttgtatctggttgccaggacctccaatgatctgagtgtggttttgctgtcatcaagaagctcgttttttctctcttccattag

SEQ ID NO: 32930 - DNA, 1029 bp, Homo sapiens
aaaaaaaaaacttcgactttttagtcactatttttaatgtgctaaggaaacattaccatttcatccatgtgtccattaaaagaaagggcagcccgtattcctggccttagaaattctcagtttggcttgtcactgtgatcaaattcagtcccagggtgcataagaggaaggtcatgaaacatcctgtgcccagtttttccagaagcaaaatgggaataacttaaaaaaacacttcaaccgtcttgataaagttgggccaggggacaaagtttgctgcttgtcagggttagaactaaaatggttatattaggataatcatgaaagatacttatttcaatattaaatgactttcagaatgaagtgcaaccattggcaacaaataagagcacaaattgtcttttttcccctatagaattatatgctatgttatcattaaaaggaatttcaagtgatttgtatgtgcatttgttaccaataaatacatggactctgttctgattgtttacgtgctgtgttagtaattcagactgttggcctgaggagaatacagtaggagttgttcaggctttaagaatcacaaaaactgaaattggaactcagcttggcccctactagcaatgagatctagggtaatacatgtaactttatcgaacctcagtattctattctgtaatatgggataatagtatctacctacagattttatgaggtaggcagacagatatcaatatagattgattagataccatcataatgggtggttaagtactagacactaagctaatatatatcagttatctcttctcacctgcagaatcattctgggggcaaatattaatccacattgatgacataggtttcagagagcataaaaaactcagagtttttgtatcttccaaatgatttctcttctttggtggaggattagcagttattacacaaaacatgggctgccaacctcaaaccctgcttttaacaccaaggtttcacataatagagtttttagcattagggaaaaagcagttactt

SEQ ID NO: 32931 - DNA, 1070 bp, Homo sapiens
gggcttcattctttcctccaccaacccaaactttctcctttcttagggtctttgttacctctgcttgagatactgttcctagacgcctccctttccttcttgttgctgctcatctctgtctcttgcacacacacacacacacacacactcacatccctatctatgtgaattcctacttgctttatatctcaccttaagtgtcacttcctgcctgagaccctagcgtatgttagatttgctggtcaaaagcttttccagcattcctcctgctacttatcacatttatgactaattagttatcttggtagatgttggctaatgtctgtctttctggctacagtattagtaaagacagggattatgtttgtctgaatcactactgtggccctcccattcagttctatgcctggtacataataggtgatcaacaaatattttggtgaataaataatgctagatgcagaaacaaattagtgactacatcattgtagcattacaagattgtggagtcctactgtgttccacatcaataactgctggctctgtatggttaatctgtgctctctgaattgtaaaatgacccagtatggttaaaaatgggcctaaaatgacgtaaatggtttttatcacagaggaacacccccagatatttgttcacaaaggaagctggtttagcctaggaattggcatcccttctcctgtatagtttttttaagccataatactcaagtctatcaaatatcctagcacaatacacacaaccttagggaagtggcaggcaccagtcgctattcccgtgggtggttaagcctttggtatctgggaacaactgaagggtagtaattggtgatacttattgtctgaacataactcaatcttggcttagcttgggaagtattcgtaccctcacttgtgggggtgcttggccaaaggcagaggtgtccctataggtcactctgaggcatttttatctgcacaatagctattaacaagtaatgggaaaagtggagataggctggttactctaggtggctgtaaaacaagtgtagataggacacaaaggagcagca

SEQ ID NO: 32932 - DNA, 1049 bp, Homo sapiens
atggcatatgttggcctaagaaacaaaacaaaacaaaactcttcttttgtactttattcgataaatagctaaagcctacatatggaatttttgtactgattcactcaacaaacacattgactttatatgagttgaactttatttagacataatgagaagccattggaatgtctgaaatgtgaggagacataatcagaattatgctttaggatgtttgttttggcaaaggtatgcaggatgaattacaagagagaaaaactggccgggagctgtgtctcatgcctgtaatcccagcattttgggatgccgaggcgggtggatcacctgaggtcaggagtttgagaccagcctggccaacatggtaaaactccatctctactaaaaataccagtaaaagaaaaaaaattagccgggcctggtggcaggcacctgtaattccagctacttgggaggctgaggcgggagaatcacttgaacccaggaggcagaggttgcagtgagctgagatcacactactgcactccagcctgggcaacagagtaagactccatctcaaaagaaaaaaaaaagaaaaagaaaaagagaaaaattgaagaattagagagctagttagtgggctattgcaaaagaagcattgggagtaaatgataaggacctgaagtaggttgtggcaatagggatagaaagaacaatataataaggtaagaataagcaggacttggttgctgatagtaagtgggaagcaaggagtcaagagaagtcaaatatgaactgtggcatggggagaataatattgccattaaagaaattactaaatcagactgctaggattaaggaactaaagagtctgctcattttaatgtgttatgaatttataaactctttttcagaaggaatggtagcaataaagagggaagaaatagggtaatagtttgaatggatagaaggctaaaatctttcttaaagtttatgcatgcttggctgtgtttactgaatataatctattttatgggggtcccaaagaaaatttttctgtagccatcacagct

SEQ ID NO: 32933 - DNA, 1049 bp, Homo sapiens
caccacgagagagcaattaacagctagtaattactgtgctcttcagaacggcaacattttgcctttcattccaattatataatggacaagtgggtttttgatcttcaaattagtgagctcttgtcctccttgtttggaggcagaattggcaggttaatgatggcctgtgggggcactctttcctctgactgatgtgaggcaagaacgccttaaaggaggcagtgagagcctttcaagacccgcagttccacctttatgataaagacagagaaagagtctttattttcagagggttttgatgaggaggaaagataggcttacatgtggcctccaaacagtgccatgtgcttttccttcttcttatcctccagcaaaaggtgaccaagttttaaaacatggaaaactgaaagtttcagatgtgcaagatggctaagttctggagatccagtggacagactgatgactatagttagcaatattgtattgcatacttgaaattttcttaagaatgtagatcttaaatgttctcaccatgtgtgtgcacgtatgcatacacacaaacacacactcacacaagattactatgttaggtgattatatatgtcaactagcttgattgtggtaatcatttcacaatatatatgtatatcaagttatgtacctcaaatatatacagtttctatttgcaaatgtacaccaataaagctgaaataaacccaaggaaaactggaattagattatgtgatgttttggtatgcctttggtaagggcataaaataccacatgttggcaaaaaaaaaaaaattcctgctctaagattaagaaaggattttgactttatttaaatttattgtaactactttgagaattacagggtatgatatactttggataaaatggaatcttatcttaattgatagtagtatatgaggagtaggccttgcacttattaccagatctagtataaatactgagattataaatagaggaagttggacatttttgttttagacatgtttgttttctgtctccaatctctgctattcatg

SEQ ID NO: 32934 - DNA, 1092 bp, Homo sapiens
gcttattattgtatcccgatgtcctctcttgtatatatgtttgatcattgggttacatttatatcatctgaaatggaagtgattctgatttacaactcaaaatttgcctaagccaaatggtgaacatttcattatttccgttttatgggtcatgtctgaaggggtttggctcagaaaatagaccactgctcgaaaggaggaagtctgttcccatgaggcagtaggtatggagtcagcaaatcatggcacgttcacccccagagtgtcagggaaaccatttgttgcagccgccaaagtcaacccatcccactggcatgcacacgcctaagtatgcacatcaaacttctatagacagacagatgacacagttagcaaagtcctaccaaagaagagagagagcccgtatcacagtggtggagtgaagctgtgacccaggctcctgtgttttttccttgctttctctctctcacatatctttttccagtgccaatagcaatacagattgcaaataaagagagaggagcaagcagaatgtgagtgtgtgtgtctgtgtgtgtgtcttctctaaccataggccctcagagctttattcaatctctggcacaatgcagcctctgtagaaaagatattaggaacaaaaaacaaacatgaagatttgggagcaggctgccagaattattaagaaaaacattcagatgatgccattaaaaacatatggggattctataaagccctgaaaagaaaatgtttaattatgcaccgtatgtaaaagccatcacgtttagattaatactaaagactgaaactgcgtggggcttaagtagtccatagtgatgcatcaatctctttactcctttaaaaataatgtttttcttttgctgatgacaaatacctttcaaactgttgagatcatgctgctatagtgatacatggagtttaatgaagtccaaagtcactaacgaaagtttccgaattaacttttcaaggttgttgagttagatttctttcttttctttttctcctataccattcctgctcacttccctctgctaacaggaattcctcctccccctccttctccaacatacaaag

SEQ ID NO: 32935 - DNA, 1051 bp, Homo sapiens
ccaccatcacgacctggagcccgcagggaagagactgttgtaaaaatgataaatcagaattactacacaccaggtcttgataaaacaaagaaagttgattccggggtctgatatatatctataatcacagagaaacaaagcttgatcagtgaagggccaaatgtgaggaaacgtgaagttcaaaatctgatggctgcttaatattccaaccaagcagaacattggataatacagtggaaattgatgactcagtggcatcggctgcagcaaaatagagatatattacaaatttcttcacaagaatagggtgatatatatgccagtgcctgttcatcacatttttatgtattcttcatatctagaaacaaaagaggatatactgtctataccaccttcataaaatagggttaacgtattttctggggttttgttgttgttattccctttaagaagcaaaatccatgattctctttcagaaaaatgtctatgtgtaaaaatgaggtattgctggtgcatctcttaaatgactgtcctaattgcactcctgaaggactctcagattcagtatatttgtgtgtgcatgtggggtagggccgggtggggaagcaactgaggagccagcgatgtaaaaatcacactgagggcaacttggtgttcgattaagcagcttcaattagattcatgctggatttcacagaagcagtggtctaggtgctcccagggattttcagaggctatttataaggcagcatgttcccagaagtggagttgggaggtccttcagtcggaaattctgaacgtcttaattataaggggtcttagacaaagtgctcatctagcatggaatcctctgaccctgataagtccatgaaggagtcaggattatgggtctttgctcttctattttcctagctggtattgcttgttagcaattgacacccagtagcttagcatcaccattctaggttagagatttctagccagtgatttctatttcaatgtctgcatgacacctttgtctggcttgagagtggtggttctcaaagcgtga

SEQ ID NO: 32936 - DNA, 1053 bp, Homo sapiens
tatggcttgcgtgtggtttatttggtttggagttgcttcaactttccaaagacatagtagatttgtaaaaacagatcattaatgataaccccagaatacttatgtctgaaatattgggtggatgcagcagttaggatatttttttttcctgctagttgtctgttctttaaaggcatggctgtttagttgccaccggattgaatgcttctgaagattagcctctcattgtttgaatgttttcataacattgttgccataaagcatcttcatacttcacagttgagatcttgacttccagaataaaaaagaagtcaggggctaatcataacaattagctaatgtgtcaacaattagcactttccatcaacctgctctaaaaggagactcttcttatccacttgcagacaaaaatgcaatgatgtagttaagaaaagcactgaaattggctcctagagtcccctgttgtagccaactaaatccccagggcattgtttacagtgattattctgccattatgatgttattgcataggcggaggggggagtcgtattgctcaaaataagtctgttcttttttttttttctagaagacaaaacaaaacattaaaagaaaacaatccctttttggctgcttttggaaaagtagaacaaaaactgctgtgaaaggtcagccagttatagtactttagtgtttaactggtaaatattttaaaaaagagtatatttaatattttaccacttggaaaactttcaatgcgttttaggtccagcacagctcaatcaatgtaagatttcagaggtctctggtggggatttctttacaatggatacattatattctgtggccatctatagcactgcttagtagaaatacgttttaacatcttttatataatccttctagtaatacaagaacatttatactacaccttttataaagaactgcacagtactttacacagacccatatatctatgtaaataccgtgggtttgtcttttaaaaagccttaaaacaacttgtaaatccccagtagcatctcagaattctgaggg

SEQ ID NO: 32937 - DNA, 1025 bp, Homo sapiens
tcacttcaccactttaaatattactttcttcatatgttaggtgaggggagttgatttaggtgagttttaacttttctctttttctaccaataatatgtgcttttaaaagccccttccatcccaacacatacttgaatatttatagaaaattgtatattttacagtcatgttgtaaagaaagccattaatatatttttagaaaatatgttaacatatacagggattttattcctgtgttattcttacttaaggtaaattaagagatagacaggaattgccacgactgcagaagagcatatatagagtaagatacagttaggctcttatatatacaattttaaaagaattagaaataaaggatcatagaatctatattttggtaggaaaacaagttgaattaaactaaaaagccaattattggctcagttcaataatacattaaagaataatagcttcatttagttcccttacagtaatctctcttcaacctagcgcttcctttacatgaagctttacttttgaatataactttcactatgggaagaattttggttttcatatataaatctcaaatcattcctgttgagggccattagaaaaagaaaaaaaaagagattgggaagagaagcgagaagtcacatgctttgtagagcaggggaggaggtttggcaggaaaccaaaagggatggtcagagcaagtggcagcagagattcatgtcagggaagaggaagggatgtgcctcaggctgtgtctctggcacagacttgggaatcagtattgactctcaggcagagtggcactcatgtcagatgcaggactggaccaggacagagatgtcttcttattgtgatctttgaaagaaagctaagtgaatttgaaatatccggttgaaactgtagagaagaaagagcctaaggaggttctaacaagagagaaaaaagttattattcatttaattattacaaacttagggtagaaagagttcactgatgttgttatcttggttttgtgtactgtctttatt

SEQ ID NO: 32938 - DNA, 1022 bp, Homo sapiens
ttatcttcctttaccctaattccttccctcctcatccttcaaatccccttcctcatcattcaaagtctaactcaagctagcctttcctccttattttccccttatctttccaatccgtatggagatttctcacctttcctgatagaggttgcgccagaatggtgaggattaaattgtaattgctttctaatagactgctgtgtctgcccactagatttcaagctctctaaaggtcaaagctatttcttacattagttttgaatccgcttctggacagcgccacatcccagaggacttcctcactcataagcctatgagggtcaaggcaacaatgtaggagctagtgattctcacaggaacacttatttcagaaaagctatgctgaaaatctgggttttaatttgaactactaggccttacttggccttaaaaaatgacatgtaatcttttctgtgctgtcccttctccaagaaggtgggcctcaggcagatgaagaatcgaggacacagggaaaatcctgggcaagctgtggcactgggggagtgtggtttatcccccagaacaatctaaggcagtccacacctgctgcttcatgactagggtttcaaagctttgagaactggcataggcaaagcttgtcttttggtatcaggataagtttcagtggatttaaaatgtgttgtaatcagatttaagtccagaaagcttttttttttttttctttacttacagtgaaactctctctttaatgctgtttggtcaaataaacatcaacaaccacgttcaagtttcttggtcactcctgaatcctttcttttaagtgggagtgggaagttatacagagacaagtgtcggccgggcacggtgactcacacctgtaatcccagcactttgggaggccaaggtgggtggattacctgaggtcaggagtttgagaccagcctggccaacatggtgtaaccctgtctactaaaaatacaataattagctgggtgtggtggcatgcgcctgtagtcccagct

SEQ ID NO: 32939 - DNA, 1056 bp, Homo sapiens
ggacctagctgtgaaattgttgggtaacatagtaactctatatttaactttttgaaaaagtgccaaagtgtcttgaaaagtgagctgcatcattcccaaatatttaaggtacaatatttgaatattaatttgaccttgcttgattggaaatgaaagagaagtcatttgattccaatattcctagaaaagactctcagttgttcacaaacacttcagagtatttgtctcagcccctgtgatgggcactgcgtaaaccaagacaaatgaaacatagtttctgattctgaggagtggatgagaatttttggcatttcaagttgactttttttttttttaaagtgtagatatttgttttcttcttttattacttgtcttctcttttggatatcaccactggacatttaggaaagactcttaatggggtactagatgtgttaagacctggagggctggatggatggtgcacatagaagtagacagcagataggaagccaggatatacaggatcaagagactctcaagtcagtggattatttaggtgtaatcaattgtcaactcgtttcatgactgacagtggctttcctctccaccacagacatcacttaaaaaggaaagggcagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaggaaagggaacctgtctctcatttataaagaccacatttgttttccatgacagaaatctgatggaaactttcattttcacagaattaccaccttgctttggtttggggtctaggtaatcataaaattttgtgagctgtggcaaatcgtatatataattgtatccacag

SEQ ID NO: 32940 - DNA, 1017 bp, Homo sapiens
tttgggcctgcagtgactcacccagcactctttctacaacactaacccttttcctatttgcattaaaggtggattgaatggtggttaagagtgtcagctttggaccaggctgtgtcggcttggatcctggctccaccactaactagctgtgtgactgtggtaagctctctgtgcctcagtttcctcctatattaaatagagagaagaatagtactcaccttatagagttgttcttttaactcttttaggagttaatacatgcaaagaatttagaacagtgaccaatgtatagtaagtattcaataaatgttagttgctattattattattactcttgctattttaaagtgattaattatataataaatggccaaagggcttttgtaggtataagaattttgatgatgttatcaaaatatctattgacaaagaaaaaaagaatgcatagactattaatagttttcatcacacctgaagaactaaacataaatcctgactacgatttcttcaccaagaggtttctcaaatttctttttattgtgatataattgacataccataaaatacctttttaaagtatacaatttcatggtttttagtatattcacaaagttgtataagcattaccactgtctgattccagaacattttcatctcctaaaaagaagcctttacctgttagcagttacttctcattatccctccctaatctactttctgtcccagtggatttgcctattctggacatttcagataaatgcaatcacacagtatgtagcattttgggtctcttttacttgaaagcctaatgctttcaagattcatccatattgcagcatgtgtcagaactctattcctttttatggctgaataattttccattgcatggatataccacattttgtttattcattattcattgagtgacatttgtattgtttccattttctagctattataaataatagtgctgtgaatatttgtgaacaagttttatgtgggcatatgttttcagtt

SEQ ID NO: 32941 - DNA, 1068 bp, Homo sapiens
gcatctgttagaaatataaatgacataaaatcatcatacctcttctggtaaacttatttagaagttaaagatctggccacctgcattagcagctcaggagaagtttagattggcatttagattagctggctctgttattcagtgacttgcatacttgttcaagggcactggagtcaaccaatgtttatttttggattccccattgctctcgggatcactgcagcgaagactggtgcccccaaccccctattacctccttcaccttgtttgttgttcctggtccagggaggactgcagcccagattcagcctgactagctgctccttggtgccctgttatttttagtatatgaaccacagcagcagctggcaaccctgagttggcccatacaggcttagtttttgtgaggttgaaactatgggtttaagaatattgggaatctctggtttttatgtccttgcattatctcatgataagtaatatattatttttaactttcatctgtgatgtgccaatctttaacagtgaaaacttacactaaaagacctctgcctggttttggataactttgcctgtattttacgctgaaagtaaagagaataggaagagaggactttaaaaaatgaaatcatagtcctgtgaggaaatcttttttaaaaattgaaaactctttaacttgaataacagaaagcttttggggaagactaggagctctgaaggcataattgaagtgatgttgtttaatgtaggcgaactgctgtaataagcaaatctcagcacgtgttcattttttccctcatatagtggtctgatgtaggcctctgtcaatggtacagttgtaagttctgccccactattttcagggacccaggctttgtcacttttaccatgaggcttctaacatcatcacgggggtcaatatcctgccagcagatggggaaacagcatggaaggccatgaggtttctatggagctggccaggaagtggcacacatttcttctattcagatgccactggctgtagccttatgactgctttccacctaaatgcaagggaggctgggaaat

SEQ ID NO: 32942 - DNA, 1030 bp, Homo sapiens
aaatatcatctgcctccagtattccacgagttgtttttgttgaaaagcttcaggttgcctggccctttaaggcaaatctctggtgttcaaattggtgaagtaaaaagatattttatgctccagtgtctgctttgtgtgaatacttaattttaagagggtagagtgaagtgtttctatttaaatttagggggaactatgagggtggggtggtgactacattccatgaagttcccttttttttccttttaataggaggccctggactcagctcaatggttagcttcagtttttagtggccttaaaaactgcttttgacaggaaagctggttgattcttcaggggagggaacataggatttcagaaggggcacattcccttgctatctgtaacattaggtaccctgactgtacacagagggcacccaatgtatactctatgagtgattgaatacatatttaagacaggacttgcagcatttccggcctgagagcaatgaggtggggttgtaattgtgtagatctgggcacattcttggcactccttacaccatgtcctgggagtggatacttttagcccctgtactaattattgctgtgtgacaaattttccctaaatttacagctttaaacaataaaattttttattttttattttttagattctacgggtcaggaatctgggagctggcataacagtgtggttgtagcgtagggtttcttccagggttgcaatccagatattgctggggactaccgtcatgtgaaggctggggaacatatgcttccaagctcattcacagaagccctcagttccttgccacttgggtgtctctatagggctgtcatgacatggcagctggcctcccctcaagggagtgatgtgtgtggacacatgctgctttttatgaccttgtctctgggtcacacactgacacttctctttattttccttgttagaattgagtcactgaatccagctcacactcagtaggaggggatgacgcaggggtgggacaaccaggaggtgggga

SEQ ID NO: 32943 - DNA, 1598 bp, Homo sapiens
agatggggtttcactatgttggccaggctggtcttgaactcttgacctcaggtgatctacccgccttggcctcccaaagtgctgggattacaggcatgagccactgcacccagccccctaccagcatttctatgtgataagcagccccccagactgttgaagatggcttttcacagacatgaaattcactagtccttccaagcatggctcctttctggagagtttggggttttgggaagccttgagagtctccagggttttgtgggttggataactcaatatcttccaggaggcggaaaggttaagacaccaaattcatgttgctacacaattaaacatcaatacacgtagctgaagcactttaaactgcggcgtcggagttttttgagggtgagcccctccaccataatacgctgcaatcttttttgggttgtctccctgccccacttccccagccaaatatgaaggcagaaacaacatttctaacatgccacacctcacagcaagtagaagcaggaccggagagactgcaaacgactttacttacctagatcatcctctatgaatctatctcagttctaaccactgtttatttcattgagagcactctgtttattttgtttagagataagattctggacccttgcaagagaattttattgtttccaataaagaatgttttaggtgctcattgtttctttttctatcttttttttttctttctttctttcctttttttttttttttttttttttgagtattgctctgtcacccaggctggagtgcagtggagcaatctcggctcactgcaacctccacctcccaggttcaagcgattctcctgcctcagcctcccaagtagctgggactataggcacacaccaccatgccgggctaatttttgtatttttagtagagatgggatttcaccatgttggccagactggtcttgaactcctggtctcaagtgatctgccctcttaggcctcccaaagtgctaggattacaggtgtgagcacacatgcccagcctaggtgctcattgtttctttacaatgttttatgttaaatattaagaaaaaaagactaaataatggacacctatgtatctgcaaatacgcattcagttgtctttaataatcctttgctaatcttgcttcagatggattaagtgtgcgtgcctgtgtgtggtgtgtgttttacattacagattagaacttaggtcctctggattcacaaccccgaatcccatttgtttttcttcctttccaaagttgtcattatcgtgaatttggtgtttagctatcccatgcatatttttacactactgctataacatatgtagttataaaatagcattgttttgtatgctttaaaactttatttaaatgggaccaactgtttatattatcctgatcttctttcccttatcaacagtatgcttttgtgatttatctgtgatgttccatataggtcaaattctttcatttttattgctttataatatttcatcatatgaaaatatcatgatttatttatctatttccctattgctagaaatgcatgtcattttaaactttttactattatcaataatgt

SEQ ID NO: 32944 - DNA, 1054 bp, Homo sapiens
gtccactgggggcaattgtgtgtacctcaggggtggctgtaaggattgtatgagatgaaacacttaaaatgagaggcgcataaaagatgctcaatacatggtgcctttgctgcacctgttctcctgtaccatccttcttcaaagttctctttaatatgaatttctagcagagttcacctggctaaacagaaggatcttcatgtataaatttctcctgggattggggaaggctctgtgagtatgtgtgtccaggtttagtttgcagcatttgtttggacacctgaagcgctatggtttttaagtgagatgaaatcatgtagtgaagagagttctttaaattgaacctcattacatgaaaccttttagtgttcagaggaaaaaaatggagattttggtaattaaatttgatatttcaaacaggaaacttgtttcattggacttgcatgggcaataccattttttatataagtagctcttgctaaagtattttttgggggggcacttgaattatagtaaactctatttgactaacctaagacctgctgtggaaacctggatttaaatatatgataaaatttggaaatattttatcacatctatagcttatttgatttggaaatatatttatttcatatatagattatttgtattttacatcccaataagcatatgtgcattgtttttctttaacagggcttttactacttttttcctatattctgattctttattatgttaatttgaagcaggcatagactaggagaattaagcttaagacttttctttttataatgtttaactctcagatggtgagtcttggctggttcatatatgtgacatttagtcttttgaatacaagtagatgtcttgtatgtttgagtcgtcttagtgattgaaataagttttttctttttaaaaaaatattaattaccccatggtcaagattattgcaatttactctacaccttttcttcaatttttttctaatgctgttagttattccctttattgaaaagatctgtctttcttataaaataatcatctttgataagac

SEQ ID NO: 32945 - DNA, 1052 bp, Homo sapiens
taagcacttactatgtgctgggcactgtactaagttttctttatacgttaactcatttcatcctcacaataactctgtgaaataagttactattattttcctcatatctttttaacatgtgaggaaacagaggtacagagatgtcaattcacttgcttatagtcactcagcttagaagtggcaaaaccaggattcagactcagaaaacttggttccatgctctttaccctacactaaaccatgtctaaagtagcgttagcaagtgaagaagttgagacccctagcatatatctatcttggcccggccagtgctatgtctacacaatgtctaaattggttatttgatattatattaactccaaatccccaaacttgtgaatggcatttatcactcttaactctctctctctctctctgtgtgtgtgtgtgtgtgtgtgtgtgtgtgtgtgtgtgtgtgtaaaacaggaagtgaaatcctggaaaacagacaataaaatgaaatcctgatcatggaccttggatgcatcactgaacctttccaagtttcaaccccactctcatacagagaaatacattttaaatgactaccatagtgcttggtacagagtatatgctattatgattgagaatgaggtagagtgctgaagtttaactagataaattaagtaattagtggcttaccattagagaattcattgttgcagaatgttgggaaggttgaggaaggccatgtttaattgtaaggtatgcataaccttccttacgctggctgaataaaaattccaataccttttttgatgtgccacactgttccaaggcttctctgggacttggggtgcatttcatcttgaactatgaattgcagagatttttatcgtcttctgtcacatacacagcatccttttattgtggtttttgatgcgttaaatatgtttttatggccccctatgtctattgtgcctagcatactgttggtacttaataaacgttaaataataataatatatgtgcatatgagatgtgtggaaaggaatgacatactgttttaagga

SEQ ID NO: 32946 - DNA, 1039 bp, Homo sapiens
tttctctaactcattcttcattttcttctgtaatttttttttttttttttttgaggtggagtttcgctctttcgcccaggctggagtgcagcggcgccatctctgctcactgcaagctccacctcttgggttcacgccattctcctgcctcagcctcctgagtagctgggactacaggcgctcgccaccacgcccggctaattttttgtatttttagtagagacggggtttcaccgtgttagccaagatggtctctatctccagacctcgtgatccgcccgccccggcctcccaaagtgctgggattacaggagtgagcccccgcgcccggcctttcttctgtctttattaaacttcattttgtttcttaaaaaaacaactctttaatttaaaaaaatttgttctaatgtctattactgtcttttaatgttagctttggttcctagaatgagaatatcttctatgtctttatttcagtaacaataacaaaacttgcttatggactgaggagcctcattaagacaaataactgaaataatattctctcagcaggaattcatagagtaaatgcatgcatatttagaataattggggcttgcagtggccaggatttggccagttgtgacaaactgaaagtaaccacaattgatcaatttttgagaattaagctacggtaaatatttctcaaataattgattttaaaatatttactggctggacacggtggcttatgcctataatctcagcactttgggaagccaaggcaggagaattgcttaaacccgggagttcaagaccagcctgagcaacatagtgagacttcgtttcttaaaaaaaaaaaaaaaaaaattagccagacgtggtggcatgcttggatccaggaggtagaggctgtagtgagttctgtttgcatccaatctgggtgacacagtgagactctgtctcaaaaaacaaacaaacaaacaaaaaattaccaatcttcaactattatcaagtcatgattatgaacattaatccttagtttgtgcttttttagaag

SEQ ID NO: 32947 - DNA, 1143 bp, Homo sapiens
ttttcatattctgagagtccagtgcttttaaattaaaaaaaaacccaattcatacatatatatcaaagaacagcttctttgagttaaatccttgcttgccaatgtgtccttttatgagatagggtcatttgtcatgagggaaagcaggattaattaactgtggaaaacgtacgaagtgtggaaactgtgagttctaaaatgtttccacattaaaacacgggaaaagaagcatagatgaacgtagacatcagtatgacttttttcttcagaaggcttaaaaaaaaatctctccatcacacaaatgaaacaacctattatacacagtcttcccatatgtctgacgcagaaacaaatgaggaatgtactttatttccacataaattgtgtggtttcaaaattcagttcccttcacccctgaattctggccaccatgtcacttatatgtctaacaggatgacagaacttttaatgggacgaattgtagaaggggagaaccacataatattgtagctcatgaaagtatcaaaacaaaacaaaataaaagtcacccacaaaaatctctatggcaaaataaaaaagaattccaaaaggagttgccaaagaaaggtatataagtcacggcagccttggggaagtcatcatctatagccagcaagtcactttatgttcttattttgttatttactctgttgtttgataaaatgagtgcttacattgaatactgtaatattatacagaagatatagaaactactttgaagatgaaagatactctacatatccaggtctctctttatgtaattttattttgcttaatacaaataataaagattctgtttacttataattttcttctggtttctgatgacaatatggtaaacaattttaattattatggtaattaaattaacaaattaatttggaactgtatggagtttatgcatatttctggctaattctggatctgatccttaaggccaggatttaattttggataaagggattcatttaaatttggtattttttttttcctggcaggtgaataatagaactttgtaaacaaatagaaaagtgcattttaaaagataaaagacatggagacgcaactggaaactctttgttccatgaagcattaggctatgac

SEQ ID NO: 32948 - DNA, 1031 bp, Homo sapiens
ttctagaatttcagggcagagagaagctcatgtgcttggataaaagttacccagtaaaggctggacctaaactgggcattgggcaaggatttaggggaactagagaggagagggcggtggacaccccagagggtagaggagaaggctggaaggaaaggataaacacaacccagttgggcagggtgggcgtgagggcagtaagaggaggtggaggctgtctgtgaaagggtgaggaaaataatgttggccaagtaggctgcagttggctgaggaataatgtgaaagtcagaaaggaagaggccttctggactggaggcagccacatccgtctttaggagttgtggacagcacagtgctgatgcccagatttttgctggtgagccagcaagtttttgtgaacagcagacaccctggaatttttaatctagtgttttgtttgggtttctagtggtgtgtttgggaattatttgggtttgtttctggcagtgtgactctgaagtttgcattgtgagggatgaagagcgagactggttgaagggtaactgctggtcgggggtagaacaaaatctctgagtcacagtcactcagctttctgtgttctctccttctgaaagtgtaaacagccacatcatttcagtttggtttctagaaaatgaagatgaaatgggtggggaccagaaaaaacaacagcattgattttatgagtatttttttatggaaaattattctctatactgtactgttgttatgggccatctcctaggatgtaaaaagtgcttgttttcaatggaattttccttttaggaaagaattttatcatattgttgccggagagcatgctatttgacctgtggttctgaatctttgtaataaggtactctacatattataacaggtttctctttcattttgtttgtttttagtatgagattgtctctcaaatccacacattgttatattgggtcattcaagtgaaataggtgattagcacgggttaatggctgtatgtcataatagtgtgacatagcaga

SEQ ID NO: 32949 - DNA, 1150 bp, Homo sapiens
gtttactttagtttggtaaaattacatttaaggtgtgaggatgaggtttaacgttttatcaaaaccctgaatgatggaagcagagtggtatgaatgaatatgtctgttttgatcaggtacaggcccagtgcaagcatttagtgtagtttgtttctaaagctacatgtgtcatatcaataacaattctattaggcagtcacatatcatattcattaaggtcacagtctgacctgtgatgtttccaaagtttctctcttctctttcctttgaccttcatggttttgatgcctagtcccatattttcttcttcactctggcctcatttggatccatttttgtctcctgttttcttaagacccttctctttgctagctgatctgatctagcaactcatgatgataataacgtcaacagataatacctattaagagtttatatgcaccaactgcggtgcaaattgctcactatactacactcagacgaaaagtatcattacccccctttatgaatgaagtaaatctacagatcaggatcccatggctagttcaaggtggcggtagaattgaaaaccaggcttctgtctctgacatcatgctgtttccattacaccacagaatttagcactacaaaaaatagttactggaagactttgttctgctatcttcttacattttaattccacagtaaaccctcccaccctattttcttttggttcttgtatgagattgaatcttttttgtatgttttattggcagatgtatatttttgaaaaattttcagccagttttataacttgctgtttatttcatatgatggaaattacagctgcgaagatgccattttaagataaaattgcatctaatgctaatttaaaattggcacctggttttaaagtttatttaaggacattgcttgtttattggatacctttaaacacttaaattattttcagattgatagcagggcagttggaaatggtgaaggagaaaaatgaattttttgtacccttattatgaatcttttaatattttcatcctggtaaaacttatgaggcagctctattttgaagatccagaaaggttgatatactgggtgtttttctcttatttattatggtttcctgtaggggcaaaagcttggacaactctcc

SEQ ID NO: 32950 - DNA, 1033 bp, Homo sapiens
ttgctacccatggagcttgcaggactggaagttgctctgggtgagttagtgcatgaatggtgagtgaatgtgaaagccctggactttgcagtacactgctgcagactttataaacactgtacactttagactacactaaatgtatacaaaaatttttctttcttgaataataaattaatcttagcgtatggtaatttttttttactttgtaaactttttaaactttgactcctgtgctaacagcttaaacatacattgtacaactgtacaaaaatattttttatatccttaccttataagcttttgtctatttaaaaaattttaaaaaactttaaaaactttcttttaaaaactaggacacacacacattagcctaggcctacgcagggtcaggatcatcaagatgtcacttaagtgacagacatttttcagctctgttataatcttatgggaccattgttttatatgtggcccattgttgaccaaaacctcatgatgtgatgtgtgactgtatataatttgttattcaatatttatttttcatggtatttaattactgatattacaataatatattccctgtaagttaaatatgtgtgtatgtggtatttgtctatgtgcatatatgagtgaatatatgtattgggggctagcctgtgaacttattcaccacatataataaacatttctatggagaaaattggtggtatgtttctaacgagcatttcaaaactttcagaacatagtttttttgtaagttgcaatcttgtggattactttcatagctctgcagctcatgagtgattggggaagggaggactctgtggggtctggaaactccctatgccttcagatttattttaaatgttatttattttttctttttgactaaatatttccttcctcttttggtatacgtcagaagtcctcaaccagagatgatttttctccctggggtaaagttggcaatgtctggagacatttttggttgtcacaaggagtaggcagcctctagtgggttgtgctattggca

SEQ ID NO: 32951 - DNA, 1020 bp, Homo sapiens
ttctgtcttgcttagtcttgtcgtctagcacagaccggcaccctccagcattgtctagttttcactgtagcacacagggctaacagggttactgttactcatttctgtgatacagacaaaattttgtcacttaatctcttttcttccagagttaatgtctattacccctgtgcctacagaaaaaagagtaagagctagcatgtgtctgagtttaaaaatatataactctacttttttcctttgtgtagttttcctttagtttgaataaagcttaagggacatggcagctaccatgaaatagctgaaagtgtttgtttttcagaggtggatctaaacttgttctgtccagtgctcaaggcaatgtctactggctggcagttacttgggaggcagtatatatcatcttctttccttaaatggtacctttgtgtctaggaatccgagagccaggttatttttttcggcatttctgcaattgactaaacctcccactcagagttttctgaccttccatccgtataatgttgcctctgggaatttgtatgtgtttcttaatggtatctataaacaaagaccagcatttctactcttgccctttagataatatcaagcagaaagagatactaatttcattctgtcttaaataggattcatgctgcgatgggtatgaagacatgtgaggaaaagggaaaaatgagatacccccaagaatactgtttctacaagctcaatgtccaacagcttcattttctgttgtcatgtgcccacttttagggatgggaggtttttctgttctctgtcaacttcctctagagggcagctcatggaaggatgccctgcaagtccctcttgagtttcttaagatgttttggggccctttcagagggcagctcttctgggagactgcctcttggtagccctggggaagtaagtccttggtcccactcctggggtttggagaggacagctgggtccctgacacttcctgggctccctgtgtcttcagctgtctgaccccat

SEQ ID NO: 32952 - DNA, 1305 bp, Homo sapiens
gtccttctattcttaccaatacgatttgtggtcaacaccaccaaaattgattgttttatagtggtaggagaaaaataaattttttcaagtatcttttgtagtggtattttaataaattccttgcaatttccctctcccctcaactttttattttctaaaaaggagtttctgactttttttcttacacaaatatttctgctggtgttgttattttatgaagagacattggctttaagaaaaaagccacatggcatgagttttatttcatattatgtgctttgtctgttggagtaagactcattaggcacactgtacatagcgtggtagaaggaagatggatatcgagacaaaaaaacctgagtttgaattctaccttggccacttcctgctgtggcgcttgggagaattattaacagcttcaagtgtgttgttcatttataaagatattatattgcctccgtaagtatctaaaaaattaaaactttttttaaagtattataatacaggattgtggaaagagttcaatgaggttaaaatggcggagactccaaattttctcccaatatctattccccttctctgtccttttaataacactacgacttgagctatactgaggcatatggctattcagttataggctacatttctagcctcccttggaggaagacatgatcatgccattaggattctgttcaatagaatgtgaacagaattatgtttaaattatctgcaatttataaaaagaagcttcctgtccaccttcccctcttttctcccttcctgcaggtgggaaagtagatggatggtagtgagtcagctctgaccatatggaggagaacaataccctaggagatggcagagcaataagcgaggaggaatctggaaccctgaatgttcttgcagagcagagcttcctacctgtctgggactgcctgcctaacttgggactgttatacaaaaaagaaagacatttctttcctgtttaagccactgtactttgcggtggttttgtttcagcagcttagtctgtatgctaactagtagatctaatacttgtaaaacaccaaacataggctggcacatagaagcacaccaacacgtttatcatttaaaacactgggtatcatttaatttctttcatttctttttctttttttttttttttgagacgaagacttgccctgtcacaggctgaagtgcaggtgtgatcttggcttgctgcaaactccgcctcctgagttcaagcgattctcctgtctcagcctcccgagtagctgggattacaagcatgcaccaccacac

SEQ ID NO: 32953 - DNA, 1031 bp, Homo sapiens
gtgccccagaggaggctccattgactgcaagccagcaagcctggaatctgaattggtgtcagggtcccactcatcatgaagattttacatttggtttgggactttggagcatgaggctctggatgtaaaagtcagaagagatatggcttttgtaatgtctgcagagattcctgtgtcgataaggtcagcagaaagttaatagatttttatcttctcatcacatgaacttaatatagtgcaactgtttggtgcgggtgagatggcgtaatgggatgagaatcccatcacgcgtctcagatttttcacaaaggatgttttaggtctgtaagtgcatttttgcttaaggctaaaaaaatctattactcatttacataataaaactgttaaataaaaactttaaatgctgtgcaacaactctggctaaaaacaattttagtcagagcagaacatgtttttttcctttgtgcaggttattcaattacatatgagtaagaaaagcttgcatttatcgtactttaacagaacgtgagccagttcaacttaaatgcctttaagcaaatgctcagagccataaggcagttccattaggactgcttcatccttacaccagactcttaataactgccgtgtgcctgccctgaagggaaggtccttttgccaggcactggtacatgactggaaacacaaatggagggaggatggtatgtgtgaatcctgccaccaagactcgctttaggaggggatgtggggaaatgtggaagaaaaaacaccaggctgactccagatgccacctttgaaaatctctaggtcatattactttcaaaccaacctactgactcgagatctgctttcaaggccactctgatcagctgcccgaattggctgtgagggtggtttctgcaaactagggatgctcataggggtatgcaggaaagctgggaggctgaaatgcaaggaaacccatggagggacagcaccaggtcagactgactagcaggcctcagcgatcaaacacgtcacacctgtcttgg

SEQ ID NO: 32954 - DNA, 1077 bp, Homo sapiens
ctcaatgaggcaggtgctattaatatgcccattctatagattaggatagtgagacgctgacaagttatgtaaattctcaattaagaggttaagaaatgtgaaatagagcaaagtttcaaattaacaggaaaattcaccaacactagctgatataccagacaatttttatctgttttaaattctttataaggttggtttattttttagctagagtagacatcttaggctttctaagctgcaagggaaattggagagcagctggcctcacagcatcactttattgattagaaatgtgaagctcagagaggtaaagtgactttcttaagaccgcagagctctttgaatctagactttaagccctgcactctttttcctatatcaggcaatatttctcatgctacgttttcattttcaaaatagcataaaatcctagtgtttagtcttctatctcctattttacagaaaagaaaataaagatactttaaaaaaactagatctcagttccttgttgagtacctatcgctagctctggctgctttagaatctgcggtgtcagaggcctggacctttgcttgctcccatgagcctggtgcctggctgcaccttgacgaaggtaacaataggtattatcggcctctcatattctgccctcactagggtattttggctgtggttacttcctgagcccatggagacaaccttggctgaatcacttaaaacactttttaatcagaaccaagcaccttattttaccaaaataaccccttttaaaggtgtcacaatttgttcaacagataagcatcaaagggcaatagaaaaactggaagcagacatcataattagatgactaaaatgaaagagcagagtgatttagcaatggttgaacatttggcaaagaattttcatcaggcttcatcccaattctttcaacagaggagggaagaagcttctgagaactgtttgaaatggtggaatagcaattaaaggccttcgtcattaacagagaggaagcagaaatgaatgttatttgcctaatatggcattatgggcattggaagccagagggttgcaatggaa

SEQ ID NO: 32955 - DNA, 1024 bp, Homo sapiens
ggaattgtcaaggagcagagaaaagacatccaggatcttcaaggcctccaacatttctgagataatcaagtaaaggatgaaacactgaagactgttcctagaaaccaggtgtgttttaaatgtaaggaaaaaagctaggctgctcaatcctttaaaacttgaaattgttgctatcacgagggagaggaaggctggtgtggaggtcaggccctgggcaaaccaaacctctgagctactcaccacaggctagttcatctcagtgttctaatgagatcagtcgaggctctttttgttgagtgagagagagagagaggaatagttacagatgtgacatttcctaagactttatgaattaaatttcctgttaactactttgagggcaaatgtatcttaaagcaacagggtaccttctgctcccaagctccgctcaatgattattaactctttaattgggcaaagtctgtttatgccagtcagacatagagaaatttacatagtgtacatattaccgtgagaattcctctaatatacaattgtcaatcaaagtagagatgggtcttcaggtttaggagggtgaggataagttacaccacaaatgcaaacagatacagctgctgttataaacacaccagtcctatgtcatgcttatctgaattctttctggtactcacttttaaaccaataaaaatttcaggaaaatgttggagatatttttgtgccttcagaaccatcacttacataaggaaacttttgaataaaatgagtttttggaaataaaagtggtaaatggttgtaatataagaagttacataccaaataatagcttatgctgtattttcaacatgctagtttttggatgggtaatttttttggtaataaatctgagttgggtctgaaatgggaggtttgtatttactgtaggatctgtacttccgatcatctctcctaatgtgggaataatttctgattgctggtcaattgtcttgagattctcagatggaaacgaagctcacattgccaaata

SEQ ID NO: 32956 - DNA, 1897 bp, Homo sapiens
ttgagagtaagcagaaggaaatggtagtaataacaagattggtttgtgctcattcacacttttctgccatttggattctgggagtggtagggtgggatacgggatggcagaagaaagaatgtggaagaaaaacagatgtgcagcagaaaggggatgtgcaaggtgcagcacatttggggtacctgtaagagggtttctttagaaaacacagtgctaataactcaatatttaaaggctcatatttgggggttcacatatttccattaatagttatgtgaaaagaaaatttagcaaaatcagattgatgactgatgtaatttaattagactccagcctcataaatatgcaatgttatttgaatgaggagttgaattattaggctccctgagaaaaaaatgacaatctggtttgcttcagagtttgttgcaaacatttctgcccttgtataaatgtgtaaaatgatttggtaatttaaacactagaagaaaggctaaatttaattgaccagttgcagtaaccatttgtagatattttttgctctcctttgcagccctgactctcttttcctcttttgtgattggggatattcctttcttgaaccatgccttctataatagctttgggagatgctactgggttttcattctcctgataatttcacgctgccttaaatcctttgcatggtggctttactagcacatccagaacaaactattaagactttataatgatattaaaatcattcagttggccaaggagacttactgattttttttttttgataggttggcaggatgaagtaggggaagggagcatgagagtactttctattttttttttttaattaacctttgttttgaataaaactctggccaggctaaatacctgaagctgtgtgaattgataagctcaatctccgagataatttggcaactcagtgtactggagccctctccataaccatggtgactctccgagcagtcagatttttgctcttttatcttctctgaactgctctttacttttggccaagattctttccttttcactttttttttttgttgttagttggcttaagaacctaccctacagtggatgaatttgcagttttcttttcttttttttttttttttgagatggagtctcgctctgttgcccgggctggagggcagtggcgcgatctcggctcacaatttgtagttttcttaatgttttatcagttacccgactattttaaaatcccatttctaaatattttccttctctcttgtcttcccttcacatttgaaatggataaagcagaagttttgtttttcatgcctaccttccccagtcaccatctgcaccatctctgtattctttctctttttaattccctgcaagtgttgcacagctctgtattctctttatgccattttgttagattctttgctgaaatgaaatatatgattaataaatgggaaggcctttactagtgattgataactactcttagaaacactgtcatttgcaattcattaaatgccttatttgccatttatatttactgaaaattgatactctatgtattagttctttctcaatgacagatcactggtaaatgtatcattaaaagagagcttaattccaatttgtcttcatttctccttgaaataatcttacagctgtcatatggaccttcttctccattccaatgcattcctctttgccagtgcccacaattgttctctctgatttatgaattcctttccttagggcaatatcatattgtcagaagacccaaattcaaattctatctctgccactggctttgagactttggacagatagttaatagaccccaacctcagttttctcatctgtaaagcgggaatgagaatatttacttcacagaatt

SEQ ID NO: 32957 - DNA, 1049 bp, Homo sapiens
aaatgtgtgcaggtgtataactttggacacctgaagggcccacactccttcagtttagttttaactgcttgtttcaaaactattaataattttgcacaaacctctgagagatttcatttggattttgcagtttatttcaatgctgtttaatctaattgcccctttgttttgttcccccaaaatgatcacttgagttttataatttttagaatttcctttgaaccaactgtaaaggaatatgatggttcaattgttgaaaagagagattaaagccaggtttttatgagaattttgagttttaaaattatactgccagtgtaagatgaatataaaatataaaatggtaggggccgggtgtggtggctcacccctataatcccagcactttgggagggagaggcaggtggatcacctggggtcaggagtttgagaccagcctggccaacatggcaaaactctgtctctactaaaaatacaaaaattagccaggcgtggtgtcatgtgcctgtaattccagctactcaggaggctgaggaaagagaatcgcttgaatccaggagccggaggttgcagtgagccaagattgtaccactgccctccagcctgggcgacagagtgagaccctgtctcaataaataaataaataaataaataaataaataaataaacaaataaataaaataaaatgcgaggaactgaaccaagagtagaattttctagcctcaggagtggggcttcagaatcataactatttgagataatctatgtattttaagaggattataagttatggtgcaagaggagttttgtagcatactatatgataaactaaagaaaatagaatgattctattctacagttgaggcttgaaataaggaagatgagggtaagtttttctaggcaatgcgtacgagggggtgaaactggtaagagaatgctggcttacctatttcttagctgctagactgcatacatttgttgctatcagaggcagttttgtgacttgttttatgagagttgagtatctctagttgagagacatctttttc

SEQ ID NO: 32958 - DNA, 1066 bp, Homo sapiens
tcctgcttcttcatgatctctcctggagatatgacttctatgttatttcattccaatagtatggaattgtctttatcatcattttggcattttattataaattgcttgtcttcatggtatatatcttatttttctaggtaaactgtaaaactcctggagagcccatttctgttttgtatagggcctaatactatgctttgcatatggcagatatcaatatgattaggtgatggtggttagcaatgggctttggtggattatgtgaaccccttcaatttctttggctgtaaaacctgtgcagttaagtaatgtcggcaccagaattctgggatatctgacatttcaagtgcatactaaatccacaattgacctattttgacagtgataaaccacctggaaagtggagtattattcctaattttcaccaataatgtccctcattttgccagtgcaggtattgcccatgacccctcacttaaatcacaaattgttattgatcttaaactctgtactagacctgattctggagaatgtcaaaggagtcaaggtagaaatggtaaaacattctgtggactcatgtaattcctagggatttgggaatattcagtttacaagtcatcagaagccaagtttttacctaaatcctaacaccaatgtaggcagttttgctgcctaatatttatgctctattaatatagagcatggtgtcaagcattttgctgtatatttaaatgcacttttatgattaaagatttctttcaaacaatttaaggttgatagataatgtattgaatcttgttttactgattaaattaacccaactcactcaactctgttcccttaattcaagtgcaaacatgacttcttcttctctgcccctccccactcctctaacccccatctgtcatttcacaaatcaaccatctctatagagaaaataggactgtctgtgtcttggacaactatcctcaagtcctgaatgattacaggcttttagtgcctgttaggagttttcttttaccgagaacagccatatatggtttcttgtgcacttaggactgctcct

SEQ ID NO: 32959 - DNA, 1539 bp, Homo sapiens
tcccccttcccactcttctggccttcagagtttaccagggaattttcaaggaaattggctgtatagtgagaacaagtgtaaggaagaggataaagaggagacagacaaatcgatcagaaaaccagagagggagacaggaagggagaaatagtgtagttcttccagatccttagtttgcacacagattggtattatcctccccagcccctccaggaaatgaaaaaagtataatccttgttaattacctttgcttactacaagccatacaagaaacttcagagatgtctctacatagggaagaaactgtttacaagactctttcaaaagtgtgacatattgctctagttcagcactaaaaagctaaacacacttagcctcctttgaagtgccctggctggggcagcttatttgagtgtggttcagatattgctgtgggtataactaatggcttctacctatttagctcaagtgggaggagagaaagtcctgaattccttgtccaatgggtccctctggagactgggttctggcttcttgccaattctgtacaatgtcaacattgaatatttgaattcccagactctatttaacaagtttctaaataaataaactcattgtgtgtctgtgtttaaaattatttcacctctttcataaaagctacagcatcttattacattggccttgcaagttgattttaaaaaaataaacaaacagatctcaaggcattttaatagccagatctccacaatttgtatgtattgtgaagccattctctcacgtgtggctgtgtaggggttacctagagggatcgtgatagcgaattttaataaaaaccccaactaagttcagaaagtaagtgaaatattaactgcgtctaaagggagccttgactgtgtaactttagtgtatttagatatttgttaattttgtctactgggtctacaggggacagagagcctcactgatgtgttctaaatggttgtctgaatacagatcccccttccctattggtatcagtaggtctagaactctgcccagatggttttgtttctaggcattttttatctgtgtatgtccttgtaagttggaaggagtaaatatatagatattatcttcatatttcactttggtgaaaaaaccacaagtcctatggttttactaattattcagcatttaaacatccatacagcatttttatctatatagaaacatagttgttctaagaagtacatactgaattttttttaaggcaagttctagtccttttgaaagtgtggaccacatctggagttgttaggaaagaaagtggaatttactctaatttatgtgtataaaatacaatgttattagaaagaatgggatttgaaagggcacacggtaaagcccataacatttagtgggtaatgtggagaactcaaagccaagacaaaaataccatcaacccatgcaaaccctaaaatagattacaatgacctcagtcattttcattttcaaaaataatagccatgattaaaatgggggagtgttttgcttggaacc

SEQ ID NO: 32960 - DNA, 1034 bp, Homo sapiens
cccctgggtctgagaaatcaacctaaatatagggctctttgggtcatcagtccatctgtttctcttttgggtgttgttctttacactcgctgctacagtgtcaaagggcgccggtggaactgttttccctgtttgcttttaaatgaggccgatgtctttattttcatctgaagggaaataaatgtacatatacttgaggtttgcgggcttcgatttggactaaaggttgggagagagagagagtgtgtgtgtgggggggggagttggcgggagtgggatggtgggtgggggtgggtagcccttttcaaccatgcctaagttgtgaagtgaaagcttaaggcttcgcgccgcaactcactgcccgataacttctgaagtgaaagcagaacacaaaacccttcgaattttcttgagcaactttttcaactattttaattgccaagcaagacatacgatgccgtcttaaaatattcccgcacgcacagtccactcagcatccagaaactgagcctcgtttccgatctgatgatacttgtcattcaactggtgggagacccatttattttgtccccagggtctctaaggatgccgctgccgctttctgatagctagatctcaactcttacaaacttttactgagcctcagattcccgcttgcactactccagctgttgctgccgcagctgcctttcccagacagaagcgctgcgttgcaattcttcagttacaatctgggtaataaaggaaatcatattaaaactacagatttttgtattttaaagcgcgatttccttcccccgagtagcgcgtggcggagatggttggtgacccctgcggtgcaatcatccaacgaaaacttcactgctctgcaccagtttttctttttctgggtttagaaggggagttgtgactacaatactttaaaaaacaaaactacctttattgtggcaagagaaaacattacaatggaaacaaattacatataaatagttgttttctcggtagcttgttgttctttttgtcttttgtaaatt

SEQ ID NO: 32961 - DNA, 1036 bp, Homo sapiens
tatttctaactttaaaatatatccagaatctactactacttatttctttcactgctgccaccctggcctgaaccaccatcacccttgcttgggttttatctatagattcctgtttaccctgattccactcttataatcctataccagtcagaatgatcctcttaagctgcattctggaccattctgatcttacttctggacgagtctgaccttatttcctagtagtccccaccccctgcttatttcctatcaaccactgtggcttccttgtggttccttgaacgtgttaacattgtttggtggaaccacaattacaattctactgtcctgaattctaatataatagtctattcataagactatggtgattaaaagactaaaagatcaaacaactcatttggttttttaccttgcatgaatcttgagattgctagaagttgcaaactgtaagttgcatacatcacatttatagggtttttcttcaccatgatgcatgcgactatggaagactagctgacatttctgagcaaatcctttatcacacaattcacatttgtatggcttctcacctaaaggaacaataaaatttatatttagaagaaaatagtgttttggttgcataagtcatataagatttcatcaacagtactagctttgttattaagaaaatgttaactgttggaactgaaaacaaatataatcttttccagaccactgaaaacaccagtagaatcaaaagaaattagtgtttctgaattcacgagataaatacatacagcattttaaaaagtacgaatctagggctgggctcggtggctcacgcctataatcccagcactttggaaggcggaggcgggcggatcacgagttcaggagatcgagaccatcctggctaacatggtgaaacccagtctctactaaaaatacaaaaaaattagccggacttggtggcaggcacctgtaatcccagctactcgggaggctgaggcagcagaatggcttgaacccgggaggcggagcttgcagtgagccgaga

SEQ ID NO: 32962 - DNA, 1061 bp, Homo sapiens
tataatttcattctgtgtaattaaatgaataaaaatctatttacaatacctggaaaatattaaaattcagcaatgttattcagaatattttattttaaactacaaattagcacagctaatttgaatatttaaatttccgtaagcactgtaaattgaatacattttttcttaatgatatagtttttttcctaaaaatcctaggcatattcagacttaattcaaatgggttgtctaaaaccagacaatacagatgtggagccatttgtggtagatggacgtgtatatcttgcagaagtctccaatggccttaaaaagcattattattggacatcaacttatggagaatcttatgaccactcatctaatgcaggttttgctcttgttccagtaggtcaacagccatgaaaaagtagctgtaaaataattttcatacacttgtcttattgtttcacagagattaatattctatagcctattttcttttataaattaaaacaagttacttttttcaaatgtgtaaaagataatgactgtattaaactttgtataactgtctattgtgaaaaactgagtagggtaattttttaaaagaaattttacaatatagagactaaaattctaaccctggagaaagagaccaaggaactagactaaatttctttttataatgaaaatataaccaagtagtgaaatagcgtacaagtaaaggtcattgtaggtatctaactgaaagttattaagtagtattaataaaaaggtttgtggtagaaaattaccagtgactttcaaagggtttcaaagttcagaagttgaaaaagtattctacctatcctatttacgtgttacagacaggtgttactaacaatttcataaatacaggcaaatatatataaacatatacatacccctttcccaacaagccagtgctgccagctctcccactctcctctcataaccactatcctgacttctaaccccacagagtagttttgcctgttcttgacctttatataaatggaagcatacagtatacactctctttgtgtctggcttcttttgtt

SEQ ID NO: 32963 - DNA, 1104 bp, Homo sapiens
tcacaatcaatgaaaacaaatctcactttctctcatatctacatttggggaaacaaatttgatgaggctacgtgtatagtaagttttaagttttttccttcactgaaggctttttctgggatcatctctgtaacatcagatattatttacaggtgcctcagaaatggttacacagtgagacactgcagttttgataattaacataagtcttaaaattaactactagagagtttggtggttcaaataaccaaagatattaaaactatgtattagtattacacatcactgaatgacacagttctaattcctctaaggttaagaaaaatcataattattgatcagatgtagcaaaatttctgatctgctccctaataattataccaaaatatggaatgggagagatagagtacaagctatcaaaatatttggcatgttgctcacataaatacagacagcctttgatactactttcaaaacagaaataatggtaacagttttcatttggaaagaacgagggggaaaaagtagatgttaaaattctcaaaatttgcaaaaggactaacaaaaattccaccactaaaaagagtaataaaacatagagtgttgtctaaaccaccctcccaaaaaaaccaacccttacttttagaaaaacatccataattctttaggttctacacatcagtagctgaataagttgagtctggaactggaactaatgatgaatgacaagctaaagcaaaaaccaacttgacttttaaatcttttaatgtctaaatttccatctttctccatattgccaaccttactgacaaaccagttcaacgtatttgtatgactctgttacatagatactaaggatcgtggctcatgcctgtaatcccagcactttgggaggctaaggcggggggatcacgaggtcaagagattgagaccatcctggccaacatggtgaaaccccatctctactaaaagtacaaaaattagctgggtgtggtggtgcgctgggcctgtagtcccagctattcgggaggctgaggcaggagaatctcttgaacccaggaggcaggggttgcagtgagccgagatcgtgccactgcactccag

SEQ ID NO: 32964 - DNA, 1027 bp, Homo sapiens
atagccagtaaaaggtagagctagtatctgacagacttgatttttataaagctcatgtactttctgctattgctatgtggtttcatttaaagtttttttcaaagtacctttatatataacaagaacacatatagttatctgtgttcatcatcagcatttccagtgactaaaaaacttattatgttatacagcaatcatgcaagagtacttcttgtcacaaaatactttgggccattcatttgaaaatatgctttgattttactaaaaacttaaaatgcctggtattcaaatcttcattgatgccatgtatcttttacctagaagtagctagattgtggaacttaaaaaaaagtcttctgatgatcagaaaataagaataaaacctcttaggaatttgagatgaatataaagggaaggatcagatatatcacagggttaatgagtgtattcttaatataaaataaagattgggaaatgtctttgtattttgtctgaaaaccatcaagagtagagatcaagagcaaagttcaggaacatatggaaggtataagaaaggtttagagacttgaaagatggattacatgctcaatacatgatgggaccaatttttttttcctttcgaaatgactgattattgtttttttaaaaaaccaaattaaccagcctcttttacatcacttaggtagcaggcacttgtaaaatatagtgactatattttaccttctgagaaggtaaaaaatatcatttgtggcaaagataattttttaaagatagaccaaacaaatgcaaattgtggactaacagttttaaccaatataatctttttaaaaagctaatttaaataacagcatatgtctgaaataaacatgtactacttcaaaattatattttagaaataagattttatccacttttaggaagagtctacagtccatgtaggccgcatgttgaaagaaaatcactgtcttgttgcactacacatgtgtaagcatgatataaaaaacagtggtatacaacagttatgtga

SEQ ID NO: 32965 - DNA, 1050 bp, Homo sapiens
gaggaacactagagaacctagtctctagttgttaaacttaagtactggccaagaagcctttctcctgccgttcctgtgctaactgtaccacctggtgacagaatagtaagtgaggtgatgtttactttttttggaagtactctagctaatatgagtgaataaggaatgataaaatttggaaactgcccaatttgccacctctgatgtactaaatggaggtagccaaagatcatcaatactaatactgaaaggtggaaattgaagagtaccttgctatctacaaagtgggcttgccaaaaaattagaacccgaccaaacctgtagattcaactactgatgttcaagaaagaggacaataacttatttaatgaccccacaggatgcagtaaagaaaatccacatggtggtatgctctataggattacaatttgttacttcaataaattgtttcaacaacaatacaaaaattaagacttaggatatatcaactaagtgcaatgtgtagaatttatctgaattcatggcaacaaagaattacatatataagacaatgggaaattatggtatgatgggctgaattatatccccccaaattcatatgttgaagcctttaactcccagcacctccaaatgtgactatatttggagataggacctttaaagaggtaatttggacacacacacatgatactagggatgctggtacacagagaaaaggctgtgggagggcacagcgagaagacagccatctacaggctgcaaaaggccccaggagaaaccgcccctgggacacctcgatctcaccctttcagcccccagagctgttgtttcagccacccagcctgtggtggtttgttatggcagccctaacaaattaatatgtgtggttatatttaaatctcactatttaaaataatacatactaaaatatttacagatgaaataggttgtctggaatttgcgccaacataatgcagtgtgtgtgctgggggtcgagtggatgaaagtatagatggggcaggatcgaccactggttaatggctgttctaa

SEQ ID NO: 32966 - DNA, 1072 bp, Homo sapiens
ggataatagttcctgtcagagttgctataaggattaaatcagttgctgcatgtaaaacaaacacttaagacggtacctggcacacaggacacatttcttaaatctttttgccattattagtgttccatagcgcttgttttaggacattttttcaaataacagaaagtaatccatttgtggatcatcaactcaatttagtggataaaaaccagcatttaaaaaatgacactaaaaaacatatttgcatgatatgtaagggtaagtattgttatacttgtatgtacatgtacatgttatacatgttatgtaagggtaagtatgttacttgtatgtacacataaacgtacatacaagtctataggtcatgatgttaaaaaatatatcttactataaatatcaaaaaaaatcaaaagccaccaatttaggaaaagctaggtttagatttatgcaatatagtatttttaaatggtgataaaaaatatctatgtagcttaattcctaaagtaatgtaagatgatgatcctgccactcatattgttttactccagtgaagcaactctgcctatccaccgggggagatttggcaatgtctggagacattttttattgtgtctactgggcatggaggtgccaccaatcagtcagtgggcagagagcagggatcctgctaaactgccccacaacaaaaaattaaccaaccccaaatgtcaagcgtgccgaggatgagaaattctacttttacgtgtgatacatcattgctaacgtgattatgatgtgatatgcaagtatgtgatgacatacaagttttataatatgaaaacgaatctgctgaatcatcgaaagggacctagtcactgctcccagttccataaggtgagcaaccaaaaccctcttcttccaggaatatttgcattaaaaacagagatatactttttaaaattaattagctacatttaaaatgaggtaatcttcttcttcctcttacattgaactttatgccaaatcattttaagaacaatttttactttcttgctttcatttgaacatttaataaaaatgtttaggttgatat

SEQ ID NO: 32967 - DNA, 1511 bp, Homo sapiens
cctaatccgttttaaaattgtactatgagaaagcttttttttgaaagttgtaaagcattaatacaaataatacaaatataattattaccatcacattccagagaatatggctttttctaaactttcaatttagaaaacatacattaagggagaatctctgccctccttttcagctctgaagatcagcttttctactcagacacatgcacacaccccttccaagtgtcatgtttatgggaacatttgggaaatgttttccagatgttttattttttcccttttatagtttgttgacatttaattttacttaaagatgacaattttaatcggaaatgttagaggtacaacatagtgaggttctagctagctttatacttttgaaaaatatttttgtttctactgctttttacaagtactagtcctctcagtgatactggtggtgttcagtatgaatccatagaaagaaaacaaaatttgttgtttaaaaaaagcagagtaatgaatgaatttcagttttgaaaacaacataatttgaaaacactgttatactaacatggcaaggtgttaattaaatataagagtaaggtagtaagttcttttagagcacctgtttaaatttactccagtaatcatcttaaggattgatagtcaccatcacttattggcttaaaagttatatttcatggaatattatcagtgttaaatccaagctttgtggagctttaagtgatggtggtgaaaaagttggtgtttatgagagagtggtggggtgtctagtcattagtgaagttaaacatcaacctgttttagaaagaattttttagtcttgcctaaagtaaaccagaagtgtctagtgtttaaatctttatttagaatgcttctcttaaaagtattttttgttttgggtagtattaaataatcagtaaataatctatttcagtagtaaataatgaattaagatgatgatgaatgaggattaacacactggtctggagactggggttttatttcagtgggttagctgtgtgtgacatgttgggcaattactcagctgttttaacagcttccagatatgcagtatggtgcctgtactactcaaaagttgattttggtttaattcatctttaaggtacctcccagctctaaaactatgattctaggctgtgtaatggggttattcctactttattctctttccttttttaagggttcattttatacttaataagcatccatttcttgggtcacctacagtctttgttctcctaaggattaaaatagaaaattcatacataacaagcaaatgatgacattttcctaaatgctccttattggttaaccactgaatatatgaacacatatgaatattgtcattcatgtacttaaattcatttagcaaactatttgaacacttacatgtgcagtgtttggtgaacatgacatgaggaactagtagtaagtaaaatcttccccccaaaattcattgtggcttaaataaatatgaacataat

SEQ ID NO: 32968 - DNA, 1058 bp, Homo sapiens
aaaggatgaagcttactaaacatatatgatggaagtattattcagataacattaatattctgctgaataattttttctagtttaatcatactagaaaaagaaaaaaaatctacaaattgtcctataaaataaggacaaacatgcaaataatttaactctcagaaagtactaattcattctgattatctttcatacctctgtgctcctctgcactgacgaagacataatatgattatacctatgaactagtgcacagccttttctggcaagaaaatagtttgtagcagatacgtggttgctctttggatttttttctattgttgaacatgctgggactagctagaatgcacattcctacttcctttaccaaacgtttgcatgcttcctgcaaagcacttaccaagtgatttctcttgaaccatcggatataattttgtatgtacatgtttgaggaaaaaaatgtaaagcaaaaccttttactgaacagtgttctatagaattatgacactaaaacaaaattgtttgtggaagccctgaaagctttatagtcctggacatcaaaaattttatttgagatgatgaatgttttgttttcatcttttcttatattaccacaattgagatattttagtaattgaaggaacatacacagatatttggcagaagtcgagtaaggaggggaaaaaaagagtccgtgagtttcagtcattttcactgctcttttcaaaaagattgtgttgagctggtagaagactaaagatgtcactgaagacatcacagatactatatttatcttttggctttgtgtacattagagaatgttgattatttttatacaaaaatacagcgggtaatttttttaatctttagatgcctcttgtttgaatgtatgctttgtggaattctttgtgtagtaatgttttaaaaaaagatgtttactgatagttacatgtaggattagaatatgtaatataatataaggctcatgttccagacctacgatagcttgtagtctatgttacgtatttctttatatcacatttttaatcattggatta

SEQ ID NO: 32969 - DNA, 1031 bp, Homo sapiens
ctctgcattaaaaagttatctacaggaataattcttattttcaatttactgcgggttatcttctttaacctttccttgctatggtgaactgccttttgcagagatcagtttgtcctctgtttattgaagggtgaatccacagtagatttgatttttctgtaggcatataaactaggaatcattttttaaaacatgactatttactggtttttgtaatatcagtattgggacttgtttattctgtagtattgagtggcaggtgataccttttcaccaaccttactgtggtcaatttttgtgcagggtgttttattttgagtttagctggagaagtgatgccagacacttgaaagatcagttgggacccatgtgcagaggtccttgcctgtgctgagagctgcactacacttgcttctggtgaggtgaagctagctcagctgactggctgtgtcagttggtgtatgttttgtacacatccccgggatccaggcattttaccaaagtagatgttaatgtcagaaactcagaactttatctcagtataccttgagcacttaaaattgtttttaaaatatatttttctgtaatgagattctggaagcatacttgcttccaatttttctaagtcacttttttttaaatttctatactgatgtaactatactttttttgtggttagcttaagaaagttgtgatctaaaatgcattcctatttgatcgtgctaattcccaaaacactttttgttctatattattttgctaatacatttactgttcacctacaagaggatatttgaagaggaatctcacaatacagaggaacaggaatgtgctacatattttcctcatggagaactccttgtttctattcccaaatgtagctcttatagttctcattacttctcattgctcttgttttctgaatctaagtaagtcccaccctatctttctctctcttcttttctttcctgtgttcttgtaagtaagactgaagagagaagaacattagttctttcataaaaagaaggatg

SEQ ID NO: 32970 - DNA, 1063 bp, Homo sapiens
agtgatcaaatcagagtaactggcatatccatcatctcaaatcattgatcatttcttagtgttgagaacatacaaaatcccctattaaaactaatggaaagcttcatgaatttgaatgtcatttttgggcaggagccatgctaatcttctctgtattgttccagttttagtatatgtgctgcggaagtgagcactggccctaatttttaggaggtagtggaaatgatattttaagatactagaaatcttattgaaacacgttgtagctatccttaaaaactgtggccgggtgcagtggctcatgcctgtaatcctagcactttgggaggccgaggtgggtggataacctaaggtcaggagttcgagaccagcctgaccaacatggagaaaccccgtctctaataaaaatatacaaaattagccgggcgtggtggcgtatgcctgtaatcccagctacttgggaggcttaggcaggagaatcacttgaacccaggaggcggaggttgcagtgagccaaaatcgcgcacttgcactccagtctgggcaacaagagcgaaactcccatcttaaaaaaaaaaaaattgccctgattactaaccaatccatgccattgtttgcatatgtgcaaataactgcccaaagaaatgagggggtctgtcaaagataaaggcttctcctttgggttccttagccacagtttataccattgattgcctaactgcagctcggtgtgaaattcagtaacatggaagcaagaaatggaagcctatgacctaatatgttttcttccttagatcaacctctccacttctcctacacctgcacagttaataagccgttcccaggcttccagttctaccagcggcagtattacccaacagactatgttactagggagtacttcccctaccctaacggcaagccaagctcaaatgtatctccgagctcaaatggtaagatatgagctaccaaattttttcagtgtttaaggacttgagagatcaaaatgtttcttgatttgatacaataagaggtatttttaatatttaagaaatgtttaatt

SEQ ID NO: 32971 - DNA, 1078 bp, Homo sapiens
ctgctttaacatgataaaagcaaattaatatactaaggtaagcattaaagagaaaaatagcatttcctctctgattctaaaattaatatctacatagaaaagttaaaaactttaaaaaaagtaatcccggattttactcctagaaggcattatatatatacacctttaacattttggtgactgttctcacaggtagtggtgcatgggtgtgtgtgtgtttctatattgagtctagtcatatatcatgttatgagtatgtattattgtgtgtatatccaatgcagtcatttttcttaacttttttttttggagacagggtctcgctctgtcacccaggttggagtgcagtgctgcaatctcggctcactgcaacctccgcctcccaggctcaagtgatctcccagctcagccgcctgagtagctgggaccacaggtgtgcaccacaatgcctggctaattttttgtatttttggtagatacagggtttcaccatgttgaccaggctggtctcgaactcctgagctcaagctatccacctgtctcagcttcccaaagtgctgggattactggcatgagccactatgcctggccatctttcttaacatgtttttcacatttgtgatacatatacacacacagacatttgtatgtacctatatgaatgatactctacatgttgttttgctgcctttttactcagcagtggacacaaaaatcttttaatgccactgaatacagatacatcattcttttaatgtgaaatgtttctctatttagggtatacctgattgattctgatcagtgaaacggtagaggcaactctcaaatggactttggctatgggtagtaatcggttggaaactccttttgaggacattaacaggtagttgggagttaagtggctttttctggcagacttgtttctttctggtgactcctagaattagcgtcagtggggagacagcttgcagtaatcgggctcagtaagtgagtttctttgtggagtgtgacttgagatatgaagtgacaggattggtcagggtcttcagtgaaagggaattaggagtgttgggatgga

SEQ ID NO: 32972 - DNA, 1055 bp, Homo sapiens
tcttgccatgttgcccaggctggtctcgaactcctgagctcaagtgatccacctgctttggcctcccagagtgctggggttacaggtgtgagccactgtgcctggcctatcaggtttttttttttctttttttgaaatttttcttttttgagatggagtctcactctgtggcctaggcttgagtgcagtggtgtggtcttggctcactgcaacctctgccagccaggttcaagcgatttctcctgcctcagcctcccaagtagctgggattacaggtgcctgccactatgtccagctaattttttgtatttttagtggagatggggtttcaccatgttggcaggctggtttcgaacttctgacctcgtgattcgcctgcctcgattttttgttgagatggagtctctgtcacccaggctggagtgcagtggcacaatcttggctcaccatgcctggcccgcattgagtatttaattaaggatcacattgaatatttaattaaggatcacatactgcattgaagactcttttttctttttaatataaaaatagacttcattttttttctttcatgacgtttgaagagctcaggtcagcttaccttatggaatttccaatagtctagatttgtgtgattgttttctcaatccttttttactgtattaattgctatttcagtggggtttagtaggagggataagcaaatggtttgtttctttattgtcttctttatttattggttgtaaatatgatttttaatgagtatataatgttctaccatttttaaaaactacttttctcttgctggtggttttaatttttctgtctttttgctaatataagtaaacctgcattgactattttattatatatatttgtatatatttttagttattattttcttcttaaaaatttcctgagagtatattcagtgggtcagtgagattgtttttagatcaagaaccttaaaactgttcagttttctcaaaaatgtccaaatcacatcagccacatatcagagtccatttgatatatttatactatataggggatgt

SEQ ID NO: 32973 - DNA, 1025 bp, Homo sapiens
tatcattcttctggggtaactgcctgttttttctttccagaatctttgagatatgcctgtttgctttagttttttattttgtagtttcatggcaatgtgtctagatgtcattgtgtaggacacctgttgggccctcttagtgtgaaactaggtttttaatgatcatgtatgtgaaactaaacaaatctgcaagaagttaattttgttctttaatgatcatatatgtgaaactgaacaaatccacgagaaattaattttctgttttctctttctggagctcttggttgaatgttgacctttctggattgatcctttatcttgtttaccttttcacttactgcctttttttgtgtgtgggatatttccttaactttttcttttagccctttctttgacttttaaaaaatttttagttcagccactatttataatttctcagagcattttcttgttttctcattgttctttcaaactaatattccgtttttctattatggataaaatactttggatctctgttatgctatttatcagatttttttttttttttttttttttgagaccgagtctcgctctgtcttccaggctggagtgcagtggcgtgatctcggctcactgcaagctccgcctcccaggttcacgcccgttctcctgcctcagcctcctgaatagctgggactgcaggcgcctgccaccacgccctgctaattttttgtatttttagtggatacgcggtttcaccatgttagccaggatggtctcgatctcctgaccttgtgatctgcccgccttggcctcccaaagtgctgggattacaggtgtgagccaccacgcccggcccagattttattttacttttattttcactttttttttttttttcaagacaggttctcactttgttgtccatgctggagtgcagtggtgctaatatggcttattgcaactgccacctcccaggctcaagtgatcctccctgctcagcccttcaagtagctgagattatagtcgtgtgccaccacacc

SEQ ID NO: 32974 - DNA, 1263 bp, Homo sapiens
aaactacaatcataagtctctgagtgacttaagggctatgtatatgtcattctctttccttgttgcattttggcccataactacatgaatccctgatattttggcttcgactcactgtactattctgtcagaaagggaaaaaacttttttttttttatgactttctagttatgatgctagacaagatgagcttttgaagcccagttttatgactttgttcattcatgcattcactcattcagtcatcaaatatttatcgagcgtttaatattcgccaaatcctcttctaggtgctgaggatacagtaccacaacaaacaaatctctttcctcatggagctagggatagacgaacattaaacaagtacgtagtatgtcagatgatggtaagtgaaagagaaaaataaagcaaggaaataaaaaaggagaaaaataaagcaatgggggaatatgccattttaattaggatggtcagggaaagccttgttaataaaggtggcctttttaagaatggtgaggagggcagacatgcacagggaacagaaaggaggacagtgtggctggagtggaatgtgagagtgggagtgtggtttaaagatgacatcagagaggtaattgtaatcctaatcatgaggaaattataagacctttgggttttagtaagtatgagttgggaagctgttggagagctgttctggtatggaagtgacatgatctcaaattggtttttgagagtaggttctaggggtcaaagacagaagcatggagttaaatgttcttgtaataattcaaatggagagatattggcaatttggatcatgatggtgatattagaggtggagaaaagtagttagctagattgtaaattttttttaacctttaattatagaaatttggatatgttttgaaaggagagctaacacaagatatgcggatgcactgaataaaagatgtgaggagtcaaggatgactccatagtattttggctcaagcatctggaaaaattgggagctaaaggaggtattggagaagaaaattaggagtttgattttggacatgttaagttgatgatgtgtattagacacccacctatagtattgagtaggcattggttatatgagtttggagttcatgtgggaggtttcatgattaatgatgtctcatgtggctccttcaacattcatgtcacaagagtacttgatgacttcactactgttcatggtgtgatgagagaaagttgagtagaatggaagagatgagggac

SEQ ID NO: 32975 - DNA, 1079 bp, Homo sapiens
tccatttgcactgatcatgttcagatcttatgtggtttcagctttctgtgtgtattgaaagcctaaaatatacaatgcagggatattggccatgaatttactgtgatatacaatagtatgtcatgtccttggtagacatctaagcatttctaactttgtgcaattcacattttagaaattatactttcagcttacatgagttatttgggttcaatttgcaagtatccattcaagatagggtaatttattttgagaaaggagtaaaagaaagctgattcgctatattgcacatatatattgggaaattgtgccaagtttcccaggtaaaataaatttatgggcatggtaatacttgtttagcttttaattttggtataattttaaactgcaataataataaaaaaatttctgtatctactctactcagattaatcaattattgcatattgccccattactttatcattcattcttttccactacatgtatacatatttttttctgagtcatttgtaagttgagatatgttcctttattcctaaatactttgatgtgtatttcctaagaacaaggctattgttttttgaagccacagaaaaattactaaattcaggaaatataacattgatacagtgcagttcattttcacatttcatcatttgtctcaggtttcccaacctcatcactatggacattatgagccagataattctttgttgtcaggggctatcgtgtaatttataggatgtttagcagcatccctggctactagatgccggcagcttgtggtctttctccttcctctagtgtgacaactataggtgtttcctggtggggggcaaactgcctgtagttgagaacctaataatgtcctttctagatattttttcctggtccagaatggtaatactttgatacttcataaaattggctccaatacaatatagtttgtaggttgttaaggaattgaaggttaaggaattgtgctctatttcttcagctaagggtatggtctttgctaactacatgctgtggtcagcatatagctgtggttttttttgttgtttggtttttttttc

SEQ ID NO: 32976 - DNA, 1027 bp, Homo sapiens
gccccgcgggcagccttgttacggctgcctgcgcaggggcccgcggaggctgggtagggcagggcgggcactgccaggcctccttcgccttcttctccttcccgccccggcgccaccccactcctcctcagcgggagaatccgacacgcggggctgcccgcttccctcgtgccggaggcatcccggcgtgggcctgagagcggcgggggctgcttgcaggtctggtgaggctgaaaacaccctgaaagaaaggtctttccctcgattctctgggtgcagcgttgctgcctcacacgcgggccacattcttgtgtgtcggtgtgacggtatgtttagttaacgactccagaacttactgtttcctgggtaggcctcttgtgcaccagaactgctggctgtattttgcaggtattagtatgcctagacggtggagttaccaaagttgttcttttgtgccaggcctcgaaatgcagtgcgatggtttggccagttccgctcaaccgatgtttagacttatgccgagaatttggattctctgtgaccatttttggttaggagttagaactgtttaccatactgtttggattggagggcatagttgagcagattaacacttttaaaaaaccagaacttaagctggccttttgcatgtcactggtacacgatacggtagtagtatgacaggcagcagttcggtaaaaagtttaccttacctaccactaatactgtataatgttgaacagttaccatatgatgctgtgatttgattggaaggcagtttggaaaaaaaaaaaaaaaacagaagcataaaaatgtatgaattatttactaatccaaaaagtaagtgaggagtcagctttcttcctgacggttttcctttcacttttcctcttattttctttttctttctttgtgacagcgtctctcactcttatctcccaggctggagtgcagtggcacgatcatagctcactgcagcctggccctcttgggctcaagcgatttccccaccttagcctctcaagtt

SEQ ID NO: 32977 - DNA, 1038 bp, Homo sapiens
aagctagccaatgcaggactgaagtccatgttttcatcttgagggcaatgggagcttgtaatgaaagtaacgtgacctgatgagatatgcattttgaaaaagatcagactgtattgtggagaatggatttgttgttgttttgttttttgagatggagtctcacttcgttgcccaggctggagttcagtggcatgatcatggctcactgcaacctccacctcctaggctcaagtgataatcctgcctcagtctcccgagtagctgggattacaggtgcctatcccacgcccagctaacttttgtattttttttagtagagatgagatttcaccatgttggctaggctggtcttgaaatcctgacctcaagtgatccacctgtctcggcctcccaaagtgctgggattacaggtgtgagccaccgcaccagacctgttctcagtattttacatgaattgaatcatttatcatcataacattcttttgagataagtattaatatccacattggcagctagggaaactgaggaacatagagttaagtaattcgtccaaagtcacacagtaagttatgcaacccaaagttgagaaagagggtagctttgggaaatcggacagggacaatgcaaattttaaggttaaattgcatttaggaagtaatgaacagtgaggatgggtgaaattgcctgacagaaatgtcatgatctgatctagtttagattacagtgaagtatttcgttagtctatgacaagaaggaatgagaatgcagagaatctcttaatcagactatgcattttgagaatgtgacttcacagtcgtgaagctgactttattctgaagggctgaatattctgaaagagagcaaatgagaatcaagtattgacaaacaccaattgcttcctccattcttttcctagagtgatctttcaaaaacacatctgatattcacatgtttaaaattcttgaaagctaatttagcatttaatatttattatgtgccagggactgggtatattatgtcaagtaagatattcatgc

SEQ ID NO: 32978 - DNA, 1408 bp, Homo sapiens
gaaatagattgagaaacaaaattaaattcagaaattagaactaagaaggcacctgtccaggcactgtggctcacgccggtaatcccagcactttgggaggccgaggcaggcggatcacgagatcaggagttcgagaccaccagggaggtggaggttgcagtgagccaagattgcgccactgcactccagcctggcgacagagccagactccatctcaaaaaaaaaaaaaaagaaggcacctgtagggataatataccttctccagccttctgttgtatatcagtagtacaaatgcaggcaaaatagtttcccaataattcccccttttcagtgttctttcctattctgactacatctaagacagaatctgcagtcattaactctccccacactcccttttagatcatgttttgcttccttagcttactgtgcctcccagcacttagtggttacagtgcttattctagaattcatatatactatagcattttttgtttcactttttattgtggaaattttcaaagtatagtataatgaatcctgtgtacctgtcactcagcttcaacaattaccagtgtgattaattctgtctctgcaattttttgacaaagacactggatcatttcttctgtagactttcccactgtatggattttgctaattgcatttccttgttttttaacatgttcctctgtcccttgtgtttcctgaaacttggtagtaagatatagagtcttaatcagattcagttcagatttttattttcttcctttctttcctttagcaggactactccataatgttctatgcaatcattagataaataagtctgattgtttctccttttgtgatattatcagatatgtgaatactgcctcaacatattaattggaggagaaaaaatttatgatctgtcattccttcatttgtttctcttagccagaatacttctataaaaagaaacttcccttcatcaatttttgtttgtttgtttgccttaagagacagtaccagtgtctgtgcgtgtagcgggggtgggtgtatttgactctttccctttaaggtacagtttataaaataaattggttcctagcatccactaaagatgatgaaatacatatttttttcattataaactcgagcatttaaacatatttgtgtttcaatccattgttgttagtgtccttatttattctcacattgttccatcttggccagtgggagcttattcaagttagctcttgagtccctttgacatgggcctaattttaattctccttgatagctccttgctttttagtacaacagcttctccaggttcatcttacacacttcctgatctggacctggaattatgcaaggagccctagaatattttagtaggaaataaaaaataccccattctttt

SEQ ID NO: 32979 - DNA, 1213 bp, Homo sapiens
tgtctttctctgccccagagacatcataaatctggtgtatttcttgtttcttagatggaagtttccagtaattctttggactttcataagatccaagaggccagagatatttttaaatatataagaaacaatgaaaataaaagaaaaaaatgattaaagttgcaattaatatgcctagagagaaataagccttgataactttcctatttttagaaaacccactttaaaagagaggcagatgctaaaataggagaacaacaagtatcgcattaacaaccaaaatccttcttccagaagccatgttgtaccaacctcaacctgtggtgtgtggttctcaaatcccctgagctcctaaaccagagaaattctgtgtcatgcaaatgaggcactcctgatagagtgaagctcactatgagcagtcagtcatcactttttgagccctggcactgtgctctgtgctacaggacacaggaaacatcagtctgtgttctcaaggagtatgctgagatcctgttaccttctctcattatactgtaaacatgatagcaagaaaagaactgaaaataaatataccaccatgcaggatgattacagaggctgagtgctgtttaagttaaacctcctagtttatggatgccccaataagccagaatgttcttagtagatatttcttctttatagaagcataaagcccatggatctaataatcattttttgcattcctagtatgtgacaactctaggctgggtactgggtaataataatgaacaaagagacaaggactctgccatcacaagcaatgagagggaaggagaaagggagaattcaaaagataagataattgcaaattgtgatgagaactatgaaggaaaaagggtgaagagaaaagaagaggggctgttgggacaagacataggtgataagagcagacttctcacagaaagcatcatgtaggatgaatgagagggaaccaaccaaggccagagtggaaagaactttccaggcagagggaacagcatgtgtaaaagcaggtcaggttgtctgctgcccaaagaaggagggcaggggtcaggggagatcatgcagagcctggtgactcctggtgccaacttcagtgttttttccaggtaaagccaaacacttgctcagtctggctactgggcagagaataggtcaagaggggatgctgcaaaagtggggccagtccagacat

SEQ ID NO: 32980 - DNA, 1072 bp, Homo sapiens
tgcttggcactgaaaataccaacattaatgagatctgatcattgcaggactgtgtattgaatgcagtggtagagatgcacaaagggcaatgtggaggcagagtgaagagccacctaaaccattccagtgaggcttaaagaatgagttagccagagggaggcagagaatagaaaagaatcttccaggtaaagagggcaggctaaagtcaccagggattttctagcataatgtacataggaaacttttataagttaaatgctggtagagttaggagttggggcaggattttgttaaaaaaaattaggttagtgagacaggcaagaactagataatggagagcttgtaagccacagtaaggagcttcaagtttatcctgtggttgacagggagctactgaagattgaaagtagaagagtgattcggacttggtcagatttgtgttttggagggctcactttcacagctgtgaggagtggatatgagggggaaaggactgaagacggggtggccaccaagaaaactgttattcaggtaacagaggaagcaggtctgactaggacaggagaacttgattgtacaagcatcagcctggcagatgccaccaggccaactgagcccctgacaatagcaaagaacccctttctgataaataagaaaagtggctgccctcatggaagactcttgataagtacttcattgatttattggctttatatcattttgtcccaaacaagtacttacggcacaaaggaagaaagaagagcaagaaaaaaaaatggaagatacacacaagataaacaaatgagtgaagaaatgatattttgaaaactgatttaccaatctatcaaaatgccaggaattcaatttttttttccatgtctctgaacactattaaaagctcctttctaggaatgacatgttgaaaatgaaaatgcctctttggaatttcttcccaaacacatcagttctagcccacatttagattcattcaatccactgctccagtttagtaattgcaatggaagcttcttactatacattttctcgtctggactccccctgtcattttttc

SEQ ID NO: 32981 - DNA, 1088 bp, Homo sapiens
tcttagtaggaataaaaatcagtgcaaggatctttacattcttgatcttttaatgcttctcatcagcagtgtatgaactttttatgtaaagcattatttacagatgtcttttctcatattaggaaggcaggggctcaaagtgaccaagtagtaatacacgtttcaaaactttaaatatgaacatagcttatcagtatcttaactatcaagttataagaaaacctgggttaaaccctctggaagtaaaataaaaggatgccattttctttttttcaaatgcaccctctgtgcccatgccaccgtctcctgttgtgtagggtctggactattttgccccatgtgccactgaaggtatcacctagctctcttccacctactgcaacctcttctgtaatctgttccagcatttgttttgtaactcagctctatgccgtctcatcaagtttttttttcttcttctttgcttacttttccatctacttctcctcttcctcattccaaatcgatagtcctttatcagcaatgtaatgctcttatactgctttgttctctctgttcttgtttcttcattttgtaaaacacaagtgatcactgcatttctgagtacctttctgattaatatgttggatattgtagagcaagtgaaaatgctcagtcatttgcaaatcttgttgagctcttctctccctccttttactgagtattctttctgtcctggatgtcacattggccttgatttaaaagaatatgaatgtctctgcattaaaaagacagcttggagccaggcacggtggctcacgtctataatcccagcactttgggaggcaaaagcaggaggatctctggaacccaggagtagttagagaccagcctgggcaacacagtgaaaccgtgtctctacagataataataaaaattagctgggcatggtggtgcatgcctatggtcccagctacaccaaaggctgagggtgggacttgagcctgggaggttgagactgcagtgagtcatgattgcaccactgcactccagcctgggcaaagagtgagaccctgtttcaaataaatacataaataaatagacaggtt

SEQ ID NO: 32982 - DNA, 1044 bp, Homo sapiens
atgtgttttaataaggttccaccagattttcaaagtctttggttaaattggaactgacatttatgctaattagctgggtttgggagtgaaacaggtaaaattgaattacaatgggctccaaactatatttatttttaaaatagtggctctgagggatatttggttctatttgtcagttatttcatatctcgctactttctatcattcccttcccgcctggtgtgttaatctggtaatctgaaatctttttgtctgcctgtaacataataggctgttttcctgtagtccatctgtctcctacacgaggtgaaagtacttttcagaaatggcttgggttgatattattaatctttataagcagagaattccttgaataatttaacagccaaatggcatgagggggacttggtataaaaatgaattttcctgtcagctttaaaaattacagcgtggcctgccttttatctgtgcaactcaaatatcaaaacaatggatgtttatgctctttatacagttttctgttttgcattacctaagacctaagacgatgaagaaacatttagacaattttggtttacttttttttttctgctagaaaaccgcaataagttaattagccaaaagaaagtccttcttgttctctgaaacaacagatgctgcctttgaccttggaatttaagggaaaatctatttttgattacatgtcttgaatttcttggatttgccagtgttagggcagcagttgtgattgagtgcttttgaaagtatatgcatgattttcaaagaaatcagtctgcacagctgttgctaaagaaatcgttgttctccgtccttccagttcattactatataaggttttaaaaattattttttccccctacttttaattggagttatcctagttacagatgtcacagcctctgagctactggtcttccacccgacaccctgcttcgttgcaaaggcctaaggttggagtatgctgcatttgattggcagggtaacattgttcctctatgctgggatggggaaatacagccagtc

SEQ ID NO: 32983 - DNA, 1503 bp, Homo sapiens
ttccatcctttcagaattttgttcttggaggagaacagcttacttatttccaaatttgtaggctttttttttttccctcccaaataccaagagtcctcaggtcattgtgttgaaacagacagaggagtgacttttggaccacagaagagtttgagagattgtttcaattggactgcctgttttcttgtttttctgttttccaggacaactttggaagaagctgactgctttgaaatcaattcggtacacttcaaaaattaacttgctccataggcatttgtggtacaccagttaaacacagagttctgtgttaggcactaaaagaatatccttagaaagctagctgataggtagccttgtgggagaaaggagtaaagtccacgagtaagtataatcaacaaggcacgatgcagggcacttcagaagacttgagttgtgtgccatgggatcaggcagtaccctacttcagtctgtagatttgttcactaacttgaaatgggagtaaattaaaattcaaactgcactcatcctgtttatgtattcggtttactgataatcacaggttagtaattcagatctcaatggctgagatgtttgggctaagtattgtcaagggattgtcatatctgctttagaactggtttacaatactacactcattttatttacattacaaaagtaatgaatgcttattgtggaaatgtagaaatatgtagaaaaatgaaaatgaaaatccttaatcactcatagtccaactgcctagagactattgctggcctttttgttaaaaatacattttcccatggttaggatcatacttcatgtaaagtattgtaactttaaaaatattagcatttttttcatgtcatcaaatattctttataatattttaatggtagaatcgaagtagattgtatgtatctactgtcctttacatgacagttttatcatgcattccaatttcttgctgttatatctttgaacataaatctctatgaatttttcataatttgtgtatataattatatggacactatttctagatataactaggctcaaaccaattaacacagcctaataaggcagaggcagactgggaggggctggaaaccggcccatgagctggtgtatgccaacaaacacaccttgcaggtgctgccagaaggcctcgtctggcagccaaggcacacaatctgaaaattacagcaacagaccggattctggtagcacttggcatcaggacatccagagagcttgtggagtttcccaagaagtctgcttagatgtcttaagactgagaaaagagggaggaagtctagtgagaagcagcctggccatcagccagcctgggattcagctgaaggacctcggtctgttcaacccacaagcattgaggggctactgtgtaccagcactgtgctgggagcttgggatacttccacaaacagacgcagatctctgccttcatggaatgcatattctaatgacgaaaagcttccatgg

SEQ ID NO: 32984 - DNA, 1048 bp, Homo sapiens
tttaagggagttggttgcctcgtttctcagaaaggaggaagaaatttctagacttcttaaaaaatcagctccaatagccaggtgcattatgatttttttttccccccagaaaaactctatattcagactggagcttgataaatgtttgttgaaatgaattgaattgatttattcgctcagcttcagttgtgtgattttgtgagcaaatggatgaatcttactgctctggagaccacgcaaatatttgccaggtgtataatttgtacttttcctctattccaagcagggggaaggccagttacctgttacctggtgtggcattgtagcaagttgcttactctttgcttttatatttcctcctttacagggatgcctaggtttgtgtgtttggggttgagggtggggagagacaatgaaatagaggatggaaagaaagaatttctgggtattgtagaggaggatgacctggctacaataccgagatgtaatctcttggataatttgcatgactgcaagttaggaatacctgtgactctctatttccgtttccattaaggatcacattattcacttttttccttacaggttttagttatataacatcagtaacccaggaatgctagagatgcctctatcagatactttcatgacaagttttagccagagttatctcattctttctctttgtcaaaatagtgaaagttagtgaaaacaggacagtgtgtcctcttctttgggtggaggcaaagctgattttatattctcttcaaaagagttgcaaattaggcagattctgatttctccccagctaacacttctggtgatttcagctggagaaaatgaatgttttgtggcctaaatgtttagtacattttgttctaccattttgtacccacttgtgaacttatgaagagacacttcaaatacttcagaacttcaaaacctttccattccctcaagaaacctatcacagaagccaatcaccaaagcctccctcctgctccatatgaatatgcccctctgagagtgcttcagggaggaggtgcct

SEQ ID NO: 32985 - DNA, 1068 bp, Homo sapiens
tttatagataaacatgtggcatggtccttgccctccaagggtttgaagtctctgggtggagagacatgaaaatagatcacttcaatgttgtattccatgcaccacagcaagagtatacagagcagagccaaatctgtgggggctgtgggaagaccaggaaagccttcatataaaggtgactcttgagtggagtcttaaaagatgaatagatgtatgtggaaggggaattaagtaggtactctagggagaggtagtgttaccaaaggcttgactgcttttgatggcctgggccagggtcaataacctgaggtgaagtagggctgggaagcctttaagacagacatggacagatggctcttctggccttgagtcttggccttgagactcattagctgtgtgagcttaagcaagtcatttagcttttctgggccttggtttcatgtataacgaagaggtctggctagagggtctccagagttccttctagatatgacatcctttaattctaagtagagcactagtctggataacctccacaagttgcttccatgaatccacttacagcctgtgcttttccaactgcaaaactgttacagcaatactctaaaccattagcaaaatgatttatacggaatgcctaacattattaaggtacccatgtggcctggtggcattgcttggtgtagttgatgtgttgaaggatgtagacacatgcacattttataccattctctcattaattcagagccgcaaggttttagcaggttctcactgcctcagtgaatgatgatacaaaatttctaatagtgatgaaaagaggatgagattttctgttagggatggacatggattggcactcgtgtgctcaattttgatttgaagtatttagaatgctttagtccaaaatactttcattccacctcatattgtatcaatgagttgccaaataacttgatgcacaaccccctcatgacttgtagtttttagatctcataacacccttaatgacttcgtgattataaggcactttcaagtaattaaaccatcaatagttactattctgggtta

SEQ ID NO: 32986 - DNA, 1002 bp, Homo sapiens
atttaacagtgagaaatgtgttacttcttttttattatttcacttgaaaaagcatctccttttgcctgatttaaacacatttcatagaaatgtaaaatggaaagaaaatagaacttggctaatttcatagctgcagctgacttaaattttaaaattttgatagtattaaatgttaacacatgagagcccctgaagctaaagttgttatttatttgcttaatttaaataagtatttgcttttgattaaggcaatgcctggaatattgttttgaatttttattgtttgtttattttctttcaggaccccgcagggatctttgaattggtggaacttgttggaaatggaacatacgggcaagtttataaggtaagtacattgagtctgagagtggcttatgtacggtttcagttcatgaatgacaaattgcagtgctgtctatactggctcataaatggctcctaacaaatttaaaatgaattaatatacttgttgattgactctccatcttttaaaatatatctgtggttatgttgcttaaactggattctgtgatttgggtatttcccttcattatatattactgtgtttgtatgtgacacatgaattctgatggcacatatttgaagctcttcaagcgttcagtttcctttacttaatcactgccagaactggtttttgaaagagaaaagaatgccatctacttcagaaatttaagctattaaactattacagctggaaaagtagatgtgttattggcctaggacatgaattaaatgagtggagtgaacagtgttggaagaaaactgggttacctcacaaagcaaaagcttaatagcagcgacgaattttaggaaataattaaaagttaaacttgagttgagactgagctgtggaataagaagtcttgcttgcctgtgtactaatttctgcttacaaattcactcaaaaagtgtttttaaaaggtattttccccaagtataatctacgaaaaatggctggtt

SEQ ID NO: 32987 - DNA, 1158 bp, Homo sapiens
aaacaccaaacagttcaacttaaccaaacatttattggatataaagtgtagtcatttcctcatttagtgagagtctttatgtattagactccccgttggatgttttctatgtttcccctcattctcatcatatctctgctgggtagattttatcaatactttggtaccattaatatgcattgggataacttgggaatcttattaaaatgttaatcctgatgcagtaggtctgggcagggcccagatttctgcatttgtaacaaggttcccagatgagttggatggtcatgggtgcagtctgagtagcatgctgtttataggtgaagagactttggctctaagagattaagtgatttttcaaagataacacaactggaagtggtaaagccttattcaaatgctgatcttgctccctggagagttgccttccaagtgcagtaagacagatacattcaaagcgatctttggaatgtactttaatgtggaatttactctaatggagtgtaatgggaggaccttaggtaggaactatgatttgaatctgatctcaaaagactggtaaggctttgactgacaaagatgggacaaaaggactttttggatagcaagaacaaaaagggaacaaggacacagaatgcgggagtgtacagaacatcttctgggaatggtgagctggaggctgtagctgatgcctggggagaggtgtgctgtagctttaaagggaggctgaggttggatgggagagcagagtagaccggggaaccactgggagatttggaggacagtgtctgtgatagcacattgtaggtgctcaggaaatgtgcactggttgattgaatgtaatctagtttttagtcatctgttgcccatgttgcaccattgagatctccacagaattctgtggcctggctgaaacgccacagaattaccccaagatgacctttactgttgtttatatagagctttcttaatagtctctttgcctttggcaatataggacatattactttttcctccctttccaaatttttttttggctaagaaaatgctgcttttgcacagaccaataatacacattcttcttaaaagaagcattgttccttcagtagcaacttgtaatgggaaaagtggaacaaagacaaaatgcaattctggtct

SEQ ID NO: 32988 - DNA, 1033 bp, Homo sapiens
ctataatcccagctactagggaggctgaggtacaagaatcacttgaacccaggaggtggtggttgtagcgagctgagctcatgcttctgcactccagcctgggtgtcagagtgagactctgtctcaaaaaaaaaaaaaaaaaaaaaaaaaaggaaaaagaaaagaaaacagatattcttaataataataagtgtaaaatatctagaaattaatgtaataagaaatctgcaggacttatatgaagaaaaaattaaaacctaacaagggacatactaaaggcctgaattaatgcaaaaatatctcatgtttctgaataggaaaatttagtaatattattcccatattaatatggaatttcaataaaaatatcaagcaggaatttgttttaggatctgaaaaaattattttaaattttatttggaaatatcagataagaatagctttttaatctgctgttataatttgtgtttttgttgcacacgtgtatgtgcatgtgtgtgtatgtctgtgtgtgtgttctgtgtctgtgatgcaatatttgccgcataaaagttttaacagttatacacagtagattttgatttttattaatataagcactctgtttcaggtaatgacttttcctaagaattacatctggtttcataaggtgttttgtttgttttactttgtgtttgctcaattatgtatgattttccttttctttctataatttgtcttgatttgtttttgctgtatcacttgaaagcagcatatatagtaagatttactttttgaacccaatgtaagaggtttcttttaaaggaggaatttaaaccatttggttttacagccataaatgatgtgtttgatctcttctcattttatttattctactttctttagtgttttctttgtttttctatatagactgttttcaaaaatccaatttgaatatatacttaaacctgtagttctctaattatgcaaattaattaaaaaaggaatcctttaatgtccccattacataaaaaagagtcaagttaaattttat

SEQ ID NO: 32989 - DNA, 1086 bp, Homo sapiens
atacagagatccgagccccagatacagggtttgctttctagattgaaagagtctgttgaaggggtttgaaggctgggtgtccctctgtgatctctgaaccaaagctcttgccagttcagtcccccaaccccctttaattagtgtgtatgtttgcaaagagtacctgggggtattcaaagcagcagggacattcctgtgactattaagttctctgtccctttgaggccaggtctgtttcttttcttttctggaagcaaggtctcttgtatctcatcacttgatacaatgcaagttgcatcagatttaaaaaaataatcccctgtccttctttcctgtttcctccgtgtggctgctgccttctataagttgctgctggtttgcaggattcacaatcaggattttgtccctgtggagattttgtttagtttgcaaggaacatttttatttgagttgcatggttccttaataactcccctttgacaaatattctggttaaaatttctatgatcattatatttacttggttgtttagtatcgcatttttatactgaattatttcaaccatgttttcaaatggacagctctcaaaattttttaagtacatttaagtgaaacttggaatgtgcataagttgtgagatcatgtgaactctgcacttcacagacttgataaagtcaaacctttatccaggggatgcttcctccacaatacatgtaaatctgaatttaaaaatatacctaagaatatgcagaaactggaactctcatacattgccggtgggtctatgaaataactcagccactttgaaaaacagtttggctatttctgaaaaagttaaacttactacacgacctagcaagtccacttctgcgtatgtacccaagagaaatgaaaacataggtccacacagaaacttgtacaggagtgttcatgaggagcatcattcacagtggcccaaaaatggaaaccacccaaatgtctatcaactgatggataggtaaacaaagtgtagtgttttcatacaatagaatactattaggcaataaaaatgaaggaagtactgaatcaggctgcagcatgcatgaa

SEQ ID NO: 32990 - DNA, 1039 bp, Homo sapiens
gtcacttgtacacttcaaaagagtaagtcttatggaatgtgaattaaagctcaataaaactcttattaaaaagtagataaaagggttaataatctctctactgaacaattatcccccataatgaatcctgtttcatctgtactcctacccaccttctcccccatattattttaaagtagcatattatttcatttataaatatttcagtagtttgtgtacttaaaaaatacataaccataatagtattatcatgcctaaaaaatttaacgtgtaataaaatattcagtcagtgctcaactttctaatcatgtttttagactgcttagcattttgttgtggagatggatcataatatatttaaccagttcctgttgatgaagcttgaggttatttctaactttccaactgataaatagtgcttcaataaacatccttatatataagtctttgtgtgcatctctgtttccttaggataactccttagaaattgaatttagaatgaaagtgtatgaatgatctctaaggctctagatattgccagattggcttccaatttcttgtgctgtaggtgtgtagcatttataaatgaacacataagactctgaaaaatcaattagtttaccaaagatcgtagagctactaagtggctgagcttacgactgactggcccaaagccactgccaatagtgactcacatagccatcatttgatttatggaccttgtcatgacatcagaattatctgttgtattatcaccctgaggctcacagacttcccagaagcctttggtttagggcacaagttgtctttcatgagcatagtggtgttttaagagctatttccaaggtatttcttccttgtaactttgttttgtaagatgaccaatgtcagattataacgtgtttttttttttttcttgcctaaaaccttaaaaacctaatatggtagctatttggggattaacagtgacattcttgtggagtgtatctaggggatgtttgtttgtttatttatttatttatttgtttgtttgagatgg

SEQ ID NO: 32991 - DNA, 1040 bp, Homo sapiens
tggtctcaaactcctggctttaagtgatcctcctgccttggcctctcaaagcactgggattacagacgtgagccaattaaatactagtccttaactgaattaggactagaccaggtcaaaccctccagcttccatttaagtttttaaaatcaaattaattccagtaatacaaggatataataaaaattattgaaggggtatgccagtgactgctggtgtaaaatttaaatgtggaaacttctgttttcaggtctaaaatgactccaggtgtcgaagatccctgatctttggcaagaagatgcaaattttaaactaatctgtggtgaagcagagagaatactgggctaggaagctgggctcgtttcagctgtgcgatcctaaataagtccattcaataaagtgttatttagaactttcaagggctgcgctgtaactgtccacgtcccctgttgtgttttctcaacacagtggtccctctagaaccttctagatcatgttgcttctctgctcactactgtccaatggcttcttatctcacaaggaacaagtaatataatctcgtctcctttcactgtttcccttgctccctgcagacactcatttccccaccggctgtggaacaccctgactactctcccaactctaggcctttgtaggaagtccacagttttatgattctagaactatatttgccataatgcaattttggtgaggactgtatagtgggatgcagcaggtggccccgatatagttaagatcagtgcgttatgccctttcgggaagggcactgcgctgcagcctgttgttttctttgtgttaaatggtcccttttggaaactggctcacttgcagatgggcgcttagtgagcacttaactcccggcaaaggcagaggccacttcgctcattcctaccaatccagacttcggcttccaagaccaacataagcctcagttgtagagacattctgctgtctctgtctaagtagctcaaaaaatccatccctcaaaatctatcaataccttctaacaacttttattg

SEQ ID NO: 32992 - DNA, 1078 bp, Homo sapiens
caggcttaaaatatgtaacaattgtatgtttcacttggttagaaaaaatgaaagtgttttctcccaaagaatgatttattaggttgcgtaatttatatatattatttattcattcaccaaatttctatcaagtacccactaaagatgtaattttgcaacaccaacaactgtgagggaagagctgttaaaggagcagagatttgtatgttactgaagttaaactggtataaatacaaattagaatgttacaactttaagatgttacatttaactgcaaagaaaatagcaatcaaatatatagctatttaacaaaaagaaatgagaaaggaatttaaacatgtcactacaaaaaatcaaccaaacaaaacaagacagtaatgcaggaaatgagagacaaaaaagctataagacatgtagtagaaaatagtagcaaaattacagaagtatcttacaaataattactttaaatgtaaatgtattgacccctctaatcaaaaaacagagattggtagactggattttaagaaaccatgatccaactatatggtatctacaagagactcactctagctgcaaagacacaaataggttgaaaatgaaaggatggaaagggtatttcacacaaatagtaaccaaaaaagagcaagagtggctaaactagtatcagacaaaatagactttaaatcaaaacatgcttacaagagacaaagaaggacattatatattaataaaaggttcaatacagcaagatataaaaattatacatatttatgtacctaataacagataatcgaaatatatgattgaaaggagaaaaagacagtctatgataatagttggagacttcaacatctcactctcagtaatggttagagcaaccagacagaagataagtaagaaaacagaggacttgaacgtacagtaaaccaactggatccaatgggcatacagaacattctacccaacaacagcaggatacacattcttctcaagtgcacttggggcattttccaggaccatctgttaggctgctaagtaagtcctaatagattttaaaaggtagatatacaaacatctg

SEQ ID NO: 32993 - DNA, 1027 bp, Homo sapiens
ttcagaggcctggataactgagaatgcatggtttatcgtatgtatgtatgcatttgtatgaattgtatggttatgggggctgtatgcatctatattatatatgtgcagaactctagagttggtgcaattgtgatttgtccgctagtttagagaatggcatcacataaacacataaactgaaacagtaaagactttagtgtattttggagaggatgcaagagcatttggctctgcgagtttctcatgacaggagctgccttcctgctgccttgcagcacatggtttggagtctggtccaaatatacatccagctgtcccattacacacaggtgacctggatccaggtcactacctgcctccagcagcagcttgcactggggcattcaatggacttgagggagcttctatgtcttcataaacctggagaagggttttctcaggaaaacaggaatttgggttgcaccagaggatctcaagagaaggatgatgggaggcaggggtttcttttcttctaggactcaggaacttgtattgttgaaataacaatgaataaggatactactactattgttaataaaaatgatacctcctgttgtgttgtctgaaatccgacatgctattttctttaacagacaactatttaaatgtgtattagtatccatatgcaataattttccatttcttttacttttctgcctgcctgtgactttacttttactatttcttttggctgtaaccattcttggtgagttcattcttctcttttcatgtacttttctacatttgggattctactgttgactaaagaatgtttagatttaaaaagtgttctttttaatgacttttccagtcataaaaatattttcaaagttaggccatgttgtatttagaaatcccagagtgacctgtaaacatttcctttggaagggaaagcctcattagcaactgactgtgaatagattctcctctcattttcttttttttttcttttttgggatggagtcttgctctgtttcccaggctggag

SEQ ID NO: 32994 - DNA, 1047 bp, Homo sapiens
ttttaaacctaattttgcagtgctgtagaaacacagcatctactgaggggtgaagtaggcctggctacaactcctctcatccactcattgatccccaggctggtttagcttttctggaactagttaggcagtcccttctttccccaagccatacagtgcattttctcagaagaggaagagcgttcttggttaggccttgacattatgaagaagctgttctccctgctagaatctccttgggcttattgtgagtcaaagattgaactcattgttgtgggttttgagatctactcttttaaaataatattttccatacataagtttccgtgtttgtaatagcccatcttaaatatatgtaaaatctcattcctaaactatagatggagcagttagggcctgagaagagtctgacggagtacagacaggcacagcactgggacagaaaactccagaggaggggcacttctgcctgctctgcttccaagatgggtgctgcagagtgtggacaattaattttttttactagaaaatgaacaagtgtttgttaatttctgtcagttctgttttgtaatctgaaatgtttatgttccagagggaatgtttgatttctcctttgtagttgtcatcttgtttaaaatctttgtaggcatctggaccaaatattttccaagatacctagacatataaaattatatagttttggtttactgtgtgcacatgtatgaattcaactgaaaatgacacttagtgattcagcaaaagcatgctggattttacatcatggtcaatatgattgacatatgttgctccagtgccccaagcctatatccctctactcccctgctgcctccacacacagtttagcatatttaaaatcagtacattctactagaaagtcttttaacctttctccacctttgtttcctgaaaagctgtttaaaatttgtagtgtatctttcagtaagttcagtgttagaattgaaaaaaaaatgaaagtttttggtaatatcaacaaatgctttaaaacaacttatagcaagtcctgct

SEQ ID NO: 32995 - DNA, 1024 bp, Homo sapiens
tgaggacaatgtctgttttattcatcctcgaattctcagtgcctagcagagtgcatagcacagggtagttatgcaatacatattggagtaaaggaatacagttcaaaaaaacagtctcattaacagatgcaaaccaactcctctcatgacgcagagaatctaagctcaaacaaattaccagagttggcagttgaagtactatatatagacagaacttaataaatgcttttctttgtcttaagcctttgatgacagtgatgtgtttttatgaacgtagataaccacaagcagatgtgtcaaagctcttttgtccaggaataaactgagtttcgtcatcatcttgacagtactttcctggatgagtgttcaggaaacatgaaaagtttttaaacaattcaacaaatgtgtaataaaagtttgttaccttgttttatttgttgttatattgtctcttggcttgagtttttatttgggaagctaatagagagacgggatattagaaaaccagaggcaaactgcttggtttattgaagcactaactgaatgaatgcaggtatacgagtaatccaggaatcccatgcattaaggaaaaatttatttctatcacctctgtattgttgttaccttgtgaacctggcttggttttttcagcagttggtaaactgataagcctgtttctcactctgtcattcatctcatcagtttaccagcccagaaatactcctttcagtctttacaaaaaaaaaaaaaaaaaaaaagaagtgcagatgcactcacaaacacaaaagttaatttattattatttttttttttttgagatggatttttgctcttgtcacaaggctggagtgcaatgacgcgatctcagctcacagcaacctcaacctcccgggctcaagtgattctctggagcagctgggattacaggcgtgtaccaccatgcccagctaatttttgtatttttagtagaaatggggtttcaccatgttggccaggctggtctcaaactcctgatcccaggtga

SEQ ID NO: 32996 - DNA, 1041 bp, Homo sapiens
ctttggaataaaaagaggtaagaggtaaggtaggagtacagaatttggggatgaagtatatttttggcactaacatcactgtgatgttaaaactatttttaaaagataataaatacccacacctctgacttactaattattttactaaatttattgctctctatgctatttatgtttattatttctatatggtgaaaatactgtaactattgcacgtcttccccaaactgtatgttctagtgatatcatgttggtaacttggaagcggccatgataggaatttctttttttgagacagaatttcactcttgttgtccaggcaggagtgcaatggtgctatctcagctaactgcaacttccgcctcccaggtccaagcgattctcctgcctcagcctcccaagtagctgggattacaggtgcataccaccatgccaggcttattttgtatttttagtagatacaggctttcaccatgttggtcaggctggtcttgaactcctgacctagtgatcctcctgccttggccttccaggaatatttacaccatcgaaattggcaaacactacagttagggtttctcctccacccggacctggttgctaagcatttctcagcacaccactggctttgcccagggggtatatccgagcttctccaccccatctttctttctcattatgaccaaagagatttctcctgcacttttctgtcaaccgtcacagtgattctgaatttggggatgtggttggggagaaaggaatacgcttagttatgcaatgttcttatctctctgtgcctatgatctggtctggtacaagtctcaactgcattcaatttaacccttgattcttccttttgtagagatagaattctccctgcaacctcctgaagagctggccttccctccttctccatcacagtagttccaaagtctggctaaacaaaatcacctgggaacttcttaaaatacaaatttccaggttctatcacatatgtaataaatttagattcttgaggaatgggactcaaaatagtatttt

SEQ ID NO: 32997 - DNA, 1002 bp, Homo sapiens
cagaccccacatttacacactgcctatttgaataagaatctctttcagtattaaatgttttgtgacacacaaatgaatttgtacacagtcttttagcttgaatttgtagacagcctttaaatgttgtttggggatctttggactaattgtataagcgctcagtctggcttctcaagaaccagtacagttaacaatccatataaaaagttggagtgctgcctgggcgcggtgactcacgcctgtaatcccagcactttgggaggctgaggcgggcagatcacctgaggtcaggagtttgagaccagcctggccaacatggtgaaaccccgcctctactaaaaatacaaaaattagccaggcgtggtggcacacgcctgtaatcccagccactcgggaggctgaggcaggagaatcgcttgaacccgggaggcggaggttgcagtgagccgagatggagccattgcacgccagcctgggcgacagggcaagaatctgtctcaaaaaaaaaaaaaaaaaaaaaaaaaaattgaatgctaaggctttgaggaaaaagtgtctttacaatgtttgtccctgatgacagaataattatgaactatagtaagcgctgtacaatgctcatttaggtttgtagacttacttataaccaggtagtggggaacccggcttcttggaagttgtatgtttacttagtgtttcttaattaaaattacaaattttatttacctttaactcttataggtaacttttatttttgttacaaaggaaaagtaggactgtcattattattattattattattttttgagacggagtctcgctctgtcgcccaggctggagtgcagtggcgcgatctcggctcactgcaagctccacctcccgggttcacgccattctcctgcctcagcctcctgagtagctgggaaaacaggcgcctgctgccacgcccggttgattttttgtatttttagtagagacggggtttcaccgtgttagccagga

SEQ ID NO: 32998 - DNA, 1031 bp, Homo sapiens
gcctgccatcttttcaaggtgggctggcaaaacagaggaccacagacagaaaaatggagtaataaagtttaaatagtaggcaataatattaatctgctgtgctgcagtgccgattaagagattgaaccaactccctgcagttctaattggattttcctgtgttttcttcaacccttagggctttaccctgataaatcctattttttcttgccatttattcttcatgaatgactctatgtaatggaattatctgtaaaaacacacaaatgcttgtactgccatagaattccttttgtggctctctttgcagattgcagacgtgttgctttctaaaaggcaagtaattaatacacagaattgctgggctaattgctgtctacatatttcacatgcataataagatataaggctataattcaggtacagggaaagcacaaccatgtgtaaataatgccctagaaaactatattatgttaggattcaaaaaatggatctacacactgttctgcataatgtctgaggtaatcaatgtaaaaatgaaagaggaataaagttttacatatgcacacatcaagtgtatttctcaaatatgtaaggtaattttcacatgcccaattcattattatttttgaaataatgtcgtcttggtctaaatttgtcttcaagtatgtgtgtgtagccaaagaatatctttgtcaggaaatgttgcacataaggatgtaattgctgtttatgattccaataacaaccacgttagctctagttataaaatattaattatatatctctaggcctataccagagtgtatgaaacagtcctaataggttcacttctgtaggagatctccatactgatttagaaccaaaattttgattttattggtccactcagtttatctgatttcatcacagaaccagtgattctgccactttcctttgttatgtttttagttttgactttgtctagtgccatccttgaaaccacctagatttttctaccagaatctgctcacatagtcccaaactcatcc

SEQ ID NO: 32999 - DNA, 1026 bp, Homo sapiens
ttaagcatatataatatgcaaataatatcagatttgattctattatttatgctcatacagtggccaaatttaaaggcaattagtcaaattatctatttaatacaccacatattttcataagtcaaataaatattagatgatgctaacattaacttctttcttcattatttgtacttgaaatatacatctacttgaattaattaagtaatgctatttcacaaacatttttgaaagatttttggaaatctaggtgacacatttgccaccagacatttatgaatctttaggaaattttctttgcctcttttgatcacagttttctcatctgtaaaataaaaggtctaaattagataaattatgagggcctttttgtgttatgaaaactacatctacctaaaaatataactttcctggtaaattatgaaataatttgaagtaaaaacaaaatagttatactaagtgacatggctatttgggtactaaggaaaaataaaaaagatatgaataaactgaagagaattgtgtttgaatcctgctgtaacttttttacaacctctgtggccttctctttaacctttctgagtctcagatccctcatgtgtgaaatggaaaaggcagtaaaattttaaatatgttttccccactatgtggcaagggtgaatattcccttggattgcttttgtttttcagtcttatatttcacaggaatttggattaacgtaatgaattcataatatttaaagttgccgtagatgtttaattagctaactgtacaggtaataaacatggctttgtgttttatacctgaagactatgtgaacctggcaggttaagtacaatgatttctcttctccatttatcaattcatgcaaagcttatgcaattggtcctcattgctcttaaaaactcacctattacataaaccttactagaccaggcctaaaattatgtttaatattagaatcactaaaagtcaacaatcgtatgcctacttgctttcattttttgtataccagtaataaatat

SEQ ID NO: 33000 - DNA, 1020 bp, Homo sapiens
atacaaaagtgtgattatttgatttggccaagatctttaaggctgaattcttataagagaataaaaaatctcaggaacttcaaattgccactccactttaccgtactgctggtctacatagcaaagaacgaagggtatatttcctggtaggagagcgtagttccctccatgctacatgtatataaatctatagttttatatttcttggtatttggtgagaagaaaatgtagtttaacatgggattgggactgtggaaaattccagaggaaattgtcaagatttactcttactgatcaatgttatcttcaggactccttcttccctcctaaggtttttctctgcaaataataattctttcagcttcagccctaattactagggcccttaatctttttcatggttttatagtccttgaaacaaacatatgcgcttattattgaaggcagcttttgtttgccagaggcaaaaatacttacagatcgtcttctttaacacatcttttcacgtctgctagacagctcagttctctccttctaactcatccctcacccaactcctcccaaattttttattgaaaactgtccacacattgctaagctcttttgttttgtttctaagaacactgtgtagtcttcgtgtagaatggcaacttgatatagacataagatatataaacatttgttaaatatacttgaccaccaactaactaaagggtttctcgatataaactcttgcttacacggtacccaattaaccttttatcacttttcaaaacatgcatagctttatggcataagctcatttatctttgctaaaagccttcataggaatctgaacaaaaatagtttctgttaaaatattcaactgtaatgtggagccttttattacattttaaacatttttttcttgttcctaggccctttaaggattagagcaaaaatgtacataaataattcatgtagcagagtataagccccaagagcctgtctcaaaaaatgatgaccagaaaaccacagatg

SEQ ID NO: 33001 - DNA, 1083 bp, Homo sapiens
gatagcaaacatagtctctttaccttacctaagattgtctaccatagcttcccttctcctatctaatttttttaaatttgactgctgcctttcagatgatcttttagctctgtgtaacctcttttatttttccttttttttttaaaaaaaaagataccttagtttaaaaaataattataaacaccttatatccaccatttaggctcagtgctcaatcacatctagccccattcctcaataaatttactgtttatttggaaaaagaaataagtgattaggtataataaaatgttacaggtactttaaaaagtatgcttctggtcacagtggctcatgcctgtaatcccagcattttgggaggccaaagcaagaagattgctcaagattgggaatttgagaccagcctagacaagatagtgagaccctgtctctacaaaaaaaaataaataaataaaaataaataagtaaataaataaaagacacatgcatacatataaagtataatttaaaaaaacagggcatggtcaattaaatttgttggggaaaaaacagaagggacaggacagagatatcttcatagatgaaattagagctgaagccaaacagattaatgggtgactgccaggcagaccatgagttagtagaggactctaagcagaggaagctgcagtaacaaatagcagagacatgaacaatactggcatattttgaaatcacaagggacattgtgggatgtggcgcagcaccttaaaattcctctgcaatctcatttctaaagttggaatgggacaagcctggaagtacagtgacctgacaaaaagttgtttgggtagcccagaaagaaattaaagtctggattaagtaacatggagacactgtgtaagttcaaggaatttttaagaatcacaattttcaagacctggtgattagttggatatagagggtaatggaaggagggtttaagaatcaatcctaaatttttagtctaagtgatcatgttcatgacagttctattaggtaagatagaaaactcagtaaaattgctccctggcacaaatttggaaataatggtatttgtgattg

SEQ ID NO: 33002 - DNA, 1022 bp, Homo sapiens
atatggcataattaataagaagtttgtttagttaatttcttatgacacatgaacaggataatgcttataggtactatataatctatatttatataaaacctgaaattattacttgtctctaaaagaggaggttttttttttaagtcatgattcttgaaatcctaggtgacagaaactggcaaaattaaaatgtttaaatttacttcaaattttttttttttaataatattgactttttcatgataagtaaaatattgaattcttaaaaatacagatttcccctatcattggttttacacacatgtatttaaggaatggttaagatcccagctattagcattaaacttccattttaatactattgcatcctgttctggtcataaacctctgcctatctctagctgctcacacaccttcatctataagccaaaggggttatagatctatttagaatagcttgcttatggattgaaacacaagtattttcatcaactagcagcattactctgaactttctaatgatgattggttttactttctactctactgaagtcacagaacaaagctgcaagatggcactggaaggggtcagttggcacccaacagtgttcacttccttacgaagagctcagagcaccagtggggttgcttacacaacattagatctaaatagaaaaccattctatgtccacccccattgaggattaaaactgggagggctaatttgtttcaagtggggaagaaacactacagactccctgctctaggctgtgtgggtctttgtcatttaactcatcatggggtctccctagaatctgacctgggtttgtttcggaatgaggctacaaatacaggtgcttgtgttggtgccctgtgtaactgtttccatccgttgtcacatttaaattgtattatgttttaatagtcatttgagtgctgtttctgtgagcaaagctgctgctcaatttgcaacacttttattaacttgtaacattttatccaaaatgggaagctatatctaa

SEQ ID NO: 33003 - DNA, 1025 bp, Homo sapiens
tcctggactcaagtgatcctcctgccctgacttcccaaagtgctgaaattacaggtgtgagcgactggacctagccaatagtgaaggctttcatttttgaagatggtggcttgaatatttccccccgtccgaatcaatgacaaactgtctttcctgagccaagcagctgttggaccagctcacagggggtctagagggtaggagctaggccttggttcttccaagaacagatgaagagaaatgcaagaccttttccccttctgctcttagggatgccttcggggaccagtaatggagaactatgaggtgctgataaaaattctgtgaatcctgaaggcagcttgccctacagagatccacaaatatccaggaggaaaatgagtgttcctagaaaaatatgcttgtctccttctccagcagaaatagccaaacaggtgataaagttcctttctaattccaagacttgaagaatgctagcttttacacatgaggagattataagattaaagaagtttctgtgactcttggacaataatgtttcatagatggtgctaaatacttcccattttatcacctctgtaagcaaataatatctagttgtcccacttttttctttaacattattgaatgaattcaggtgttgtctgtctaatcaacccctccaccccccgctactgttcatccaaagagtttagtatccattgatgatcattacttagatccattatttaattaggggctttctggttgaatatattttttacatctctaccatgaaaaaatattctgcacctattataaataatagctaatgcttccatggcacttgagtaaggtgtggttctaagcactttatatggactaatatattgtgcttaataacaacccaaggaaatagttacaataattatccccatattacagatacaaactcagaaacaaaacaatttgcccaagtcactgctactaagtgatgagttgggattccaaagaatgaattatatatatatatatataatatatga

SEQ ID NO: 33004 - DNA, 1030 bp, Homo sapiens
tagacaagattaacagaagaaatgctattgtgatgtgcgctaatgacaatttttgtactgcaaatcactacacttaaagttgtcacatattgaaagatttttaggattgtgaaatacaacatttgcattctaaagtaacctagtgggccaggtgtagtagctcatgcctataatcctagcactttgggagactgagaggcgaggattgcttaaattcatgagcttgagacaaacctgggtaacacagtgagacccatgtctctaaaaaaaaaaaaaaaaaaaaatactaaaacaaaactaacccaatgaaatctgaacaaaatgaaatataaactgtatgtttttaaggtaacaagaaagtaaaacaaatttatatattggaattctttggaattcaactaacggagctctctgttcctttgtaaattttctacctctgttgaaagagataaactttttttaatgacaatatatgattaggaaaaatgtatgtccattccattttgtggtttttctctgatctttgctgtcaaaaaacaaacaaacaaacaagcaaagaacaggtggatgattcatgtcaagtatgtcctttaaggcattatttgcattcacatttacagttcttgaaagatcatactgttttcttctttgacatcatgaagctcgtaagtcaaggtttatcacactgaaacataatgctcttcaatatttatttcataaatgtttatcataacctcttatctgccaggcatattaactagtggcatcccaaatgaagtttctttctcctctcaccctctctgacacccttcttttcttctttccttccttcccactctctttcctctgtctctccttaacatggagtaacctaagtaaaattaaatgctgacaagaaacttgatcatgggagaagacgtgagaactagagtgattttggtggagcagagagagataaacacaaagatagaagccattttccattcagttaagagagacaaccccttactaattgtgtcagggaagaagg

SEQ ID NO: 33005 - DNA, 1023 bp, Homo sapiens
atacaagaatgtagagtcaggatattatgctttgggatgcagagtcaaactaacatgtttgaaaggtatttgaaataattcttgtccatgcagttatggtaccaaccaatatatacttaggtttattttatttatttatttatttatttatttatttatttatttattattttgagatggagtctcactctgtttcccaggctggagtgcagtgggctatctaggctcactgcaatctccgcctcctggttctagccattctcctgcctcagcctccctggtagctgggattagaggcatgagccaccatgcccagctaatttttgtatttttagtagagacgggttttcaccatgttggccaggctggtctcaaattcctgacctcaagtgatccacccgcctcggcctcccaaaatgctggcattacaggcatgagccaccacacccagcctacttaggtttatttgtttcactttgttttcaaattttggggatggtttgttctgtcatcctttggacttattatttttttgaaaatatgtgtgacatttacatgattctgaattcaaaactgggttgtttttcctattttctctttgcttatataggtaaaccatttttattcattttttacctttcattattttgtatttgaacccaggtagcatggtgcttgagtctatggtcttaaacaaaatgttagacttaaactgcctcattagaaattatcaaacccttttttacaggaaagtgggtgttgttgaaaattgcatatatttgtatccagttcttctcaagatctaaacttggaaactatcattacaggcctctccataagtcccaccctctacctcctcctcccaaatttaaaaccaccaggcagtagctaaaagcctcttttatggctttttgtgttccaaaagcttatatccttaacccacatacctactttatagattcatagcatgcaagctttgcagatattcttttgaagtttgcatttataagcctttgtgtacca

SEQ ID NO: 33006 - DNA, 1881 bp, Homo sapiens
tgttttggttcgttatagcccagttcaagcttagagattggtaagtgctttttaaaagaaagttgttttgtttttttaacccccaagttggctgtagattgaatgtctgtaggttgactgtagattttattttttatatctcagcaaactagattttgttggttctacttttttctctcctcattaactatagatactcaaagcctactatacttgaacttaatctcataaattatgagaaattttaagtaaacaaaacagttgagccttcccagcctgataatcagtagcaatgtgtcagtaccaatgcatctgtgatttgtgccacattactgggctaaatttgaagaggaaagctcggtcaaacattcttccagcttgtcatcttggataggctgaatgggaggtattttcaaggtgcatggtttgttgccatgtgcttttaagtagatctgccacctctagcttgactttaggttaccataaagctgcagaggtcacttttctgatttgtcagggccgaacacctgaagcatatatttcagttttcataacaggacctctgatctttgtcctgttatattgactggtttcataggagaatatatttttggattgagttttaattcttcagtagcagctgaataataaaataacgttgttacatttatgattcagcttaatgaatgattacattattagtattcctgcctgtgttttttgtttaaacatataacgtctttcaagaatagtgtacatatctgtctgggcactgtggtgcatgcttataatcccaacattttgggaggccagggtgggtggattgcttgaggccaggagttcaagaccagcctgggcaacacggtgagaccttgtctctacaaataattttttaaaaatcagctgggcatggtggcatgcacttgtaatcctagctacttaggaggtggaggcgggaggatcactctagcccaggagttagaaggtgcagtgagctatgattgcacagctgcatccatcctgggtaacaacaagaccctgtctaaagaaaaaaaaggaacatacatacattattttagcttcttttataatcccctagcttaggaactggtcagtaaatatagagtgaataacagatttatactggaattatctttactagtttgttatacttcctctttaagatgttttgtcaaagaaattctgaatttattttgtttctctacatgttagctagactcatgtatcatttagcaacaacaaaaacttatttcatgtgatagactgactgtttacttctagctattgttggctatgtcagagagaccagataccttagccaagaatggttatcaagactggagaaactgaatatgtgtgtgagtaatcttttgagaacaggctggtattatctttttgtaaagggatcatattacatttctagaatttcagaacttatttttatagttgaagctaagtccctcctctgattgctagaaataaagctatgtaatatttttatttcagcatttggatttattataatatgtattacgatttttaagattttgtttttcattcttttagacaggtgctctagttcacagctataggggaacaggtggaatatttgaagtttgctggaatgcagcaggagacaaagttggagccagtgcatcagatggttcagtaagtatagtaaagtgtttccaaagagggtgtgggtgggtattcacatcagaatgcagcttattgttagtgataccaaagtgtttttttcaaaataaattttaaggtatgatactgatttttttttttcctgaggctgtaaacttttcatgtgcgttggattcaaataatgtaaacaaaatttaggctgtc

SEQ ID NO: 33007 - DNA, 1033 bp, Homo sapiens
aggatggatggataatgtgtaatgggccgttttctgagaagagggaatgccagatggaatgagaaggtgacgctgagtcatgcgaatggaggagataggtgggactgatgcttagagaactgtaagctcaagattaaaaactgggaattctcagcagataggtggtctttaaaatccttgggcatggccaggcctggtggttcactgttggggttcaatcaggctggtgggaaaaatattagagatagttatagaaatagacacatatcttcttggaaaactgagaagtaacttcagtaatagatctggctgaacgcggcctggttcctttacctttagttaaacaaattaaactagtaataaaggaaggcagggtagtttacctagctagcttgtttactcatataatattaagactaacctttgatgtgccatgggtgcttaagtgctttttacttgggaagtccacaatgtcagttaccctctaatggtgttgactcaagcctttgtgaattaatcttactgaataaatttgagtctcactagcggatagggccatggtcgcaactgtttacagaactctccagggagtctgtaaatggctcggacaccctcagctggactggcgaaacaggatatctgtgtgttagtgtactttattcatccattgctgggtcagggtctgcaggcagacacccacagctagtgcccccatgttgccacagctcatgcctataattaaagcactttgggaggccgacgtgggcagttcacttgaggtcaggagttcaagaccaggctggtcaacatggtgaaaccccatctctgctaaatataccaaatttagccgagcgtggcggcaggtgcctataatcccagctactctggaggctgaggcaggagaattgcgtgaacccgggggacggagttgcagtgagccaagattgtggtgctgcactccagcctgggcaagagagtgagacttcatctccaaaaaaaaaaaaaaaaaattggggcagggacaaaactgtgt

SEQ ID NO: 33008 - DNA, 1031 bp, Homo sapiens
catagtagtcttactctgttgcccagactggagtgcagtggtgcaatcacggctcactgcagcctcggcctccccagctcaagcagtcctcctgcctcagccttccaagtagctgggactataggcatggaccactacacctggctaattttttattttttagaaatgaggtcccactgtcttgcccaggctggtctcaaacacctgggctcaaacagttctcctgcctttgctaccaaagcgctgagtcacacctggccacacagctcaactttaactctcctgtttttcccctttaagttttttctttaaattagggttgacaaactttcactaaaggacttgaaagtattttagacattgtaggccataagatctcagttgccactaatcagctctgcccttgtagtgaaaaagcagccataggtaatatgcaacttcatgcatttgtctgggtttcaataaaactcttatttatggacactgaactttaaatctcatttttccacatttgtatgtcttcctttgatcccctcctcccccattgcactataaaagccattcttggcttatgtgccatagtttgtcaacccctgctttaaatgcagtctttgatatgcttctgttgcctaacccagttactcactattattaccataatctgtgttgctaattacggagatcttttgcaccttgcagcaggagacaaggatgttcaataatttcagagctaaactcaaagtattaaatgccagcctgctttggggcttcagagatttttaaattcattgattttaaggggcatttgattttaagaggtgtttgacaagaacagattttaagaggtatttggcaaaagttgcttagaagaaaattatttgcaaatcatatgccgtattccatttgttagttgagtagatgataatgggaatgatacttattcagcataacatttgtctaactcttgtaattgacagagtacttccacacacatgatctcacctggtcttcaccatgtgtactaaggataa

SEQ ID NO: 33009 - DNA, 1035 bp, Homo sapiens
ttggagagttgatgttccatgacattcagactcttaattgtcagaggatcatcaaacgttttctgtgaaatgtaccataaagcatttgcagcctggtgcaattagaggtggcattatttaatggaaagaacatagatttttgaatcagaaaatctaggtttgaatgtcagttccactccacttaagaagcattattaagactgagcaagtcacttaacctttctgagcctccttttcactgtctgtaaatgagggataataataataataatacctgtttgttatgggataaggctaaatgatatacatgaaaatactgtatagactcctataagtttaggtattgttgtcattttctcattttggatccaggtacctgagtatttgtctacaggaagtaaaaaatagactttcccaatgttgttggaatgttggtggcttagatggatttctcttttaagaaatactcaatgtggtacttttatctgattaatcagacctcgaaaatagtgctccgtccttcatgatatacagtcacacacccagacattcagcttgagtagagccagccatatttttgtgcccacgctccgtttaagcctagaacctttgcgccgcttttcagtgagtttcccgactgcagtaactaaatgatgttaaactggaacaagatacccagtggttttagtactacctgatttagctgtctctttgattttgttgtgctagaaaaaatttcagtttggagactgactaaaataaccctggttattctcaaatctttgatgacatccttttacaaacagcgagccagtggcacagcatcaactttaaaatggaaatttgcaacttcaggcattttgcttttttttcattctctgtttagtgtgcctaaacaagccaaaataaggtgcaaaatgatttttctgtagtatctgaataagtttgcaaacatcgttaaacaattcaacttgattaaagctcaccacttaataagcatttacacatacatttttgttcacctgttgtgcttcc

SEQ ID NO: 33010 - DNA, 1032 bp, Homo sapiens
aataatgagatagcagaaataatgaggcgtttttatgtcttaaagggtgccatgagatatttatttgaaattgcatccagaaataggatatggaagagagtttgagaatgttatagttctgtgaactcaggacagggttcagatagaactcagaatctcactcataacaaatgcccatagtagctttagatctgggcacttgccacttattccaaagcttttttttggttctgatctccaattatacttaaatgtggctacttttgcaataggtcctaattcagaatcaccaagtacagtaatgtctgggttgttttggggattcatcatatttatcaccacaacctacaaatgatacttattgagaattagtcattcagtatctaagaaatgcgatataaattactcttaggttataactatgtttcttgaaagatctaaagtaataccgaagaaactggaatctttatactgctgctttccctgcaatagagcactgaattggattaggagacagcagaaaaggaacatcgtggcaaaggaagtatttgtgcagggacattcaaaggactggtttgtgaagacttccaaaaagcaaaactaaaatttccgcctggcctgtctcattatcaaagactgtccaaaaacacattatgaaagtttttatgttttgataaatatgtggtttagtaatactttttttatgtaagaacttttaacatttgttctctgcatattgttcagtgttgactgtgttatctatctgcagggggaaaatcacttaaattgttttaggcttaaatattttttactgttgtcaatactataagatactatctgttgaaagtttcccacctccaaaattacataaattctcagattcatttttctcacctataaaatacgttgctgtggagaagggatttacattgtgatattcagcctcaaatatttgatggacatctctgttttaaataagccatccctcagactcatcaaaactaattaaagaaaaatatatttattgtaggg

SEQ ID NO: 33011 - DNA, 1024 bp, Homo sapiens
gcttctttgggtatgttccacatgcacatcttgggatgaatttggaacttgtgttggttcataggaagaattgcaggatccacttcagctctctcttagggatttattcttatgcttttcagttcctggaggcctcgttttttctgatttagtttcgattttttgattgaaagaaactggctcaatctagctggtgaaagttggggggaacaccaaaaaagtaggccaattacagtgttgaacaagtgtgctcagaagaatagtagagagttataattccacaaatggagtagtggctgctatggaacaaatcctcccacaaatagtaactacaatttctggacaacatatgaaaaacaaacattatgaggacaccatagaacaaacctgtttcagaagtcagaccggattggattcttaagagaatggcattggagtttcctgttattgacggatctttgcctgaggacaggttcccgttggcagaggaattagagaattgttcagaactaacattgcactgcagagtaatggggtccagcacaggaaaggaggaaatccaggaagaagatacccatagaggtggagtaccaaatgtggtttataaactctcctaaaatatggggttgacccccaaactggtaacagttcaagtatctataaaccaagaaaaaggattatcaagttgctgtatgtgtacaatggaatactcctaagcaataggaaggaaccaaggcatcgatgtctgcagcaacttggattaatctctgaaacattatgctgactgaattagtcttcacaaaacaagccatcatatgtgattctacatatatcctaaaaccagacagacctcatctattgtgcatgtggggtgggacagccaaaacgaagttatgaaagggaaagaagaagaggttggtaggtggtaggaatgagtggtgaggacagggattaagtggggaagtgcatatggcagctttctaaggcattggcaatgttctgtattctgttagggatttacgtt

SEQ ID NO: 33012 - DNA, 1145 bp, Homo sapiens
cccaggtagctgggattacaggcatgcgccaccacgcccagctaattttttgtatttttagtaagagacaggatttcaccatgttggccaggctggtctcgaacccctgaccgcaggtgatccgcccacctgagcttcccaaagtgctgggattacaggtgtgagccaccgcatccagctgaggatttctgtgttctgtagttttaaaaacgtcttagctacggtcatcaggatgaaaaatattgttatatcgtgatggtcttgtgttttgtcaaatgaactaaattttgtgaatagtattttcttgttaaaaatgcaacagtggcattttgctcttctatttttgtccataatttcactgaaatagattgtttttgtgtattgcatttatcctaatattttttagttatgtgcatttaaatggctaggattctacctgttataattaatcattttaaggagagtcattcttatctacttaaaaagatttttaagaagcctttcactgtagaatataaatggcaatcatgtgatatagcagaaagactagtggactctgtgggagctggcatttgctttatttcctgaatatactatgaatctttgacttttggcagtactcttataaaacttaggtgatggaattggactttctaaggtttattctagctgtatgtcaagtgcttatcattgttaactggaagtcagagtgattctctcttaaaaaaaatttcttaccgaaataatattgttgtgtattttggggataaataaatagaagataaatgaatttttacttttttaaagaatcaaataataacatcttacatttataaatattttctgtagttcattaccaacaattttagttttactaaattagggaggcataaaaactgattgaggtttatagaatttggtgggaaatgatgtatcagtctgaaagaaaaactattaaaagttaagaaccagaataagtggttaagatatttgtgaaaatattcccagaaataattcctattagagatggatttttttcagtatgttgataggaggattttctctgtttaaactcttctgaattcctattggggaaaaaaggttgacctcctccttttcctgttctcctcctctgcatcctgctc

SEQ ID NO: 33013 - DNA, 1026 bp, Homo sapiens
tccttcccagtgtgatttatttgttcagtaattcagtgtctactgcattttattttcaaatatgtttatatctatttctctatatctagacactaacattttatcagcatatatatcttaagaatcatgtatgttcaaggcattattcttagttctgttagggaacagcaagatgattaaatcagtcctgggtctctagaaatttgatcagagaggtatgatagaagaataaggcactatgcggttgtggaaagggagatatgttaagctggggctcatttctctctctggatggtggggtggataattaatggaggaagctgattgggcctgatctttggaggagggataggaagatttgtgagcagaaccgtagtcagaaggacatttctggtaaggaatgaggaatgtcagggcagccaaagagtgcagataacactgcacacagtgatctgctgtggtgagagtagagaatgttgagtaaaagtagaaatgcagatagacgggacacacatgttttggacttgaattcctttaatacaaatagtttcaatagtttcaatatacattgtcagactatcttaaatgcaccttaagttttgtaattcctttgtaaagtatatcactatatcttttaaaattcagatgtttattttaattacgtggtgtgctttataaatgcattgcatgatggctaggacataggtaaatgagttgactaggaaaacatctaagaaataaaaaaatatggtcctgcgtatgtttctagaaattttccagattaatttgcaggtgcagttggtataccatttttcacatatttattcacccttcaaatcctagaatcaaatactttttaaccatgtcatcaactattaaatcactattgtggtctttctccttaacgacttgtagtattaataggaaaagttaaatgaatgaatgaagacaaaggtagagaaaaggtaattagtgaaaactgagattagatacatctatgagggtgatgagagactcactgatgac

SEQ ID NO: 33014 - DNA, 1035 bp, Homo sapiens
ttccctaaaccgtttctctttctgtgaataaatgaccttggtttaatgtttagctctgactcatctgaaatctaaagtgaaatgtcaatattaacagccaccatatagggtatggcaaagagattcctgacacgtgaactgcacctggtttgggaaggtgtgatgcattcttaaaacagcatatccttcgtggattgggtgccctggaagatatgtccaggagatgcttataagatgatagtgggcctggcgcagtggctgaagcctgtaatctcagcagttagggtggcctagatgggcaaataacttgaggtcaggagttcaagaccagcctggccagcatggtgaaacccaggctcaaccgatcctcccagctattttgtctctactaaaaatacccaaattagcctggcatggtggcatgcacctgtagtcccagctactcgggaggctgaggcaggtgaatcgcttgaacccaggaggcagaggttgcagtgagccgagatagcgccactgcactccagtctgggcaacagagaaaggctctgtctttaaaaaaaaaaaaaaaaaatcaatcatagtggtttctcagtggaactcaggtgtgtctaacccagggtaacttttgtatcgtttgtggattctttgccctttgcatacctacctgaataatgatatggtgatggtgatgatagtagggagaggtgcaaagacaatagctcctggattgcatgtcctcctgttgtgtgcctggcgtgatactgccctgctagcctgtcctgtcctgtagctttctctgtaaacacatgccaggtgtggcctacttaggttttgtgaatttgtctagttgagtctgagttgttagagcagttcctttcaactgttgatttgcttgacgtgagatcaagggggtgaaaatcatacacaacacatttttttcctctttgtttgaaagatattttcctcttctggaccctatctagaagaagtattccttagacaatttccggcttcttttctctcatgaagaggagg

SEQ ID NO: 33015 - DNA, 1241 bp, Homo sapiens
aaaggtagacagcctctagataggagaagaggaaaagggaaagccattagaacaggaatgccgaattaaagaaggcataactggaggtaaagacctatactatcacagggaggagtgcatgttggaaagtaatgagaagttaaggttatcaattctgtgctccagaagtaggctctatatagttatgtttgctgtttagagatgatgcagttggaaaatggccctcttatttaaataaaggttggtgagacacctgctggagtataactagattcaccttacgcagtatttttagatgagcgagtccccaagggctttctgttagcaaaaaggaggatatcccaactctttctccctgaaatttgaagtaactaataccaagggcagtggttgcattacaataaaatgaccatgtagaaaatgggtgaggttggtatagagcactaattcaatacacaggaccaaggattctttggaatgtttcttcgtgtcgtgtggttgattctggagcttctagccacgcaagtatgccagttgatcatggaggaacattaaatggtcacagaagtataatctaaaataatctgcaaaattggtaattggtgttgttgcctagactgggatctggaccagcagtgtatcacaatgtagtgaatggtcactgtttgttcagcaaatttcaacaatttctgttgcgggacagttaagaaacaaagacagtatatgaataaccattctatgtaggtttctctgcctcaggattcaaaacaccccttcccctaaccattcatgtctatttacttatctaaacaaaatcaaaagaagccctaattatataggaatccagccatcgattggaaaaataaaagagatgggaccatattttatgacaagttgtggaaaaggttccaggatcaaattgggtagggtgtaaatattcttcacccgtggaactgctgtggtttcttttcttttaaaacctgattatcagccaggtgcggtggctcacgcctgtaatcccagcactttgggaggctgaggtgggtggatcacctgaggtcaggagtttggagaccagcccggccaacatggtgaaaccccatctctactaaaaatacaaatagtagccgggtgtggtggcaggtgcctgtaatcccagctacccgtgatgctgaggcaggagaagtgcttgaacgtaggaggcggaggttacagtgaaccgagatcatgccactgcactc

SEQ ID NO: 33016 - DNA, 1053 bp, Homo sapiens
agagacagggtcttgctatgttgcccagactggtctctaactcccttgtctcaaacaatcctcttaacctcagcctcccaagcagctgggactataggtgcaagcctctgtgtccggctcagtaatttaaccaatttcacagtacctctaaaccccaaatatggtggccttttctttcaaaacatttctagatggaccttttctgaggagttaacaattgttttagtctgggctttgataatctctttacaggtctgtttttgcctccctttcaggtaattatttttttaacttgttaacttgttttgaacacttgagcattttatatggttcaaaatttaaaaagtacaaaagtgtatacagcaaaaaacctttccacatctgtcccctagccacttggttcacctctctggagtgacgggtattattagttttttatgtgtccttccagagatgatgttactatatacagaaaagtacgtaatatgctgtctcccaatgtatttcccaaaaacgttgtagaatattatatgcactgcttttattgcctaactgtctttcctggtgatcattcccaaatcgatatctgaagagtttcttgttttgtttttgttgttgttgttgtttttgactgaataatactttattataattttaccaggcccctgttgatggagaattggttgtttctttttataatgcagcaatgaataacattgtatataagttattttgcatgtgtgcaaacgttttgatgaataagttccccacagtagaatttcacggtcaaaggatatgtgcatttttattgtatttatttattctttttctttctttcttttttttttttttgagatggagtctcagtctgtcgcccaggctggagtgcagtggcgtgatctcggctcactgcaacctccgcctcctgggttcaagcgattctccagcctccatctcctgagtagcttggactacaggcgcacgccactacgcccagctaattgttgtatttttagtacagacacgggtttggcgtgttggccaggctggtct

SEQ ID NO: 33017 - DNA, 1068 bp, Homo sapiens
gataggagtctcactctttcgcccaggttggtgtgcagtggcgcgatcttggctcactgcaacctctgtttcaccctcccgagtggctgggcttacaggtgtgtgccaccatgcccagctaatttttgtatttttagcagagatggggtttcaccatgttggccaggctggtctcgaactcctgacctcaaatgatccatctgcctccgcctctcaaagtgttggcattacaggtgtgagccaccacacctagtgcatagagtgttacttctgtgcatgtatgcgtatattattatgtagaataacatgtagtgttacttctgtgtgtctgcatatgagtgtattattatagtccaactccagagagaagatatgtatgactgttaatcatgcctagtatagattgtgtttattgggcacacacctggtgtaaaaagtgagcagaactttgatgcaatgtgcaatgaaagctcaggatgtatatcttgaaactatgccatattgtcagggggtggtaaatacagataatgtcaatccaaggattgtggattcgtttatttattttatttatttattttttattttttgagacagagttttgctcttgttgcccaggctggagtgcagtggcgcaatcttagctcactgcagcctctgcctcccaggttcaagctattcttgtgcctcagcctcctgagtagctgggattacagatgtgcgccaccatgcccggctagttttttgtatttttagtagagatggggtttggccatgctggccaggctggtctcaaactcctgacaggtaatcctcctgccttggcttctgaaagtgctgggattccaggcgtgagccaccgcacctggccgattcatttattttaagtagtgaaattatatgattgtatttatctcagagcattcattctggagggtagtatatgtattgttgaggtgagggtgaagggcggtgtgagcagttacaggcatcaagaacagtaagaaagctattgggtggaaatctgaattcataaggctctctgtgatctgcccctgcctgcctctgatt

SEQ ID NO: 33018 - DNA, 1034 bp, Homo sapiens
ctcccagacagggtcttgctctgtcacccaggctgggagtacagtgatgtgatcatggctcactccagcctcaacctcgaggctcaagtgatcctctcacctcagcctcccaagtagctgggatcacaggagtgtgccaccaccccaactaatttttactttttatggagatggagtcataccatgttgcccaggctggcctcacactcctgggctcaatcagttctcccacctcggcctctcaaaatgccgaaattgcaggtgtttgccattgcacccagcgaatgcccaccttttatagagattccttttctggctttatccttacctttaagctgccaccaatcagcatctctgttcacagggtcagaggatggggtcatctgtccagaatgtgggtaatgcagtgccctgatgaagtaccatcattgtttccttcttgtagttgtgattagtatataacttggaacttctctagtgtggccttgaaaagcctttcatgtcttaaacgtgggtttttttgtcagtctgttttactttcaacctgatcaaaattctttagaatttatcatcatccagtgacatctactcgctttgcaacagtgctgttgtttcattttatctttgagacagggtcttgctctgtcatgcagtttggagtacagtggtatgatcacagctcactgcagccccaacctcacaggctcagttgatccttccaccttagcctccctagtagctaggagtacaggtaccaccaccattcatggctaatttttatttttttctgtagagtcggggttttgccatgttgcccaggctgttctcaaactcctggactcaagtagtccacctgtctcagcctcccaaagtgctgggatgacaggcctgagccgaggaccctggccttttatttcattttaatttaaatcttttcccttcattttgcgtggggccttgggaaggaggagcagtagatacatttgtctgccttgaactgtaattggctaatttatgactgtaaatgttcccag

SEQ ID NO: 33019 - DNA, 1133 bp, Homo sapiens
gcagccgggggttggggacccccatcatcaactaagaaaatcaaatgcaactgtttttaatactgcttttgatacacactggtaatgttaagctatactgaaacataaatacttgaaaaatacttcatcaggagaggtggttcaatgtgaaaaatgtgtggctctcagtcacagatttggctttcttcccagctttgcttttatataccactgtggcccttcacaagtgactcaactttctcttcaccacagcggtgctatctataaaataaaggagttgaacagcatgtttaaagtgtctgattctgtgattctatgtgtttttattattactggcttttctgagctacctcagaaacaagtatattatgtatagttataaccttatttgtaagaaagaatgttttaagttttgaacaactcaccttccaatacagtgaggtccgatctcagattctcacatgttccagtttgtgtcttactttttaaatgaaggtaaaataaaaagctttgtgactgtttctccttattaatacctcactctattaccttccaggcttaccttaactggaattatgtcagcgtccttagataattactttctgttagagcctgctcagctgcatggcacctaaacagaggcctacacaggacatatttttccacacacaaggtcattttgggagttgaggttagtcaggtagagctgggaatactaccaagaaatggtaagaaacattctacaacatcaaactatgtgacatggaaaaacagtacctgaatctgaggacttcaaagagacatcgtattttgttttgttttcctaggtaactcagtctgtagttgctgaaagaggaggaaaggattagacactggtcagttttcagttttagtgacctgatagcttttggtctctggatttggcatgcatgaaggcatccatcctgcttggagcatttcatagtagctgcacattcctgttgtctggcttattttgccgagttttaaggaattgaggactctgtactctgttcaaatatcaacttctttgacaccacactgtttgctcctctgttgtattcttgaataccattccatatgtctctctaaggccagtttgttaatttaaaaaa

SEQ ID NO: 33020 - DNA, 1033 bp, Homo sapiens
atatgattcttaactgggtgatgggtcttagattttttttttttttttgagtcagagtctcactctgtcacccaagctggagttcagtggcatgatcttggctcactgcaacctctacctccctggttcaagcgatcctcctgcatcagcctcccgagtagctgggattataggcatccaccatcatgcctggctaatttttatatttttttgcagagatggggtttcaccaagttggccaggctggtctcaaactcctgacctcaggtgatccacccgcttcagcctcccaaagtgctaggattacaggcgtgagccaccgcgcctggccaattagtgccttttatgtagggtttgacattattagtgctgagttcagaatcttttacttgcatttgagtcactgaaaagtgtaattaacctaactggctcataatgtaaataaaaatgtgagatatgtgtgggaaataacctgtttgctgactgcttgtagaagtctttttttcagtcagggttttggggaaaagagaacttaaggggtagcatgtaaactagctaaaagaaacacatgggaaagcaaggagtcaaggactggcacaggggttatctaagatgataggcaaaacagtcagagaaacaggaaaacaaattagactataacaaatggaaaattatgctgttaagcatttaccaaatttccaaaacggaaacacaacaaacctaggtgtgtttgtgtacatttgtgtatctaagattaactggctttgttttagtacttgatataaatttttttacatttctagagaatgttttagatctttattttttttttttttgagacagagtttcactctgtcacccaggctcgagtgcagtggcgtgttctcggctcactacaacctccgtcctctgggctcaagcagtcctcgcatctcagcctcccaaggagctgggacctcaggtatgcactaccatgcttggctaacttttgtatttttagtagcgatgtggtgtcaccatgttggccaggctg

SEQ ID NO: 33021 - DNA, 1029 bp, Homo sapiens
atcccagctgcggaggctgaggcaggagaatcacttgaacccgggaggcggaggttgcagtgagccaaaatcgcaccactgcactccagcctgggtgaaggagtgaaactccgtctcaaaaaaatttttgctttccggagtggaatccctacttttctccaggcaacactgctctggttgacaactgacaactgctttatcagtcacttcaaatatatatgttaaattttacacaaacgttaacatggattctcactaaaaatccatatggcacaacacagggtatgtatacatgcagaaataactgaagggttatcaggaacttatgcacacacattttctgtactcttcatttaaaaacatgcttttataaacctaaatgaattttattacttaattttattcagtgaatttagaaaatactcgttcaaaggagtatagaattgtacttttctacttttatggatttagagtcagtactcagaaacgtcgacgttctgaatgacagagcatggatgagttacatttattggtgctaatgtctttaggttgtattctgaagctgtatgaggattctgaagttatggtgcctcaattttgtaaggcatacataagaagtaagatacaaatgataaggaattttgattgctcttaaatgtaaatttaagagttttggagggaaaatctgaacagctgtagcttaggaaccctgaatgcttctcataaaggacagtacttagaagaatgaccattatataaagtttcttatatcccattagagaagaagtttggataattatattgttttaaaaaaatttacatgccataacatgttgcctgcatgaagttacactatttgattgaagattaagcattaggcttctttccgtgacagtcttaaattaacatccttgccaatgatgaccactagtcatgtgtttctagcacaggcctctccttgattgagagttatttgttgcctcatctcactaggcagagatccttccttgaaaacaggtctctctcacc

SEQ ID NO: 33022 - DNA, 1072 bp, Homo sapiens
ttttgtatttttagtagagatgggatatcaccttgttggccaggctggtcttgaacctctgggccttgttatctgcccacctcggcttcccagagtgctgggattataggcgtgagccaccacacctggcctgaaattgttatttcttatttttattttgagacaaagactcattctgttgcctaagctggagtgcagtggcatgatcttggctcactgcaatctccacctcctgggttcaagcgattctactgcctcagcctcctgagtagctgggactacaggaacgtgccaccatgcccggctaatttttttgtatttttagtagagatagggtttcgttatgttggccaggctggtcttgaacccctgacctcgtgatccacccgcctcggcctccccaagtgctgggattacaggcgtgagccaccgcacccgcccaaaatttttaatatttatgtatagaatgtaagcttttcagcatgattttgaatcaaacaaaatgagttagattgaaagctctgctttctgagagcttagatttgtaactcagaattagtgtggactgtaaggatcatgctgaaaggttaatacattttggtaaacatagagtacccagattcaggagatttatgtgaaatgaataggtttgagggatgagggaggaggaatacctgttgaacatttaaactgtgaagtttgccacctattttcccctttattgaaggtttcaggaggtagaatttaaaaaaacaaaactctgggctgcaagggtcagagatggtcattacggtatcttaatagagtaatttcttttttttgacggaggtttgctcttgttgcccaggctggagtgcaatggcgcaattttggctcactgcaccctccacctcccaggttcaagcagttctcctgcctcagccttctgagtagctgggattacaggcatgtgccaccacacctacctaattttgtatttttagtagagatggagtttcgccatgttggccaggctggtttgaacctctgacctcaggtgatctgcccaccttggcctcccaaagtgctggtg

SEQ ID NO: 33023 - DNA, 1067 bp, Homo sapiens
gcaaatattctaaatgtaaaactctaaggaaatttcaattaaaataataaattagttagggatgcttagctcaaaactcttgattggttctgcactggtctattaagaagttcaagcttcctgacatgtgaaggcattcttgcatggccctgcctccttttggagcttcattttcttcactgtattactcataggtcactgtccattgagatctttgtctagcgcccatgtttgatgttttcttccctctctgcttgtgctcatgctgccctctttcccttccatgactgctcatgcttctcctctctttttcatctggggtatgtctcatttttaagacctactcctgccctcccatagatgcccatgtattgctcataagaaatgctgcttcagcacagaaataaggttcatttccctttgcatacccagtatctagctctgtgcctgacacatagaacatgtgtaataaaagttaactgaatcaatgtacaaagagatgaacaatccacaaacactaaagcctctgttgccttgcttttactacccctagtaacagcaatggtggttacttcctgctgagatgcccactcatgatgatgacaaaacttgtctctttgtggatggatgaattatgttcttttgttttatgacccatatgcacacctgacaaatggtgctagtaatggattttactcgtgttctgcgtcatgaactgccacttgtgtctgtatctgctagattacttgcccattcctttgttcttgccattgtgtcctgaaagaatgggatgagcatgggggcagaggagatgttccagaagccctgttcagtgatccagaagaagtcttcaccttttacgtggtgttttatacaaattctctagtgttttgctatggtgttttgctggctgatgattcagtgaacacttgacaatcattgcttgtgcagtatgcatgtttttaactactgatttcgaggctgtcaaggggaaaatttcttttgaatgaactcaaaagagttcagtaggtgagcttgattctgcagctgctagaacttgccacttc

SEQ ID NO: 33024 - DNA, 1037 bp, Homo sapiens
aggttcatccaggttattccatgcagtggttcattcctttttattgctgagttgtattctatgctattgtgtaccaaagggaccttgtcccacccagcacatagctggagctcagtgtcagctatgtaaaagaataactgactctacaaacaacttgctgtgtcaaacgtcttctgcaggtggggaaagttgaagctggttatttccataacatttaaaacaggtaattgttttgaccttctgattgaaatccactgccatgaatccccttaaatgaccagtcacctcatttgaatgatgaagaagtagatcaaataagaccaaatgatacaacaactgcatttgcatgctgccatgatcaggccaaattttaaattggtgatatagttgaaaacttcagtttttaatgtcttgattacactgcaagattttcaccccagcaatggagtttaacaaaaaatttgaaatcccaggaaatgaaattgcattaatgatggactttatgtataaaaacctgatgagaggatctcagaacatcttctccctaacttgcacttctaataatattagtatcttccatttctattgcacttgaaaattataaaaggtagcttcatacatactgttgtgcttagtattgaattaatactgtgaggaaggtggggagcacagggtggtgctggtggtgggtgttattgtcatttccctggacacataagagaacagaaccacagaggtgtcatcttatttgtccaggactgcacaactacttaattcataagcctggttagaactctgatcttcattctactttcaccccatttcttatggataaataaacactttttagaaaaggagaaatctgtgcttttttatttggagactatttccatcatttgacctttacaatcccaatgtcaaaatatcccatatgtgtatttctgtagtaatcacttgctgaaagtcatgtttgtataaaacaaaatctctatctgaattgtttttccccaaacaaatcttagagatacttagaataa

SEQ ID NO: 33025 - DNA, 1034 bp, Homo sapiens
cactgagctttaatttcattgccaatgacggctgcaaggcagattgatgcccaaacatggagtgcacaatggcacttagaggctgcgggagaggaactttagtctgttcatagcccataacccagaatgagggccaaacgtgctaaacaagctgtctgtaaagctgcagggtctatgccatcccaaccagatggaactggtctagaagctgggagcactcagttcctagcccactgatgttgctacagtagtgtgaccttgagcaagtcacttcgccttcatgctttgttacagcaaagtatcatctataaacgtcagattagagaatgtgatctacctacctcccctgttgtgggggcgcatgacataacatcaaatctcaatgattcatccaagtgcaccacaaatgctgcctcctctgtggtcattcaaagggcacctctgattcctccaactgaacagagtctttccttttgaattctattggcattttaatagcatctttctttggacacataataaatagattagcaaacatttattagatgtgccaactttattctggctactattctaagtacttcagtggtagttgggggtggagtagtgagatcaggtacaaagataaataaccaagttcttgaaggtttggtttaaagataatatgaactaaaatgaaattagtatgtcaaagagatatctgtctcttgtgttcattgaagcattactacactagctaagactggaattgatctgtgtccatcagtagatgaatgaataaagaaaatgtgatatatatatatatatgtatgtgtgtgtgtgtgtatatatatatatatatatatatatatacaatggaatattattcagccatgaaaagggggcatcctgttatttgtgacaatatgaataaatgtggaggacattatgttaagtgaaatgaaccaggcacagaaagataaatactgcataatctcacttatatgtgaaatctaaaaacattgaatttatagaagcagagagtagaatggtgg

SEQ ID NO: 33026 - DNA, 1058 bp, Homo sapiens
atccaagcctgtccaacttcaaaaccaacgttctctcattggttttgaattttttcaaaatttaattttttttcagaatttaatttttgctaggcaaatgaagtaccaaaactccatcaaagaagtaatggttaagcgatggcaacattcagcttatttcttccattaattcttcatgacacaaaatttagagagagagggaaaatgagggatgatagaagagtgtggcaggatgagaaaaagacaagaaaataaaatataatggtaagaatatgaacagatggacccaaacctaggctttgctccttattatctaagtggccttgggcaatttctaatgcttttttacatttgtcttttcttccgtaaaattagcgtgataataacagtatatacctcataaagttcttgtgaaggttgagttaacttatgtgatatactttgtgatgttacagtgcaataattttataccatatatgtgcgtatgcaacagtacatactatatgtaacgtgaatatatgtgagttaatacatatatatgttaatacctgaatatatatatgatatacatgtgagttaatgtgtgaaaaatgtctgcaacatgggaagcattaagtatatgctattaccacttaaaaatgaattacatatatattagatttgaaagataaaatcggtgtaaaggttcacacagttaaatgtattcagtagacattcatagatgtgatatttaattttttatggagaaaggcacaaagaaaagagtgagccatggaaagagcactagctatgctattaactcatctgtaactggggtcgttttgcctcgtggtctcctattccttatatgtaacatgtgggattgaaaaagatgagtctaaggttcctttcacctgaaaagttttcttatgttctactttggaaagttgaaatcgaggtctgttcctgcaacttatttgacttataatctgtctttggttaaatgtaatttatattttacattttgtttatttatttctttttttttttgaaaaattgcaagtaggtttttttatttt

SEQ ID NO: 33027 - DNA, 1070 bp, Homo sapiens
agtaaacatgtgccatggtggtttgctgcacctatcaacccatcacctagtaattaagcccagcatgcattatctatttttcccaatgctctccctcccccaacctcactccctgacaggccctggtgtgtgtagttcccctccctgtgtctgtgtgttcccattgttcagctctcacttataagtgagaacatgcagtgcttggttttctgttcctgcattagtttgctcaggataatggcatccagctccatccatgtccctgcaaggaacatgatcttgttactttttatggctgcatagtattccatggtgtatatgtaccacattttctttatccagtctatcattgatgggcatttgggttgattccatgtctttgctgttgtgaatagtgctgcaatgagcctaccaaccaaaacaagcaaacaaacaaacaaacaaacaaataaacacaaaaacaaaccaaggaccagatggatttacagctgaattctcttaataactcttaataaactaggtattgaaggaacatacctcaaaataataaaagccacttatgacaaacccacagccaacatcatactaaatgggcaaaagctggaagccttccccttgaaaaccagcacaagacaaggatgccctctctcaccactcctattcaacatagtatggaagttctggccggggcaatcaggcaagagaaagaaataaaccgtattcaaacagaaagagaggaagtcaaattgtctttgtttgcacatgacatgatcctatatctagaaaaccccatcgtctcagcccaaaagcttcttaaactgataagcaacttcagcaagatctcaagatacaaaatcaatgtgcaaaagtcacaagcatttctgtacaccaacaacaggcaagcagagagccaaatcataaatgaactcccattcacacttgctacaaagtgaataaaatacctaggaatacagctaagaagggaagtgaaggacctcttcgaggagaactacaaaccactgctcaaggaaatcacagaggacacaaacaaatgcaaaaatattcatgct

SEQ ID NO: 33028 - DNA, 1075 bp, Homo sapiens
gttataatcatataataatgtaataaatgtagataaacatatttgacaaaatttaacattcattcatgataaaaactcctatcaaattgaaaagataggaacatccttaatatgataaatggtatagaagaaatacctatagtaaacttgatacttaatggtgaaatgttgacagaatccattttatgagcagaaacaaaagtaaagatgtccattattacctgttttattcatgatttactgatttactagcagtataacatatgaatgaatagtatatttactgtaaagaagaaataaaagcgtattcaccaatgatgtaattatgaagaaaatacaaaagaatctatagataaattattaataagaaaatttaggctgggtgaggtggcttgcatctgtaatctctacactttgggaggctgaggtgggaggaggatcacttgaactcaggagttcaagaccacagcaaggcaccatctctaaaaagaaaattagccaggcgtagtggtgcatgcccgtagtttcagctgcatggggggccgaggtgggaggattgcttgagcccaggatttcaaggctgcagtgaatcacgattgtgctactgtactccagccagtgtgacagagcgagacccttttgcaaaaaacaaaacaaaacaaaaaacaaacaaaaactagtatagttgctgaaaccaaagtgatatgcaatagtcaattgcctttttatatattagcaaaaatggtgtaatttaaacattacaaaaaaaaagacagtgctcaaaagtaaatggaacaaaaccaaaaattgacaaatgggacttaattaaactaaagagcttctgcacagcaaaataaataattaacagagtaaacagactacctacagaatgggagaaaatatttgcaagctctgcacctgacaaaggactaatatccagaatctatcaggaagttaaacaaatcaacaaggagaaaacaaataacccattgaaaagtggacaaaggacgtgaacagacacttctcaaaaaaaagacacatatatgcaagccaataaacatgaaaaagtactcaa

SEQ ID NO: 33029 - DNA, 1050 bp, Homo sapiens
aagtttctttttttgttgtatttctgccaggttttggtatcagaatgatgctgaccttatagaatgagtttgggaggagtccctcttctccttaattttttggaatagtttcagtaggaatggtaccagctattccttgtacatctggtgaatctgtctggtcctgggttttttttagttgttagaatatttattattacctcaatttcagagttcattattaatctgctcagggattcagtttccttcttggtttagttttgggccagtgtatgtgtccaggaatttattcatttcttctagattttctagtttatgtgcatagtggtattcataattctctgatgactgtttatatttctgtggtgtcagtggtaatattccccttgttgtttctgattgtgtttatttaaatcttctctcttttcttctttattagtctatctagtgatctatctattttattaattttgttcaaaaagaccagctgctggattcattgatcttttgaattttttgtgtgtctccttcagctctgattttggttatttcctgtcttctgctagctttgggatatgtttgatcttggttctctagtttttctagttgatcttggttctctagttcttctagttgatcttggttttctagttcttctagttgggatgttagcttgctaacttgagatctttctaactatttgatgtgggcatttagtgttttaaatttccctcttaacactgcattagctgtgtcccagagattctggtatgttgtatctgtgttctcattaggttcaaagaacttcttaatctctgccttattttcattatttacccaaaagttattcaggagtaggttattccatttctatgtaattgtatggttttgagtgaatttcttagtcttgatttctaatttgcttgcactgtggtctgggagactgttactattttagttcttttgcatttgctgaggagtgttttactttcaactgtgtgatcaattttagagtaagtgccttgtggcactgagaagaatgtatattct

SEQ ID NO: 33030 - DNA, 1022 bp, Homo sapiens
tttggaatagtttgagtacaattggtatgagttgttctttaaatgtttggtagaattcagcagtgaagacatggggtcctggtttttttttttttttttttttttttttttttgcggggagactattacagctttgatctcattactttttattggtctgttcaggttttggatttcttcatgcttcaatcttggtaagttttatgtgtctagaaactcattcatttcttctagattttccaacttattggcatatggttgctcatagtagccactaataatcctttgaatttctgtggtatgaattgtaatggctcctttttcacctctgattttatttatttgggtcttttctctttttctcttagtctggctaaaggtttgtcaattttatttattttttcaaagaatagactttttgttttgttgatgatttgtatcgtttccttcatttcagttttacttatttctgatctgatctttatttttttttcttctgctaatttttggatttgttctgctcttgtttttatagtcttttaatatgcatcattaggttgtttacttgaagtttttctttttttgatgtaggtgtttgtaggtatatatgtccctcttattattgcttttgctgtatcccttaggttttggtatcttgtctttccattatcatttgttgcaagaaatttttcaatttctttcttaatttcttcatttacccactggtccttcatttacccactggtcattcaggagcatattgcttaatttccatgtgtttgtattgtttccaaaatcccctttgttattaatttctacttttattccactgtggtcacagaagatgcttgacattatttcatttttttgaatgttttaagacttgttttatgacttaatatgtggtctgtccttgagaatggcacatgttcttaggaaaataatgtattctgtaaccatttgatgaaatgttctgtaaatctttattaggtccatttgctctatagtgcagattaagttca

SEQ ID NO: 33031 - DNA, 1260 bp, Homo sapiens
aaagaataattcaaaagctttctaattttttttcctacttcaattaagcttcagacatcagttcacatctatggcaacagtttttcttctttgtatgatgccaggatgaaaatgtactatttttgcaacaccactttcttatacttttatgtcacagatttttaaaggtatcaatcagattaaacaattgaaaaataatatattatttttcatgtatgcaatttcaacaggaagtaagataataaaaaaaattaaagaaatattcctaagggtgttatttttcaaagtgaaactatctcagaattgagaggtatcctagatcaaaccatttggtttagaaaaatggcaacataagtagaaatacatgtatttacatagtgtgtgtatgtatgtatgaatgtacattgtatatccataaatggcttgcaaatttctttctttctcccttcttcacctctttatttcttcctttctttctctcttttataactatctgtacctatctatcatctatctctctgttatctatctatctgtcatctatctatctatctatctatctatcttagttttatgttgatttaatagaacaccacagagtgtgtaatccatgatgaatagaaatttatttggctcacaattgtggaggctgggaagcccaagggaatggcaccagcatctggtgaaggtcttggtgcaaaatgacagaaggcagaagggcaagagagtgcaaaagcaagcaagcaagacagggctgaactcacttttataataactcactctcataacaaatccactttcttaataatgaacctactcctgagataatgaaattaatccattcatgaaggcagtgccctcatggcctaatcacctcttaatggtcctacctcttaatgtcccacctcctgatactgtcacaatggcaattaaatttcaacatgagttttggaggagacattcaagcaatattattttaccccttgtcccccatgactcatgttcttttcacatacaaaatacattcattccatcccaatgccccaaaactcttaacttattccaacaactcaaaagttcaaaatccagagcctcatctaactcagatgtggatgagatcaagacacaattcatcctgaggcaaattcctctccagctgtgagcttgtgaaattaacaaactacgtgcttccaaaatacaatggtggggtaggcataggatagatattccaaaagggggaaataggcaagaaaaaaaagt

SEQ ID NO: 33032 - DNA, 1044 bp, Homo sapiens
tagtttgctgagaatgatggtttccagcttcatccatgtccttacaaaggacatgaactcatccttttttatggctgcatagtattccatggtgtatatgtgccacattttcttaatccagtctatcactgatggacatttgggttggttacaagactttgctaatgtgaatagtgcctcaataaacatagatgtgcatgtgtctttatagcagcatgatttgtgatactttgggtatatacccagtaatgggatggctgggtcaaatagtatttctagttctagatccttgaggaatcaccacactgtcttccacaatggttgaactagtttacagtcccaccaacattgtaaaactgttcctatttctccacatcctctccagcatctgttgtttcctgactttttaatgatcgccattctaactggtgtgagatggtatctcattgtggttttgatttgcatttctctgatggccagtgatgatgagcattttttcatgtgtctgttggctgcataaatgtcttcttttaagaaatgtctgttcatatccttcacccactttttgacagggttgtttgtttttttcttgtaaatttgtttgggttctttgtagattctggatattagccctttgtcagatgagtgattgcaaaaattttctcccattttgtaggttgcctgttcactctgatggtagtttcttttgctgtgcagaagctctttagtttaattagatcccatttgtcaattttggcttttgttgctattgcttttggtgttttagacatgaagtccttgcccatgcctatgtcctgaatggtattgcctaggttttcttctagagtttgtatggttttaggtctaacatttaagtctttaatccatcttgaattgatttttgtatcaggtgtaaggaagggatccagtttcagttttctacgtatggctagccagttttcccagcaccatttattaaatagggaatcctttccccatttcttgtttttgtcacgtttgtcaaagatcagatggttgttgatg

SEQ ID NO: 33033 - DNA, 1048 bp, Homo sapiens
ttgcttgattttttagcagtaaaattcttcaataggaagtgattcattgtacacatcctgtcctgtaaatggtcaattcggcaaatgcctttgcttctctttttaaaactgtcaagtttctctgactatgtattttcccccatcatctctgttatgaattatgttcccccaaaagagatgtccccaatatctcagaatatgacctatttggaaataagatcattgcacatgtaattagttaaattaaagtgaggtcatatcaaggtagggtaggccactaatccaatatgtttggcatcctgataagaagagggaagataatgtgaaaagagacacacagggagaaccctatgtgaccatagaggaagagatcggagtgatgcagctacaagccaaggaacgctggccaccactagagctagaaagaggattctctccacagtctgagggagaatagcctgctaacaccttgattttagacttctagcctccgtaactgtgagaaaataaatttctgtttctgtaagacacatagtttgtggaactttgttaaagtaaccctaagaaatgaatgcaataatctttgccagtaatatactacatggaccagtctaactacagtcatgtgccatacaatgatgttttcaacaatgttcttataagattataatgaagctgaaaaattcccattggctagtgatgtcatagccatcctaatgttttagtgccatgtgtgactcatatgtttgtggtgatgctgatgtaaataaactggctgctctagcagttgtataaaagtctagcacatacaattatgtacggtacatcatacttgataaataaatgactgtattagtccgttctcatgctgctaataaagacgtacctgagtctgggtaatttataaaggaaaggggtttactggactcacagttccacatggctgtggaggcctcacaatcatggcagatggtgaagaagaagccaaggcgtgtcttacatggcagaagacgagagaggtgcaggggaactgccctttgtacaccat

SEQ ID NO: 33034 - DNA, 1081 bp, Homo sapiens
cactcacataatagcccattaatccataccaattaattcatttgccctttattccatgatccagaaatggattaatttattcatgaaggtcctcatgatccaatcacctcttaaaggccccacctctcagtattgccacattggggactaaatttcaacatgagttttggaggggacattcaagccatagcaattccctcattcactatttgctggagtttgtgtagtaaaagcaggatcaatatttggttctttccctttatttacaagttttcagaataatgagttggtttcttatcatccctcaagagtatcaataatgactccccacttctttcttcattattgagatggttaattttatatgttaactagactaggctaagggatgttcatagggcttgtagaagattatttctgggtatgtctgtgagggtgtttccagaagagattagcattttaattggtagactgagtacagaagattgcgcttaccaatgtgcgtgggcaccattcaatctattaagggcctgaatagaaagaaaatgtggtaggagggtgaattttgccctctgtttgagttgagctggcacattgatcttctcctgtgcttaacattagcactcctggtttggactagaactacaccactagcttttctgggccgccagcttgcagatagcagattgtgggactcctcagcctccataattatgtgagccttcataattatgtgaacctccataataaatctctttctctatatatctctttagttctgtttctctggagaaccctaatacaagtatcattgggaactcataggatttaagtgaatttgatgtgttttaatccattgcagttattattcttattcatgtacaaatttccccatctttggtcagcaagcccttcttgactcctaggtcctctcgacttgacctcagtagtttttgatagctttcctgctatctgtcaataaaaagatttttcaggtttatcttttatattcccttctcatgtatcaaaatttaagaggaaaatacaaacatttcttaataattttcctgacaaggaatgg

SEQ ID NO: 33035 - DNA, 1048 bp, Homo sapiens
tggcagcttctgtgccatccattcccctctcagtccatgttattgaatgaaatcccagacatcatgtcatttaatttgtgaatactttaatatgtatctgtaaaagataaggattcttattagaaatacataagcccaatactgttgccactcttaaaaatctaacagtagtttcttaatatcataaattatactaataatattaaaattcccaattgtcttatgaatgtcatggatacatttttctttatttccccctcaaaatcaggatcccagcaagatcctcactgctaattggttgacacatttttaaagtcttttaatctataggttcccctctgcgtcccttttttcttgctagtttttgtttgtcctctagagttttccaaatctgattattcttgctgaatttctgtgacgtagttcagtagttcactatgttcctctgtccttggtattttctgcaaattggtagttacctctagaggctttatcagattcaagttagattactttggtgagactgcctcacagattggactgtggtcattcatcttccataagaagactcagacacagaatatctggttcttcctctcactctctttctgaaaagggcaacaattgatggcaatcagtgcctagaccctttagttcattagggattgtagaatagtaatattctaattctatcatttttacaaatttactgtctagaatacttttttattttttatttttatttttttctataggtttttggggaacaggtgctgtttggttacatgagtgagtcctttagtggtgatttctgagattttggtgcacccatcacccaagcagtatacactgtaccaaatttgcagtcttttatctctcacccccttctatcctttaccccctcccccccgtgtccccaaagtccgttgtatcattcttatacctttgcatcctcatttggctggaatatttctgtaaagagaaactttctatattcatttgttttctgttgcttataacagaatgactcgaatcaggtaatttataa

SEQ ID NO: 33036 - DNA, 1046 bp, Homo sapiens
caatattgtgaaaatgaccatactgccaaaagcaatgtgcaaattcaatgcaacccccatcagaataccatcatcattcttcacagaattagaaaaaaaattctaaaatttatatggaaagaaaaaagagcctgcatagccaaagcaagactaaacaaaaagaacaaatctggaggcatcacactacatgatttcaacctatactataaggccatagtcaccaaaacagcatggcactggtataaaaatagtcacatagaccaatggaacagagcagagaacccagaaatacacccaaatacttacagccaactaatcttcaacaaagcaaacaaaaacgtaaagtggggaaaggatacccttttcaacaaagcaaacaaaaacataaagtggggaaaggacacccttttcaacaaatggtgctgggataattggctagccatgtataggagaatgaaactggatcctcatctctcaccttagacaaaaatcaactcaagatggataaaagacttaaatctaagacctgaaaatataaaaattctagacgataacattggaaaaactcttctagacgttggcttaggcaaggatttcatgaccaagaacccagaagcaaatgcaacaaaaagaaagataaatagctgggacctaattaaactaaagagcttttgcatggcaaaaggaacagtcagcagagtaaacagacaacccacagagagggagaaaatcttcaaaatctatacatctgacaaaggactaatatccagaacctacaatgaactcagacaaatcagtaagacaaaaacaaacaatcccatcaaaaagtgggctaaggccatgaatagacaattctcaaaagaagatatacaaatggccaacaaacatatgaaaaaatgcacagcatcactaatgatcagggaaacacaaatcaaaaccacaatgtggtaccaccttactcctgcaagaatggtcataataaaaatatcaaaaaacagtagattttggcgtggatgcggtgaacagggaacacacttctacacagc

SEQ ID NO: 33037 - DNA, 1050 bp, Homo sapiens
tcattttacttctttatgtattctgtttcttcactaagactccttcctcaatattttcatttgtttcaagtgtgtttgttattactcattgaaacatttttatgactgatgctttaaaacatttgtcagataattctgccatctctgtcatctcacagttggcatctcttgattatgtttttcattcagtttgatatcttcctgtttcttgatatgacaggtgacttttgataaaaatctggatattcatggtattgtaagaatgtgtggatcttatttaaaccttctgtatttgctggctttctgaaacactgctttagcagagaaagggcagctgagccttgttactgccaggtgggggtggaagtccaggtttcccacttgacacctgttgacacttaaggagagggctccttattactgctggtcagggtgaaaattctggctcccattagatctcttctgatacctgcctatctggaaggtgtaggagtgccttgttactcctcacatagtcttcactgacactatgggaggaaggtggcctcattacctctggacattggtgaaaattctgattcagtggtttgcctcctctcacattcaccagtggggatggtagggagctcattactggccagtggggataagagttcaggctccccacttggccttctctgatgcaacactggtaggggtgttgggatacattattatagcctggtgatggtggaaatctaggttccccattcagcctttgttggcacggacaggattggggtacagtttttttctgttgtgtttggctgcagtaaaacaatttttatctaaacactttctgtcttgcttgcctgctcctttcctggtcctttggctagacagcatgcattttggggctttaagaaaaaaaatctacacttggtgtttactgtatggctgtcttctttagctctgagtctgggatatataaaaacagaaagaccaaggtactcaacatgtcattcctcaagtcttgagtttcctagccagacctcagggtctgccttcttt

SEQ ID NO: 33038 - DNA, 1048 bp, Homo sapiens
aatgaaatttgaatcacaacttaccaaaacctatgggatacagcaaaatcagtgctaagaaggaattttatagcaataaacatctgcatcaggctgggcgtggtggctcacgtctgtaatcccaacactttgggaggccgaggtgggtggatcacgaggtcaggagatcgagaccatcctggctaacatggtgaaaccccgtctctactaaaaatacaaaaaaaattagccaggcgtggtggcgggcacctgtagtcccagctattcgggaggctgaggcaggagaatagcatgaacccgggaggcagagcttgcagtgagcagagatcatgccactgcactccagcctcggtgacagagcaagactccgtctcaaaaaaaaaaaaaaaaaaaaaaaaaatctgcatcaaaaaggtagaaagatttcaaatacttaatctaatgatgcacctcaaggaactagaaaagcaagaacaaaccaacctcaaattagtagaaggaaagaaataataaagatcagagtagaactaaatgaaatagagactaaaaaataaaaggaagcaacagaatgaaaaattggtgtttagaaaagataaacaaaatcaataaaccacgtgttagactcaccaacaagaaaattgctgggcatggtggccatgcctgtaatgccagcactttgggaggccgaggcagcaggattgcttgagcccaggagttcaaggccagcctaggcaacacagtgagagccatttctacaaaaaaaaaaaaaaaaaaaaaatagctggatgtggaggcatgagcctctaatcccagctactcaggaggtcgaggtgaaaggattacttgagctcaggaggttgagactgcagtaagccctgattgcaccactgtactccagtctgggtgacagagcacaaaactgtcccccaaaataaataaataacaaaaatgtgatctgatgagaattgcaaaatttcgagatagtaagaaaccaataaatgaaaaagatatatcatgtcttgtgataggaaagttaatttatagattt

SEQ ID NO: 33039 - DNA, 1031 bp, Homo sapiens
actaacatagcaacagaaaaccaaacaccgcatgttctcactcataagtgggagttgaacaatgagaacacatggacacagggagggcaacatcacacaccagggcctgtcagggggttggggggtaagggagagatagcattaggagaaatacctaatgtagatgatgagttgatgggtgcagcaaaccaccatggcacgtgtatacctatgtaacaaacctgcacattctgcacatgtatcccagaagttaaagtataataataaaaagaaaatgtaaaactgaaaaaaaaaagttggaaagtaaaattacatttttttacttcccagtcgtggctgttttttgtatttggttttgtcaaaaaattgtttgccatagtattactagatcatcctttttttatggaacaaaactaaaagctcttcagttgtgacaattatctctagaagcctttcaatagaaaggagatttagatatggctactttttttttctttcaatgtcttctaggagccagacactggactatgtatttaggcatttatcatttaatttaactcatccgatggtacaaaagataaaataagaatgaagaataaaagataagttctgaagacactgagagtgctctttgggcttcatgaactcttgagattgaggttgtagttcccaaaattcagtgtgcattaagatccttggggtgcctgctcaaaacaggaattttttagcctcaccctaagtgatttggtttaagtaaacctgggatggagttcagagatctgcattttgaacaaacaacagttaaccttgatacaggggacccacactcgttagagagaatgttttgttttaaaagtaaagaaaatgaaaataacatgttcttttaatgcttaaattaacttattgctggaattattaaaatgagaaacctccaaagttttggtactttaagtcagatttattcatttttgaggtggtaagtcttgaacctgaaagagaagccactgtgagggaaagggattataaactca

SEQ ID NO: 33040 - DNA, 1634 bp, Homo sapiens
gttgtttcttctgagtcagtgatatgtgatcttcgttggtttcattttgtgaagctcagtctgtctctgtaacatactttaggatttgcaccttgtgctccccaggaattatgttagtgtccttttctatgctgtcttcaaggatggacagaggcctaaaccacaacaacaacaaaaattagaaaaaaaaatacttagatttcggtaatcatccataggaactcatagcatcagtctcttttctctgtgaataatatctttgtgtaagttgtcataaaaaatcaacgttagaagatgacaattagaattcttcttaggtattgagggtaagaagttgtaaagaaagaaaattcgtgtttcaactaaaagattggattgcatatacctttgaagtggttttgtaaaaaaagttcagttactaaactgagtgtgccctgtaatccttttgagtgcactgaagatgctttgaaaatactttgttggtcttcacattgtgcatcatgtcctgcaacttgtaaatatgtgcatgttgtttatgtttgtctgcctgtctcttattgcactaaattctgcaaggtgaataatttttttataccatttatttggaaaaagttcctcctccaactcttcttcactgaccttttaattagttggtaaacttagaaaaccaggtaggatttttgaagccctgagtttaaaagaagaatcgtggctatttgacatcatccttacattcccctgacttaaaaagctaacaagaagcacgagatcttccacctcattttagaaagcttttctacagaactatatgcttgcttatagctacctatctacagtttgaacagggagaaagggagatatgtatgtctggttacatcttccttcactcttgaattggctgggacagcaagcaacaacagtttgaggtccagtgacctacgtaaaatgagtgtcgtttgtgtcaggggacacatgtaactgtgcaacatggtattttctacagggagggctaggaagggtggttttggaacctaacctactttgtgtcttcattgtcagaactaaggttggaaatgccctttaaagaacttggtgaggcatatgctaggacaatagagctgctttagaaagaaattgagacatgttttgtcaggacagataaaagtttaatgcaggcttttgaacagatgttttaaaacaaatttgaccttaccaactatttttttcttctagccaaatcattgtacaggagtttcatatatgataaaaagtgttttgttattgtttttgctttcttggcaggggagaacccctaccattgtgagcagttactgtcactctggctgaatggacaaatagctgtgtaaatagcttctcataaaacgcttctactgatagctgtttgactttttcttcccgttatgaatgggaggaacatttgtaaacttcctttctgggtagctaccaaaaaacgtactggcttatggtcccatgtgaccttgtctccgttaagcccagaatctgagtgcctttagcaagtgttagcatttcacagagagaagagagacagaattattgctattaatcaccattcataaataggagcttggaataacaaaggtctgtgtgaattc

SEQ ID NO: 33041 - DNA, 1078 bp, Homo sapiens
catagcatgtgacctacctaccccatcagaaataactttttatcttgctcaagttctggtcaactagtagcctgacggcttagaactttgactatttaaaagtttcattttcttttgcaattttagttttatgtactgttaaagaattgtactgaattctttttagatcacagtaaaaataggttggcagagatttcagtttcccagggcttaaccagaaccgccacctcaatgcattgtcagtagaatacattattagaaactgttaaggtctttcccgggacatttttttctgccattttcttttgcaattgtagttttatgtactgttaaagaattgtattgaattctttttagatcaaagtaaaaataggtcagcagagatttcagtttcccagggcttaaccagaaccgccacctcaatgcattgtcagtaggatacattattagaaactgttagggtctttcccaggacatttttttttctgtatcatgtctccccatcattgaagcgcaaattttcttgaattcaaatactcccaatgagcttgtatacttccaaacagctaaacttgatttccagttgtggatttcacacatataattgccgccttcttccctcctcttttttcccccctagttgaatcagcttgtctaacaagcccattttcatgccccagctgtgctgtgggttttccaagcctcatatttgaatattcaatgagtttaagatggatatgatttcaaaaaatagggccgggcgcggtggctcacgcctgtaatcccagcactttgggaggccgaagcaggcggatcacgaggtcaggaggtcgagatcatcctggctaacacagtgaaaccccatctctactaaaaatacaaaacattagccgggcgtggtggtgggtgcctgtagtcccagctactctggaggctgaggcaggagaatggcgtgaacccgggaggcggagcttgcagtgagccgagatcgcgccactgcactccagcctgggtgacagagcgagactccgtctcaaaaaaaaaaaaaaaaaaaaaaaaaaaatatatatatatatag

SEQ ID NO: 33042 - DNA, 1089 bp, Homo sapiens
tagaagccgtgggtcatggaagagaaccatggaacccagtgactagtgttcagctcaattaggatgaacccgggcacttagccgtgtgggaacaatggcaagcctttagcccaattgggagcagcaatgggcgcctcgctggatcaggagcacagtggacaccctgctggatccggaggcatggaagtcgccggcgggtctgcgatggcggcaagcagcagtgttggatggtgagcgaaagctctgctccagccttagcaaacacggaccagaagaatgcagttgcaagatttaatagagtgaaatagagtgagaacagagctcccatacaaagggaggggacccaaagagggtagcctcatattgaattttttaatttttaaattttaatgttacatttcaaacattaacattttacataattacagtacaattgtcaaaatcaggaaattaacacagatttaaataaataagacttccagattttttattctcaattcatagcatctgttttataggatattaagaacctgaaatcgcggactttgaggtcagactagtatttgatgttgtggtcttactactcgctagatgtatgatatcgaaaacatttcctaacccttctctgcctcatgaagaaggagatgatgatgaggaggatgatactaataatatctgcatgttagtatgtgtggggcatttagaatagttcctggtacctgagatagtccttgacagtgttgagtggtcccaaggtgcagtggaaccagattgtcccagctctgcattggacaattgtggcattggccgagttttatttttattttatcaacattttagtttgaattattttagacttacaaaacagttccaaaagtagtacaaataattcctgtatgcaccttattcagactccccaaacattaacattttacataactacagtatagttgtcaaaatcaggaatttaacacagattcaaatgatattgtttaatctatatactgtttacatttcattaattgtgtactaatggcctttccctggttctagttatttaatccaggatgaaattttgcaggtagtttt

SEQ ID NO: 33043 - DNA, 1117 bp, Homo sapiens
ctaagtatgttatcaccctgtggtgttgagcatatcgtcccaaaaacctgcttcagcaagcagttcttggccaggcatggtggctcacacctgtaatcccagcactttgggaggccgaggcaggtggatcacgaggtcaggagttcaagaccagcctggccaagatggtgaaaccccatctctactaaaaatacaaaaattagccgggcgtggaggtgggcgcctgtcagctactcgtgaggctgaggcagagaattacttgaactcaggaggtggaggttttggtgagctgagatggcgccactgcactccaacccgagcgacagagcaagattccgtcccaaaaagaaaaagcagtttttgccatcagcaaggatatctcctccactttaatggacaggcctcatttttggcagctatgctgtttgagatgtagactgaatatccaaggttcctccctagctcaagtttttacttgtgattacacacaccacattgaattccgtcttcagaggcaaagatttgggcttcatatctcaacagcaaaagggcctgttcagcaattcccttcattttagactcatatgacctcagcgattgcatgatagtagtaaactagtctcctggaaataatggatgtaggtgcttctagaatatgttacagaatttcagacttaacctattaatagataaatggatcttgacttaaggtgacaaaatgaaacttttattattgcttaaaaatgctgtgccaatattgtataactagctcctctaatacttttggtattttggatttaataataagaccttaagcattttaaatgtgaacatgttcagggaagtatgctttgatgtaaatgtctcagatctaagttgtaacacaattgaatacttgtggcttattcttggtttaacttaggaaaactggttaaacaatcccccatttgggcctgtcatcattttaatagtgacgatgttctttctgaaatcttcagggtcggagtcaggctgaatttttttaaaaattaaatattatgttcaaattctttcctttttgccattgtgaaaaagcaaaattttaaatgatttctcctgttagaatttttaaaaatac

SEQ ID NO: 33044 - DNA, 1047 bp, Homo sapiens
gcacaaaatactggtttctaagtggttttgcttcaaaggatgtctagatgtaagtgattccacttaaagccaaaataaaaattcctaaagcagttcttaaaggagttagagagctatattaaacagtttttctgtggtataataatgtgtctcttactagaagtcccccacgaccaagttaaagatacttttcctgttggattctcttttacaaataagtctaaatgactgataatagaagattgttagtcttgcttgatggtaaagtcttggattattctgatatatagacgtgcattgttttgtaacttagttacttttcagataggtctgtgttaacttttgaacatgtgtaacttaacctaaatactcccaaactttacctctaaatttttgtttttatgttgtgaatgtgctaatatgtgcatcaactgtaaagatgtatcagttttattaaaatcagttgacaattagaataataaagtggataaaggcaaattaagatataggaccaaaacagaatattgtagatggcagttatgaatgtatatttatattttgattaagatttctattaactttttggctgggcagagtggcttacacctataatcccagcaatttgggaggccaaggtgggcagatcacttgaggtcaggagttcgcgaccagcctacccaacatggtgaaaccccatctcttctaaaaatacaaacattagccgggcgtggtggcacattcctgtaatcccagctactcgggaggctgaggcaggagattcgcctgaacccgggaggcagaggttgcagtgagccgagattgtgccactgcactccagcctaggcgacagagtgagactccatctcaaattggaaaaaaaaaaaattatatgaacttttgctattaatgtttatttgtaggctatttatatcacttcataaagaacagttctttgagaaaagaataaaggaatgtattcatttccagaaaaagagggttggggaaagtttgccatgtaggttagtcagaagaaagcaattctattat

SEQ ID NO: 33045 - DNA, 1031 bp, Homo sapiens
gcagcttctacaagatgacaatacacattaagccatactggggactgtcattaataacaagtcatacagagtaatttttagctatttttaaaaatcaaaattatacttaaaggaatccagttgtcctatatagcttgttaccaaaacacagcagttgcttcatccccaacccatagtttctgctccccaaagtaactacatttagtaatttacctacccctcctctctccccgccccctttgttttgttttgttgggacagggtctctttatgttgctaaggttggtttcttcccgcctcagcctctggagtagctgggattacaggcttgaatcacctcacctggcttacttacatatctctaaataacatgcctgtattgctgttacttgtttaaaaaaataaaaattcaggtgttatctgttgttgacctattatcatggatgagaagggttgggttttaagctgctcctgccgtagccatgttcttcccaaccagtttttcccatatgatagattttgtttagaaccacattcactgtttacataattccgactttttaaaaagtcatttgctgctgagccatgagatgtgttatgacttcttttgccatgcagcttttttgtattttctagagttaattttttggtttatattcttagtttctatgtgcttctcactaatgaatcttcacactttatgccagttttgatgtgtctcggagcggatccattttcgttcattgtgctgggtatttagtgagcctttttgatccggaaactcattaccctatagaacagggacatttgggggtgggggcttgttgaattttatttcttctctattatcatcattccctttttctagatctcccattatgttgaaaatgggcttcctggactgatccttttgactttttttgttttttaagaatttttattttacttaactttattttattttattttatttttttgagacggagtcttgctctgttgcccaggctggagtgcagtggcatgatcttggc

SEQ ID NO: 33046 - DNA, 1047 bp, Homo sapiens
caacatagacaaatacagcagaagaagcagtgagatatacatttgtctcaggtgagtggagggatgattttgagtcctgtcctatgtccccacgcctgtgaagataagctatcaattcacattgccttggtgaccttcaacagaactgctttagggtagagatctcggggcccacaaggatttcttcaggggccaagtgtgagggaggtgtgtagcttttcatctttgtagccatcttatctaggaaccataatgggaggcaggtttgcatgacccagcttgacttttcctttaggcttagtgagtctggggttccaagatttattttcctttcacagatgtctttatgtgtaaggatttagatgttttatctgatcaggaagattataaaagtgccagtttagtgatttttaggaagtgattactgcatgaacacacgttcttgaactttcctccaatcacacgatgttaaactgcttgtgtaaataagagcttagaccagtggatctcaaactctagagagcttcagactcaccgtgaagacttgctaaaacacagattgctgggctctaccctcaaggtttccgagtctgtagtcctgggaagggatttataaatttgcatttctaacaggtttctacgtgatgctgatgctgctggtccccacactctgagaaccacagattgaaactgtttggttaaattagtggttatcaaccctggttccgcccttacacacttgaagagtcaaggccttagggtgggggatgggccacagagtcaggtgctgctaatgaggtggggcaagtatttaaatcttcaggatgtggatgtagtttgagaaagcccttcaaataactggttgttttcttctattctctctccccctttgaaaccactctcctctacccctcaataggagagtcctggtgcaaatgaaacagtgctcatggattgttttagtcctctcccagaaaataaaacacagcctttaccaacagttgccccaatgcttcttaaggagttcagtagaggaagaagtagtta

SEQ ID NO: 33047 - DNA, 1047 bp, Homo sapiens
cttaatttatttgaaaatagccttcctcgtcaccctctaacctcttgaagttcttgcagtttttttcttgcatacgacttatctgtacttaaaattatgttattgatgtgctgtattatttatctcctagacagatacagaacaaagcactgtggcaataggaagttttgttttgtttactaccgaatctctagagcctagaatatgtttggcacatggtcgggactcagatatttgttgaatgaaggaatgaatgcatgaattaatatttgttgtatcttagctaatgccgtttcaaatggagaagacggtttccagagaatcttacagcgttagtgctacgtaaggtgtttggtgatgctgctacagcttctctgaaagctaacaagttaccaactttgagtgttttcacgttatcacctttcttttgtatgccctctggtggagtgatgataataagcggcaagtgagtagaataggtcaagaagaaactaaaatacaagaacctagatcacaaactggataattaacttaaaaaaaatagatttgaaaattttaactttagttaagcctcctgaataattacaatacgattagaaagaatgaaaagaaaatgagccacagatttgaagagagatctggcttaggatgaaaaaataacctattgagcacacccaaaatgtttggatctcttaaaagaattcctgcttaaatatacttctgtcccttgaagtattttaatatttttccatctttagttcaaagacctctttctctcaactgtagtaataatttcagtgaacctttattgactaccatgtgtcggttaacgtacacaagtggtgaagccagtgttcaaactccagcagtggaggaccagagtcagtgccctaaatcttcatgcttcactaccacctttgtgccaaggtcgtgtggatggtacagggaccggagaatttcctttggagcaatagttatggacagaaaaatgcttggtaagttcacagtgtgtgttcctcagttccattttccagtatgtttatagag

SEQ ID NO: 33048 - DNA, 1008 bp, Homo sapiens
tccaaatttctgggataacaggtgtgagccaccgtgcccagcccacatgttgcaaaattgactgctctttttacctgcgcttgcacccattagcaatgtaagaaggacccaaaaatgttaccttaaaatataattgtgtaactatgttacctctgaaattataaggtagcagcttctataatgcagtattaacaatactttctaaagcattttcaaaatttattgtggccaagcatggtggctcatccctgtaattccagcactttgggaggccaaggtgggaggatcacttgagcccaggagttcgagaccagcctggacaacatagtgagacccagtctctaaataagaaaaaaaaattaattcttgtgcagaaaccctgagtagctttttaaaatgttatcgatgacaaaatgattatgtttattatgataatgtttattgcttataaaatccagatattataaaacttttacttgtttatgtgtgttcaattgcaggttttttcttagtttgttgcctaagagtacaccaaatgtgacatcctttcaccaatatagattacttcataccacattgtcaaggaaaggactagaagaattttttgatgacccaaaaaactgggggcaagaaaaagtaaaatctggtgagatacttggatttgtcaacattagatatatttatggaacccccccccccgccccgcccaaccatcgttctaggattatatatccagtttaggaattatttagatgtttcctttttcagttttctttgagactgtctactagagaaaattaaagggacaatataatagtagagttaattgttccttggcagattggcaagatggttagataaggaataggctgaaattattaactaaagtaaggtttagggcttattttagattttattttttaatgataatttaaagtttgtttatttatttagagatggagttttgctcttgttgcccagactggggtgcagtggcacaatctcagc

SEQ ID NO: 33049 - DNA, 1042 bp, Homo sapiens
tcctgtcaagccccaagcccacaacttgtcccggctccctccggatcccaccaaggtcaccctggaagcgtcctcccttttctcgccccgcacccgcttcacgcccgttctccctaggccagcacccaccagcagccttcggaaagccacgagtgaggaagcccccaaatccgaggcgagtgccaaggggccggccagacagagctgccaccgcagtaaccgaaacccgccgcaacaaactcatggccgccatggctactacgggcaggaggaagaagggaggcgggtcacggaagctgagagagccaatttaccaatgaggacaaaggcaggatgtggccatcttaagtgagggcaagttttctattctcctcaccgccggcttgagacgccggaagtgacgctatcgttggcggaaacgcgttttgccagttatgcgaaaacatggctgcggccggtttggcccttctttgtaggagagtttcatccgccctgaaatcttcccgatcgttaataactcctcaggtccctgcctgcacagggtaagtgatgtataaagtaggtttgcccacctctccaactttggatcttgtttggttgccgagatgccgagatgccgagaacaactcaagaatggaacggccgcctggatggcagagccggagcccactttggtgaggagtgagtgaccttggagaagtcgctcacctccgacatttctattccttcctcattttgttgctgcctgctgtggacaagacagtatatggggtttgtagatgtccagcatttgttgaagtaaatacatctataagtacagaagcatcctcttgggctgggtgaggtgcgaaaaactttaccgaagatgtttttgttgtgatactcaagtctgtgtcaagtttggatggattaaaaaagaagagatatttgtatttacaggatgtgttacaatgaaagtaactggtaacttagtaacttcttttatttatttatttttcttggtcctggatccagtgaagtatccatttattacattggttgc

SEQ ID NO: 33050 - DNA, 1031 bp, Homo sapiens
tgctctacctccttctgatttagccattttcaaaataagtgagttggagactaaggattagggtccacaggaagtactgcagaattctggaaaataacaaaaattatgaaatttaaagatccagtgcattatgaatacacataattgttgtatttcactagcagtaaaatgaatgaacttaaccaaagaggtctgaggacctgtttatattcgcattctattaattataccatgagcaaatgttgtgtctactaaatgcactgttcccattgcccggaaatttgaaaccatcatacaagggggtccagtatttattccagagacaaagattggtaatctctcattagtttcaaaattccccatattactttatctttagataagtatttccttggtacttgatgactttactgtttttaatttgcattttatatgacagctagtcccaagcattatttgaggtgactaaataataatagtctacattaactgagatctcattccatgccaggatgtatgggttctgcatgcattttataattaaattctctaacaatgctgtaacacagataatgtgagtattcttataaccctcatttcacagattaagaaattcaggtgcagaggggtcaaatcatacaatgaggaaggttaaggagcaaattcctattcaggtctggttaactccaaaacccatctgctataggttctttttagcataaagtgtacatgagatatgggaggggagcactaaaaaacagaagaaaagctctttggagaaggataggatagcaataacttaattgctacaagtacctctgctatatccagctccaagtttcctgacagagctcaaaatatggaactgtttgattgggaaatcctcttaatctgacaaataaaaatataaaatcatcttttatttagaataaatatttagaactgtttctctcctgcccccatatggtaaagatattggatatgaaaagagttcacatcttttataaaatattttgcaaaagatatagaag

SEQ ID NO: 33051 - DNA, 1025 bp, Homo sapiens
caacagaaaattgcacagtcaatttctgctggctggactgaactgaagatcaatcctcacaattcagactgagggttgagacaaaactttaaggatacatcttggaccatatcgtatttcattcttctaatggtggtttgggcttgtcttctagtctgggccgctctaaacatttataattccaacattgtggatttcatcttatatctgtggaccatcctagtttattctcccataagtcttagaagctttatggtgattattttgaggttttcattctcgcataaagcacaatgctgtcttcatcagaaaacagttggcataagaattaaacatatgaacatcacaaaacaatttataaaaacttcttaaatatacgctttgggctagttgcaaagactatgctaatagcacttccagtgagagtgatatatttaagtgtactggatctggaatggtgttttggtttggggggaattttttttttttcctggcaaatcacatgtgttgttgatgtgagtatctgatgaaaaaacaatgtcagaataaccgacatgaaaattttttaggataacttggtgcctacctgaaaaatgtattgtgttttagactcttgatttcaaaaggttccacagaactagtctgcgcttaccttacccatgtttatatatagctgtcctacagggagcttttatttagaaaatgtctgcataatgttagattcttctcctgtctacattatgcactacataattggacttcattatgcttttgaaatgcttatctgcctgtcacataagttaaactatttaatttgttttgaatgttttggattgctacacaatacaatattctaaatttaggcatgagggtttttttgttttgtttttactttttttttgtcatcgcactatggaacacaaatggaattctcttaatttataagaagatagttgcagttaaattttgaaaatggttgtaatgagccatgaagttcaatctttataatataggtactgctcttt

SEQ ID NO: 33052 - DNA, 1048 bp, Homo sapiens
gtttcctcataagcaagagaccatacttttagttaatttagatagtagacgcgattaattactgtgtcagtagtgtctaatacagtttaaaatgattgttatgctgattactatacattcttatttatccactgaagctgacttctactagtgaaagtgttgatagtctagtgaattatgtaattaaaacgaatagcctgtttcttttaaaagtaattatttagaacatttaatcactctagacctcttcttcccgcagctaacccccatgcgtgtttatatttatgtaatataaaaagactgaattcgaactatttgatttttaaaaaagtagttctaggaaataaatgtaagccctcatgggaataagtaagttattaatttatagtgaaacagttaatcttttataaacttaattttacgacgcagatgtgacagcatagaaaaactaaaggcccagatacccaagatggaacaagaattgaaagaaccaggacgatttaaggatttttaccagtttacttttaattttgcaaagaatccaggacaaaaaggattaggtaagaatttttaaaaattatatttggtgtttcagatatattcaaatacattgacagtgtcgtttttgtaatagaaagttatgtgttttgagcataaagtcatgaaaataccagttattgaaaagtaattagaaacaggaaatttttaatcagaaaataccatgcacattgagtaagtttaccctgggtactatatgtgaaccactgacttttgctttatgaaaactacagtcaatatagaagatagttgttaaaattccactgacagttatttatttatgcattcatccattcattcattttttcattcatgaccctgaagatattttaggatcttaggatctatagaaatagcactataagatttctgagtcatagaatgccagataaatttattcttttttgttatgatttatttgaaaactataaggatgaaaaatgaagtgcttatcattcatagtcttattatccagaaataaccactgtaa

SEQ ID NO: 33053 - DNA, 1028 bp, Homo sapiens
atattctgttttatgcattttacagccttacaactattgcatttctttgaaaacttgataatacctaggtagttttaacattggaatactgaagattatattgcctgatcttatttaattattactctagtttattccctttaaataagtatttaaataaatggcatatattacatttgagtgctgaatcattgtagctgtcacatggttttgctcttgggaagttccccactgggtttgtagtagaaacagagaaaaaatccatctgttttttcttccacctcaattttctatccaccctctcatcccctataaaatcattcttctctggttagtcacctttttctcttccttgtgttgataaaaatttaaatctttagtgccatactgtcaaaatcagaacactgcctggtacacctttgtggcttaggaaaaggggatgggagtgttacagctcccctaaattggtcaggtatactccagctttattctaggatagcctttgagactacagaattgaattcccttagtagggaatcaaatgttacaatgtattctaggaacagagagctgacagagaagtggtaagagtgcattgtaagtgtaagaagtggagggtacttatcagactttataggaatgggattgtcaatatcacttggcttagctggagtccgtactgtcagttcttggcctggtagaactcagtagcctttatggtgttggaagtgggtaggtacaccctgtttcttcaaatatgttgatattgccctatatagtggaaatttataccaaaccagttaaaatagtttacatttggcctggcgcggtggctcatgcctgtaatcccagaactttgggaggctgaggcggttggatcacctgaggtcaggagttcaagaccagcctaggcaacatggcaaaaccccatctctactaaaaatacaaaaatcagctgggcgcagcagtgcgtgcctgtaatcccagctactcgggaggctgaggcaggagaatcgcttgagcctggg

SEQ ID NO: 33054 - DNA, 1903 bp, Homo sapiens
tgctttgtttcctagggtggtctcaaactcccaggctcaagcagtcctgctttggcctcccaaagcactgggattacaggcgtgagtcactgctcccagcccagctatttcacctttttatccttcatgtgtttactggagaagcacttttaacttccttcaagaacttttcctttgcattcacaacttggtggtttggcatcagaagcctaacttttggcttatctcagcttttgacattccttcctcactaaacttaatcatttctagcttttgatttaaagtgggagatatgtaactcttcatttgaccacttataggccattgtagggttattaattagtctaatttcaatattgtattgcctcagggaatagggagacccatagagagggagagagacaggggaatggctggtcagtggagcagtaagaacacacacaatattgattgaggaagttctctatcttacatgggcgcagattgaggcaccgtaaaacaattatagtagtaatatcagagatcgcagatgactgtcacagatataataatttaaaagttttaaatattgtaagaattacaaaaatgtgacatagagacacgaagtgagcacatgctgttggaaaattatgcttgacatggtgttgccacaaactcaataggtaaaaaacatagtatctgcagaatgtgcaataaagtgagatgtgcctgtaacatgaatcatttattaggtgtatatagtcttaccatttctaaagcattttcatatttgtttaataattgttacatttttatacccatttaatggctcagaaaatcaaggctcggagatttagtgagtcaagatgacagaggtgatcaggtggcagattccattctcaaccaaaaacttctctttaccaattcattgcattttttttttcttgagatggagcctcactctgtcacccaggctggagtgcagtggtgcgatctcagctcactgcaacctccacctcgcaggttcaagctattctcctacctcagccccctgagtagctgggattacaggcacgtgccgccatgcctggctcatttttgtatttttagtagagaccgggtttcaccatgttggtcaggctggtctcaaactcctgacttcgtgatccccactcctctgcctcccaaagtgctgggattacaggcatgagccgccgcacctggcctgcatttttaaaattataatactgcagcctttttgttgagggaaaaatacgtaaaatattcgacaaccttaaaatatctaaaactcaagcctggatgtggtgactcatgtctgtaattctagcactttgggaggcccaggcagatggatcacttgagtccaggagttcaagaccagcctgggcaatatggtgaaacctcatctctacaaaaaaatcaaaaaattagccgggcgtggtggcacgcctgtagtcccagctacttgggaggctgaggtgaggggatcacctgaccccaggaggttaaggctgcagtgagctgtgattgcaccactgcagtccagccagggtgacagagtgataccctgtcttaaaaaataaatcaaaataaaaataaaacccctgaaattccattttaaaaaagaaaagtttgaaattcatctttattggtactagcttgacagatgcttttctaacaaaatactttatttccaagaagttcaaagttgttgattttcctttgaatagttggttgtctttaggttgagagtgagattctttatatctcggttattaaataaatgaatgtcttctaatttttcttcattttttccctttttccataaagatgtagccatagctgtaacgtataaccatgatgggtcttatagcatgcaggtaagccttactggttttgttct

SEQ ID NO: 33055 - DNA, 1050 bp, Homo sapiens
ctccactaaaaaatacaaaaaattagccaggcgtagtggcgggcgcctgtagtcccagctactcaggaggctgaggcaggagaatggcgtgaacctgggaggcggagctcacagtgagctgagatcgcggcactgcactccagcctgggtgacagagtgagactctgtctcaaaaaaaaaaaaaaaaaattgtgactaaagggatctaaaattataaaagtcctggaagaatacctagaaaataccattctgaacatcagccttggcaaaagatttgtgactaagtctccaaaagcaatggcaacaaaaccaaacatcgacaggtaggacctaattaaactacagagcttctacacagcaaaagaaccatcaacagaatgcacagataacctacagaatgggagaaaatatttgcaaattaggcatctgacaaaggtctaatacccagaatctatagggaacttaattaaactagcaaaagacaatcctattaaaaatgggcaaaggacatgaacagacacttctcaaaagaggacatacatgcagccaacaaatatatgaaaaaaattctcaatatcactaatcattagagaaatacaaatcaaaatcacaatgagatccatcttgtaccaatcagaatggccattattaaaaagtcaaaaacataacagacagtgaggctgtagagaaaagggaacgtttatacactgctggtgggaatgtaaattagttcagccactgtggaaatcagtttggagatttctcaaagaacttaaaacagaactaccatatgacccagcaatcccattatcggatatatacccaaaggaatataaatcattctaccaaagagacacacacactcatatgttcatcacagcaccattcacaatagcaaagacatgcagtcaacctaggtgcccatcaacagtggactggaaaagaaaatgtggtacatatttactatggaatactacacaaccataaaaaagaaagaaatcatgtcctttgcagcaacatggatgcagctggaggccactatcctaagcg

SEQ ID NO: 33056 - DNA, 1056 bp, Homo sapiens
ctgcatgactcatggtgatgctgagtatccaggaggaaatttccagaagaaacagaccgtcagtcacgggcttccacttcacagacctccttatggccaagatgagcctcatgttttaacaaaacagttcttgggattgaatgactcacatttaccttgtgctaggttctaaagattgaatccacattttgttactaatgattttcccgctaacataaggatgatgagcagggcactatcatacacactggctgagaactggaactgtttttgggaaggtggcatttgtctcattccctgaaataccttaaaatgtcctctacaccaacccttccgtctaccctgctcacatgtacagtgacggggaactcaccaccttttgaagaggcagttcattttctttgcaaagctctctcctaacttcctccgtaaattccagccagcatggccacatgggtcacgcctggtgccttcacacgtttgaggggtcttcgtctctttttaaagcttagaggtacaagctcaggacagtcttcagtaaggaaatttgtggatttccctttggatctttcttcctctccagcccacaagtggctctagtgagacgagcatttaagctgcaggtggtggcactcgggtctcagagccaccagacgtgcaggtgggacagtggttccagctccgactgcctgtcagcgtccctcccaggtgctagccctggcaggcacagccctcccctcatgccagcaaaggaaatgctcttgatgagaggctcgctttaaagaagcccaaagcgtgtgcttatccaaggggttcagctattcctgacttcacggcttgcatgtttgatttttctaagagaaaagaggctgcctgctgggtgtctgtggaaatgagattaaaaactgtacaatctcagattttactaaaatgcaaaaatgtagtttcagtttcttaaattataagcacgagtcttctcacgcttgttttctccagtctcttggtgctaaggacttcagtgtggtgcagctgccgccacacctcagaggcctgttg

SEQ ID NO: 33057 - DNA, 1032 bp, Homo sapiens
ctttgggaggccgacgcgggcagatcacgaggtcaggagattgagaccatcctggctgacatggtgaaacccggtctctactaagaatacaaaaaattagctgggcgtggtagcgggtgcctgtagtcccagctactcgggaggctgaggcaggagaatggtgtgaacccgggaggcggagctttcagtgagcggagattgcgccactgcactccagcctgggagacagcgagactccgtctcaaaaaagaaaaaaatgaataaacaaacaaaaaacgctgcaaagctaggtgttttgagattcagctgtttttcttaagtaaatacaccctggtttgctataagcctttgattagtttccagagttctgaaaaggttgattctgacattttttgccagttctttcattgctcttatgaaggagagttttcagagctccttactttgttatttttcactgacatagtccagtgcgttacacaggtgtgagggtaggcactaggacagcagtgccttcctgaatcagtagtgccaagcttgtccaagagttaccgagtcaggaagaagcaggtgacatccctcctaagtggagatatacaaaacttaagctcttctatttctcaaaggaaaaggagagaggaggaaaccattattctttgttcatttgcatgctaggtgcatgtactatcttatttaagcctcactacaacctttatgaggtaggaggtattgtcctcattttacaaatgagggaataaagtgccacaggccacaaaactgctaagtgacatacttaggattcagacttgaaaaggccattctcttttcaccatgttttccatttgctggttcactgtgtgactgctacatttcatcatgttttctcatttcatcgtcactcagcccttttttttctttttatttatttatttatttattttgagacagggtctccctctgtcgcccagactggagtacagtggtgcaattttggctcactgcagacttgacctcctgggctcaagcaatcct

SEQ ID NO: 33058 - DNA, 1894 bp, Homo sapiens
tcggagaaatgcctgtttctccaaatctttttcccatttaaaaatagctatttatctttttattgagttgtaaaagttatttatatattctggatactagacccttattaagagatatgattcacaaatatttttcccattctgtgagttgtctgatcactttcttcacagtgttttctgaagcataaacattctaattttgctgaagttcattttatctatttttttcttttgttgcttgtacttttaagtgtcatgtcaaggaaaccgtgacctaattcaaagtcacaaagatgtgtacctatgttttcttctaagagctttaaaattttagctcttaaatttaggcatttgattaattcggagttaatgtttgtatttgagatttgagataggggtccaaactcattctgtgcttatggctatccacttgtctgagcaccattttttgacaagactattctttcccctagtgaattgttttggaaccttagtcaaaaatcaggtgaccgtaatcgtatgggtgtatttctggactgtcaattctgtccattgatctatatatctgaccttattctaatactacattgtctttattcctgtaggtttgtgttgtaaattctgaaactatgaattgtgagtcttccaactgttaatatgaaatattacattgatttttcatatgttgaaccaagctggcattcctgtgacaaattccacttggtcatgatttataatcctttttatatatggctggatttggtttgccaatattttcttgaggatttttgcatctcttttcataaaggaatattgatagttttttgtgatgtctttggttttgatacggaggtgatagtggctacatagaatgttccttcctcttctattttttgaaagagtttgagaaggattggtgttaattctcttttatatttggtagaatttcccagttgtagtaagttgaatagtgtgcttccccaaaatttgtgtccacgtagaaccacagaatgttactttacttgaaatagggtctttgcagatttgattagttacagagagatcatattacattaggatgtaccttaaatccattgactcatgtccttataagaagaagagaggacaaagaaaaatacagaaaacaagaccaaagagatggtggcagagattggagtgatgcacctgtaagccaaacaatgccaagaattgtcgagagccaccagaagctaggaagaggggaggaaggacacttccctagacccttcaaaaggaagcatggccctgctgacactttacaccttgatttcagacttctagcttccagaactggaagagaatagatttttgttttaagccaccaagtttgtgttacaacagctgtaggaaactcaaatactagtgaagccaatgagaaacataggcacctaacacctaatctggctctggggttttctttgtggtaagttttttgaattactaattcagtctctttacttactcttggtctgttcagattttctatttcttcgagtcaattttagtagtttgtatctttctaggaattttaaatttcatctaagttattctcatttgttggtatataattgttcattgtattttgtagtaattctgatttctataaggttcgtagtaacattctgctttcattcctgattttagtaatttgtttttatttttatttttcttttttagcaaatctcagacctgtatgagatgacttttgtaatttgagtctttttttctttgtcactgtagctaaaagtttgtcaattttattgatcatttcaaacaaatccaacttttggatttattaatttttctgttatttttctattcatttacgtatgttcttcattctttccttctgctt

SEQ ID NO: 33059 - DNA, 1048 bp, Homo sapiens
ccaacacggtgaaaccccatctctactaaaaatacaaaaaattagcttaggcgtggtggtgcacgcctgttaatcccagctactagggaggctgaagcagaattgcttgaacctggaaggctgaggttgcagtgagctaagattgcgccactgcactccagcctggacgacagagcgagactctgtctcaaaaaaaaaaaaaaaaaaagtaacgaaattaagatttctttagggtggcaaggttttgccttcactattttcaaagcatttcactattagtttatacctcacattctttgaaggtggtcatgattttatgccatttaacatatgaagaagcctagcatcagagtttaaaaccttttctcatgctggtgaatactttcttcaaagaagctagaggtaattaaaaatcagaattctttccccctagtctttttcttttttgaaatcaaatcagccatttggcatgaagagcgtagcagtagagagagatgcttgtgatctgtcttgcaacttgaatgtaagctgctttgaacaacataaatgtgaatggtcatgctgcaggtcttaaatctttattgttagattatccaagtgactttaacctcaggaaatgccatttgaactgtcttgtgtcacctcagacttttcttgtaggaaataattattctagtaatagtgattctagctttacaatgtctgtaagtggtgcttaatcaattacctatatatgagagtctcaagaataaactgtttatttagtatgtcttgtcttcttcctggggtgccaattagtccagctttccttgctgagcactcctgattgcttcttgtagactgcaaagtgaagttggctcagcttctggttttaatcagtgatagatttatggggtgacaggtctactccgtcccactttctttctttggattggagatgttttccgaatgggtttttttttttttcgttttatattttgaaagaacttgacaagtttgacctagagagtttttaaagctttgtgagaccagtgtgcctctctgcttt

SEQ ID NO: 33060 - DNA, 1023 bp, Homo sapiens
ctatccagtggttggttctgtgtggagaatgtgggctgcctgactataaaacatgtgccttttccactctaccacgtatttattatgtctgtgaccaccagtgatttttgcagaagaggaattcctcttatgtgcgaggcattttcttctggtttttcatttttgtagcctgaaatttctcacatgtggtgatgcaattttctgtctgttttagattaacaagtggtggaataacctaagtgatggccagcggactgtgacaggtttgtgttagcttacacgttttaaccattcaagggaagagaaatcaaaccaaaaggtacagtatgtcacaagcaatggctcttgtaccatgctcaccagtggtttagaagacagtctctgtactgataggctaatgtaatagtatataaagtggtgaggtataaaggtttacatgatgctctgggtccgttactttctaattttgatttagtatgatactgattgatcagttttgttgtagaattccagcttgtggaatagcttattaattattacttcccttattaaagaaactaatggaaacattaagtaccttctatattcaggatgctgtaatacacattctgtccctacttggagttgcttacagagtagttgtctccctttttacagataaggaaaccggctttcagagaaggaacttttgaaagtcaaactgctagtaagcaatagagcagagtttcaaaacccaagtctgtccattcgaaaaccagttttcgctcttctcccccatgctatttataaaaccccatttaaatgtaagcatgacatgcatgtcaccatgataactttttttctttgtaaattgttatggaaagacagatttggctcttcaagttaacacctctgcaatatttcatggagtcagttatttgagaaacttgaaaatagatttttgccaggaagagtggctcatgcctgtaatcccagaactttgggaggccaaggtgggcggattccttgagctcaggagttcga

SEQ ID NO: 33061 - DNA, 1081 bp, Homo sapiens
ttcccaagggttgtttctcagggagatacccttcacttccatgcaagcctgttcctttggttgtttgaactctcaagttccaaggcaaggctttgaagacatgagagtttcttggcaagaagatgttctctgcggtagatgaaactttagatactcttttctgacggtagcaatgtaagcctgtgacagtctctactcctagatacatgcggcgctgtgagtgtgggaagtgggcaggctttggcattctgcaggaggggtctggaaggaaaacacgtagtgagcatctgtactggaggtcagcatgccctttgcttttcctacctgctttttactactccttagaacaaggggctacgtgccagtcagttaaatgtcattaggtccgctttaggctggctgagggggaaaggcagtttagcatgtaatttgtcatgtggaatattgggtcattgataaggcccctggacctcttgaggttgccccacactcccgtgaccccttgatgggcctgagattgggctgcactaatgagctaccttttgcccttcagcttccttccactgtatagcctgatgtgttttgctacgtgagtgtacgccctaggcttgtctccctggtcttgatccagtgtctcatctttgcacctctctcacaactcctatcagagtttgtttctaatggaagaggttcacatgataaagaacaaaccagccagtcctcacatcaagatagagatgaaaaatgccaccttggcatgggactcctcccactccagtatccagaactcgcccaagctgacccccaaaatgaaaaaagacaagagggcttccaggggcaagaaagagaaggtgaggcagctgcagcgcactgagcatcaggcggtgctggcagagcagaaaggccacctcctcctggacagtgacgagcggcccagtcccgaagaggaagaaggcaagcacatccacctgggccacctgcgcttacagaggacactgcacagcatcgatctggagatccaagaggtaagtggtccgccccctgcctccctgcccgcaccccaccaccccatgctgatctg

SEQ ID NO: 33062 - DNA, 1509 bp, Homo sapiens
ggcggcctggggatgactttctctttgctcttttgctttatctcctatttcacctttgatcctgttttaaccacgggctttctctctctctctcagccccgcttctcttcctgagtctgcagggagattatgttgctgccttgtgacagaatacatttttgtggtagctgattgtcatgattaaaatgtagtttacaactttacattttaccacaggaaccttcagaaagggttgggggcccctgaaaaagaaagttcttattcacaaattgcattcagggatcattttcctgggtggaaagaaaggcttttgctctcatcattttctgtatcctgggaggctccttatacagggtaaatgtgtagttccctaggaagggtattttttcccagaaggtgaagactatgtacataattttaaaggagagacttgtgtgagtggtggcaaaacctggagacaaaaagtggtggcaggcggggagctaggtgtgcctttcccccgaggagatgtgtaacgaggacgtgtgcccttgttaagactagagagactgtggcaagaagagctgaatgaagttgggccagacgctgcttccctgcgaagggttgtgtggatcttctgccgcaccaggctcatcctgtccatcgtgtgcctgatgatcacgcagctggctggcttcagtggaccagtaagttctaaccatcctttccgacagtctccaggggcccggccacggccagctctaacactcttattctgttgcagaggttgtgctcagctttgggctaggtagcagtcttagagatgccttcaggtctgttgaaaggggtcgatggattttggcaacagctggaaggatgaaagggcagtgttgccagagaagaaatggaactggcttgatttctgggtgggggtgaaatggaactgactccagttctgcacaggactgtgcttctcggttgtgtgttaacatgaactgacagtcggtgcaggcagatgtgtcttgcagtgctatgagtgggtgagagcacgttgtgtggcccgggctggtgagccagcaccgggaacataccaagtgcctggaggcagttatcacatgtttggcaggtctgtggcaaataagccctgagaaaactagaggactgtcgaggattttagagtctgacctggagtccgtttaagtttggcttatagtgtgactgtgtggcaagtgttggggtggcagccgtggttttccccagtctgtactgatgcagagtagacaagagagcctttgacgttcactctgtttcctgggcacctgtttcttacacctgctgtgctgccttacacttgagaccttgattaaatctattctctacacatttgccttgaggcatcggagcagtagtactgcttgtactgtgcgttttccatatgtgggtaagctggaggttcatggttttggtaagtatgtgcctaagatgcatggcaattaggtaaaactaatttgcagttttgtttttgttttt

SEQ ID NO: 33063 - DNA, 1662 bp, Homo sapiens
cagtttccttagctgtaaaacagggatactagtacctacctcaaagggttgttatgaggattaaattagttagtatctgtaaaccatttaaaacagtgtctggcacatagtacatgctatgttggtttgttataaatttgtataaattttcttaattacctttaagtgaaaagcttgcctttataaatgcatactagtcgtgagatttggctgtacacaaggaagattgctatagcttcctttatttcttgctaatgtcaagacaacctgaggtccacaaaatagaagtgaaagtactaaagttaatagcaattctcttttgcaataatactggagcacatatcctgtaataaagttaattggggcaaactgggtagaagtctaattgctaggagctacatttttttaatcctgtaaccccagggatagaatttatcctaaataatctagaaggagaaaaataaaactataattgtatattatactattaataataagcaaaagctgggtgtggagactcatacctgtaatcccagcactttccgaagccaagaatggaggattgattgcttgagcccaggagctcaagaccagccttggcaacatagtaagaacccgtctctacaaaaaataaaaaaattagccagacatggtggtagtgcatgcctgtagtcccagctactctggaggctgaggtgggagattgcttgagccagggaggtcaaagctgcagtgagctatgattgtgccactgcattccagcctgggtgacagagcaaaatcctgtctcagacaaaaataataataagcaaaacagctagagaatctaaacagaagtggaatgggtaagatcgcctcagtggtatatcatgtagcattaattgatgatatgtagaatgtaagggaaagaaggtattttgaaggtgttttcattgacgtttgaatactgggtgccaaactctctactatgccagaggccagggatataaacaagaggaagacagcttgccctctaggagctcttaccagaagcattgggctgtggtggtataggtacagggaagacataggaggaaggaagtaagttccccgaccttgaaagagtcagggaaaactaaaggaaagaagaaatcgttgagacagaccctaagatttattggctaagtaaattgggataatatagctaacatgtattgaatgtttattatatacccaatattttgctaagcacttttaattatcccattaattcctctcatccctatgtggtagatgcatgtatcattgtaaaaatgagtaaactgaaacttaaatctgtatctatcttctaaaattcatgtttgaaatcactgtatttactatggcttccagctgtgggaaaattctgcctgtggagatcttcatactttaaggccataagaaaaaatagttttgttggagtaagagaattattttctcttgtttttattttttatttatttatttttcatgttaacatttgaaagttcttgccaacagctgaatatctgttgcttattgttttgagagacctgtctctgaaggaggtaggtgcaaatatggagtaggacagtggttccttcaaaggagaagatcctgtatcatatcctgtatttccatcagatatttcattttcctgacttg

SEQ ID NO: 33064 - DNA, 1034 bp, Homo sapiens
tgggtctgtgtgttctctcctgtatctagaacagtgcctggcacatagtaggccctcagtaaggactagttgaatgaatggatgaaaaaatactgtattttactttttcagtacaagtccactactcgaaatatattattatgttagctacttggttacttcttatttttatttatttatttatttatttagagacagggtctcactctgtcacccaggctggagtgcagtggcatgatcttggctcacttcagcccgatggtcctggctcaagcgatcctcccacctcagcttcctgagtagctggggctaacggtgtcccttttttgtatttttttgtacaggcggggtttcatcatgttgcccaggctggtctcaagctcctaggctcaagcgatctgcccgcttgagcctcccagagtgctgggattgtaggtgtgagccgccgcgcccagccacttggtcacttctttagctttatcttcccttctcttaatgctaatttccttacgcaaaaaagtttccttttcatgtttgaacctctcttccctttgatacatttctgcttgttgggtgtaaatggaggctgtcccccatcatagctggactaagtatgctatataatttatgtcatcatttttaatgtaatttttgggaggttaattccagatggattaatgtatgatatgaaacctggatatcaattaattcatctccaatctggttagttggtaggaaggtaggtagtaggtaggatgtgagtgactgtctctgtcacccaggctggggtgcagaggtgcaatcatggctcactgtaccctcgacttaccaggatcaagcgatcctcctgccttagcctctcaggtagctggaccacaggtgtgcaccaccatgcccggctagttttaaaaaatgctgtatatagatgggttctcactttgttgcccaggctggtcttgaactcctgggctcaagcgatcctcccactttggcctcccagtgctgagattacaggtgtgagccagtgcacctgg

SEQ ID NO: 33065 - DNA, 1060 bp, Homo sapiens
ggcagctacacggccacgcagggtgggactgctctgcctacgaacagcactgtgtgcgaacacagggccacggttaagcctcccggctgcctcccccagggaacacgacccctgagaagattccagacagtctcgcagaggcacggggaaggatggaacagagccgggagctcggtgggaagaggggcagcccgcaccgcccccgggatgtcaccggcgcttctgggaaatgtagtccttcgccgcgtccgcagccctgggcactcggaaggaggactacagttcccttcagccttgggaatgctttgtgcagcgcgcttgcgcggtgtggcggccgatgccgctataaaggcttgttttgctgcagggctcatgctcgggagcgtggttgagcggctggcgcggttgtcctggagcaggggcgcaggtaggtgatggctgctgccgcacccctgccctccagctcggttgtcacggggatcacccctttgcatttcctcggggcgtggcgggatgtggccagggctgcgagcagttcgggggacactggagacttggggaacggcgtatggcctccccctggtctcctgccgccgcctcctaggcctgtgagcccggggtctggtgacggggtcgtgtgctggaagacaggcaggtaggatcgggatgagcgggcagggacgcgggctacgtccctggccgcggccgccagggggcgctgcgcccgcgggccgtgggtgtgggtcgcgctcgcctgggcaggccggagcgggctgtgggaacgccctagggcccgggcatcccaggcgaagcgggtctgagagaaacgcccacctgggaggctgtgcagcgggtggctcggggcaccctgctcaacccgcagcggagccgccagcgaccttcgaagtaagtcatccccttcgtttttgcaagcgggtaaatggaggtacgtgacataagcacgcgcagcaaagccgtggctgtgccgggaacgcagcccagatctctccacggtcatccagtgctcttttcgcttctgccacacagagccgcgggtggc

SEQ ID NO: 33066 - DNA, 1044 bp, Homo sapiens
cgtgccctttcccctgggctccaccacttcccctcacctcccctctccctataacctcaactcctcatctttctggtttggctctaacaaaactgaagaagttggaatcctgtgagaagcgcaagctgaagcgtgtccgaatctccctggcagtaagtatgcctgctcttctagcatctcggcggcaccgggcagggagggcagggtctaggctggataaactccagagcccctagctgccagcctccctccctctctactagagtgacgcggacctggaaggcgagatgagccctgaagaggtaaggtgccactggactctggaccctgtttcttcctggttgtgttcaatcatcatgttggctgctgtccccatgggagggaccacggggttggaaaaagggcaggccagctttcagggaggtgaggtcagctacaggcaccttctccctaaacctcatagtctcttcccctcagattctggagtgggaggagcagcaactagatgaacctgtcaacttcagtgactgcaaaattgatcctgctcccttccagctggtggagcggacctctttgcacaaggtagggccagcagcctggcccagggctggtctaggctctcaggacacagtggggatcttggtccccctacaagtttggactcaggccagtggggaaggagggaggagaagggagttggctcagtgcggagatgttttttagacatactgcttggatgatgggaggtgggagcagcctcctcctgctctgtggtggagccaggcatcgtttttcctctgctcagccttgccctcgagggaactctggaccaacgaagcaacaaagacagggattgagctgggtggaagccagaaggccaggccagggtcagagctaggcgggaggccaccacagcccagcaaggttgatacgcccatgcggaaaaaaacgggtgagaaacaggcaggataagaaaatgcaataaacaagccaacaaacatccaagtaggggtggggagactgcagagtagagataaacaaaga

SEQ ID NO: 33067 - DNA, 1032 bp, Homo sapiens
ggaaaacatgaacacagtgagttcaaagttccctataaggtggctgccagggaatcacctgtggttgaagagcaggtgtggcaaacttaggattttttttccccattccactaaaagcaatcgtgtgcatttgttggttttacctctgtcttcgtggaaattcaacttcactatctacttccccttcttcctcttctgaggagtcatctccactctgaggagaacaaggattaagagttttatttattttagtgtcactctgtctctctcaccccatccccactaactgtaaaaaatgtaattatcatcaaaagtcattcatttagtagtagcttgctgaatgtcatctttaaacatacatgtcctcattattcatttagtaacttttccagggtacctatgatggcgggcctgcatgagatgctggaagacgtgtagaactgagtgaaattttctttgtcctcagagaggtgatggctctattaaagtgtccagaggtgagtgatggagagggaagttggagaggaggtcttggatttggggtcagtctcttgtaatcattgtcactagtggttccaggctctgttatagaattgatctttgaaatcctcaaagccgaacaattactttttccctttttatataccaatccctttttcactaatattatgtagttagatagacatttttgagggtcagactatatcctgtttgtactgtatgcctcactccattaatacaatactgcatacaaaattggtgttatccctataaatatatataattattgtttgtcaattaaaagaaagtgcttaatgcatttttattgagtcagcatgttggcagcaataagggagctctggctgggacacctgagtccccgtgattgctggggctccatggttgatctggaaggcggggtaagtgtcctgactgaggtgatcttcctttacagagaactcatctcacaccaagggcataggagcagccacacttaagatcaactgtccttaaccacagcatcatgatacg

SEQ ID NO: 33068 - DNA, 1022 bp, Homo sapiens
gtttagcaccaacctctcactttttagataaggaaagagactcagggactagtccaaggacgtaaaacagaaagtagcagggttgggatgctaacccaggtctcttgcttccaaactagggctctcctgtctgtctccgcaacgtcgtatcaggtcatctgtcattgggagtgtatgtgttcccagcagatcagatgatgggcatatttataaacctactctgaaaagaagacacagcgagtgactttcatgggcactggactgatctgaactcatgtttccatctgcttttccaaatccccaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctggtcagtgtcctgccctccctccaaccctgtttccttatctgtaaaatttggatactcccctgtaacctcatgggattgttgtgtggggatgattaaaagtgacagtgggtgtatcggggctggcacacagtggccctcagcacttacggagggattgagcaccgaagtgggagacactgacagcttccttttgtactgcttccctctcccaccccagcctgtttctctcctctaggctgaggctggacctgctcaaacagtttccttgtcggaaactagaagaaaagcaaacatgtccaagagaggcaggggaggtgtgtggggctcggggtcaggggctgactccttgaggctgccctgtgtctgtcttctgtcttgaactgatccctcttcagggcagagagccagctgctgcttggtgggggctccacatccagacctgagggtgaaccctgactctgcctgctgtgctcttggggaggatacttaatctctcacctgtagaatggggcaaggatggcatgactcagggatgtagtgaggattacacaggacatgtagtca

SEQ ID NO: 33069 - DNA, 1130 bp, Homo sapiens
ctgtggctcacgcctgtaatctcagtactttggcaggcagattaccttaggtcaggagttcgagaccagcccgggcaacatggtgaaaccctgtctccactaaaaatacaaaaattagccaggcgtggtggtgcgtgcctgtaatcccagctgcttgggaggctgaggcaggagaattgcttggacctgggaggtggaggttgcagtgagccgaaattgtgccagtgcactccagtctgggcaagaaagtgagattctgtctcaaaaaaaaaaaaaaagatttgaaggttgaaattattccttgatacatgggctacaggatggatgttgttagcagacatgaaaacattcatctccttgtacagttcttgggtgaccaggtgcgttgtcagcagtaataatttgaatctcaatagggggcttaaaatattcagtaaactatgctgtaaacagatgtgctgccaccaaggctttgttgttctatttctagggcacaagcagagtagatttagcctcattcttaggggtcctaggatttttagaatggtaaatgagcattgccttcagcaaagttaccagttgtattagcccctaagagtcagccttcctttgaagctctgaagccaaacattgacttttccgcgttagctataaaagtcctagatgacatcttcttatagaaggctgttcgatcaacattgaacatctgttgtttggtgtagccaccttcatccaggatcttacatctttcagataacttgctgcagtttctccaacagctcctgctgcttcaccttgcacttctgtattacaggcacagcttctgtccttaaacctcatgaaccaaccattgctagcttccaatttttcttctgcagcttcctcacctctctcagcctttataaaattgaagagagttagggccttgctctggactaggctttggcttaaaggaatcttgtgattggttttattttttatccagatcactcaaactttctccctatcagcagtaagggtgtttgactttgtcactgttcctttgttccctggagtagcacttttaatttccatcaagaacttttcctttgtattcacttggctgtttggcacagaaggcccagctttca

SEQ ID NO: 33070 - DNA, 1923 bp, Homo sapiens
cccccggggcaggggacattgtttcacacttctctccactgtcatccccgaggtatgtatgctaggagcttggggaagagtgaagagttaagcgcttaagcaaagccatgtggttccaagccccctgcagtgtttaagggcatggcctcagcttccctcaccctctctcctcaggcctcagtcccagcctccccactgggagccaggcaagcccaccctctggattcctccctgaaagcctgagcactccctgtgaaagactacatgctcacggcatttctctctcctcctcctcttcggtctcaccacaacccaccctatcaaaatactgcacctccacacagccgcttctctttcattgggaaaggccagcacctggcctctttctctttgatgcttttgtaaattgagttttggggagagcgttcctggtctttgtcctaaaccagtgaagacaaacagtgtacttggtgtaagcagacactgaaggtttgtctaagctgtcagcctgctctcccaacacctgtgcctgtgctgagacctgatggtccaggaaagggcagctgccacactgtggatcccccgccacccacacacgcaccccccgcccagtgccctttgaaattctcacttgagtcttctgcagtcagagtccctggccacgcccctgtctgctgtctcccagctcagctcctcagggccctgggaatgtgtctgaacagcctgttcctacaggagttcagtctgcagggagctgcctgcagggacagtgctaggctgggtgaggggacaggtgggggttcatgtgtgtgctccagctgttcagggtagagcatctgggctcagttcctccctccctcccctgtccctcacactcatgccctcctagccgctgtagaacgggggcgggagcagcacgggagcccaagtgtagcatctgactctgcacggcccccagttgctggcgccctgcttctgcttcctggcctgtccgtccagcagtgaactggaagctgccggagtcccatccccttaccctggaccttggggtgggagtggaggggggacctctgccacttacttccaggcagaaaagggcctggagtaacgtgcgggggtgggtagatgatgcttgtctgagcattccacccttcatccccaagccccagagcctcccctgccgtttgtcctcagaactgggttccttttttcccctgtcccttcctctcccttctctcccttgctgcagactgcacagcgcaagatcagggaaattgtacaacaggtgaagcagcaggagcagaaataccctcagggagtcgcctcacagcgcagcaagtgaggctcccacaggcaccagcaaaacaacggatgaatgtagcccttccaacacctgacagaatgagaccaaacgcagccagccagatcgggagcaaaccaaagaccatctgaggaatgagaagtctgcggaggcggccagggactctgccgaggccctgagaaccccaggggccgaggaggggcggggaaggtcagccaggtttgccagaaccaccgagccccgcctcccgccccccagggcttctgcaggcttcagccatccacttcaccatccactcggatctctcctgaactcccacgacgctatcccttttagttgaactaacataggtgaacgtgttcaaagccaagcaaaatgcacaccctttttctgtggcaaatcgtctctgtacatgtgtgtacatattagaaagggaagatgttaagatatgtggcctgtgggttacacagggtgcctgcagcggtaatatattttagaaataatatatcaaataactcaactaactccaatttttaatcaattattaatttttttttctttttaaagagaaagcaggcttttctagactttaaagaataaag

SEQ ID NO: 33071 - DNA, 1159 bp, Homo sapiens
gaagtgatttcgttcatatgaaatgtccagaataggccagtccctagagacagaaagtagattggcagttgccagagaataggaggagttggaactaactcccaatagttatgaggtttttatctgggggaatagtgtggaaatgttctgaatagataatggtgatgattgcacaacatactgaccactgaaattgatatatttttttttttttcagtttttatttttttgagacggagtctccctctgtcacccatgctggagtgcagtggtgcgatctcggctcactgcaacctccatctctcgggttcaagtgattgtcgtgcttcaacctcctgagtagctggaattacaggggcatgcccccacacctggctaatttttgtatttttagtagagatgggttttcaccatgatgaccaggctgatcttgaactcctggcctcaaacaatctgtccacctcgaccttccaaagtgctgggattagaggtgtgagccaccacgcctggactgaagtgtatactttaaaacggtgactctcagattatgtaagttatatctcagtattttaagtaaagaaaaaaaaagaacattgtaagctgtggttctttttcactaaaaaaaaaaaagaaagataggttcttggctcctctgcctttggagttagacatcaaaaagaaagattatgttgaatgtagtggcttacaccagtaatcccagcattttgggaggccaaggtgggaggatcacttgaggccgtgagttcaagaccaacctgggcaacatagacctcatctctaaaaaaaaaaaaaaaaaagaatgaaaacatgagctatgatcgtgccactgcactccaacctgggcacagagcaagaccctgttctccattagaaatttttttaattaaaacaatatcaggctcctcaaatcccattaccaccaccatcacctccatccttactaaccaggggtatgaccctgtggtgatgggataagaatcccctgaacaaattcagtcaatcaagcaaatctttataggtgataatatggaaataagacatagagttgcatcccctcacccatccccttagccctgacacacagaaagctccctagaggaggcagtcttgtgcaaaccaccaaaacatgaatgcccat

SEQ ID NO: 33072 - DNA, 1035 bp, Homo sapiens
ttgtagtgagctgagatcgcgccactgcactccagcctgggcaagaaagtgagaggagatttggagcttggtgggcccagcccctatgtttcacagatgagggaatggaggcacagcgaggggaggaattttcagagccaggactagaaccaacgtgcctccatttctgctctgctgctgttttacttatgacccacttgccgtggaggaagcggtcttgaccacacatactctaactcaattgtcacttccagctgactacccttgtgagctgagaattagaaccagagatacctttgctgcaagctcgactccaatttaacaccttggtggacctgcccttccttccctttgggccctaggtgggttggcagagcctacacatccctcttcctagagcttttgactccctggttatttcctaaaacttggctcaatgagaggaggcccatcacagctggtgctcaggacagggacaggcagtaactactggcctgtgtctgactgtccctgggtggccaaaaacccaaatttgatactgggcattacagtcatgacttcctaagaccagggtggaggcagcatggcatcagacagaaccaggggtaacggcagaagcaagacctggaacctcctgctggtatgcttgccgtccacttagacaagaaagaggggctggggaatgcagccgagcatcagcgttttcctctcctgtgaaccacagattgcccctgcggaaggcccagacgtcagcgaaaggatggtcatcatcaccgggccaccggaagcccagttcaaggttagtgccaagggacacctcagccctgcaggctctgggcacagagcagccacctcagaggcacattcaaggctcttctttggaggcccagcctccatttccctccctgctgctgcccaccaagctcaggctcaccctgtcatccctggctgttcttctgcatgtttgccctctgctgggaagccctctttcccttccctctcatggaaaagtagatcatctgttggtgcccagtt

SEQ ID NO: 33073 - DNA, 1023 bp, Homo sapiens
ctgaggcaggagaatcacttgaacctgggaggcggaggttgcagtgagccgagatcacgccattgcactccagccttggtgacagggcaagactctgtctcaaaaaaataaaagtaaaaaaatcaatctggtttttgctagattccctttgtctcaacaggtccctgaaaacatctgtctctaaagcaagatggatgatctcactaactccagagattctcccacccctagtttctactttgccagtctttgggggccacaatgaggggcacatttgatgctgctgggcagggagagagcctcacactcatccatgggaggagagcgcccagaggaggtgggctgagctaagatctgggtgatgcactccaagagatgctttggctgcaggtgagagctgagctcccgtcacctgcctttcctgtagaacaggcttccagatgctgcacaaaattcattcagccagtgacacctaattccagatcctgactccagccctgcttaccctgtgatcttggcagttatctctgggtcccatctgcttcagtcataagatggggtcctcattcctgcccctttagagggagtgtgtgcatggaatgacattccaaaactgcacaagtgcacaagtagccctccgacttctggactaggctggccagtgccaggcagtagagccctcggaggtttctttcagaatctgagcaaagcagccacaagtcattacgaagtggacggtgatggcagaactgatttggtcagcgtgaatcatgaatcagccattcgcccttctcggtttgggtggtggtaggagctgggaaccacacagccatgatctgctctctcttgcttactcagagataaggaccaggtttaatgccaggtatggatctcaaagtagagtcaagggatcctgccagaagtctcaatggccaggctctgtgtgatctgccagagggtgtcagacccctggacacactcagatccgtgtttttcggccgaggccctgccaagaaatggctg

SEQ ID NO: 33074 - DNA, 1045 bp, Homo sapiens
ctttgacagctaattttaaaaatctctttcttaccctgagttcctaggaagtctaaatttgatagtatttatgtgagaagtatttgaacccagaataggagccacactgtggcttgtctattcccggcctcacatgagttttgtaaggaaatggcaaatcatagttcaaaggaattatttctgccatgagacctgaaggaacgattcttcaggcgggaggagggctgaagtgctcttttcccagactagagttttgtgcagaagagttgcatgaattctcccccagctcttcatggcccaggacacggacctgcagagaaagctctggagctgatgttctttccagggggtccttagaagcagagccaagagagagaaactgcttcacccaccttcctgcaaaacttgagcttgccaagagactgctgatctcatagcgccctcttgtgggcatgaggggctgctgcagcccctttccaagtcaaagcaaggctctcactacagccgtgttaagtggagctctgtcgccggcaggcgtggctggtaacctacagcagccctggagcagctcctcaagttgttcacatctctgccttctcattccaagctcaaaaagggcaacggtttcattttgtccctaatgggtcataaggcaaaatcctaaccttcaggagattcgggggatggagggcattgcctgtcactgtgagatttgctcagggatcctcaagtgaaagctgggtcaccagactccaaacctcagccacgtctgaccactgttggaatcgtcttcctggaggactatcttgcagggtgggcctgtgggaattggttccatggtgcccagagctgttcacttcctttcctggaacagcaatgtcagtgttgacccagccttgtgtaaagcacagctagcaattctgctgactcaggtcagcgttctgcctgtaagaatatatcagaccgggcgcggtggttcacgcctgtaacctcagcactttaaagggaggctgaggcgggtggatcacttgaggtcaggagttca

SEQ ID NO: 33075 - DNA, 1026 bp, Homo sapiens
agtgatgctccctcctcagcttcttgagtagcagggactacaggtgcacaccaacacgcctgtctgtttttcccccccggtatctataagtttttttgccttttataataatttgcctttacccttggaattcaggaatctgaatctgagtgctttgatctaaagatccgtgtttttctttggctcaggagaatgttttccttccataattaattttagcgttgcttctctcccatccactttattttctccttctggagttcccactccagaagaggaaagttatagcaaacctcactctactctttgtgtctgtccacttcccactctttgtcttggttttgtgtggtttaacagtctcgtgcattgatgggcttttcagcagtgtcttccctactatttgtacatcctctactgagtttttacttaaccatgtttttcatatccagggtcactctggttctctgattgttcatttctcatagcagtctatatacaaattattgaagcactgtcctgctgaatctcactaggagatcaaatcacaattttgtaaaaagctctcccttctccctccattaattcactcgggtcatttgcttgtcttgtgcagctgggcttctctccttcatgctggtgattctttatatatgtctaatggattttaattgtccatttatatatttaaatgcattcaacagagagcataattacaatccttaggggagctttttcttagcatgctccccagaccccacctgaaccagtgagttcagaatgtcccaggtgagcgcagcagtgagtgcagtggtttagatcttgggctgcagaggcagacacagagatctgtgttagcatctcagctctacctcttgctggctcacgagttcctagctccctccagcttctaaggttgtcccatgagaacacacagagcaggacaggcagctccatgtaaagagacactttgacaagctggcatagagcagtgcaccttctgcatcttagaaagctatgtccacaaca

SEQ ID NO: 33076 - DNA, 1051 bp, Homo sapiens
atatgcattttaaatattcacagatttctctccaccagaattcatgcagaaaacttaaaaattaaggtagttaaataattgatattttcctttggagtttctgacctttgacgtcatgctaaggaaaaaagccttcttccatccaagactgtaaaataaaatatcctcccctattttctttttctttaagagaccgtgctatgttgcccaggctggagtgcagtagctgttcacaggcacaattatagcacactacagcctcaaattcctgggctcaagcaatcctcccacctcagcctcctcaataactgggactacaagcacttgctaccgcacctggcccgtgttttcttacactaatttttagttgttggttttgggggattgtgtatgtctgcaattcatggagaatttatcttgacttatactgagatacagatctaactttattttttttgaaatggatattcaattttcccaaaatcatttattgagtaatccaccattttatcgttgaacttaaaatgctaactttgaatctcatcgaatgccaacatagaatctcattcactaaatcaaatttctggcctctattcccttccgtttgtctctgtctacacagcagattctgtgtgttttatactatttgacagttttaacagcaatgttattttttcctcaaagaatgaactggaaaggtggccaacttttactatgcttgggaaaatcaaagaaaagattggaattttctcttccttgaagaattggtaaaaattcaatcaaaaaacatgtgggcctaccaacttttgtttggagaaagactgattattaccttttcaatttcttataagtttttaacttcattttgttgatttatattttcctatgaaaatacacatttttttccacttaatttttctttttatgtgtattgatataaagtgatacaaaacagactattattgccttttaaatatccaaacttgtggttatttctctcaatttctttttttaaaaatatttatttatttatttatttattgagttggag

SEQ ID NO: 33077 - DNA, 1035 bp, Homo sapiens
atgaggtgtgatgagaagagctagagcaggagactgcagtggtgtcttctccccatgtttggatatatttgtggaagtatcatctgacaatctcattttcttcctgtgggttcttgacatcttgtggtaaacatctctttctgtgaacacctggaaaagctacagaagggcctgagtgattcatacatcttcacctgagcttaccacttaggttcattcatgtctgtgccaaagtcacgcactggtaggtgaataacaaaattactacatcttatagacaaaatgaggtaaagatgaaggatacgagcactgctattccaaaagttctaaaaaaaagaaaaaggcaagttacagtgtgaatgtagacaaagattagaaaatgttaggaaattgcttcatgttcagggagacaaagatggaagcaggttggacacagcctggaatgggtgaccacgttcctctgcctctgaagagctgtgtggctaaacccacccccagtctgtgtgaccatccccatgtagaaatgtaagataagcaagcaagcaagatgatcacaaagccgacaactaaatagtaaagagacaaagttgtaaaccatcccgaacctggctaatggagtttacgtatgtgggaatttacatcatgtgaagaatctgatctctccatggatagagttggaaaacactgttaatccaatttgttttaaacagtcattcaacaaatatttattgagtacttactatataccaggcactgagaacacgacactaagtaagacattctctgtttgcaaggaaattctagtctgaaaggggaagaggtaactaaacaggctattcacataccatgtaatgagtgctgtcttagggaaacaggaatgctggagagcacagacagggcatttgagctgatctttgggatgaaagaaagcttcctgcatgaggggtaatctatgctcaggtgaaacccacaggtcagtaggacttagccaggtgagaagggagaaaagcacttccttgcctaggaaataaatag

SEQ ID NO: 33078 - DNA, 1051 bp, Homo sapiens
agctttgtaatatattttgaaagcaggaagtctgagcccttcaacttccttattttttgaaatcattttggctattcaaggtcccttgagattccatatgaatttttctatttcttcaaacaatgcccactgtgattttgatagagctcatattgaatctgtagatcactttcggtagtataaacatcttcacaatattaagtattccaatccatgaacacaggatgtctttccatttatttgtgcctttaaatttctttcaggaaccttttgtggttttcagtgtacaagtcttttacctccttggttaggtttattcttaagtattctatactttttgatgctattgtaagtggcagtgttttcttaacttctttttcagattgtttattgttgtgtatagaaatgtaaatgatttttgcatgttgattgatttttgtatcctgcaattttgctgaatttattctaaccttttttgtaaaatctttaaggctttctacatataaaatcgtgtcatctgtgaatagagatcattttatgtctttctttccaattcgaatgccttttatttcttttttgtacctaattgctctggctaggacttccagtactatgttgaatagaaatgggcaggagtgggcatccttgccttgttcctggtcttagaggaaaagccttgcattcagtctttcatcgttgagtgtgatgttagctgtgggcttttcataaatggtcttatgttgaagtaatttccttttattcctaattttgttgggtgttttttatcatgaaagggtgttaagtttgtcaaatgctttttctaatgacatgatcatgtagttccccccccttctttctgttaatgtgatttattgtattgattgattttttaaaaaatgtttatagtaatggggtctcactacgtttcccagcctggtcttgaacccctggcctcaagcaatcctctttcctcagcctcccaaagtgatgggattacaggcataagccactgcgcccagctccccattaattgtatgctgaacaaaccttc

SEQ ID NO: 33079 - DNA, 1069 bp, Homo sapiens
tgcatagtgtcctcaaggttcatgttatagcatgtaacaggctttccttcctttttatggccaaataacattccagtgtatgtatatagcacattttgtttatctgttcatctggtgatggacattttgaggtcttctgcttcttggctattgtgaataatgctgctatgaacatgggttttcaaatagctcttcaagaccctcttttcaattcttgtggatatgtgccaagaagtgagattgctgggtcatatggtagttctactcttaatttttgggggagccttcatactttttcccatagcagttgctccattttccaaccccaccaacagtgcacaggggtttcagtttctccacattctctccaacacatgttattttctgttatttcgataacagctatcttaataggtatgaggtgacagctcattgtggtcttgatttgtatttctctgatgattagcgattggtgatattgagcatctttttatatatttattggccatttgtatatcatctttagagaaatgtctattcaaatcctttgttcattctctaattgagatatttgattctttcgttatgggagttgcaggagtcctttatgtattcttgatcattaactatatattagtccagttggtgctactgtaacagaatactaaagaccggataatttataaggaacaaaagtttatttggctcacagttctgggaagtccaagagcgtgatgtcagcatctggtgagggttatcctatggtggaaggcctgaggcagaagcaagtgcaagagacagagagaagaaataggtccaaactatccctcaacccactaattcactctgtgataactgcattaatccattcatgattaattaattaattaatgcaggtgattaactcatcacctcctaaaagtcctatctttcaacactgttccagtggcagttaaatttcaacatgagttttgaggggaatttgaaaccatagcaaaccccttatcaaataaataattggtgaatatttctcccatcccatgggttgacctttcactctgttgattat

SEQ ID NO: 33080 - DNA, 1074 bp, Homo sapiens
cttcatttaccaaactggcttcattactgagttggcttagtgcctttgtcctacagcactcctgtaagaaccgttcccttctaaatgaagctgcaaataattaaaatttggcacaagaccccctgcactgcttgcctccttcttggagaatggcactgattgcaaacgtgctgatgacgcctccttgtctgtctgtgtccttgctgtacatgggttggtgtgacgctttcttggggctagggtcctatccagatgaccttgtaatcatggctcctgattcttttcctacagggtagatatccatagaaaagagaactctggagctgcagagaagcctgtcaccatccatgccaccccagaggggacttctgaagcatgccgcatgattcttgaaatcatgcagaaagaggcagatgagaccaaactgtaagtttgcatgcaatgcccagatcactcaacagagaaaaagagtagattctccctcatttaacccaagaggttttttttaaaaactccaaatctgttactcagtaacagaggcagggagggattgtgtttaagaaatttgttcccaagtagaatacagtgggaagtagatcttttgcatttacatatggctgtctcttcacttgcatgtctctcggtgattttgatgcttctatcacccattgatagtaattattgggaggaacatacagactcatgctgtccaatagaactttctgcaatgatagaaatgttctatatctgcactgttcaatagccacatgttgctattgagtatttgaaatgtggctagtacagtggaagaactgagtgttttatttttttactcagagtttggtagccatgtgtatagctaatgcccattgaattggacagtgcaagtgtagaaagtatgttgtcaccaaagctatcatttattgtcctggaaaagatttctcccaccatgcttctaaattgtttgcactcttaacattggattacatttccttaagtagtagaaactagtttacacatggctgctttattcttcttccacttttttcttctatctgtccttcctcctcacta

SEQ ID NO: 33081 - DNA, 2289 bp, Homo sapiens
agctgcctaacaacaacaggatagaactgttgggctattgttttgtcctgttacatgagtgattcctgattcagcaggaaaatattttcagtagagttttaggcaactttatagaactttcatgcccagtgaaataaattatttgaatggagcttagctcgtcacagaatcaaagaactgcctgatttcctgaagactaacatctttgaagaacagagcatatgactaagaagtgagcacagaatctgagaatcctaatggatagctttattcaggaggttcaaacccagccctttctgggagtctacagccttatctgtagcactagaaagcagcaaatatgaaacctttttagcattctctgtgtcagcactgagagaggacagtaatgtgctacacctcccctgttttgcactgtgaggacttctgtgggttaagtgtgaattaaagcgtgctatgaacactccaggccaaggccagagctgggctcgggtttattacatgtaattctcagtggcagctctttctgagcattacatacaactccctgcaacccataaaggctgcagctgctttaaagttatttaacaaacagtatttttaacagtagtccttaagcttttcggggtctcaggtccctttgcaaatcttgtaaaataacaagaaaaattcacatttctacaagtttgaatcattttggaggggtttatagaattcttgaagctcaagcatgggtccagtgtaaagaatcgtatattatagagttttattattactttggacagcaggtttatcataattttcttgaattatctttaacttaatgttgttgttaactccaaactcccaacagcttaaatcttttaaagggaagaattgatctagtcacctttgttttgggaaacatatatttttggtgtttaagtttactggcttggattgagaaagttttctctggcatttgaatttatttttaatttctaactatagaagaagaggcaagaaattatgatctaagacaagacaactcacaagagtaatcccttattagccaatcatagagtttatactttctcttttagccaagtaattagaattgtcagttttatttattagatttaacccacacagtcaaagagttcagtcaaagggaaacaaaaatagtgatggttcaaccttgtcagtgaatgaataatttaaattaaaatattttcttattgttttatatgtatatccaattatttaagaattaatgcaaattataattaaaactcataccttgatagtgatgtaataaattgatacaaacttctaggagaccagtctgaaaatatgcattaaaaagcatcatgttcttttactgcattacttttcttctgtgattttagcctaaagaagtaattcagaagaacacacaatccagtgatgtttgcaacaaaggtgatttttagcaacactatttagactagcaaatagtgggaacagcctacttaccaacaattggggaatggttaggcaagtcatggtacatttgactcactgcaattttatatagacattaaaaatgaaaaatacaaagaaaatgtactgatacaaaatactcatataaaagtgtttataaaatatgtggaaaatatagttctgagttgttcatacgattgattacaaacgtgttatatacaattgattacaaattactgtgaactcagatgaataaacgtagagatgcagataactgtggagccagtgtgatgagggttttatgcatttttctctaaagtttgtctgtttacattaagccagagggtgacagcactttttcctatgacagtgtagtttttgccttttccctagtcaacacagacacagaaaccgccgttgtcaacgtcacatatgcaacaagagaagaagcaaaaatgtaagcagatttgggcttatttctgtttaaatttatttgtttttatatttgaattccattgagttctgtgtttttaaatgttttctaaaaagatgcagatctttgagctggatatgtgccacctttgacatacccatggagctccacggcatctgagccacctttgacatattggtagagctccagggtgttcctgccatctttgacatgtcagtggagctccaggacattcacaccgggatatttgtggattgtgtagagacttgaaaaatgttgagccttggcatcaaaaccaagatgggagctgtgtcttgacatgatcgggaatagagggcaccatacctgtgacactgtgtctcctagactctgct

SEQ ID NO: 33082 - DNA, 1078 bp, Homo sapiens
tattttttgtacatatgatcttgccttcccattctgacatggaagctttctcttttaggtgttggatggacttttggctcaatatgggacagtggagaatgtggaacaaggtaataagtgaggaagccttttgggttttggagagagatattatctgttatttcttataggttaggtcaactccagggagaaatagtaagttcatatttctttgaaataagcttcctagagtatatgtatttacatctatgtaagatgtatcttacatagatgtgagagatatctgtctctttctatgtatgtctatgtagtttgccttttcgaggaatattatttacaagctgtttctcatatactgtgcagtgtgctcaagcactgacaaacgctgtcaggctagggtaagcttaattcacttaggagtaattggatttacacggttgctactttcctttccctggataagaaaaacagatccctaatgtcttggactgagtgttacccaatgaataggactcctataccaataatcccttgaagtgcttgtgaattgcagactcctagggcttactgtagacctgctgagtaagagtcttgcagggaagagctcgtgaatctatatttaaaaaagcacccgaggccaggtgtggtggctcatacctgtaatcccagcactttgtgacgcccaggtgggcagatcacatgaggccaggagttcaagaccagcctggccaacatggcaaaaccccatctctactaaaaatacaaaattagccaggtatggtgacgcatgcctgtaatcccagctacttggaaggctgaggcacgagaatcgcttgagcctgggaggtggttgcagtgaaccgagattacaccactgaactccagcctgggtgacagagtgagactttgtctcaaaacaaacaaacaaaaaccctgaagtgatttttgtgtacactcaagtttgagaacacctgtctcaggagcagtgctgcaaatgcccagaagatacttttcttcctgccaacctcttttttatcttctaaagcatgaaatactatgatttttaaaaggaaaacag

SEQ ID NO: 33083 - DNA, 1049 bp, Homo sapiens
ccccgcaaggtggtacaccacatctcttttctggcaaccccccaaaatgagtatttataggatttcagtgtcaagctcttctattaaaacaacgtctctaacatttaaatgctttatttccaggatatccagcatgttctcaaagataaaaaaaaattacataacttatactgttcttttttctgtctaattttaattgcttaagtaaaaacaagaaacaatctaagtcattcaaagctttcagaccagcaggatgtcttggggaaagcctctgaatgaaaaggcccaaatgtccattagtaggggatggattaaatatacttcaggatacctatgtagttatgaaatagagtgaggaagctctctaactctaccttgaggaagatctcaagaatatgactgtcaggtgaaaaaagcaagatgcagagaatgtgtagaatatgcagatacttctctaagaaaagggtgaaaatatgaatatatattcacatttgctattatttgcataaagaatctgaaggatacgcaaataacatgtagaaagtatttctggtgaaagagggggtggtgagacttttcacagtataactttttatagtgttttaacttttgaattaggactgtagtacctattcagaaataaaaatatttttaaatggcattttgccttgttaggtaagggggcaactaaatctgatcttgttgaagcccactatatgacctcacctgtcctgtttgagcctaggtacactttggggtcaggtcagttgcaggccaatatattttgaggaagaaggggataattgtataaatagaatctgtatgatgacttaaattctaactactttggtaggaaattgaaaagatgagtctgtatttaaattattattattattattattttagcttgttgggatttcttgggtttttcatttgttttttgtttttttccaaagtaattgaaaaccttaaaacatgctcatgaggccagtgtggtggctcacgcctgtaatcccaaaactttgggaggccgaggcaggcggatcact

SEQ ID NO: 33084 - DNA, 1068 bp, Homo sapiens
atgtcaaaaagaagtgaggaatcaggctgggcgtggtggctcacagctataatcccagcactttgggaggctgaggcaggtggatcacctgaggtcaggagttcaagaccagcctggccaacatggcaaaaccccgtctctactaaaaatacaaaaaaattagctgggtgtggtgacgggtgctggtaatcccagctacttgggaggttaaggcaggggaatctcttgaacctggaaggtggaggttgcagtgagccgagaccatgccattgcactccagcctgggcaacaagaatgaaactccatctcaaaaaaaaagaaagaaagaaagaaaaaaagaaatgacgtatcatcagaagactgtcctgatggtgggatatagacagccacagaacagggtcgaattacacttgcaccgcacatttcagagctgtagagttctcttttctgaggatgaaaagtcaataagaagaaaatatcttctgagaagaaagttagtgctgctggctgtgcttacctgcctcccggtgtttacctggcgtgtactgactctgtgtggggcgtgatgattcgtgtctgagtcttggtgaaaggtttatcaccctcgtggtttaactcaggaaataggaagtctttgccatgggttcttgccagcctgtccagcctgctctcttgcctttccttggaagcattctctgctcctctcaaatcagaggacttgagattcctcaaattcctgttctggctgccatgcctttgtgtgcctcattcccttagaatatctttcccgacccctctatgctctcacttttcccattggcgtattctgccttccattcctcagagcgttgctaaggtgttgcctccccctggttccttgccaggtttcccctcctgtctgtcttgcccctcaggcaccctccatcatggtgcaggcttgtcccttggcagtgcggcatgtgaggtgcactccctgcccactagcctcctggttgggagcaggtggttcatgctgtctttctggtatctaacatagtaaatgcttggtaagggtctgtggaataagtg

SEQ ID NO: 33085 - DNA, 1029 bp, Homo sapiens
tttgacttgctgtgtggcctttgtttcctcatccaacgataatatctacctcccaggaatgctggagagttcagcaaatgttaagaactgttctctgaaggctgaaagataggtattgggtctattacaatggcagagaactcaaagcactttataggaatctaatttgtgttttatctttgtgaggtagataagtggcaggtgttcctgtgcccactttatacctttaggaatgtgcatttcaccatctcattttagcagttcctactgcttcccgcttccagacccacaggaaatttccatctgaatggagactgaaaacattctgatgtgtacccagcagggtttgtaatttcattcattccccagtttgtgtgtcttgtttcatttttggtcagggatggagaggccctcctctgaccgtgggtccattcctcctctgaccctgggtccattccttattacctgttgggttccagtcccttttctcaatctttcttctctttcacctctctgtagcatttggcactaatgatgatcgcacctttccaaaacttgttcgtgaaattatactctcagaattctgcatctgtgactggctaaccctggtcccgctcacctgttctcctaaatacaggcatgatctgagaggtgatctcatccattttcaaggttttaaccaacaccagtgttcagcttctagtcctggattaagtaattaatttattaatttattttttgacagtttcaccctgatgtgcaggctgtagtgcagtggcatgttcatggcttactgtagcttcaacttcctgggctcaggtgatcctcagcctcccaagtaactgggactacaagcacacatgcccgactaattttttaaaaaaatttttatagagattggggtctcaatatgttgccaaggctggtctagaactcctggcctcaagcagtcctcctgctttggcctcccaaagtgttgggattacggatgtgagtcaccacagccagcctagtcctgaatttgtaact

SEQ ID NO: 33086 - DNA, 2010 bp, Homo sapiens
gcctctgcactcaatctgatgcaatacattattttggttgaaaaatatgaaggaaatctgggttcatccagatatgtaattggcaaagagtattttaatagccttttcagataattatggatattcttctttgatactacaacaaaatttgacaagcagtagtttcttaaaggttagttgccatgtagtatctgaaagcatatgaacgttaatattctgttacattaaaattttttactaatgcagggttttgtagcattatacattagtcatttggaaaatattgagtcactgggttattcagatcttccggatgttgatgttgcaccatacaataccaaaaaattacattcatcactatcatgacgagtattgggaagctgcaagctcataatagtaaataaaagtattccaaaattctagttcttaagaggtcaaattttatcattggcaacaaatactgtgagttgttttatttgcagtgacaggcggactttattcatttcaagaaaaatgtgtgagagctacccagatctgaatggtcatcactgtctgtctgttctgtcaagtacaaatgacatacccaggaagaaagtggccatttcagctcccaattcaaatgatcacacagttgcctttcctgagacatcttacttcaggatgcagcaatagtgttttctgcatactttccattttgtcacaccaaatattttaaaagatctgcattccagggtcaaaatttttgtggaaaaaaaaaaagcagtaatctttactgctttgtcaaggacagttttaagtgaagctggctttccctcctccactaagagtacacaacagtgagcgtacgacttggtgcagtgtggagccactgccttcatgcagcctcaggcactggcagttttacccgccattgcttttgcaccatgagtgaaaatactaacacgataaacaaggcaaataacatcttggtatgattaggaaaatgggttttacctaataacccctgaaagggtcttgaggattccaagggtgtgcaggtcacgctttgagaactcgtggcgtagtggttaagagcatgactcggggttttgattgcctgcgtttgaatcctgctcctgctgcttatgagctgtgagcctttgggaggttattggaccttttcgtgactgtgtactctctgtaaaatggatgtcataatagtacctacctcactaagcaaatctgttcaatagttaaaccataaatattaattagtattttgaaaattataagactcacctagttttttgattttgtgattggctggttgatgggctggggaaatggccaaagccctgcttgccttgaagctgtctcctctgtcagtcttccaggatgaatgagacgtccaccattgtcattttacctttatggtggtaaagtacatgttaactgagttaaaaaacaaaaacacaaaaagcccatatcctagaagggtaacatgtgagtgagcgacttaacagggattggtgaatctggttaacctaccaactcttgccacccgagtcaaggcgctgatgggctggaggagcggagagcgcctgatgaagggagcaaggggaaggggcccaggagcagcaagggtctggcgccgtgggaaagctggaaggcagtgtgagagtgtggatcagagggcgctctagggtggggtaaagcgggcagcagtaactttgcctctcataggctggggttggtcctggtcaattctttattttgtgtgaatcgcaaacatagttcaggtatacgtaacggaagtgcccctccctatgcattctccagctgtagggtacagtcatctccggggcattatagtaaatctcattagttcagacctgattaatgttgaactcacgactgttgagatgtaggtagtgcagtatacagaaaagaacaagagctctggaatgaggcatgtcagggctggaatcctggctccatcatagactagctgcatggccttgggtaaaagat

SEQ ID NO: 33087 - DNA, 1053 bp, Homo sapiens
ttttttaaaaaattacattttaatgtaaacatcagtttatttaaaataactatattttctgaatactaaacattactaaccatcagagaaatgtgaattaaaaccacattgaggtattatcttataccagtcagaatggctattattaaaaactcaaaaaaaacaacagatgttggggtggatgcagagaaaaaggaatccttataccctgttagtgtaagtgtaaattagtacaacctctatggaaaacagtacggagatttcttgaagaactaaaaatagaactaccatcatctcactcctgggcatctacccaaagggaaccattgtataaaaaagacacctgggctggtgtcttgggaagccaaggtgggcagatcacctgaggtcgggagctcgagacgagcctgaccaacatggagaaacccggtctctactaaaaatacaaaattagccgggcgtggtggcgcatgcttgtaatcccagctactcaggaggctgaggtatgagaactgtttgaaccctggaggtggaggttgtggtgagccgagactgtgccattgcactccagcctgggaaacaagagtcaaactccgtctcaaaaaaaaaaaaaaaaaaaaaaagacacctgcgcttgtatgtttatcatcgtaccgttcaccatagcaaagtcgtggaatcaacctgggtgcccatcaactgatgattggataaagaaaaggtggtataaatataccacggaatactatgcagccatacaaaggaatgaaattatttctcttgcagcaccatttgtatttcacattatcttatgtgaaataactcaaatactgcatgttctcactcatagtgggagctaagcagtggctacacatagacataaagatgaaaatagcagacactgggaacacaaaggggaaagggtgggagtggggtgagggctaaaaattaactattgtgtacagtgttcactatttgagtgatgggttcagtagaaacccaaacttcattatgcagtatatccacgtaacaaacctgcacacatacccctgg

SEQ ID NO: 33088 - DNA, 1031 bp, Homo sapiens
tcatgttacaacgctgtcttcgctattacagtgtgagggagctgctgctcttatctccactctgcagaggggagattgaggcacgtcggagttgagtaattggccaaggtcaaatggtaagtgggaaaacctggatttgaacccaggcagcctggcatccaactccaaaatccttgacctctatactctagtgtttctgacaggaggagggttttggagttaggttttagcctgagtctcataagatctgtccaaagaaagttgagcttacaattaatttccctgctgtaagcaggaaaattaaaattatttttttccacgttactgctgccttaaatactgtagacaagtttcagcgtacttctcacttcattggaaacctataaagataattgccaggtgctaacacacacttgttaaaaaccagctttcactcgtttttaacaatgcaaaagtgagcagtttctcatctgcccagtgtatgattctttgctcagaagaagtagaatggatgaacagagacgctgaacgattgtggaatttttgattatgctttaatagggaggtaaggaaaatgtatacaggatttgggaactagacaacgtgagtttgcatttgggctctagcattatgatctctctgaccttgggcaagtcacttcacctctgagtgtgtttcctcttctataaaatggggttgataagttgcccaacccgccctcacagagctgttgttggaattgaatgagataaagtatgtgaacacgtttcacctatgtaactatgtgcagatgctcattactgccatggctagggagagaggtgccggagcagaggtgagcagctgcctagaggaacttgagcaggtttccctgggttactgtattcctaaggaaatgtgcaccctcttgtggcgaagtaagggggttaagggttcttgtgaaaaatacttcagtgttgttactgtgggatttttttggtcaccagaaatactttcccagtaatgaatgtacacactctttctaaacaaat

SEQ ID NO: 33089 - DNA, 1053 bp, Homo sapiens
tggaactcccactcatggtgggtctaccaaaatcccgtactcattgggcatcaaatgagctcacccatgaagccagccctgactgttgtaatttttgtaatgacagtggccagttactgttgtcaccctttccatggctttttgttctgggttgagttctccttatctgtaatcccatgggacctggaatttttctctgttcagagcgaattccaggtttttgacaatgacaaatagcagttattcatgggacagggtgccactcaccactgatacccattcattcttttatcttgtgtctattggtcaaattagcccatggatcctgaataggaaagaaatgaatctgaaaggtcagctttgagatttatgaagttcaataaaaatcaaaattgacaaccagtagcttcaaaattgtacttctgcttgcagcaaggtattctgcatatggttctgttggatttataaaattatcggtaggctggcaagaggtttgaaaatcaataactcgctgaacttatctctgagaggatttttatatgctattggagtattttacccttgtgcctttgacagaacaatttctcaagaaggaaatatgcggccgggcacagtggctcattcctgtaatcccagcactttgggaggccgaggctggtggatcacgaggtcaggagatcgagacatcctggctaacacagtgaaaccccgtctctactaaaaatacaaaattagccgggcatggtggcatgtgcctataatcccagctactcaggaggctgagcaggagaattgcttgaacctgggaggcggaggttgcagtgagccgagatcgcgccaccgcactccagcctgggcgacagagcgagactccgtctcaaaataaataagtaaaataaaataaaaaaagaaaatatgcaaacatttcctcaacttgcagctactcttgacagtcccttgagtgagtatagaccacaaagcttggtaattaagagcataagtccagtttgggcagactcaagcttacatcctggctctaacctttactaggta

SEQ ID NO: 33090 - DNA, 1033 bp, Homo sapiens
gtagctgagattacaggcgccggccaccacgcccagctaatttttgtattttttagtagagatggggtttcaccatgttggccaggctagtctcaaactcctggcctcaagtgatccacccgccttggcctcctacagtactgggattacaggtgtgagccatggcacctggctgataattccaattttataaaaactaagaaaggaaggtgtcaaattaatagtagtttcctctgatgggattatgggagattttaaacctccttttctgatttcctacaatgaacatttataccttttgttctttttttttgcagactatatcatacacaaaagtacacaaaacacatatatacagtttaatgaatgagtataaagtgaatacccatgtagctactacccagatcaatcacataaaagcagcattactttttatcactggaatactaacaataaaaattttattgaaaaatacttttcctgagttcctcacttggctatggtaggaataaaataagactgtataggaaagtgctttatttttcaaaccttaaaatttccatcaaacattagaagttatctctcgtctctcaggtgccaaagatgacaggtgcacataagcagtaagtcattgccagagtctggggctgcttgtgtcatacagagatttgcactaaaaaatgtatcaattgtgccacttgcactatctgcagtttttccctcccaggaaaccctttaggtgtagacttagacactgggagaactgctaggactgactgggtgttaaaaacctctttcctacattttgtgcggattacctttgattttctatgatccctggattgttgcgtgtggtggaaggaggttgtgttaattcgttgatttcaccaaagccagaattccaagcaggagtttttgtttgctttgttattgaattatctagtcttttacatcgtgatttgaggtttggttcaaaagaggcaatggattggtcataatttaataattttatctgatactataactaaagcca

SEQ ID NO: 33091 - DNA, 1026 bp, Homo sapiens
gtgatatttcaacctgttgggcagcagctatgctgtgcactgtgaccagagctgtttgtttggccagctactgcaggcgctcattgcagcagccagtgttttgtttgtgagtgtcttctctatggtttcctgcttcagtgaatagaagtgggagttgtgggggctgagggaagaggacagacagaagacggttggactcatttcctgaatcatcttaggcattcttgccgtctcttggttccatcttggctgggcagcatttcccactggtttgtcagaccaactttcccagccacctctgggggtgggaaggaaaaccacaccttgctctgtgtcagccagttaacaggcagagttttgttcagtaaatatttataaaacctctctactaacctcgaaccctgcaactctgtacttttgaaaagtttattctctttccctggcctcccaagtaactatttgggcccagcagtatacctcacacggacagcactggtaccccttcatctgcaggccaggtaccagagaagcttgtgcttcctgatcttaaccttgaacttggtcgaccattcctctatttaggattgcagagagttcatgggaaagggtcaggggtagattgtctttcacagtttttccctttaatctgtcaagttaaacccgtgtgatcagaggaagtgcaaagcagcgtgtggaggggaatgaggcctccaagtgcagggaggcatgtctcctcctggctctgccgcacaccagcagcaagggcatgcctccacacgatgttactttctgtgaaatagaaataaaggccctctggtcctttcggaaataaatttagaaacaacctaaacatcgaacagttgggaattggttaaaaaaactaggtttatctttattaagcagtgttgaatttttaatgccgtatgaaaacatgatatgctgagtttaagaaaaagatacaaaatgtggaaaatgtgattccaattttttcttttttttgaaagagtctcactctgtctccccgcc

SEQ ID NO: 33092 - DNA, 1054 bp, Homo sapiens
gcacacacatgtaataccagctactcaggaggctgagggctgagacaggagaatcgcttgaacccgggaggtggaggttgcagtgagccaagatcatgccactgcactccagcctgggtgacagagagagacactgtctccaaaaaaaaaaagtttaaaattatgctcttactacctttaggccctggggaatgtgtgtaaagtgtactcaggttgtatttaatttcattgacaattaaatttcccattaaaacaaaattagggggaaatgtttcagctgtattggagtataaaagagaatggctttatggaccacctgctacctaatattacagtgtgaagaaatgaagagaaatgctttttaagtaatttaaatgtttttttctctgattaagaaagtctgttcacaaatttattaggtaataattcctctagctttatcatccaatgattctactcctgcaatggcctgttcctgcacatggcctagtgatggagtgtaggggttgtaaatggatgtgtcattgtgctggaccctaagtagacataacatgtgcgagagaggaaagactccaaggagttaaggaaattattgtccacctatgccatgaaaccctttgtagccactaaaattaatgttgtagaagaatatataaagacttgtacaatatactaagtgaagaagattgcagaagagtaataaacagtatggtcccattttcataaatacctacacaactaatagcattcatcagattattattgttattattattattattttttgagacagagtctccctcgttgcccaggctggagtgcagtggcacgatctcggctcactgcaaactctgccttgcgggttcctgccattctcctgcctcagcctcttgagtagctgggactacaggcgcccaccaccacgcccagctaatttttgtatttgtagtagagacgaggttttaccatgttggccaggatggtctcaatctcttgacctcgtgatccgcccgtctcggcctcccaaagtgctgggattacaggtgtgaaccac

SEQ ID NO: 33093 - DNA, 1004 bp, Homo sapiens
gtctggagggcagtggccctcttcccacagctccactaggcagtaccctggtggggactctatgtgggggctcctatacaagctttcctgtacatcctctgaaatctacgcagggggtgccaagcctcattcattcttgcactctctgtgcctgtaagcttaacaccatgtggaagctaccaaggtttatggtatcttgcactctccaaagcagcccgagctgtacctggggccctgtgaaccgtggctggagctggagcagtggagatgggggttgcagcctcctgaggtggtgcagggcattggtgccccaggcctggcccactaaaccgttctttcctccttaggcctctgggcctgtggtgggaggggtaacctggaagatttctgaaatggctttgaggcttttttcccccattgtcttggatgttagcacttggctcccttttagtcatgctaatctctgtaacaagtggctgctccacaacctacttggattctttctctaccatagggcctggctgcaaattttccaaacttttatactgtgcttcccttttaaatataagttccactttaagtcatttctttgttcccaattctgattgtagtttgttagaagcagccaggccacatcttgattgctttgccgcttagaaatttcttccaccagataccctaagtgtcatcactcttaaattcaaacttccacgtatccctaggacatgaacacagtgcagctcagttctttgctaagatgtaatgcaggtgacttttactccagttcccattaacttcctcatttccacctgagacctcatcagcctggacttcactgtccatatctctatcagcattttagtcacaaccatttaaccagtctttaagaagttccaaactctccctcatcttaatgtcttcttctgagcctccaaactcttccatcctctgcccattacccagatccacagccgcttccacgtctttctttatctttatagcag

SEQ ID NO: 33094 - DNA, 1025 bp, Homo sapiens
atgaggtcacattcctgcttaaaaaatctttcatgactgcagacagaaaagactgaaaggaaatgtgccaaaatattagcaattttttttttctgagtgatgagctttctggtgataatttttatttactttatggattttactcctttccaattacttatataatagacatataatagtattttttaagaaaagtgttatttttataataaggaaaagtaccatttaaaaacctttagtggctcccatttgccaattaaaaatcctctctatgacattcaaggttttggcaatactgctacaatccttctgacctcaccctcttctctctctgccctcactccaagaaacagcagcagaacggagttacccactgtcaccaaatacatttggtgctttgcctttgctcatgccccttctccacccgtcaactttccatccttcaaacagatttctccttctttagagactgtttcccataacatacatcctgtaaaagacttaaaaaaaacacgcaaaaacaaagaacattcttaatcccacttcctggagataaccactgttagcattttgatatatgtctttgttctgcagctgagagtagtctagtataccttggctgtctgttacagattttatattctatatggtggtgttatttatttctgtcttatctccattctggattttaagttccttgacagctacaagaatggctttacatttttgtagcctccacaggccttgagcacagtgacattcacataatatgcattccaaaatcatctgctgaatcaaacaagggagataagacaagcttgtaacttaagcacaaaccatagtaacaaacataaacatgctggttacattatgaatataatgctgagtatatccataaatgcttaagtcgcaggagaaatacaaatgctttaaccttggagtgtcaggaacaattacatgaccagggacctactaaggtagggtaattttggtacagtacatggaggagattcagccttgaagag

SEQ ID NO: 33095 - DNA, 1049 bp, Homo sapiens
aatttgaagcttccttcagtcctccacagaattagacagaaaatttatatcatttttatatgtattaagtatatacatattcaaaatataatttaaatatttaagtagtattaaaggaccttttaaaaatacttagattgacttaaaagggttaacatgcagttctttatcattatcatattctttaccaagttaaactgaatcccacagaaaaaaatctatcctgaaggtttgtagttcatcatcagccctcgggttagctcagcatcgtgacacctctaactacatactcatgtcgcccaggttcttcactgtttcacttacagggatgccatgcatctggctgaggatgttttaattaacaatagagatactcttgggaaagttctcaactttcctttttcctttttctgtaggaggtaaagagctaaataaatgtttatatagtgtcatgatgccactaagaaaataacagcccctttgtctcttttccctcaatcataaggaagttatgacctgaatagaaagacaaagcagtacccttctgtgtttttctcaagtgagaacatttttttcttttgcataaagtcacaaaagtgtatataagggctgaggatctggtaattgtccacatttcagatttttttaaggaaatattcctagaagtataattggattaaagagtaatataaggattaagacacttgctatttaggttggtgtgaaagtaattgctgtttttgccattactttcagtggcaaaaactgcaattacttttgcattaacctaaaataatcattgccaatgctttccaaaatggctgcactaaaatatatcccctgaacagtacatgaaatcattttcaaccctaatacattccataatttcacccaacatattccagaattgtattcctcatttcagcagccttattttaaaatattttataattataaacttttttttccaagtagaaggtatgttgatcaatatttccccaaatatattactgtactggtaagacatattaaaaaatggttcagtggtc

SEQ ID NO: 33096 - DNA, 1001 bp, Homo sapiens
aaaaaaaaaagagagagaagggaagaaaaggagttgtatagggattatcccattgtaatgattgatgatgatatagtgatataatacactatgtacagccgttgtagtactgaattgctaacttgtgaaggagagatgagaatctttcagatacagaagcatgaggagtagatatttgggaaaagataaatttgaaaatatttagatatcgtgtggaaggttggtaaagaccaagctctacagagcctagcgttttctcttcagcaaatagaacagcccactgaataaaacttacagtagggaaaactctttaaggaaggctcacagtattcattattcagcaaacatttttgagtatctaaacatttttgtagtatcggccaggcattattctaggcacttgagctagaacagtgaacaaaacagacagaaatccttgcccttgtagagcaaacaatttagtgtggacaagcagaaaagaaaccaaataaatacataaaatgtattatctagagccttttggttctgagtaatagaaacagaatcaagctagcttaagcaaaaggagttgctgtgaaggagtttctgactggctctgtttggggcagagatgcctacttctgacctaaccagatatggccacagtgacagggttccaggatataaacaccgcctccagaagcccacctctgtgacaaagaggccgtgtgagctgcatagcctcaaaaatgggtctgttatagaccccagacctttccagttccattgttttctttcattaccaagactaagtgttgcaatgcaagtaagctcatagtatttgaaatgtaccattaaaaaaaactcagaggacaagactacttattcaaactgtaaggaaaaatgagaccataggaagaagagaaagagattcactaatttattgaaattgttgagaagcgacggcagccagagccttggttatctagaaagtttttggaaagtggaaagtttacctcctt

SEQ ID NO: 33097 - DNA, 1031 bp, Homo sapiens
tttggaggcaactatctctcttttcactttggccactaggaagctcagagccaaactcatagctctaatgtagcaactctttagtacccttttgaactgaataattgtattttaaccctactttctttctgagtctgcttctgtcttgacctcctaatctaatttcctattttcttaccctgatgtattcatttcatttatattgcactgttttattgtatgtctttaccataagctgcctcaaatatttgtgaaacagatggtatataaataaagaacattggaatgtttgagaaagttgttgttgacaagaccgatgaagatgaaaatagtgtagttctgagaaaatgttggttgctgtggcatctgctctttttttctcccttgcactcttatctcctggggtggtccatcttcgttaccttcaactcccatgacacccctgctgtggctttggctgcattctggagtcttctctatctccgccctcaccctggattcacaaatgcagatctgtatttctgacttccttcctattggatagctccatctgaatgtccctaagtccctcaactcaacacgttcaaaacgaggctcagcatcctttcccccagatcctctctgcctggatctcagttgcaccaccatcaacttcatttctccagtcagtaacccggtcctcactttttactttttccattttctgatccttcacatccaatccacaactaagacctgtcactttaaattataaacatgttgtggatctgttctctctactccatactacctataaggctctttggagtttttaatctatccttgcctaccttggggtttttattttatttttatttattatttttttagaggcagagtctcacttctttcacacaggctggagtacagtggcatgatcgtagcttactacagccttgaattcctgggctcaagtgatcttcccacctcagctgcccaggtagctgggactacaggtgtgcactaccacacccagctaatttgttaagttt

SEQ ID NO: 33098 - DNA, 1069 bp, Homo sapiens
gttgggaagggaactctggatgtgcatggacacttgaatgagatggtaaagtctagggtaaggaatactggcctgagtcctatctcatctggttctgtcattaaccagctctgtgatcccccattgggctgttagttttctcatcagtaatgcgaggatgtaagttagttgatactcaaccttcctgtctgttctagaattctgtgagtctatgattaagtccttagcaaagaaatatttaggaacaactgcctgtgtgaggataaggagccagacacacctgtgatatgagggcagcccgggtctctaggatctgctctgggccaggtgtggtggctcacacctgtaatcctagcactttgggaggccaagctgggaggattgcttgagctcaggagtttgagaccagccttggcaatgtagtgagactctacctctcccaaaatatacatataaaaaaaattagccaggtgtggtggcatgcacctgtagtctcagctgcttgagaggctgaggcgggaggattgcttgagcccaggaggttgagactgcagtgagtttgtttgtaccactgcactctagcctgggcgacagagcaagactccgtctcaaaaaaaaaaaaaaaaaaaggaatctgctttgaccattccttatctggggcatgtttgcaaacacaatcagtatcttcaatctactgtccatcctaccttactgctccccaggcagggccaaaactccatagagctgttagattccaagactgggaatcttggaattccagggttccaaacctgctttgacaccaggcccagagacagggctgtttctctcagtgctttagactgagcagttgtgttatcagaagaaatcagtttcttactgcctcaggatgggccgtaactgttcctctcaagttttccttgttttcagcaacccatagaaaagagtctctcttacctaggctgatgtgtcaattatatcaaagttgtttctttttggtttggagcgtgtaatttggtaccaagttaatctgtcccctgaggtttcatgtaggctcatgttagcagag

SEQ ID NO: 33099 - DNA, 1032 bp, Homo sapiens
cctgcattggcctcccacagtgctgggattacaggcatgagccactgctcctggcctgtgaaaagcatttttaagtgaagggactgatgcacagtttctccttgagtttcttcaaagctctgcctgtcagctgaaataaaggtgaaagagtgaagccagcaaactctgctcttaactgaaaaaccaggcattagttgttagatcattagtcctgctttctaggagaggatcttcagatgttctctttggggtgtccaaattagcataggcttgtaagagtgtaaacaaatgatatggccaaaagagtaccggacatgggatcagaagacctggtccagcctagctgtactccttactgcttgtgtggctctggataggacactcctgagcgtccacctcactttcctacattgtgagcacaaacacacctacctggaagaattgtaagggctgagtaggttcatgtgtatcattgtacccagcataggaagctttttataagtagttgaaataattgattggtgaagtgaacatagagaattctgtctcttatccttcttgtccctggagtagaaagcctgcttttggtagatacctaagcagaaatagttctggggaagtggggagaaacagggtggggcagtgcgtttctcactttgcagatcttcctgggaggcctgagagtggatggggtttggagtgtgttgttggtttcgtacctggaatctgatgtgcattttgactcagaatgcattgtcaggaatcttgatgacaacggtatgttgctcagtaactgaaagattgtttgaaccaaactattgtagcaaaattttcttggcaggtatgccctgttgatactgagcccagtgtgcattgatagttttatagtgactactacaaagtaaacagaagttcacagtgactcagagtaaaccgtgactcagagtatacaggtactacactctggacatcctaaagcaattaacaaataaatgtgctggtaggaaaattgttgtctattgtattacctta

SEQ ID NO: 33100 - DNA, 1029 bp, Homo sapiens
tagagaacaagatactagttgcttaatatttaaaatttttggctgtttattattttttaaaatgtttatatatttttcttcttaaaatatttgagatgacaaaggtactggttactcaattatttgaattaaagaagacagagatttagatttgtaaagtaggtaagtcgaaaaggcattttaagagttacaaagggcccaggaacaggtgattggttctaatataattatttctacatcacgagagtgttgccagggaagagttagctctttgttcactgatttgcatattaatggtatgttgtgtctatttcaataatggtttcaagaaaatgatttagatattgaaattgatcagtggctttagttcacaagtatcgattgtggtcacggtgttaatacctgccttataaatttctaggccaacattgtatcttttattctctatggcagtttttattaaacactgttccatagagccttaggattccaaggagatgccaaatttatgggaaggacgaatggatgtacgtacatgggaatcctggcttcttacccactgcccaatacgaagacaactgcatttgttgctgttttatatacagaattggagttgagtctaagatttggtttagaaaaggggtttgctgctttaaaacacagtttgtaagcacccaccctacagtgtgtaaagtgtgtaattctgagtcttcagttcattccttgatttgacccaaagccctttcttgaggaaagtttagaccctgcccttgttactcctacatctgctttccatggaatagccctctatttcctgtcactttcattttggtaacaagtatctgctttgccagctgcatgccagactactaaatctatggatttttctatagtcaacaacatagaatgcgtgcccttcaggaactttccagggagctccttggccagtgattgcgctctggctcttggcagagccattagagtcaactgcctttgaagagtgatgggcatggtgacacgggacccatt

SEQ ID NO: 33101 - DNA, 1811 bp, Homo sapiens
aaagttcgaagaatgctgttcgagggtggtagaaatatatgaaaatacatttgtgaattgaacctttgcaatgatgctacatcagtctgagtgatctgtactttgctatagtttttagaaaaaaatagttagaaatagaggtaattttaaaggtagcattgcacgtcttcccatctctgtgcttgcccacagacagaagtggggaatatacctaagcaggttgtggggttgttgttgttgttatgttgcttttttcggcagttgtgttcctgacataacaagacaaacatttctttcaacatctgagccacacagattagacagcgaactgtcacccgggtcaagactatgtgccatgtggtgaatgaaagtctagctcaaggaatctcctgggtgggttcttcacggggttcagacagcctgttgcaaaggtcagggctgtgttgtggtttacgtgtttccctggtaggaactgccaggtctttcccagaggtggtatctttctctacgtcactttctgtactgaataaggccttgggcctctcatactgtcttgactatggggtgagtgttaatagggatagtatccataaagttctgagttctttattaattttataatcgcacaaaaaaatatgctaaataatgaagcatgtgaagtacagttcatttcccctcaactgtaaacttttcctgcatttatcttcgtttcctttaactcttatggactgtttatggtgctggtgggagggagagaggaattatcaaggaaaaaaaaataggtgaaagaaggttatttccaactccccatgcatttctttgagttagtacagtccagagtgggatatggcattttccgtggaattctgactcaggagatgggggagaggaagagagttaactaatactgggtggctgctacgtgctaggcactggactaggcttcctgttttatcctccccacagcctgaagagatccgtctttatccttcttacacaaagggctctaaagcttcagactctaaaataactccttgctcctgaccagaacttcagaaggcagtggcttgttgtccatctcatttgaatactgcaacagaaccttagcaatgaagtagaaagttgtgataatatgtatacaggctataaagtaactttgtatattattcctaacttagaataagagaaaatttccatatataaaacctatgctgagaaagattaggaactcaagttcagtatatttttaatttaatataattgaaaagaattaaaagtgttagtcataatttgaaagaacttccttgaagtagtcctatagtagaagcatttataattatataaagagaaagaggtttttttaaaaatcattgtggttgacagttaagtgtaaaaaacatacatgtatgcagtgtgggaggagggcctgttccatgcctttgacccagatatatatattttttcaaatcctgaaaaaaaacttgaggtttttttgtttaggatacagaatgttgcacaaagattggcatgctttcatttttatatgtatttttaaaaatatctgtgtcttagagaaggaaaataatggaatttttgtaaattgctttttagaaaatggttcaccttattaacagaacattttaaacctctttgacacgtgaaaaagtcagtgaaagcactttttgatacaatacttaagtatcttatgcatttgttacttttatctcatgcattttgttacttttttggtttagtaacataggacttaagatacagttaaaccaccaatgaaatgagatatataagaggtt

SEQ ID NO: 33102 - DNA, 1060 bp, Homo sapiens
ttactagagttttcttttccttttttttttttgagatggagttttgctgtatcacccacgctggagtgcagtggcacgatctcactcactgcaacctccacctcctggggtcaagtgattctcctgcctcagcctcctgaatagctgggattacaggcacatgccaccacgtccagctactttctgtatttttagtatagacagtgtttcaccatgctggccaggctagtcttgaactcctgacctcaggtgatctgcctgccttggcctcccaaagtgctaggattacgggcgtgagccacagcttcttttcttcttcttcttcttttttttttttagatggagtcttgctctgttgcccaggctggagtgcagtggtgcaatctcagctcactgcaacctcctcctcccaggttcaagtgattctcctgcctcagcctcccaagtagctgggattacaggtgcccgccaccacacccagataattttttgtatttagtagagacggtgtttcaccatgttggtcagactggtcgtcgaacttctgacttgaggtgatctgcccaccttggcctccgaaagtgctggaattacaatcatgagccaccatgcctagccagttttctttttgtactcttggtctggctccttttgctcaatttatctgtaagattcagctatgttgttgcatgtagcagtagtttgttctttttcattactgtgcagtgttccattttctatgtacatcacaacttatttgtccattctttttttttttttttttttgatggagtctcactctgttgcccaggctggagtgcagtggtatgatattggctcactgcagcctccacctcccgggttccagtgattctcctgcctcagcctcccaggtggctgcgactacaggcatgcgccaccacgcccgactaatttttctatttttagtggagactgggtttcgccatgttggccaggctggtctcgaactcctgacctcaggtgatccacccgcctcggcctcccaaagtgctgggattacaggcgtgagccactgtgc

SEQ ID NO: 33103 - DNA, 1032 bp, Homo sapiens
acttagccctttagttctcagattgagttatatacttcccagcaatttctgttatttaagattgctatctcatttctggtgtaatacttacatggaagtctttctctatttgggggtggtggggttctggcacataggaatttcttaatggcagaatattctgaaattctcggcattaaagtatacttgataattagttcacttaatattaaagcatgttcattcttttcttcccaggtcgctattaaagcatgaagactttctgaaacctgccctagagctgggatattgtttgtgggcaatattttttattgtctcttgtttaaaaagtgaacagtgcctagtgaagttaggtgacttttacaccttttacgatgactacttttggtggagttgaaatgctgttttcattctgcatttgtgtagtttggtgctttgttccaagttaagtgttttcagaaaagtatgttttgcatgtatttttttacagtctaaattttgactgctgagaagtttctattgtacaaaacttcatttaaaaggtttttctactgaatccagggtattctgaagatcgaagcctgtgtaaaatgctaccaaatggcaaaaagcaacaataaacagtttgatttttacttttctttctaacatatcaatgcttagcagaactattcagattgtcagtagtaaatttaaagacaaatgcccgttttcctccagtccatgaaacataccatacttatatacctgcaactaagtgtttaaaattatgctctgtaactctgtactgctagtattagaactaaaaatcttaaaatacagccagtgcttaatgcttatatcaatgtggatttgtcggcttttatgtaatctgtaatatgtatagcaggaaatacgaagagttacacagtgtatgccttaaaaggctgtttcttaaaggtgttacaaggggataatggtatttcaactagttatcagcaagtgacaatacattccaccacaaatacactcttgttcttctagcttttagac

SEQ ID NO: 33104 - DNA, 1048 bp, Homo sapiens
ttttggcttccagagaagggctaagaaaacttccaagggttaaataatgtgttcaggtttcagtcataggatctcagtcgcaactatttaactctgttgttttaacccaacagcagccagatgaatgagttggggccctattccaataaaagattattttggggcattggaatttggattttgtgtgtttcttcacttgtcatgaaatactgtttttccccctagttatttaaatttttagcttatgggttatacagaaacagccagctggccagatttgacctacaggctatagtttgccaattgtgtgctgctttggagctggaaatactgtcaggatcatagttaggtaaaataattgtttcaagtttttatgagtagcttttacaaatgaacatttagtagagggaacaacacatttgtaagttgtagaccttacgttctggctaacattaagataacttaatgcacctaactgaaatgtccagtgggatcttactcatagccacaggataattagtggctttgttcaggatgtatgtaacaatttatttaccttttgaaggctaaagaacgtgccaatggaatggagcttgatgggcgtaggatcagagttgatttctctataacaaaaagaccacatacgccaacaccaggaatttacatggggagacctacctagtaagtttattttcaaaataaatataattggcagtttttcacttgtcaaagaaacacttgtattagtggaaagtcttcagcacttaggtttgtgccataaacttgactgttgattgattaaatgctcctcattagggcatttttctcatagtagaagttcaaccattacaggtaaaactaaatcttagtcaagtccatttttaaattttttgtttgttgttgtttggttttgtttttgttttgttttgagacggagtcttgctctgtcgcccaggctggagtgcgatggtgcaatctcagttcactgcaaccttcgcctcctgggttcaagcagttctcctgcctcagcctcccgagtagctgggac

SEQ ID NO: 33105 - DNA, 2640 bp, Homo sapiens
agattcctgggctgactgatttctgttaactacagttactttattggtagtcttaactgttactgtgaaacacccatattctgctttcacttctggagaaaattgtttcatttccatagaggtaatctttctagtgttggagtaaacaggcttttagcaacttttgggttccccatttctatattctcacctatgttaatttttgcctgtggtaaaaatagcaaaaactacaccctcatttttgagacttcctcctttgtccatggagagaagggaagtgtccgttcagaatacttgatagggaattccaagggattgttgttaattggaagccccagagcatcactacatcctttaaccatttcttgatgttaaaggcagctgttcatatatttttcttttaatctttttacagtcagtcatggagggaggtagaggggaaaggctgtcacatttcatgtcaccccaccatgttttataatggctttgaagtcatttgaacgtttctagagtcgtctggggcctagagacctgaactcattttactggatgagttagcctttccttctgtgttaaacctcaaaccttaatttgtctattctgtgttacattataaatgttttccctgagcatcaaaggatcatccaaattttctccattatgttgtaaaccacaaaactatcttctaaagtgttttgagctgtaatttagaataatcctctactgtcctttcaagaatgtccagaatactctgaagatgtatcacacaaggaaatctcttgtgattttatctgaaagcttcacctttgattcatgccatatagtgacttactgtaatactgcttccttttgagtcttgccatttctgctctctggagtagaaaggcttaccaggctttactttgtctaagtttgataacctaaaataaaggttgccttgataattttacctagctatcagactgactaggagtaggttctgtcctttcctcatctactgttttggtgccttggcagaacttttccttggtttcattacttagtatacccttttgttgattatgtgtctttagctcgttggtgacctagttatcctggttaccattcctttgctatttttcattacaaatccccccttaacctgccagccaatcccagttttggttgggaaagctatgagtacacaatgtttacctaaactttggcttttgtatgtagtttctgtactcttttgcttcctgggccctaggttaggagctcctgatttagctgcctggttttgatgtgtacttaagtaactaggtaagttaggttaattcctggttttccataagtttgccctggctcatctccatttagctggagaagctgtggaggatctctgacaccctctctactcttatttgtgtgtagttcgctgttctgttgtagctccatctggttgctttcagttttttagggggcctcccaccatggttagatgcaatagggttttacagggtttagtgtccttcaagctagcctttgctttccactaggtttctgcttttctctaggatttgaaactgagatcatcatctttatctcttatcactgaattataagtagtaacttgaaaggtcaaggtctttttaaaaatcaagcatttttttaagtaaattatataaattatataggattttgttttattgattgcaacttgattgaaataggtataaagtataggtgtcatagttaataaggttccgcctcaccctagtctttatggagtaacattctgaaacacagtccttggacagttcccttaactgcttgactttggcacccctttctgaaggaagtggggtcaaataactcttatccctgctccaaaaaggtggaagaaaggacaagttaattgacttatgtcatttggagcaatgaaactattaacaccaggtatattcagttcctgcccttacctatattttcttatcttggaaggggattgctgtccctcaccatttatctcacagcagcttatttgtttttaaagttgcccagaaagtgtgcaaattaaacttttaacatctacgtgtaggaatcccgttctgcttccagaagtggaagtgctcacggatcggggaaatctgcaaggcatacccctgcaaggtctcgctccaaggaagattccaggcgttccagatcaaagtccaggtcccgatctgaatctaggtaagaaagactgtcttgagatttcctcgttactcttagctctgaaattggtgcgtgttttgtaaaccaggaaggtagagagggttagattatttgttggcctattaaatattggtactagaagtgaacttaagttctgggaggcaagactaaaagcggttaagagcctgggcttttggagtcagggttttctatttttgctggtttgggcagattaacctttcagctttagcttctttataaaaggcaaattagtaatacagtaccagttcttcagggttgttgtgaggatttactaaatgtaagtaaactgcttactagtatggcaaatatactgcagaacattggctttcagtaattagaattcttgataaataagtatatatatggtgcgcttttttttttttaatgttggtcaaaagtagg

SEQ ID NO: 33106 - DNA, 3358 bp, Homo sapiens
tgttacctaagtttccccttgttggtaaagctaccttaagatctgaatatgatttatcaggtaaataagactattaaatgtcttagcaaacttttgattaagattttatatgattcctcagagtattttaggaagaaattttcagtgatgaagcgtgagtttcctgcgtaattttggagcccaaactgcttaatttggtttgaactaatcaagccttgcgtttacatactcggatgagcatagagtttttagtttttgatgtttttcccgaagccgattgactccaatgtcacgagtgttttagatttttttttaagttcttgctttcttgggtaagaaagttgggattgagctcaaaagttgttaaaaagtcgtgacttctgatcattggcagttgaatctgttataacagtcattggtgtttggactgcaaagtaagcgattttaaagtcttttgttattaaacagaaaaattcaattattgggtacctttctactcttcaaaaatactaaatgactggcttctgactagagctctcgattgaatacacgtgaagaatgcttgagaatggaaaattgcccagagttcattagtatattttacgtgagaagggaaacaattgaaactaggttccagtttgagactcggctcaagagaaatttgaaattttctgatgggttatctttttactagtaaaagtacactgtgtttttcgcaatctttgaattgtagagggaggttaacttaatgtgttaaaaattgagttttttttcttacataagagtcttcgctttctggccgagatctctaaacttttacgttgtgaaatacttccatattgttgtgtttggtgtttgcgtgtttgtgttccaattggaacctttaagggttggaatacacctgaatcaaacacgtgtctaggcttccaaagcaagcttgggaaaaccataaagctcaatggaacagcttgatcttagacatgcctgtggtgtaaatgatgcttctctggagccagaaaaatgagtgttattcaactccaggcttctgaactgggtcttaatgtaaatcactaatctcttcaaatcagtggaattctcccttatttatctgtctctaatccagacaaccccacccctctgtgccccaccttttccagtgactgtaggagtttgttgttgtgtccctcccctttaaggttgggtgtgtgggataaattattctcagtttgatcactcaatagaatacatttgggtgaatataatgacatttaaagaactggtgtgtccctcatccctcgttggtctgtgggatttattttttcccccctctcaaaggtaatagattaacactaaaatctgtctataggggtctaattagcaggcttaacctgatctggccaaaccactttcaaaagtaagatctcgttttcatctccggattcaagactcttcccccaaaattgcttgcattttgtaaaggggttgactagcaccatttctttgtaaaaagaggcactcctggcctttaagtcacaattacaagaagttgaataaaaagttgatgaagtgcagggtaatctttagagcccaataatggtcacagcgtataggttgtgtgagatttgtatgttggtcttgcacgcagtgtaatgttctgagcctctcaatattgtaatgagtttctacgagtgagtctttactaaaggaatccagaaactaaggagacactgatgtatggaccagatgttaaagaaaatgttttgacccagcagatactctgatagaatactggctattatttttgtaaagccgatgtgattgcaacataggcacgtaatctttatcattagagatgaatagcagcatctggacaccaacccatcaaactgcttttcaaattctgcagtttttctcatcttctgctgaatcttgggatgtctttttatattccttggttttagctcctaaactctaaattctaattttcaaaactgaaacatctctgaatctacttctttctaaagaattgcagccatctcaccaaatttcctttaaaaaaggattgaattgtcaaataggaggaaattgttttgtattgtgagtctggttaggtttatcagtctcttgaaacccggttgaaatatttttttcttggttttaaacaagaatgctttaatattgtggatattgtctggaactagaacgtgacattttcaagctgacattacaggtgattttataaggtaagtactactggttttgccaaaaggttgaaaaggaattcaggtggtgggggaagtgttaatgggatttgccttacatagcgttttttcctcctttctctacaataaaatccgaacgtaggtggtaaatattaatgctttcatagctattttgcccaggacaagggcagagctacagctgtgtatatttcttgagccttagcattttatgttgatcagtgtttttacatatgcgactgtttttttaacaaggcatggtgactgatgtttaggaattttaagtgttttgacccaggttagtattgggggtgtgggctatgtagaattagatattgaaatcacttagtcttgtttttaaactgcaaaccaaaagaagttcttcactgtagcaaattacagtcttgaaattcccccaaaatctttgctttgaattgggttttggaggttacattgagattgatgttatcaacatagattgttacctgacagtttggataaggggcccctttttctctaatttttgtggttagaaattaggttaaaaggtagtcttctgaaaagtcaaaagatatttatatttgcttttgttggggagtactgactgttttatgaatgtaaatttaacagtctgtgctatatttacaagagagtttttataagcacaggcctacaactaatttcagatgatgtttttttccagacactattctccagtttttgaggatttacttatccatttactcttctggtagacagtttggctgccagaaaaaaatatagtccttattatattgatatgagcattgacctttccataacaggattaatgaggttttctttgcccctgtccctcccaatttttaaaatattgccttgtcagtcaacttaatgagtttgtgcatgtttaatgttaaatggattctagttgtatcccctagaaacattttaacaaaaattgtgttgataggacaagtttctgtttatttctaactagggtctcttaactaaatgtacataacattagcccaagagttgatcttctggttttataaagtagccacttgaacttagctgagttgaattaaatctaatatttataataatttagtaatggt

SEQ ID NO: 33107 - DNA, 1050 bp, Homo sapiens
aactacggcgagcgggtacgtagagctgcggtagggggtggctgtgtggtcctagctccttgcatctttttctaggcccgtcggcctcgggccaggaggcaggggcgttttaggctccgaagtctgaagccgggagggcaggcaagggagacagcatttaaccaaaaaaagcctttgtggatagtgccttagtgcctttggtcgtgaaggagggaggcccccggcgggtttatgtggcttctgcccgagacggccgtttttcccgttataagagggggaagatgaaaatggccgctgcgtccccgcggtgttgggggaggggagcgatatcttatttcggcgttgctctcctgcgaaggtccgccgcagccatcttgggctggcgggctgggcgagctgccagaggcacaaaatggcggagaagccgcgcggcaacgcggacccgacccgcagcgggccgcgcttcgtaaggccgcgtggtggggtgcaaggggacagacgacgttcttttgggtctttgggccggtgtttaggttaacgaaggaccgtctttgcctccacggaaaggacggagtctgggatgtctttggggcctcttaagatggaaactaatccaaggccgactaagttctgggcccgttaggtggaggggattgcgtgagggctttgtgtttggcctaaatgaagcgcttttctctgatgccgaaagggcttcccaggcaaaaatctgtatcagtattctattaggacagaccacaaagtcgttaagatgattttgtggacatcgcatttccacgggattgtgaaggagaaattggcgggcaaccatttacggcgccgttatttcctttgttttgaggcgttctaatacttagaaccacagcgtgtgttggctacagttttctttcccttaagtttccacctcttaaaggtgttcagtgagggttgattgaattgcgggaacaagacagttctagggtttaaacagcatacgtagctggtctgtggggctctgggtattggattcggaaagcattgaatgatgcgaac

SEQ ID NO: 33108 - DNA, 1034 bp, Homo sapiens
ccactcctccaggaaaggaatgtttagtgattttatggtttgggtcacaacatttttttggaggttggtgtgggggtttctgaactgagatacgattacggagtgatcttgttctttctttggtctatcatcatcccagagtggctttgtctaatggtggtggtttaaggtattgtttatgttcaacaaaagaatacaatagcaagtccagatcctacaccaaggcctagctgacagtgctaggctagctcctggctgtcaggagctactcttctctttcttatcatgaacatgtgaaatacgctctcactttggaacctttgtacttttttggtctcttctgcctggtatattcctctccaaatactcattctgcttattccatcatttcatttagacctaagctcaaatattatcttagggaggccatctctctccattctttctctgaaataacatttccagaattgctattccttcaccctgctctatttttctccatggcacctagaactacttaactttatattatatttttattgtattgtattgtattgtactgtatttattttgagacagcatctcgctttgttgcccaggctggagtgcagtggtgtgatcttagcttactgcagcctccacctcctgggttcaagcgattttcctgcctcagcctcccgagtagctgggacttaacaaacatgtgctaccatgcctggctaatttttatattttttgtagagacagggtttcaccatgttagccaggctggtcttgaactcctggcctcaagcgatccacccgcgttggcctcccaaagtgctgggattacaggcgttagtcaccatgcccggcctatttattttatttttacctatctttcctactagaatatatagtcttcaggagcatggattacacagatcacaatgtgaatggtgccctctggagtcgtgaagtgtcatcctgcttcaacaggggccttgtctcttctctatacatttatccccatcagtcagaacagtacccagtgt

SEQ ID NO: 33109 - DNA, 1012 bp, Homo sapiens
acaatgatttacatacagtagccccctcttacccgcagttcactttctgcagttttaattaccctcagtgaaccgcagttcaaaagtgttaaatgcggctgggcgcgttggctcatgcctgtaattccagcactctgggaggccgaagcgggtggatcacctgaggtcaggagttcaagaccagcctggccaacatggtgaaaccccatctctactaaaaatacaaaaattagcctggtgtggtagtgcgtgcctgtaattccagcttctagggaggctgaggcaggagaattgcatgaacttgtgaggaggacgttgcagtgaaccaagatcacgccattgcactccagcctgggcaacagagcgaaactccatctcaaaacaagcaaacaaacaaacaaaaaatattaactggacagtacagtacagtaagatattttgagagagaggccacattcactgaacttttattacaggatgttgttatgattgttctgttttatcattattgttgttaatctgttactgtgcctaatttctaaattaaactttatcagaggtatgtacgtacaggaaacaacatagtatatgcagtgttcagtgctagccgtggtttcagcatccactgtgggtcttggaacacatcccccacagaaaaggggggactaccatatatcgattttttttttcctcttcatctaaacttcatgcttttgatttctacccacaacctagaacacaatgccaggctcacatgggaccctgtaaatgaggttctctattggtaagtgaatagtggatttgtccaactgataatagtttggacattcgtccctgcccaaatcttatgttgaaatgtaatcgccagtgtcggaggttgggccaggtgggaagtgtctgggtcatgggggcggattcctcatggcttggtgccgtcctcacaatagtgagtgagttctcacaaaatctaattgtgtggcacctcccccacaacccaacccccttgctgctg

SEQ ID NO: 33110 - DNA, 1007 bp, Homo sapiens
aaagcagtgcttccaccatcccagacctcaggaaccagtgactctgggaacgatgggctcctatcttgggctgctgaagttgtggaaatgattaaatgtacacagtggaagaagaattcagatagaagatcatgaagtgaagggtggaagcttgttgtattaccagaaactaaggaattcaatttccgcagacacccaacacaggtaatcacatgaccatatgacaactgaagaagaactagagaaaagaaggaaagtagcatttaaggagggcctactacgtggtagtcactttccttgcaatatctcattgaacctttactacaacactatgatagagatattgacaatcctattttaggaaatggaaaaaactgagacttagcaaggttatagggtttctccaatgtcaacagcaagtcagttctagaaccagaattccagcccaggtctgtctgactctaaaagttcatcatctttccacccaaggacatgcatctgtgataagggacagtgagaagtcagtgtgatcaagtcggactcaaggtcactagagaggcaacttcgtctgtcagacagtcgcagacaagccaccttcaccatcagtgctgcacctgccatccctgctgtgcactgagtggtaacactcaggtactttccgtattggtaaggttttacagacctattatactcccgtgagataagcacagcagattttatgagctccatttatagctgagtatagtgaggtttggaaatacaaataattttcaaagttgcatgagtgatttggaaatagtggacttagaacctgactttcacatgtctgaatgaaacaagatggcaggaagggcctgattcactgtcacaggagtggaggctcaggcagcagctgcccagtacctactctccaaggtgtggtttcccaggaaagaagagttcctccaaacagctgggtctagcgacagtcttgcaaccatcagacagcctcagccttcacagcctgt

SEQ ID NO: 33111 - DNA, 1041 bp, Homo sapiens
agtctccaaggagcatgtcaccgtctacctgggcttgcatgatgtgcgagacaaatcgggggcagtcaacagctcagctgcccgagtggtgctccacccagacttcaacatccaaaactacaaccacgatatagctctggtgcagctgcaggagcctgtgcccctgggaccccacgttatgcctgtctgcctgccaaggcttgagcctgaaggcccggccccccacatgctgggcctggtggccggctggggcatctccaatcccaatgtgacagtggatgagatcatcagcagtggcacacggaccttgtcagatgtcctgcagtatgtcaagttacccgtggtgcctcacgctgagtgcaaaactagctatgagtcccgctcgggcaattacagcgtcacggagaacatgttctgtgctggctactacgagggcggcaaagacacgtgccttggagatagcggtggggcctttgtcatctttgatgacttgagccagcgctgggtggtgcaaggcctggtgtcctgggggggacctgaagaatgcggcagcaagcaggtctatggagtctacacaaaggtctccaattacgtggactgggtgtgggagcagatgggcttaccacaaagtgttgtggagccccaggtggaacggtgagctgacttacttcctcggggcctgcctcccctgagcgaagctacaccgcacttccgacagcacactccacattacttatcagaccatatggaatggaacacactgacctagcggtggcttctcctaccgagacagcccccaggaccctgagaggcagagtgtggtatagggaaaaggctccaggcaggagacctgtgttcctgagcttgtccaagtctctttccctgtctgggcctcactctaccgagtaatacaatgcaggagctcaaccaaggcctctgtgccaatcccagcactcctttccaggccatgcttcttaccccagtggcctttattcactcctgaccacttatcaaacccatcggtcctactgttggtataac

SEQ ID NO: 33112 - DNA, 1047 bp, Homo sapiens
aggattccctctttctctgtcttttggaatggtgtcaatatggttggtaccaattcttctttgaatgtctgctagaattcagctgtgaatccatttggtcctagacttttttttattggcaatttttttttattaccctttcaatgttgctgtttgttagtggtctgttcagagcttctatttattcctggtttaatctaggagagttgtctatttccaggaatttatacatcttctctaggttttctagtttgtgcacataaaggtgttcctagtagccttaagtgatcttttatatttctatggtattggttgtattaggttggtgcaaaagtaattgcggtttttgccgtaacttttgtgccaacctactactatctctcattttgtttccagttgagcttatttggatctcctctcttcttttcatggttaatctcactaatagtgtatccattttctttatttttttctaagaatcagctttttgtttcatttatcttttgtattttttctttcaatttcatttagttctgctctgatctttgttatttcttttcttcttctgggttacagttcagtttgttcttgtttctctagttccttgaggtgtgacattaggttgtctatttgtgctttttcatattttttgatgtaggcatttaatgctatgaactttcctcttagcactgcttttgctgtatcccagaggatttcacaggttgtgaaactataggtttgatagatgatgttcagttcaaagaattttttaatttccatcttgattttattgttgacccaaagatcattctggagcagattatttaatttccatgtatttgtatagttttgagggatccttttggagttaatttctaattttattccactgtggtcagagaggtacttgatatgattttgattttcttaaatttattgaaacgtgttttgtggcctattatatggtctatcttggagaatgttccatgtgctgatgataagaatgtatattctgcagttgttgggtagaatgttctgtaaatatct

SEQ ID NO: 33113 - DNA, 1030 bp, Homo sapiens
gagctcccatgaatgtcgggtgggtgagtgagggactgagagttcagtttggcacaaggggtagctacagaggagagcggccttagagccctacctcccttcctcgtgctgactttggtgtccccctaccaccctccaacagagaacggggccttcttctgcaatgagtgtgactgccgcttctctgaggaggcctcactcaagaggcacacgctgcagacccacagtgacaaaccctacaagtgtgaccgctgccaggcctccttccgctacaagggcaacctcgccagccacaagaccgtccataccggtatggccctgccccacacgacccgaactctccacaattattggggcaggacagggagaggatcctagagaaagctgtgtggggcctggagacctggtggggcaaggcaggaggcaggccccatcctggcctgaacgaggggtctaaccctgtcttgtctttgcttagtgactcgactcatctactccctgtatcctttgtctttcctctgagatgctctatcctgcttttctgcctttgctggggtcagaagtgttaatcccactgtacaggtgaagagactaagtctgggaaagacaaatagattcaatttttgtaaagccagaaaaaaaagcctgttgatttgtttcaatgacttgttccttatcaactcacattcctttaccaggtagcttctcatgacctgcttgttgtttaaaatctactctcttagtaccgtaaatggccctattatcccaaaaactttccatgaaggaaggttcagccattctattggtttcctctgctgagcatctactcaggcccaagccccacccctcttgcaaatggaatccagctgtagttgccacaagcggaaaaatctgtttgttctaaaagagagaaactagagcagcctgattgtgtctccctggtgaatgagttgatgagtgaatctgtcttatccaagggaaaagctagaagaaccttcccaggtaatctgaagtagcccctcaggttcca

SEQ ID NO: 33114 - DNA, 1086 bp, Homo sapiens
ggctctggccaaactaggtcaatgggaaggaggggaggggcgagaaaggggttgacggtttcaaaccttgatggagggctctctctagcgttaggcagcggtaaaaacaccattcggtttgagctcccggaaccacgggactcctaatttccaataaatgcacttacttcattttaacttcccagattctcatccctaccccttattaaatcccaaccgtctctttcacctttatcccaccgggcgaaggggtgagaaagcctcaatgtaggattttgaggccaaaggctcgttctttgcagaccgactctgacccttccgcttgccgcagaagggatgagcggcgcagtgtgacgccactggctagttttaggaccagactgcggcctttgtggctgagtctttcgctgtcccctagcccccgaaagcgcaccccggagcctgctaccgagaccaattaggacatggcacccgggggttataattcccgggagggccacaggaaggcgaggcaactttggagagtgccagtgcgcgcgcaggggtcggggccccggcctttgccgagtccaagctgtgtctctacggtttcggggaaatcggattcggaaatccttacggcttggcagctcctgttctaaagactttgggcggaaaccaagtggagctgggttcccgttcttgccaacgtaggcggaaggggctttctgtttagtttttctccaaccttgcctggggcgcctatgatggagaccctcagcccctagggactccatcttttgaccttgaagtctcgctcaaacattcccctaaaagaacgggggtgagggagaatggaaggcaaaaagagggaaaaaagcaaataaacttcggaatcggacaacttaaagtctcgatatgagcctcggattgtattcgaactcctgggttctagacccagctctgctactaacttgtctgaccttccccatttataaactgttgtgggtgagaggtgggactaggtgaactctgagagccctgcactcggcgcggacgagggatttaggggaaagtgtgctgtattccccgcgagccttccccagc

SEQ ID NO: 33115 - DNA, 1035 bp, Homo sapiens
aaacctctcgctcccttttgtgcatttagctcgatctgctgagtttatgggtaagaaagaaggaattagccccagaccccgggaaagcaaagcgcactccccctcttatgtcaccgaatagcaaattagttctcagaattccagaggccgagctttgctacagcgaaggcgccgacgtcacagaggaggagcccacgtgatggtggcggagcaggccataccatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattcttagaactggggttcttagaagtggtgatgcaagaagtttctaggaaaggccggacaccaggtgattattgctgttgctgccgccgctgctgctgctactgccgccgccgccgctgttgccgctggtgccgctgccgccgccgctgctcatgatcattattttaccttttaattctttttttttccgctcttgccaaatgctttggctccaagttttctatgtgtatctattgatataaatgtatatatttatttattctagctgtcaggtgttaaaataaatgccgaagattagtcccacgtctctcccaccataggatatagattgttatgtatttattattattattgttgtctttgagtgaatcggccggtttggggaggcttttgccaccctcccttgtgttgttttggtttttggaaaggaggtggaggagaggaaggaggggaattagggggcggccggagcagagaggacgagacagtgcttggggggtgattcgggctagtctgggggctgtctggccccagaccgcggagaggacgcgcgctcgcgctctc

SEQ ID NO: 33116 - DNA, 1020 bp, Homo sapiens
agacagtgagtacaagggagtactttcttagatgatcccttcttgttgcaaccagagagtcagagccaggcacatactttataaacgagggaagaattaacttgtttgactaaatcttcttgggctgtggttaagaattggctgaagccatcaaatcaggccccagaaaccacaatttattggactacatttttatttttattttaatgttttcctctgtctggtgtgctactagtcattaagctaccagcttaagactggtagtcatatggaggctggttgacttgcctgttgaatgatagggtttcatttgtctttttttttttcctttggttagttgatgggtgatgggtcgtttttgttaaatgtacgtgtggaaaatatctgtgtaaaattctacacttagtaatattaatgattatgttagctacatgaaaggcatatttctaatgcagattctcccggaacccaagattcagatattgaagactccatgttacattcttccttcacttgatctttgcatgttacttgtggaatgctaggagaattgtcaatatcccagtagccttctcttaaggctctatgcttattaaggtgtctcaatcagaacttaacacagtattccaggtgtagcttattaattcaacaataacgatagtaatgataatacatacttataatggagcttaagactggtagacattttcctaaatatttcatttttgctaactttcaaaatcatattttgaaaataagctaattatgtttaaaataatacatcttcaatgtagaaaaagagaaaaacttggcaaagtataaaccaacttaattcactaaatctctcatctgtctttcatttctatttgagtttttattagcagatgcttttcagtgaatctacaagtatcttatctttcttcttgaaggaacatttctttttatacttctaaattggaatggaatatacagttcacttttccaaatattcgagggaatgcctgtctcaatttgactaca

SEQ ID NO: 33117 - DNA, 1032 bp, Homo sapiens
gactgagtcacggacgtgcccttactcacgtcttctgtgatttgaaggcagaatctgaagcaaattccaacacagctgtgagaggcagcccgtttttgttcttaaaatgctaactacacacatttgcaaacctgcaaagctatttttctccttcctttggaaggtgttaaggctaaaaggacatgtagacaggagacagcaaggagagtccctttcctgtctctgttatagaacttctatttatttttagtgtttattttttcacttgtgaatgacatgatactgacctggaagaaacattgcttctgggatatgtagctgatctcctgctactgtccctatagtccaccgaaaagttaaaaggcttcaattctgatcatcttctccaggagaatttttatagccagtgatgtcaagcttacattttaactttgttttcatttgtttgttttttaatatacttggttattaatgtcatagttcatcaatagcctaccaggtacaaaaatcatctagtaaaataaagcaaaatctatggtagttatattattttcaaaactattttttggcattctcattgtgttgcccagtctggagtgcagtggtgtgatctcggctctctgcaacctccacctcccgggttcaagcgattctcatgcctcagccttccaagtagttgggattataggcacctgccaccatgcccagataacttttgtattttttagtagagatggggtttcaccatgttggccaggctggtctcgaactcctgacctcaagtgatctgcccacctcagcctcccaaagtgctgggattacaggtgtcaaccaccacacccggctcaaaccatgtttaagttagcagaagccatttttaaaataaaatctcttgaatcattgtaatttttttaaaaagagagaagaaaaaataataaatgaagatagttgtgttggtgaaactgctcctcttctgtattcaacagtccttgagggacctctaaagtacctccagaagtcattgtgacagcc

SEQ ID NO: 33118 - DNA, 1027 bp, Homo sapiens
ttacacattttcagaagggtggatcctttgatgacagatgtaatttctacccccttatttctccccagttaaaagattgccagttaaaaatcctttgaaaatggtttgatccttttcatacatgcaaatttttttccagtctttaggaaatttatataggctgtagtttttagccaaaaagcacacaccaggagttgagtcttttccttatccaaaatagaaagggtgtggattttccttctttgatgtggataaggcacaacttcttctctaacacttctgatggctgtggtgtttcctctttgttagaaatccactgtgaacatcccatcccttctgcaggtctttcccgtaaaataagatgttttgcatttttcagaccatatgtcttcttggtaagttaggctaaagaggcaaaaaaggcaagttattttcatgattgtgttttcaagactttagaaaattaattttatcataagagaaagacctggacaccattatgagctgcttggttgtgagaatttgatgaccttaggtaaatgcagataagctgcatgatcctctgcattatgggatcctgattatgtgtacatatttattcacctaatcttggagtattatgttcctttgtcaaatcatgagtatgatataattttatttttgtttataaatataggtatacaatctctctaaagtgattcttcattttcttttactgttcatattaatggtaaacacaaggtaattatattcttcccacttgattaagtaacaagaagaaaacattaaaaaaaacccacctctgttgtctacagcattggctctcaatactctatgcaaagcattctgctaagctcatcaccttcacaaattcatttattcctgttaagaatcctaaggttgaaaatacagttcaataaagggaataaatttcagtattcaatagtatggtagggagactatagttagtaataatgtattgtatatttcagtgtagctagaagagaggaatggtagtgttcctagc

SEQ ID NO: 33119 - DNA, 1027 bp, Homo sapiens
tggactagggcagcattgggccagttacttaataagagctcttctgcatctgccagcttgagatgctaaaatactttagtggattggtacagcaagccaacagtctacctgtggaaacagaaaactgatgagattataaaataatggaatataaaatgcaatggacataaattagtttaaaagtttacaggaaaggaattacttccagtgtatctaatgctggtcctcatcttggggcagtgaatccctttaaagtaaaacttgaaaggaagttacacaaatatttaatttaatggtaatttaagaggacagaataaactaggcaatgttcaagagagacaaagaagatagataaaaggctcaaaaccatatatgagaaacagctgatatagaggatgagtaagctaatgaagaaaagacaagcaacaacaacaaaaaatctccttttgcagtttcaaaaaagattatcatttgaggcgattgttcctgatctttatggcactgaagaattgaagcactaggaccaaataacagaaattacagaaaacaagatctcggctcaaatgtgaaagactttcctcacactattctgagatctaataggaagccctagaaggtgttcaaacgtgagtcaaacaaatacctaatgtagaggttgtatttaaggtgcaagcaccagagtgatgttgaaatgaatgagatttaaaatattttccaatccaaagtctataagactccatgattttgtgaaatgaaaatttctcttgtactcacagaaaggatcattaaagtctttttcattgaaaaaggcatacagttttctagcttccttttgaattctagttaatgtattttaggccatggttgccagcctactccctataaatagttacataatgcaaaaaagaaaagaggaaaaaacagtaccaaggccctaagacacacatgccagaacacacatgcatggaatatttagcagtaataatatccacatgcatgattggcatcagtcctctgatttccgact

SEQ ID NO: 33120 - DNA, 1074 bp, Homo sapiens
tcaacctccactgccactcacccaattttccttcaaattgacactcttaacccttctttctcgttttctgtgttaatatatcaatgtatcttctacagctaccggaaaagtggaagctttggggttggttgttcatgctagccaatggaccaggctgctctgctctgctctgctctgctgtgctctgctttgctttcttttctcctctcctctcccctcctctcctctcctctcctctcccctcccctcccctcccctcccctcccctcccctctcctctcctctcttccttttcttttctttttttgacggagttttgctcttgtcacccaggctggagtgcagtggtgcaatctgggctcactgcaacctccgcctcccgggctcaaacgattctcctgcctcagcctcctgagtagctgggattacaggtgtgcaccaccatgccgggctaatttttgtgtgtgtttgtgtatttttagtagcgaaggggtttcaccatgttggccaggctggtctcgaactcctgacctcaggtgacccgtccgtctccgcctccaaaagtgctgggattataggcgtgagcacggctggaccaggctgtgtttctaaggagatgaaagtacataccatgttcaaatatccaaatgccttttgcagctcatcccacaagatctctgccctcatctgtggtagggttctctcagattggcaactgttggtggagtgcacgaaatttcaactaagtataaatcttaacttccttgtgttgtggctaaggtgttggagttcactggactagtatcttgggcaagaaatgaggagaaagtctgaatcctttccaggacttgtcttctgcttgcttgtgcctcctgattgctaaggcatgtatgaagtataactctaatttcttctaagtgatttacacaatttctggtggtcttacagaaatcagtcaacaccaggcagagaggggaccttgagtgtctgacggtgaagttatcataagctagttcccagagcagaacatgggtggtccctgtagcttggtcctcccaggagtctcggatgtaa

SEQ ID NO: 33121 - DNA, 1064 bp, Homo sapiens
ctatttagcttcatcctaatgttgatatttaagacagctgttggccttggactaacaatgcttatgagttggcatttttaacaacttttaacatgtcaattaccaatttgccttctccatgcttatttctgctcgtgggtaagttgcttcatcataacaactgaaactatgtggaacacaggaaaatgtgactgatctggaagccagtttgtagttagagctccttttttctactgtaacacacatatagacctatttggagcatctgatgatggtgacctatgtgtcacttgtctcttctcattccacatcttctgttagcaaaaatatttgacagtaccattacctcccccaggagaacatttgcaaataaaaaagtaaaacacaccaagattcatggaagaaatgttactgtgcttactcagagattcactgttattatttctagctttggttctgggttctctcatttattaaacatgaaatattgagaaaatatcttgccttttctggctctgaatttcctaagcagtaaaatgagtataacactgatctcacgtggttattgtgaagaataaacaaaaatgaattagtaaatgtaaaacgtgacacacaatcatatagtttcttggtaaatgttacagttcccgtctctgtcgaaggaaaagcatcttctagattgagaaatgacctaattcagtttggcattctagtaacgagcgttataatatttgtaaattacatggacacacagggagaaaagtaacagttttttaaaaaaaagcccctcccttttcttgacttgggtctttcatgccctggtactccaggaagttccccaaccctggaatcagagctcactcacagtcaaatgcccacagcttccacaacggtcagtgaaactgaaagctgcattggaataaatgggccacgaagatccaatctattgagagtcaccacagctacatgaaataaggaacaatttggctgaatcacaggcctgtgagtagtgtgagctgtgttcaatctatctgttgagccacggagagagacagttcttatgg

SEQ ID NO: 33122 - DNA, 1049 bp, Homo sapiens
aggaaactaaggccttgtgtggttaattgacttgcacagtgccagaaagctagttatcggctgggtggggatgtgaagccaggtttatctggctgaaagcaaatgttcttaaccactgtgctcttgcatactgtatgtatagcaagtgccactcagtaaacatgctttccttgctgcacagattataaataaaacaaacacattagaaacatcaagtttcctgattcgattaattcatcttctcacatccttaatattcaattattaagatgcttaccagtacaaagaaaaaattgttgtgaaataaagtgataagagttggaaaccagagtttaagcccgtgtttgctccacactctctgtagattaaacagatattgcatttctctgggcctcagttttctcacctgaaaatggtagttttaaagattattttcagctccacaattttgtgaattaaacttgatttctgagataaaatgaaaaaggaatgagagaactatttagagattgttttctaccctgctattgcctaccaaatcctaccaaatgtcaataattttctttttataaatcttttatagaagtttctgattatgtagcattttaaaggtattgtttattacacgttataaaaaattttatataaagggaaaccaagttttttagcacatacaaattttatgatatgtatttcatttgatggaacgatgtgcaaattcatttactttccatgcaagagtgatcttgttttgatttcagactaagagctggaaaaataatttccattttgttgttaaagacaatggatagtaaaacaagatctgggtggcagggaataacctccattaccagggggtagataacaaatggctggatgtgtgacaatgtccaattcataaaattctggttaacaataatttaataatacttctttgtgcgaggagaaaaaataaaagaaatagtcacttggagaaatgtaaatgggaggagatggtgtttttctgtcattgaatataacaatacactacattgtctttgtaacaatgg

SEQ ID NO: 33123 - DNA, 1031 bp, Homo sapiens
taagccagtacttcccagagtattcatttgaggaatatttttgggtgatattctggaacaaacctctggccatggtaatttttttttttcttttttttaagacagggttttgttcttttgccctggcaggaatgcattggtgcaaccttggctcactgcaacctcgacctcccaggcccaagcaattcttccacctcagcttcctgagtagctagaaccacaggtgtgtgccaccacacccagctaattttgtttatttttttatggagatgagatctcactgtgttgcccaggttggtcttaaactcctggtttcaagtgatccttctcccttgccctcccaaagtgctgggattacaggtataagccaccatgcctggcctgtagtgataattttttaaaaagtaacatccataagattctcaaactgttatgtccatagaataattaataaatgaaaagtgttttataaaaatatatacacatatatcagatgttcttcgtatacaagaagctctcctactcaatagtagtaaatcaccagaagataataagaaaagcaatttatttatgcacaaatacatgtacagtccatgaactggagacatggtaatttaatgttatttaataaacaagggatagtgacattgtatatgtagatagatagataaatacacacacatatatgcatagaggtgaaaaatacacacttgtatgtatagatgtttttcgatgtatgtgtgtatatacatgtatgttatatacatattttttgtatgtgtccttttttttgaagtaaataactttatagcttaccagaccagaattgattctaagattcctatattgttattaacaaggatacaacctgcatgtaactattgggatatttttgtgttttaacaaagagtcactttaatacaatataatttaagaacctgtcttttctgtgtagcaagtgaatttcccagctagttacatgaagaaataagtatcatgatgtgttggaaacttgagaggtcaagtcccat

SEQ ID NO: 33124 - DNA, 1088 bp, Homo sapiens
cattggcaaaatgggtacagggtgatcagcctgagtgtagatggactatagcatagcatttgattgatgtacaagctcaataaaaagtgttatgctaggccgggcgcggtggctcacacctgtaatcccagtactttgagagtctgaggtgagtggatcacgtggtcgagatcgagaccatcctggctaacacggggaaaccacttctctacgaaaaatacaaaaaattagctgggcgtgttggcacatgcctgtagtcccagctactcaggaggctgaggcaggagaatggcttgaacccggaaggtggaggttgcagtgggctgagatcgcagcactgcactccagcttgggtgacagagcgagactccatctcaaaaaagaaaaaaaaaaaaagtgttatgctagtctacataacactccctatatgtcctatgtgtctgactttttccattcagaatttcccaaatgacccttgctttcacactgcttcttccgccttgctctgtaacattctgaatgatctgaactcctctttgggccactgtccagactcttggtctctgaactccacactttcagttgtttaaattcaccaaaaaaattcaccaaaaagtcgtttctgactttgaaccttttcttttacttctgtccttgtgtggagtgttattattttttactcctcattttttctgacacgtactcacttcctctagctaattccttctttttctttacactcatcttcaatgttctatcctgagggagccatttttgacgccctagggtttggtgaggtttatcctccatagcagccaggactccttcagaacacttctcatatttgtaattataataactgattgtggcattatttatttagtttctttctgacaagagggtcaatttcacgaggacactagccataccgccttgttcatagttgtgttccttggcgtggtatcaagaccagggtattggtggaaggaaagatcaaggttaggatggaaggaatgaaggcaggcaggcagtaggtttaggatataatttttgcttgcaccttatttggtgcgtatttttcagaatgt

SEQ ID NO: 33125 - DNA, 1044 bp, Homo sapiens
atatatgtattaaaaatcttgagtgagaattacctgttataaagagaagtcatcacatttgggagctcctcaacacttttgcatctgaataagcaaattaacatctgttctatccttctttccttctgttagaatgaagatgttatttcttccagctaagaccaatctcctgtgttctaaatctcatcctctctcaccttcgtagggaagatacatcacctttcatcccctcttctctagcttcttgctgttttcaatttaatatgcttaagtctttataaaatatcaatagtccccaatcctttttcaggactgaaagagtgcctacatttcttctttttgatttttaaccttttaacaaattctgtatattcactgttggcttttctttacctctcacttctacctcatctttttctaatctggcatttacactcaacactaacactaacaatcctgttcttgccaccattactaatgatgtctaatttaccaaatctaatggatacttttcagccctcatttatgtgacttcttgatagcactcaacattgctggttaattcctgtttttgaaacagtctttactcccatttttctggtttctccttagtctctttaagcagtttatactcttctgttccatctttagagatccaaggctgagtcctggatcttaaacactcacattgtactttcatggctttatttatcaaaacatcaacactgccacatttatatcttcaggcaagacctctctcctgagttctaaacctgtaaatccgacttccacttggtgcctccaactgaaaatatcctaaacctaatttgtaggtttctttctaaatctgttcctcttctaatatttccctcctcaaataatgtggttatcatgtttaaacaagcatgtacccactttgccaatggtgtagaacctcaaatatatagccataaaacctaaacacctttgcacaaatttagcctttgatttcatctacctttgtccaagaataatgtcctttctttcttttccaattattagtgt

SEQ ID NO: 33126 - DNA, 1026 bp, Homo sapiens
tcctattatgcaaaaaatagctctcttgatggtgttttatatatcacataaaattttcattcctttttttcttttttctactcttactatatgatataaaacaatctgtcttctagtttgcttattatttcttctgcatgatctattcttcttcaagctctctattccattctgttgttcagtcattgtattatttagctccaaaatttctgtttggttattttctaatgttttctatcattttgttgagcttataattttgttcttttattgtttcctaattttttaaactgttttttgtgctctcttgtttgctgaacttcttttaaaacgatacatatttgtacatattcatgaggtgcatgtgatactttgttacatacatagaatgtgtaatgatcaagtcaggatatttagggtatacatcactttaagtatttatcatttctatgtgttgggaacatttcaaattctcccttccagctattttgaaatatataatacattgttgttacctgtagtcaccttactctggtatcaaacattagaatgtattccttctatctatctatgtgtttgtacctattaaccaaccttactttatcgccaacatccatataccccttccatcttctgatatctatcattgtactctctacatcctggacattgacttgtttagctcccacatatgagtgagaacatatgtctttctgtgattggcttatttcacttaacatcacctccaaccaattcagtccacgttgctgcaaatgacataattttatttttttatggctagatagtatttcattatatatatatcccacattttatttatccgtttgtccactgatgaatttttaggttgattccatgtttttgctattgtgaatactgctgcaatacacacgggggtgcatgtatccttttgacatactgatttccttttctttgaataaatatccattggtgaaaatgctggattatatagtaatagtatttttagtttttcagaaatctcta

SEQ ID NO: 33127 - DNA, 1051 bp, Homo sapiens
acagttatgttaatttagaattcatttatgacctaagggacctgagaaagaataaattaattcagaattaaatgtggatgtgtacgtgcatgtctacatacacgtgcacgtatgcatgctgagatgcattctatctttaacattctaaatcaggtaaaaagaaatctcaacagcatacatattgggctgggagtaggtcaaggtgaataaattaattaaatgtaacattctttgatttccttgcgtcagttcccctctcagagaaagagagatctaaccagaagacgcaatctaattgatgttcttttgtttttttaatcccagcaaattaaagagactttgccagtgatgtttttagttctttcaggaagaatgtgattcctgcttacacttgtacattgtaattttagtatatatttaaagtttgctgttgttttcctaacctgagcattttggggaaattctgagccttagagatgaacaattagcttgaaataatgatatttaagaagaaaaatctgttggtacacaagggtcagtggctctagtctcagtttctgatgagttcatttcatcattacccttggaatcagaaacttcttttttttttatttatttatttttttagacaggatcttcctctgctgcccaggccagagtacagtggtacaatcatggctcactgcagcctcaacaacctccccggccccagcaatcctcccgcctcagcttccagagtggctggtactacaggcataagccaccacacccagctaattttttattttttgtagagacagagtcttactatgttgcctaggctgttctcaaactcctgggctccagcaatcctcctgccttcacctcccaaagtgctgagattacaggcagggatcagcaacttcttaaaggtggctgataaagacaatcatatgttgaacacagaagaatggtgaggatggggtgggggttggggaagattgggagggggcctggtagaccaaatctgcttctctaagcttcatcacagccacaggcatcttacagcttc

SEQ ID NO: 33128 - DNA, 1441 bp, Homo sapiens
tcccagctactcaggaggctgaggcaggagaatctcttgaacctgggaggcagaggttgcagtgagctgagatcatgccagcctaggcatcaacagcgaaactctatcccaaataaaaataaaaaaagcaatgactgaagtttagcaaactcctaaattaagactttttctgagcctttctctgtagcatgtatttgctactagaggcaggcaaggtcataacctagggtgagctttgggttattaattcaaagacccagtgtctaaatcctcatctgtaaaatggggacaaaattatctgaactcccagtcactggatgtggggaccagtgagcctgctgggtgtgaaagcacgttgggagctgaagatggaccctgcctcacgggcagtgggggttgttatgtagcacgattcctgaagtgtgggccaaaggagctgccagtgccacatgaatttgtgagtggtcgtcatgggtgtgtgtcatggaatagaagtgttaatatttaatatctgggctaataattgtaatcattgtttgacacaagagaatgtacaagatgattttaccctatgaagtaaatgagtttgtttttctccattctacaaaccaagcagtaaaagtgcaggtgggttaaataataggcctaaagtcgaatcaaccatcggaatgtaatttgttaaaactttgccttttgttcacagcttttagagtttttcttttctcatggatcacatttttgggaagggcttcccatcacctctataccagtaataacagctgacatttattgaagcttggtctgtgccgacacattttacagatgagaaaactgagctagaaatgttaagtagtttaccagaggtcatgtagctggtgtggaagacccatttaagttttgctatcttaataacagtaataaaagcattaacatgtattggctgtttgctaggtgccaggcatcatgttaaacagtgtcatctagaacctcatttggtatcacactaagcctgcaagggaagcccttgaaaatgttatgcagagggaggactcctaccatctctcttctcttgcaatggatttgcaaatacctttcttttgcctttcttttaccagcttggaaacagcaaatttccagtgcctcttatgataccagcttttcctgctcttgttctgttacattaattattttgttctatttattaattattttcctgctcttgttctattacattaattattctaatccagatgttatgaatcggctgcctgcagtctgaatttggcttgcagccttgtcctgtttcggccttcaatgtattacaaatgcatggttgaattagatggcaatgtctaaaaattcaggtgaccatatgtaaatctgtatttatgttttctcatgaaaaattgcataatacacctacctgtttgagataaaatga

SEQ ID NO: 33129 - DNA, 1029 bp, Homo sapiens
agcctagatcgcgtcactgtactccagcctgggcgacagagggagactctgtctcaaaaaaaaaaaaaaaaagaagaaaatttacctttcctgtgtttcctcctaatacctggtcccttttgtggcccttagcctgttctttcccatgctttaaagaatacctggcttatttatctttgcagcacccagggggtcatgcacatagtaggtgctcactaagtgtgatgtgacttgagtcactctttaaaagagctcttcccagtgaagctttttattgcagtctctgagaaattagcactttctaaccttgtctctttatgatttttaaaaatccattgagttatactttatcattttctggagtccagaaaattttgatcttatctccttatgtggcagagggatgtagggcaagtttttctacattccttaagacctatcctagggcaatataagaaatgtccatagtgattgctgtagcttgttgactgggaacagcaaactgcaactcatgactcatagggatgttcccttccttgtggaccccggtgtttcttcacaggcatgtgagggtacttccggacctctggcatgcccatactcagggcttttcagaatgcacagtgggcacacgttatctttctcattatggcgtttagtgtgcttatcagtcatcctccaagtgcctccacttggatggttaatctggaacgcaagtcgtaggaattctttattattagaaactactgttatttgcgatcaatactaatttatctttgcacaatgctttatagatgacaataaatattcacatttggtatggtattatccttaggtcaggcctttgagaaaggttgtataggaagtattaatccccatttctagatgggagtactgagactctgggaggtgatgtgactgattcgtaggtcacagaatcggttggagatcaagactccacccagctattgggtgtcttctgccgcagtcagtatatcacctgcaaagagcttgtagacttttctactc

SEQ ID NO: 33130 - DNA, 1060 bp, Homo sapiens
aagagagacgtatgtctggatagaggtaaaatgctatggagtttcaggagaattaagttacttttaagttggggtaccttggaaaacttcctggagggattggcctgtgtaccttgaaaaataggtaggattggggcattgggaatgtgcttagtcgtgggctggagaggatgcaggtacccatggtattaaaggccaagatcctggaacttgaagactttattcagggaacatggtctggagcctagggaatgtgagggactggaagaggcagcttgaggccatgtcacaagctccttaaacatcttgctgaaggactttggaccttatctttagacagtggagagccatgaaacattcttgagcaaagaagaggcatcagggtttccctttagaaagatggctctggcaaaagtgggagagtggattgcagggcttggaggcagaaagggcagttaggcagttcaagccagtgaagaaggttcctaggaggcaggtgcagactgactcccagaggcatctgtctacatccagctcctctggacattgaccgcacgctcttgggaactgagttcaactcaaacctgcctaccctttaatgcagtgttcccaacccccaaccaggaactcaggaactcagatttaattcctgagtctaactaaggaatcatggctctgaccgtattaacctaagcctcatttccaccttccaggatagtcctccagtctgcaaccaaacatttccctcatcgaaggctttggtttactcactgttgcccctaaggctactctgagattttttttaaaaaatgttttcttacactgcagagtgagctgtgccctgtcatgttctgaagaaatgatgaacaatgcctcctttgttgacctgcaacctgggccaaaggggaaggaattttctttcttattttaaacagatggaaaagtggtgatgacagaaaattgtctgttgcttttggaaaacgtagggttttcctgtgtggtgaaaatcctcttggtgaaaggtgatgagcctatgaagttaccctcctttctgccatgg

SEQ ID NO: 33131 - DNA, 1510 bp, Homo sapiens
ctcttctgtccatattgttttcaaaggaatgaggtgtttaggtggctggaaaagcatttgtaggaagttagatttgaatatagacaaggtgggttattcacgttgagaatgttatttgaagaatgcctgtgaagccaggtgtgggttctactcagtgccatagatagactgagtcttctctcgtaggttaccattacatagtaattttgattctgaatttcacattaaattatttgagtttatacagacctaaattttaaaatctgtacatatattattttgatgtattaagatgaatattgctgatttaaattttatttatgcacatacttaaaggacagaaatgtctgggaaagtaattgttaaataatgatatgtaactttttaactttttaaataaataacaagatttttaatgtgtgtctccctcagggttgtttaaagttttttttctccctcaagtataaatagtggtaactatatgttttgtatcttctagcaccaactgctgtaaagcaatgctgcaaataatgcttgaatacaagtggctaagccaacaacagaataaatacttttatagtagttttataatcctgaaattcgaaagctttcccaattgcacttgcatctaaacaaaactgttgcagtttttactctatttattttgttccccatgtttatgaaagtcctgcacagtttcaaaggcatggtaaataatatatcaatgtttatgtagtctgttacagaaacagctatagataacattatccagtgaagagcaaaattcaagctttagaaaatattcatgcatgcaattttgacatatctaaaaataggtttttgtatatttatggtgggaggtggttgggaacttttaacaaaatggggtgttaatttttgtacagtctgtgggcatttacacatttttaatgtattaaaatttggtaattatgtgtacattaaattaataaaagttacttctagttatgatttgtgaattccctaagaccttggatttttttaagtaactttatatcagaaatgatactgcatctttatatttttaaaattgtattgctgctcaagaatggtaccctcttgtcaaaaaggcatacattcataattgtacattcagcattgtaaataatcttatgaaaccttttttgattgaagctattcaaaataaaaattttaatgaatgaaataacactttttttctgtgtctttattcatttgtttgctttttagtgacatgaatactgccctttgtggatttattttcctgcctaataatacttccccatttccttcttttttttttttaaaaaaaactggattttgaaggaaataagaacaacattctgcatatcatgccatgtgtgtgagcatcctggggaaaccccacagtcggatgcagtgtagagccaaatgttaaatgcgaggaggtctgagggcaatggtgaaatgaaatagaagagtagggacttataatctattaatagttgggaga

SEQ ID NO: 33132 - DNA, 1712 bp, Homo sapiens
atggatcatgtcaaatcatcaccataacatagcagtgaatcagtctcagtggtattgctgatagcagtattcaggaatatgtgattttaggagtttctgatcctgtgtgtcagaatggcactagttcagtttatgtcccttctgatatagtagcttatttgacagctttgctcttccttaaaataaaaacagaaaaatatatcgtcctaacagttaaattaacaatcaatccataaagtcctatatcttcattcagcaacccaaatattacatacatttccagaattttcttgattgttactttcagtgatattctttatattgggtacaggagaagtttggtgtttggtaggtttttcaacattagtttttgagactagtttacctcttcacatttatgctcacaaccctcttgttagaaaagtctgtgtttatatacaggctgtaagtttgtgattgataaaaagaagatgagtgttaattagcctccagtgaaaatatactgaaagcctgttttcatttgattccaatgtttcttccaaagaattctgtataaacatatgccaattccctatgatggtctagagttaggaatgagtgtttatggtgttgcttatagaacaactcaggtaatctccatttctggttttatattttctgtacaaactgcctgggttttatttttctaatcagcaaggtgcttcactgccttcttgagacgcctctcaaagctcttaaatggctcctgtgctatgtgtggtgttggcagtctaatttgcttctgttaaatgttgtagaacctttttcactaggaaataagattcatttctttcggcagtagatgtagattcatcttttaacgtttcttcaaatttgtttctgtcaggctttgtgttattttaaatggttttttaaaattttcttctatgttttcaattacctaaagacataggataatagttttttttaagttagaattttacctcataaaattttttgaggtttgatgtatgtctctgtcttatcaataatgaggcttaaaaaatactggatttgaatggctgccgttttttcaaagcaatatgaatttgatgagtttgttttatgccattaggtggcgccagaggtcagaacatgtctattttgaattggatcgttacaaatgagcatatttgatgcggaaatttctgggagaaaaaaaattgaggaaataaagttaaaaaattgacattcattgagccaaaagagatgtggagaaacatttttcacctttctgtttggcctgattaacatttaaattcttgccaaaattaaggtaacttttaaaaaacaccttttataggtggatccagcagtctggcaacgcccacagttaccacaacacagaaaactgatcgtgctataaaatggacgctaaactatgaaaacagtgtgacattgttctctgttcttccagagccagtaacatgcttgctcgtgctttctacttctagctgatcattcttttcccaacatatatttacaaatttaccaaattttacctagaattttaggaccaaatggttctcactctttatgctgcaaagacctggatgatgtttggtaactatagaaaaatagaaattacactcaggatcactgttactgctattgccactgatgattcctgcaaaaatataatcgaagttttccatcaaatgtataatatgcta

SEQ ID NO: 33133 - DNA, 1073 bp, Homo sapiens
aaaatagcagcttttcttagctatacctgtttaatctctgcttctggtgccgttttcatttgtctgcaaacaaattaaatagcccttggtctttaaaaacataaaaaaacgttgatcctggtacctgttactcctctcttctctaccagtctacttcttgagtagtctacacatgctcccttttgtgttttggccatttagttcttcaattcttttcattaaaaactttctgagtaatgaaatacttgtttttcatacaaaagaatatgcacacatatttaagttgttagccataattaaaaaatagtaaagagataacaccctgagtgtatcatccaacctgaaaaaatgaacattacctgagcacaagtcagtgacaaaagaaaacaaaaaaaaggtaacgttaccaatcaataaggcactctcatgtacctgttttgatgattttccctgtcattccctgtttcattatatacttaccatatatgtttgcagtcataaaagatagttttgtgtgctcttgaacttcatgaaaatgttatcttgttcccttttttctgtgacttgcattctcccatcaacattgtttgttgatacattattttattttcattgctgtatagtatacaattgtaggaatatattaaattcatttctccatcctctgttggtaaataattactgaacatattgctgctatgaacatatttttacatgtctttcagtgtatgggggtaagtaatagtgtatgaaagagtggagtaggagtggtttatcccaggtacaagcagtgagagagtggtgcgatgctgtagagaatttgcaaacagtgattaagcccagtagaagtccatctgctttttaaatattgccatgtgctggtaattccagacacttccagtggtaatatactccttccactactacccttggcaaaccattagggacaaaagtttcctctgctgtattctggtatcatgatgagcatgtactcttcagctaccacgtgccaagttgttttccaaagtgattgtatcaatcatccatcagtgtttgacatcctgttgtttcac

SEQ ID NO: 33134 - DNA, 1036 bp, Homo sapiens
aatatgagtcccacttttttttttttttttttttgagatggagtctcgctctgtcacccaggctagagtggagtggcgtgatctctgttcactgccagctccgcctcccgtgttcacactattttcctgcctcagcctcccgagaagctgggactacaggcacccgccaccacgcctggctaattttttgtgtttttagtagagacagggtttcaccgtgttagccaggatggtctcgttatcctgacctcgtgatccgcccgcctcggcctcccaaagtgctaggattacaggcgtgagccaccgtgcccagccccacattttttttaatccttttggtcagtggctcatggtaaaaaatatgtctccacctttggtataagtgttagtgtaagtttcagcctaagctactaaaactatatatatatatatatatatatatatatatactatatatatatatatatatatacaccctacacactggtatatataaacataaaaataatatagtatagtttctgtagaatgataaatatttacctgtagttttgaattgatattaacaaagtttatatttacaaataacatccacgtttaaaaatggcactgagacccttcatttacagtcagtaaaaagtaagttctttacccagtctggaggcttcatgataaagtttttgtatgtggtcttagtaaagtttgagtttgaagtggagttcaaataggaagttgtaaataaatgtccagatcaaaggaaaaggggaaaaaagtttgggctatcaatatattagaaaattttggagccacttttatggcttattattatacaagtatatgcttatatacatgtgtgtatatgtgtagatgtacacacttaagaaaatggccatgagcaagcagtttggtttttgagttaggaaagtgagacaaagtactgctgggtggatttgccattcccagctcccatagcaagccataaggtcagcccactttgaaaaatagtagatcaactcagtctcttggcttttggcta

SEQ ID NO: 33135 - DNA, 1046 bp, Homo sapiens
gaatattgagggacatctcagcaccggggactcgctaggcatttgcatgagtcaacttgtgatgtaggtaccaacatttaaccagcgaggaggtaggctcagggagagtgaataatatttcctcagttagcactgaaaagtgatagtgcttgggtcaagcccattgtctctgttttcactctgctaaaattactcccaaaattaaaaaaactgaggggggcttattaaatatttcctacttgattctaattttttaagtggttgagatgtcggactgaagagaaaacccttcatactcttgtacctgttttatatatcttatattgatattgttggaccttttgctgtaaatatcatatttctatttgttatgatagtgattcagggcaattaaggtaagattggtttcttttgggaaatgagtattatgtttactaatgcagacattttttgcatgtgttctagtgcttgtaatacaacaggaagcgggttttggaattcttcacacgtagacaatgaaaccgaacttgatgaacataatatacaaaattatgaaaataccacagtgttttttatttccagttttcagtacctcatagtggcaattgccttttcaaaaggaaaacccttcaggcaaccttgctacaaaaattgtaagtttggcatttattgtgatttccaccctgcttgcccctttaaaactaatgtagaagagaataattataactgtctttgccacagtaaaccagatcttcacagatagaatcaacttagtgatttagatgtttaccgttttgttttactttcattggtagttgccaccctaagtttaaagttcaagctaccagtgttaagcactgttgtttttcacatcatagtgcctctggctccagcttttatttctgcaacccattgtggagggagttaggatgggaagtggagacggaggttcctcagcccactgttgggtgagttaggatcgggggcggagacggaggttcctcagcccactgcggagggagttaggaatggaagcggagacagag

SEQ ID NO: 33136 - DNA, 1049 bp, Homo sapiens
ggaaatagtgtgtggaaattgaggaaagaaatatctcgctcttctgttttggtagcagtgggatccacaaacctttgtctgcttctccttaataagatcctgttcttgctgctcttctttcttctcatgactgagaagttgtctctcttgtttctcgtttacacctgttcttattacctgtcttacctttttgttttgtatgatcttgcttttgtaattcatcattttctatgatatggtgctggtgttcttgcacagaccactagtcactttgtaaagttatttcggtaagtatttattgagccacctgatctgtgtgtagcaccgtgccaggtattgtgtagatacaaatagtgcatgactggaaaagattgagaattatatttggctttaaaaattgtgggtgagatgttttctttagcatataacgtgcttgcgttatttgaggcttcttttgataagtatgctccaattttgttatttttaaactgtaagtggaagaaccatacattatcgttactctgccagcccagtcatggagactgtagtagattctcagcaagtacatgtttgatacgttcacgtttccattttaatttcaatacatttaaaatattttgaaaattaggtgacagtatgttgactgctgtctctgtggccagagattgtggaatgattctacctcaggataaagtgattattgctgaagcattacctccaaaggatgggaaagttgccaaaataaattggcattatgcagactccctcacgcagtgcagtcatccatcagcaattgacccagaggtaaggtcaagatcgactgtccgttttaaagtttgttgatttaaatttagtctgaaaaaataaaaaaagtggtgcattaaaacacagtaaagcaaaaactaaatgaaaacagaagtcagggctattttttcagagattatgtttcattaggactgggacagacccaggaatctcaatgttcaaattttgatatttagctaagatgagaagcatagttttaaagtacaagaattccagatgtttat

SEQ ID NO: 33137 - DNA, 1023 bp, Homo sapiens
tatgtacacttgcttgcaccccttagtttattttagtacttaaaatgttaatattttcaggatagcagaacatttgaaaatatttaagaacatactttttaaaaatgggaagtagtatagaaggaatcttgaatcctgactttgaaaaacagttgcttgtttcttttccaaataatgttttgtggatgcttagtaaactttttctaactttagtgtgttaatagagttaatctgtactattttttcttgttttgtttcgtttttaggagctgtttgaacttccagtaagtgaagaatgtttacttcttactaagtatatttgttttgattctttaagaatattaagtgctttgtgcctcttttgaaatgatataggctacttatgagataggaattgttcgccagttcccattttcttctgctttgcaacgtatgagtgtggttgccagggtgctgggggataggaaaatggacgcctacatgaaaggagcgcccgaggccattgccggtctctgtaaacctgaaacaggtaaggaaatatctatgctttgggtacaattctggtatttgagtaaacttgtattagcaactctaacaatgaaatttactctttcttttaaaaagttcctgtcgattttcaaaacgttttggaagacttcactaaacagggcttccgtgtgattgctcttgcacacagaaaattggagtcaaaactgacatggcataaagtacagaatattagcaggtgaggttgaacggctttcctagtttcccagtcatcatcatttatggttatattagtcatgcacagtaatttgcatgtaattgagtatttattgaatgtatgaaaagatatctaatataatattgttttaggtgattgaagtaaaagtacattttccccactgcctgatttcctttcattctgggtttttttttgagagacagtctcaccccgtacctaggctagagtgcagtggcactgccgtctcgggtcactgcaacctccgcctccccggttca

SEQ ID NO: 33138 - DNA, 1042 bp, Homo sapiens
tgaagaggcgaggtctcactgtgttgcccatgctggtcttgaattcctgggctcaagagatcctcctgcctcagtctcccacagtcttgagattacaggcttgagccactctgcctcgcacatacattcatttttttaagaactaaaagtatacatttcagttcctgagtttgtatcaaattcatttatttatataaaattgtatttttcttctatgtagcaggcactatgctaggctctggggattcggtgtagagataacagtagtaacagtaacaatacagtgtgacaaatgctatgataaggagaagtcagccaacttatgtattaggggagctcatttactgtaggtatcagggatgacttctttgattaagtgcttgtaagtgatgactatttgaattagccaaataagaggtaggtgagaagttgataaggggaggctgagagaaggagagaagagggttctaaatacccaaaggcctagaaattagagattgtgtggacattataagaactgaaagaagaaatttagtatgacaaatacagcaactataaatgatggatagctctctgaagcatgttagggatttgggctcagtccaaaagacagtggaaagccattgaaggctattattattaatttattttattttattttattttttcgatagagtctccttcccaggctggagtgcagtggcaatcttggctcactgcaacctccgcctcccaggttcaaggaattcttgtgcctcagcctcctgagtagccgggattagaggcatgtgccaccacgcccagccagttttttgtatttttagtagaaacagggtgttaccatgttggccaggctggtctctaactctgggtctgaagtgatccacccgccttggccttccagagtgctgggattacaggcgtacacaccatcacacccagctaatttttgtgtttttagtagaaacagtgtcaaccttgttggccaggctggtttggtactcctggcctcaagtgatctgcccgccttggcctcccagag

SEQ ID NO: 33139 - DNA, 1026 bp, Homo sapiens
tggagcttatcttgtacatatttgtatctttttgtttgtcaaatgaaaagatggacaatctgtatggtcattaatacctcattcagtttgactttaaaatcttgttttttaggttctcaacccattttacattttccagctgttcagtgttatactgtggagcactgatgaatactattactatgctctagctattgtggttatgtccatagtatcaatcgtaagctcactatattccattagaaaggtaagttcaaatttattatgggtttcacaactgtatttgtattttgtagtaacatctaatgtgtgtagaatagtactcagcacaaagtaaattctcaatgcagtcattattttagttgcatgaatatatgctccttctcccctccctttttgtttgttttgctggttgggaggttggggatagcaggtgctttgtagagtcaagactctaccacttgactgtctagagaccatagggatctgtagttgctgatcacagactggaatactggaaggtactgttttcagggctatcctgttaaagtgcttcttgttttgtcttgaactaaaacaatgaatactctgaatttctgactcgacattttataaagatggagtgatatgcatttattgaattaacttatttttttagcactctggcttttttcctgaggagtgggttcatattggctagtttctaacttctttttcctctttcagcaatatgttatgttgcatgacatggtggcaactcatagtaccgtaagagtttcagtttgtagagtaaatgaaggtaagtaattgaatgttggaagaataaatcaaaaaagatacctgttaggcataatgtgtgaagtaagcccaaagtataatacatatacattctttgattgattgattgattgagtcagtgtctctgtcacttaggctggagtgcaaaggcacaatctcagcttactgcagccttgacctcccagactcaagtaatcctcccactttaggctcccgagtagctgggac

SEQ ID NO: 33140 - DNA, 1050 bp, Homo sapiens
aaatactattgtaacataaggaattaagtggaaacatttaaactttaaaagcattttcttttaaagtcgaatgtacaatgttttgaactaaacactgttagtgcaatattaaaaaaaaaataagatccctcaaatttatttggcttcttgcaaaaaataattgtaattcaaaattgttaagatctagtgtgttcaaggatgcaaaagagaaccttttgctcacatggtattatagactagtgggaaagatacttgtcacacataaagatgtgagacaaaatgaagttaagtgctaccagtataggtatctactattgacttctttgttttaaattctgtaggtagagagtttgaattatagaagacaggtgtttggagacatgaataagaacagtctgtggtttaagccttacctaatacaatgcctttcgtaaattatactattatgatataatgtaatactatgaatgtattttcctgttatagaaaactgctttatggagtaaatgaaattgctgtaaaagtgccttctgtttttaagcttctaattaaagaggtaagactattgattgtatataacttaacagtcatgatcaatggatgtgtcaatttggaatgagttgtgattaaaatattcttggttttctttttcctaacctctttttcatatttttacttggaaggtaaagacggaagacatttactctggtagagaaagaatctggggcatgtattcttaaaattttgtctagttttgcttttattacctgttgaatgtctagcagagttaggctcaccaatcttcattctggtttttggctaaagctcaagaattagttgtattaggtgaacacttttaggagtagaagtaagattgtttttcatcagttcctgggagtggccatgtaatgttgcttatgagcatagcatagtgtagtgattaggaattggaagacctgattttaatgtagttccatcagtaactagctctgatctttagtacattctctctgttgctcctttacctataaacttggaataagttttttc

SEQ ID NO: 33141 - DNA, 1050 bp, Homo sapiens
tggcttgatgcttttatggagatggaagaaaatgaatagaaattcttaatttgactctaaaattgaaaaggagaaactatgtagctaaaaagtaaaatgttttcatctttggtttagaattctcaagttatactttatcttaaaattttaaagtttaattttagctattacagctttggcacagtcttaaggataatgatattattatataaatttgagtatttagagccatctcatctatcctgcaataaacatattgaatagcttcgaagttgggtttgagacttagatttgtcattgtttatcttaagaatttgagatttaaaaattctcatttgttatctcaatttttgttaagggtttctaaggatttgtaaggaagtcacacctttataaaatcaggcatatagaaaaatgaggcgttaagaaatttggatattttaaactttgtttaaagtaaaaactttggatttatttaggggactggatgaaggtgtttcttgtacgtcaatttatgaaaagcatagtgcaggactgacaaaggggatgcatgcctacaggtaatttttatccaactaaagttagatcttctcaaaattcctaaaagcagtagtatacataatcaaccctttaccatatagttgtacatattaacagatacttaaatattacagacatagtagttgagaatttattgatgttttatttgggtaagactgtcttagtttaagaattataaaaatgtgcaagctgatattttgaagttggtatccctgaaattataccatatttcatcagttcccaggtgcacgtttttccaccttttaacatctctgagattgggatgtgtcatagagttggtgaagtgtcgttcttgatagcatttttatctttcttgatcatataataatggtatgccttacaattgatagcaccttagattttctgaaatacaagcatgagttcaaattcaccgtaatgaaagattgtaaattgggagacataatctccttcattgtgttattccttgttaaatcataaaaatacacc

SEQ ID NO: 33142 - DNA, 1866 bp, Homo sapiens
ttttaagtaacatttttggaagatattttctaaaaaaacaaaaagttagaaaactggcatcgttttacatcttgcaaatttctttaatgtgtagctgaatgtttaatatttgaaatacaaaaaaaaaaaaaaaggaaaaatatgtcagtgggctcaatgaattttttccctggacaagttttgtaggtagtcaggaataatcagaaggttgcccagtggacttggaatcgaatgatggagtcagctgagtgctctccagtaggagtaaacctgccatagcgattgacttttggccagggattgccatttatgtaattggtgcttagtaaatatttattggatgattaataatctctgagaagtttttggcttggtttcattgctagtgccatagctctttactatgctacagtgaataattttgagttgtgtgaagtacttttagctcaagatggttaaactacactacttctgaatctgtggaatgaaaaaggaagactctgttagtagttcctctcaatataaattgtcctgtatcacagtagttgctagtctaaatgaattaatgaaatatgccatgttttgtggtagttaagtaatacagattcaagcactggtatcccattgaaaatgtcattagaaccagctagcactttagaaactacttaagggtcatctaaagtttgatacatcccatgagcaagtgatgaatacatcactactttggaagaattcaaatttaaacaaaatcttattaaatattaaaagaacacttcgatggtataaaacagtggtccccaacctttttggcaccagggactggtttcatggaagacagttacgggtggggagggatggtttcgggatgaaactgttcagtctcagatcatcaggcattagattctcataaggagcacgcaccctagatcccttgcacgcgcagttcacagtagggtttgtgctcctatgagaatctaatgcctctgttgatctgatgggaggtagagctggggcagtaatgcttgcttgcctgtcactcacctcctactgtgtggccctgttcctaacaggtccgtgacccaggggttggggaccccttgtataatagacagttgatagaatgcagttgtatcgtctactaagatagaagatagttccctaacgtctgttccctttcttccctcagtgatcttccattgtttgaagcactggacctttaatccactgtaggtatggacagggaagaaaggaagaccatcaatcagggtcaagaagatgaaatggtaaccagctgttctaatttactggtgatgtgtgaagactttatctctgcaatttattattttagggactagaaaaatgcaattaacaacagtggcggcagcagctaactcaatgggcttctttcttcatcctgtgcttttgaattgggattgtgtaatatgtctattagttgcttttagtataattctttttttacctgtggtctgttaaaactgagaagaagtatgtttttgcatttggtgatttaagaggtaacattggctaatataatcctaaataaaagatttaaatacaatcccaaataaagatttctaattttgacttacaaaaattttctaaaatcagcttaataaaaaaagccaacttcaacttctctactttttgttggggggagccagaaagatgtcaggtgaagtataagatgccctgttaaatgtaaaagtcacataatgaagggagaaatttttagtataaatatgtccaaatgttgcatgggacagacaaaaagattatttgaaatttaaatttaagtgggccacctgcattttcatttattaaatctggcaacgcttgttggggggc

SEQ ID NO: 33143 - DNA, 1652 bp, Homo sapiens
aagctactgaagttttatgtagagagggaaatggtcatatctggctgcatacagacttgaatgagggagacgagggctcaggacctgaatcaaggcaaagctgatggagataggcatggtgaggtggatttgagaagggtagtcaaaagatgagtggccggttggatgtaggtgtgagataggaagagttcgaaggtgacttctaaattcctggcttggctttttaggcaactcatactcattaaaggagtagggggaattggtggtggctgggtggtggggcagattttttggaagaaagagaaaatgaacctattgagtgttagctgtctgcaaacatgtagttgaatctgtgggtctgaagcacatgagagattagtgctgaaaatgtgaattggtagttgccatcgcgatggtccagtagtgccacccctgatgagattgttacaaagagaagagcctgaggaatattaataggaaaattaagaagcgggcagaggaaatggaggcttggtaacctggctacctgcccagcaacccaggctagtgtaatgtgaactgcagctcagcagagttgtaagaggtaaaatgggcatttgtgggctatcttaggaatctagacactattttccttatggagaaatgcatttcaagtacatgtggagtaagaattggtttttaaatgaattttgttccttgaaagatggtgctgcctacgtgtcattccttaaatttgttggtaaggctttttgatgtaaagtcaccccatgcttgactttctggtgaaaatgaaaaatactaatcttggttaagtgaagatgattttttcctggttttgaaaggcagtattctggtaagtaagagtagataatgcccatcaaagtgttgtgtaaactaaatattcccatacaggcgtcactattgtggttgttatagtgcctaaatacattgattgtggggtgtgtctgtgtgcgtgtgtgtgtgtatgtggttttttttaaatcctggatagtggcatacaggacagtcataggaggttagaaagttaacatttttatgatggttgtgctgtgaataaggtgattaacttcttcaatagcaacttatattactgtatttttgaagtatttgttgaatgtaaatgttacggcctttgcattgtctatgctgggttagcgtgggtaggtttcagattagacaaaggactcaagtagaaaaacccaaattcatgtaacttaaagttgacccaagtacctatgagttacatttatacatttgcaggattttactttttgtacagaatagcttcctagtgattttgtgcttctttgtggttggatttttcaaatcagaatctggaagagtgaaatatgaatcattctgtagtgtatgtagatcatgaggaaaactaattttgctttgtttcaaattgcacagtaattctgaagtgaaccatacagaagtaatgaaaaaaattatttttaggtttgctatcagtaagaaaaaacaaacatttctgaggtttatatgtttttaacacactgaagacttggaggtataacctctggaaaattttcttccactcttctttttttcttctctactcttccctattcctatattattccctagcatcccctttttctcatcct

SEQ ID NO: 33144 - DNA, 1049 bp, Homo sapiens
aggtgggttttcaccgtgttgcccaggctggtctcaaactcctgaactgaagcagtctgcctgccttggcctcccaaagtgttagggttacaggcatttatcactgcaccccgtccttttttctttttttttccccccagagaaagagtctcgctctctcactcaggctagagtgtagtggcacgatcatggctcactgcagccttgagttcctgggctcaggcgaccttcctgcctcagcaacaagggtagttgggacaacgggtgtgtgccatcatgtctggctaatttaaaaaaaaattttttttttttttttgagacggagtcttgtactgtcatcctggctggagtgcagaggcgcgatctccgctcactgcaacttccgcctcctgggttcaagcgattctcctgcctcagctttccgagtagctgggattacaggtgcccaccaccatgcctggctaattttttgtatctttagtagagactgggtttcaccatgttgaccagtctgatcttgaactcctgaccttgtgatccgcctgcctcggccttccagactgctgggattacaggcgtgagccaccacgcccggcctttaaaatttttttgtagagatgagtatctcggtttgttgcccaggcttgtctcagaactcctggcctcaagtgatcctcctgcctcagcctcccaaagtgtaggaattacagacatgagccaccttgcccagccaaaaccatgttctaattaaccacttaagttcaaatagcatgcaagaagcaaggaaattgttaggttctcgtttgagttttgttgaacatcatattttgagagtagagaagtaagagaggctcagatttctggcacataattttaattaagatttaggtttaaaaaaatgaaaaagttctgggctcaaattaatctggagaaaagtagatatttgtaaggtagaagaaggtccacagttaatcagttatcactagataactagtgattataaaaggagttaaaacgatttgtgttagtaggttatgcacagtgactca

SEQ ID NO: 33145 - DNA, 1033 bp, Homo sapiens
agagactgggtttctccatgttggtcaggctggtctcaaactcccaacctcagatgatccgcccacctcggcttcccaaagtgctgggattacaggtgtgagccaccgggcccggcctattctgtttttttatgctagaaatctgatctttaagtgttgtttaggaggtcatgtgcagtggctcacgcctgtaatcccaacactttgggaggccgaggtgggtgcatcatgaggtcaggagttcgagaccagcctgaccaacgtggtgaaactcctgtctctactaaaaatacaaaaattagctgggtgtggtggcacgcgcctgtaattccagctactcaggaggctgaggcaggagaatcgcttgaacctgggaggcggaggttgcagtaagccaaaatcgcaccattgcactccagcctaggcaacaagagcaaaactccgtctcgaaaaaaaactttttttttaaagtgttcattaagccaggcatggtgcctcatgcctgtaatgccagcactttgggaggccgagatgggcagattgcctgagctcaagagttcgagaccagcctgggcaacgtggtgaaactccgtctctactaaaaatacaaaaatcagctgggcgtggtggcgggcacctgtaatcccagctactcaggaggctgagacatgagaatcacttgaacccaggaggcggaggttgcagtgagccgggatcgtgccactgtactccagcctgggcaataaagtgaaaatctgtctcaagaaaataaataaataaataaataaaaataaaaaataagtgttgtttacagcaatatcaaacctttacaattatgtcatgccaccggctaaagttaatgcgtctccttttattgatttaaacagatgacctctacaagtagtcagaacttactctaattgaggccatttgtcttcatcaaaagtttttggttccaaataattgagaaagtaactcaaagaaagcttgtaaggacttgaatataggctgggtgcagtggttcaggcctgta

SEQ ID NO: 33146 - DNA, 1042 bp, Homo sapiens
tgaagaattgaaaatactagtgatctgcacaagtttatactgtgagatagcatgagaacttcagaatagaacctcatttcctgatttcagcagtgtagccttgaagaaatgggagaatccaggtttcagatactcagttccaagttgcaaacctatttaacaatgccatgtaaccgtttgaatgaccttggaaaacttgcttaaccttcccaaatactttccttttctctaagtgggggaaaatctatctcacggttgattatatttaatcagtatagctaacatatattgaatacttgctatgtgcttttctaaacccttaccaaataccttttagtcctcaaaaagcaacgcttaaggcagatactgctgttattcccatttcctcaaacttgaggaaactgaggcacagagaagttaaataatttatctaagctcttatagctagtaagcagtaaattaggaactctgctacctctcagcagcataatgaattaacttacataaagcatctaggacagtgcccagcatggaaaaaagactcaaagatggatttgttaagaactatgcaggggccaggtgtggtggttcatgcctgtaaccccaacactttgggaggctgtggcaggcggatcacttaaggccaggttttgagaccagcctggccaacatggcgaaaccctgtctctactaaaaatacaaaaattagctgggcgtggtggtgcacacctgtagtcccagctactcgggaggctgaggcacgataatctcttgaacctgggaggcggaggttgcagtgagctgagatggtgccactgccctccagcctgggccacaaagcgagactcttgcctttaagaaaaaagaaaatgaaagaaaaaaaaaactgcaaggtctgagattttactctacttataagctaataagttagtctattattgttttgtagatactagcagaaaataggagacttcatgaaattggcacactaatccgctggcttgtaagtagagtaaaattcccttcataactacacttaagg

SEQ ID NO: 33147 - DNA, 1035 bp, Homo sapiens
agtaagcgtgtgccactgtcacaccagctgactttcatccatatagtctgcagagtaaacagcatggagtgcttatcagtattcatcaggtcagagttactctggacattagattactggtaatttttattagctttgaagcaacttgttactaatgaagccttttaggaaactgtgggaagattgaacatgaatggtaaagaattggatcctaattccttatttttgctgattctatgcccacttaaacttttggcccttaatatttatttaggaaattcattcatcattcagttattcatttttagagacagggtcacactctgtcacccaggctagagtgccagtggtgtgatcataactcaccaattcactacagtctcaaacttctgggcacaaataatccccctgcctcagtctcttgagtagctggcattacaggtgcacaccatcaggcctggttgtttggttttgtttgtttgttttggagagacagggtcttgctgtgttgcccaagctgatcacaaactcctggcctcaagcaatcctcctgccttagcctcttgaggagctggggttacaggcacaaaccaccacgcctggcaatttttttttatttgtatctatactaagtatatagcttagggtgatggttatcaaactctgggttgtgtctggaagtcaatttagtggtctgcagctagctgttttgttttgtttttattttttccccagcaagatagagaaatatcagaatgttgcatgtaatagggtgtggtttcagtattcttctattgccattttactgtactgaacggtacttgaatgcttgtatcattatatgtacatacacctttgggtcactatgtaaaatgtatttcttattgtgggattatatcaaataaagttttgactaattttgactagcacagtcagacaatctgggttcaagttctacctgtgccatttagattttgactataggcaagttattttatctgctgaagccttagtttcatcatcagtaaaatggaa

SEQ ID NO: 33148 - DNA, 1099 bp, Homo sapiens
accacacacccacacacacttcacccacacacgcacaccacacacttatacaccacacacgcacacaccacacatacacctcacccacacacacacatactcagacaccacacacaacacacagacaccacacacaccacacacacacacaccacacatgcacacatacaccacacacgcacactcatacaccacacacaccagacaccacacacaccacacacacgcacacatacaccagacatgcacactcatgccacacacaaccacacaccatgcacacacccccacccacacacatacacacaacacacacacatgcacgcacactcatataccacacacacatatacccccacacacaccacacacacccacacctcacccacacacatgcacacatacaccacacacacaggcacacatacaccacacacacgcacactcatacaccacacacacactcatacaccacacacaccacacatacaccacacacacacccagccccacactcacatacatacctgaacacatacaccacacacacgcacactcatacaccacacacaccagacaccacacacactcatacaacacacacaccacacacacgcacacatacaccacacacaccacacagacaccacacacactcatacaacacacaccacacacacgtgcactcatatgccacacaaccacacacaccatgcacacacacaccccctacacatgtacaccacacacatgcacactcatacaccacacacgtacacatacctcacacacacatgcacacatataccacatacacgcacacatataccacacactcatacaccaccaacacacacaccatacacatgcacacatacatgcacacttatacactacacacatgccacacacagacacaccatacacgcacacacacgctgctggcttgggagagccaggcctggttattccgccttctcgagagtgtgcctcaaggtgttcagctatagtgaaggcgctgctgggctgtcggcctctgctgtggaagtaccttgcctgtgccctccttcataaaatgatgctcctgttcaagagtgga

SEQ ID NO: 33149 - DNA, 1067 bp, Homo sapiens
gagatttaaggggggcagctggaaaggaggatgaatgcgctatgggttaaggatgcactgggggttctggcttgggcgccctggtgggtgatgatgtggtgtgtcaggtaggaagggatgtgcaggcgtttgtcagtcatttgcctccctggggggctgtactgaggctgagctatcaacacttccctgagcagactaggactgcatgctagaaagggatggaagtgttctgagtctgcctcccaccagtggtgtggccatgtgccgtcagcttccctggccccgttgcaggttacaggtcctcatgggccctgggctcctggcatgccaggctctttcacttgcctggaccttgggtttcccaactatctgtatgaggagacggatgtttggatgtttaagctcccttctagctctgatactatgtcagcctatgtgatgtacacatttgcacaattacctctttcaatgatttatataatcatttcacagacccttcaaaattcattctgatcaatcaaatatcttactttttattaatacttcctctttctacatggcgttttgctcttcagaaaaattacacacacacacacattttgtctcactctgtcacccaaggtggagagcagtggcatgatcatggcttactgcagcctcaacctcctgggctcaagtgatcctcctgcctcagcctcccaagtagctgggtctacaggcacgtgtcaccatgcccagcaaattgttttgattttttgtagagatagggtctcagtatgttgcccatgctggtcttgaactcctgggctcaagtaatcctcctgtctcggcctcctaaaatgctgggattacaggcatgagccaccacacctcactatttttaaacttttagcattgtctatattttctttattacatgccacctcgaaatctttgcaagtagatggggcctgaggaataactaaatcaatacaaatacgtgaattaaaattttgattccagcacctttttagcaagtccatggcacccctggaggaactgacaaagacacccaggagtaacacaaa

SEQ ID NO: 33150 - DNA, 1067 bp, Homo sapiens
tacaaagaataaccagagcagagaaaaggcacccctatttcttctgccggtaccttcctgccaagatgttggcagggtttaggaggggtacggagtgtgaccttggtcttgcgggccacttttctactcacatctcacacccttttagctgctgcccaaggttaaaggcatcacacagaggatcaaggaaacacacttctgcataaaaggagtagtagaatccttgaggcccttttggtgcaggggaaactgaaacagaaaggaggaactgtttggccgggcacagtggctcacacctgtaatcccagcactttgggaggctgaggcgggcggatcacggggtcaggagttcgagaccagcctgcccaatgtggtgaaaccccgtccctactaaagatacaaaaaatttgccaagtgtggtggcacgtgcctttaatcccagctactcgggaggctgaggcaggagaatcacttgaacccgggaggcggaggttgcagtgagccgagattgcaccattgcattccagcctgggcgatagggcaagactgtgtctcaaaaaaaaaggaggaaccgtttgaccccctttgccagccagaatctgggagagatttgtggatgaaaaaacccacaaatcaaccccaggaatacctggatggcatgtgattagccagccatttgcaccgatcagattagaagaggcccagtccccggtccacatgccatatcacactcgagatggagtggagtgggcggttggccaggcacggtggctcatgcctgtaatcctagcactttgggaggcccaggcaggtggatcacttaaggtcaggagtttgagaccagcctggccaacatagtgaaaccccgtctctaataaaaatacaaaaatcagctgggcgtggtggcgggtgcctgtaatcccagctacttgggagtctgagcaggagaattgcttgaacctggaagcagaggttgcagtgagccaagatctcgcccttgcactccagcctggatgacagcaagagtccatctcaaaaaaaaaataaaaataaaaaataaatatata

SEQ ID NO: 33151 - DNA, 1209 bp, Homo sapiens
tagtggagttaagggagttgttgaattgggtcagagtgttttggggctggaaaaactctgaggtacgatcccatcatgagttctttttttttttttctttttttttttgagacggtgtctcactcttgtcgcccaggctggagtgcagtggcgcgatctcggctcactgcaacctctgactccctggttcaagcaattctcctgcctcagccttccgagtggctgggattacaggcacgtgccaccatgcccagctaatttttgtatttttagtagagacggggtttcaccatattgcccaagatggtcttgatctcctgacctcatgatccgcccgcctcggcctcccaaagtgctgggattacaggcgtgagccaccgcgcccggccccatcatgagttcttgaatctcctccatggcctccctggagtgtggagttgtccagtggaaactacgtgaaggcccagggacagggagctgccaccttcagagtagcctcttccatcttcagacatattttagaaaactctttcttatgttttccaaaacctgcttttatctcttgatgcttcagctctcgatctcaatgaagaagcctatttcctttcttttacaaattcagagagagccttccatcaggggaaacagtcccggcttccccatgtgctccctggtggaaatatctctaggttccctgctctccagatacctgcttctgaatgcacagcagttggtctctgctcccctcaagtacggggcccaggtgtgaagaccgtgcttcagagctgggcactgggagagggcagacacaaaccggagtgcagagtacagggctattctcagctccctgcgtgaaaccagggagctctgcctctgctgatggagctgcgccaagtccttatttgatggccgcgtcctgctggagacactgagtttgcagtggcaccaaatcctctgtgtgtgccctttgttgtggccgctccacatttccaggatggtctccacccagaatttgatttgaacgttgagaccacataatagggttttctggagagagcagggccggcttctcaagctggtctgaaaatgaaagacagggaagagaaaggagaaaggagactggtctggggattgtatggtgattagcggttaggtttgggcgagggttccgtgtgggcaggggcttacatggtttgaaccttctgctgc

SEQ ID NO: 33152 - DNA, 1073 bp, Homo sapiens
gtgagtgtgtgtgtgtgcgtgtgtgtgtcagggagagagaaagcgaggaccttttagccacagacccatgccagctttgcttaagatgatggtagttttctctctctctctctcttttttttttttttgagacagagtcttgctctgtcgccaggctggagtgcagtggtgcaatctcagctcactgcaacctctgcctcctgggttcaagcgagttttctgcctcagcctcccaagtagctgggactacaggcgtctgccaccacgtccggctaatctttgtatgtttagtagagatggggtttcatcatcctggccaggctggtctcgcactcctgacctcatgatccacctgcctcagcctcccaaaatgctgggattccaggcgtgagccactgtgcccggccaatgatagttttctctaacactatgtgtggtgaattctaagctctattagaagcaaaaacctgaggctttttaaaagcacttgcctcgccgcctcctttagggctgtgtctgacatgaccgtcatttcctcagttggttatcagcctttcttctcccttgctgagctgtcaactgatgcccccaccttcgtctcagcctctgttccgggggctgacttgactaatgtgtccccaagttgcttgatgacctcagacaagaagcacagcagtgcctggcctcacagccccatcagcatggaggatgacagtcccagcacactgctccaaggggctgtgaggaataaataataggccaatggcaaaaacactgggcggaggaatcctgctggagagacactgacacagtggagagaatgtgtctgtcaggccatttgctccttactttaaaggcctgagtggtggctagagctctgttctttgtgttttacagagggagatgttaatgttcgattcacttcttttgtgggttttctctggtgcctgcatgttccttctctgcactgctgtcagtcccaagcctgggggtggcatggggtctgctgctgtcttgaaggatatgtgggcccccagggattttcagtgaggtgaaggggtgggtacaggcca

SEQ ID NO: 33153 - DNA, 1131 bp, Homo sapiens
ggcattctgggccagggtgtgcgggcggccggggcctcagcctggactgcagctgctgctgcccagatggtgtcagatccctgtgtgtccctctggtgtgtttgccaagccgcctctggggctgactctgctgagcgtcttctctttgtcccgaactttgtgcactgtccctggctggagaagactcatttctgtactcaagtcctgtgtgtagttgctgatggccaggtcctgctggtcagccgccttggacggagtctcgggcctgcttttccgttttctgtccccttactctggcttctggatagcctttggaatattccgggcgatagctgggcctccagagagagtgggctgcagggtgtgggcccggcctccccttgcctggcgggttttcctggtcagcgttcctgctgctccccggtcatccctcctgtgctgcagcctttttctctggttcagacccacactctgccgtcccactgcctgggcttgctgagctctccgttctggcttgaaggcctcgcccgagccctgtcaccggctctgcctgtcaggagggcccaagtgtgcggcttcggtggggctgcctgacactgacctctggggttgtaaaggtcccagagggtcctaagtcgggcctgatgtggctgagatggcaagagccggaacgtttctgtaaaatctgaaagcccttgatggggccgagggggtgaggaggattcccaccctgtgtggacaggagcacgcagcagcggagtgactccaccacgtgagtggggtccagcgggtgtggcactcgatgacaagacagtttgagagcggcttgtctccggggacctggcgtaggtctcctctgccttaacccttggcttttgcacttcctctgtctgtcctccatacaggcttcttgccctagtgaggactggcttcttaacagggtgagccggttcctgtcctaaccccactggcatcttacactctgggagatagcttccccctgagaggcgagtgagccacgtaaggggaggtgggcgatggcttcccttctgtcttgggttgggggagtcaggtacagtattttttcttttaaagcatcattgatcacataataaggtttgtcatagtcct

SEQ ID NO: 33154 - DNA, 1031 bp, Homo sapiens
tggcttgccccctctcctcctccagatcttcccggtggcattccgtggcttgccccctctcctcctccagatcttcccatggcattccgtggcttgccccctctcctcctccagatcttcccggtggcattctgtggcttgccccctctcctcctccagatcttcctggtggcattctgtggcttgccccctctcctcctccagatcttcctggtggcattccgtggcttgccccctttcctcctccagatcttcctggtggcattctgtggcttgccccctctcctcctccagatcttcctggtggcattccgtggcttgccccctctcctcctccagatcttcccggtggcattccgtggcttgccccctctcctcctccagatctttgtgcaatgaggccatccctggccgtcctgtgtgaaatcgtgctcatcttctgtgatgaagggccctggcccttccttgctttctttctcttcatagttcttatcgtctgctcatgtggaatggattttgcttttttttgtttgttttgatcatctatctgccccacccagatgtaagctccatgggggcaggaagttctgtgtgtttcattcactgctgtgttcccagttcccagagcgatacagacacatagtaggcagtcaataaatattcatcaaatgaattaaatgaataccgttttgttaggtgttatcttgaactactttattttaggggtcccctcagtctgccagagctggctcactgccttcgccctttttcttcttttgagatggagtcttgctctgtcacccagcctggagtgcagaggctcgatcttggctcactgcaatctccacctcctggttcaagcgattctcctgcctcagcctcccaagtagctgggattacaggcgtgagccaccacgcccggctaatttttgtatttttagtagagacggggtttcaccatgttggccaggctggtctcgaactcctcaccttaggtgagtcacctgcttcagcctcccagagtgctggga

SEQ ID NO: 33155 - DNA, 1015 bp, Homo sapiens
aggctccattcattgtactgctcggggctgtgagtggctgcgtctgatcgtctcttaatgtccagtgtagggagcactgaggcaggcaggtctgagcaggctgaaagggggattggtgtatcagagagagtaggagtccaggctcaggatcggacagagctgagtgcagattgcaacactgtgactcccaaggtcaaggcttcgtgatcttgggaggttatttaaaagaggccctatggtgtcgtggttaagagcatgggcccggccgggcgaggtggctcacgcctgtaatcccagcactttgggagaccgaggcgggcggatcatctgaggtcaggagttcgataccagcctggccaacatggtgaaaccccatttctactaaaaatacaaaaaaattagccaggtgtggtgatgggcgcctgtagtcccagctacttgggaggctgaggcgggagaatcgcttgaacccaggaggcggaggttgcagtgagcctagatagcaccactgtactccagccggggtaacagtgtaatagagtgagactctgtctcaaacaacagaaaaagtaatgctgccaaaaatgcttcatatatccgccccagcctcccctccccccagctcccagcatcagggtttctgaaatctccataacatttagcatgtgattattgccaccatcagccccagcctgctcgtttcctgcggagatctatgggagtggataaaagaccagacaaatgcaagctgttataaaatccctcaaaaggtaggatttgggcccgagcctctgcccgaatctcttgaagcctagtgtgacgcttgccattgtagaaaagaacagcaaagccagctggcaacaaattggggtggccccatccagctctcctggcctcctgagtgttatcacccctgagagtccttatttcagtgtctgtcatgggggccttactgtcttgaggctgcaggcagatggttggtctctttcaaggacattcttgggtccactttggg

SEQ ID NO: 33156 - DNA, 1032 bp, Homo sapiens
gcaggctgcttttcccctctcagctgtttgtggtgctgcctgacaaaattcaattactagtccatccaggacatcctgcagaagcgataatcgtcacatgagggaggggcccagcctgtggttctgtctttttctttccttgtaaaaactgcacgtccattatgactgttaccttttccatttaaagctaaccaaattcagagcatttaccacttacccttgcagacctttgttttcaaagtgagctcaagttattggtgggggcaacaggcagccactgatagtgtcttcaggacatgttagtgactaagaaaagagagatcaatagacctgtggctctacccgtctatcactcaattatctgtctgtcactccaggaaaacctcatttaaggaaacacctttgatataatttcagacataaattttagattcgggcatggctattctgaagtagtaatagagaagttattaagaataacttttaggcagacagttaaggtaaaggttctcggtggaaattttcttataataagaaacaacccccgaaccatctctttttttttttattatactttgagttctagggtacatgtgtacaacgtgcaggtttgttacatatgtatacatgtgccatgatggtgtgctgcacccattaactcgtcatttacattacgtgtatctcctaatgctatccttcccccttccccccaccccacgacaggccctggtgtgtgatgttccccttgctgtgtccaagtgttctcattgttcagttcccacctatgagtgagaacatgtggtgtttggttttctgtccttgcgatagtttgctgagagtgatggtttccagtgtcatccatgtccctacaaaggacgtgaactcatccttttttgtgtctgcatagtattccatggtgtatatgtgccacattttcttaatccagtctatcattgatgggcatttgggttgccgaaccatctcttttctaacagaaaaggcgtcttgaagggctgggccagcaagctttga

SEQ ID NO: 33157 - DNA, 1064 bp, Homo sapiens
gtgccctgggcaagctcttcagcctgcacctgcccctgggcgctcacttcagctggagtgtggtggacagagtcctgcccagatgttattgatcctgagttctgggtcttcctctgaccctggcttctgttagcaaggccttctgatgtctttgcctcagtttctcatcataagaggagtggggacgctccggctctgagtaacagtctgttctcttccaggcgtgtataaacagtgctgggggcttacagagctcatgccctttccagaccccatcctgaatgtgcgggtgagaagttgcggggtgtgaggaggctgctcttcccctctttctgggataatccctggaatgaccctaggtgaggcttccgtgctgacttcccttccgtcctctgggaggtactggttcgtttctcgggccctgccctgtgcagggccgcacctcaggcctgcgcggagcatgagggcgagggacttggaatgaccagagctgtctcaggtttatcgtcaccgtcaatgagccacagttgccaccatcgcaggagaccctgggtggcaggcaccatgctggatcctgcttttcctccctcatttaaccttggagcagccaggcctgtgaggggtagctagtctcccctaggaagaggctgcacagatgagcttgctcggagccatgattggagtccggcttgctgattcttcagcactctgcccgatgcctgttgattttggcggtttgttcttgtccctccaaagccaggaatgctctgtgagagctggggccccaccagaagggttcccacggtgcccctgtgcctgctgctggctgggtggcctcttcccctggtcagctgggtggcacagaacaggggaatcccagggctgcccggggtggaccttccctccctcctccaggagctgcccatagaacagcagggagcctctttctaggaggtgggatttacaggctgagatgttggagccccacctccctcatttagctgcagaagaggtctgggttggagggagtccagactctggtcctggagttgagtctattcatg

SEQ ID NO: 33158 - DNA, 1917 bp, Homo sapiens
attcttctcatggcgctttgcttgctctgcttctgagcatctgttgtctttctgtcaagtgcagtctcacacttgtaaaacttagatcaagacttatcccttccatgtgcctttcctgccagatcaggtttgacagaatataccatgaaacccccaaataatggtggcttaaacaaggttgaatttatgtctcgtttcaatgcagtccagaggtaggcatttctgggctggcatgggggcttcgtgaagccaccacggtcctcggctccttccagctctgtgtttcaccatccctgagggtggcgctgtcttcgtggtccaggatggctgccggggctggggccatcacatctgtgttgctgggtcgcatttactccagtttagcccagtgctgctgtgtgtattgtttcgggtccagtctcatcacatggttctactctactgacttctgggaaaatgatcacagtgaacaggcctcaaggcgcctctcatgtctcctctccttccccatgctggccagctctctgcagaggcggtggggcccaccagccactgcttgtatggcctccatggagcacagcaatattgcttctttgtggtatttgccttgtgctatcagctcaaatcttaactgttcagaaagaccttccccgaatctcttgtctaacgcaagcctcatgccagccttcatctttcccatcaccttgtgcatttttttcttttttttttttttgagatggagtctcgttctgtcacccaggctggagtgcaagggtgcgatcttggctcactgcagcctctgcctcctttcaagcgattctcctgcctcagcctcccaagtagctgggattacaggtgcctgccactacgcccacataatttttgtatttttagcagagatggcgtttcactatgttggccaggctggtcatgaactcctgacctcaggtgatccacctgccttggcctcccaaagtgctggcattacaaatgtgagccaccgtgcctggccttttcttttactctttttttttttttgagatagggtttctgtctgccgcgcaggctagagtagagcacagtggtgtgatcacagctcactgtagcttcaaactcctgggcttaggggatcctcctgccttagcctcctcagtagctagaactacaggcatgtgcctccatgcacagctaattttttttaactgttttgtagagatgggatctcaccttctttcccaggctggtctcaaactagtgatcctcctgccctagcttcccaaaatgttggactgcagttgtgagccaacacgcccggctgtgcatgtcttttatagcatgtattcattttttcatgtattcattcatagggtgttgttaagtgcatatcctgtgccagacactgttctaggtacttgtgaacagcagggaacagaacaagtttctgccttcatggagcttaaattctggggttgcagggaatgtataggagatggatttttaacaaataaatatggagtgagtcagattgtgatcaattctacagagagaaataaagcaggctgcagagatagcaagtgtgtggttgtcagtgtggggagttgttcgccgtggtgcacgggtggccagggatggctccacggataaggtgccatttgtgcagagcctgaaggaagtgagggagccacagccctctgggcgggactccgtccgaggcacctgcaagtgtgtgggcctcaggttggagtgtgctctgcatgtttgagcaagtaactatcctgttaacttgtttgtagtctctctgtctccctcctggaaggtaatctccagaaggcagagaccttacctaccttcatctattgaggtttacgggaaccccatagatgccatccttatttcttggcctgagttggaaatgat

SEQ ID NO: 33159 - DNA, 1021 bp, Homo sapiens
ctaatatcggttaaataaccagtttttcttttagctcagaaatgtacgagaatttcactggaatgtttgtcttaactgtgttttgcaaaaggatagttgaaggatgaaaaagcttgagctttgtttttatttgctttttcgaaaagtattaaaccattaaaataagctttacaatattgcattatggattagctttaaaataatgcatgggtgattaaccacgtgtgttttccctcagattaatgttcttcaatcaaaaaggagatcagaaatcctaaaatcagtaagacattaattgaaatgatgttttaaatattttaatatgaaactaaatgtacgtatttaggtgttgaaagagcatctgctatatacatgataaggtttataattgctcttctttttgatcttcatttgtgtttcttatgtggcactggacttctttttgtctccttcatgttacagttgtttgtgtgtctcatctgttgatacactgtgaggtccataaaggtagactctatactgttatgtttttgttttcttttatcctcatatgttgctttacatgcactagatgcccagtaccatttggtgaataactaaaaatgtttggtataaaaacctgtgagaatatttcagaatttgttttgaaagttatcaacataaaaaactgttacacttaggtttttaattttttcttacttgttttgctttaaaatttttttcccagcctctttcaacatatttacatttttctctataatttttggcattatttggacttcaaaaatatttgagattgaggatttatatgaatagtatcatttggagaatttttcccttaaagttgatggtgggtcagtcttttggtttgttcttccgtatgcagttacaaaaccagtgggatgaaatttggggatcacttttttccttgagcctcttcacccacttgacaatgaatttttttttttttttgcggtggggagccctatttttggtcttaaagctaacgaaggccgggtgt

SEQ ID NO: 33160 - DNA, 1588 bp, Homo sapiens
ctccagcctgggcgacagagcaagaccctgtcccccgcccaaaaaaaaaaaaggatttatcttcatatttactgagttgttatatgttttgcagatattttcttccatgctttggcttgcctttttcatttttgtagcagtgttttttaaagatcaaactttttttttatgaagtcagtttattgattttgttcttttgtagttttcttttgtgttctgttaggaaatgtttgcttaaccctattcagtaagatttttttcaatgttttcttgtggaagtttaggtctatgatctatttcaagttaaattttataaatgttctgtggtaacggttgaagttctttttcctctctattattattaaattctttgcatgtggctctccagcttgctctgtacattttcccatctttattggcaccttttgtaaaaaaaataaatgaataaaagctgaccatatgcgtgggtaatttctgctttattgatctttttgcttgtcttttttctttttttttttttcctgagacagtcttgctttgttttctgggctagagtgcagtgaaatgaaaatgactcactgcagcctccacctcctgggctcaagtaatcctcctgccttagcctcctgagtagctgggaccacaggcacatgctacacccctggctaattttttgaatttttgtcgagattggggggtctcactttgttgccaaggctggtctccaactcctgggctcaagtgatcctctcaaactgttgggattacagacgtgagccactgtacccagactttacctgtctttatacagtaccatacttcattgattactgtagctttcatagtaagtcttgaaatcaggtagtatgagtattctaactcttttcctctttttcaaagttattttggctattctaggtcctttatgttttcatataacttttagaatcaacttttcagtttctactgagatttggagtggaattgcgttgaatgtatagatcaatttgaggtgaatcaacattttgctaataataagtcttctaatctgaatagtatatgtgttactcaaagtagagggccatgattctgtctatttgtgtgtgtatgatttgctcactttatttgacaatcagtggttagttcttgtccacactgactttcgacagatttttgaaagtggtgacagacacataggtaatcaatgtatagagcttgtttggtgaatgttcagcctcatcatgttttctggaaaaccacatatgggatcctatgagatattgcttgttcctttgttccagacagctttgttttgcctggtgtcaatgcgcacatctagaattcccatctccttcatggcaaatttctggatctctttgagtgcctgagggccatgcttcttgaagcccactccatggatgtgcttctgaatgttgctggtgtaccctcgggtcaccttatcgatggcaggatgtttcttcttgccgcccatctttgtggagccgttctgctggacccaaattagaaaagaagagcatgaaagattgtctccatttgtttttttttttaatttctctgagcatgtttt

SEQ ID NO: 33161 - DNA, 1026 bp, Homo sapiens
tcctctgtaaaatgaaggggatttactagatgactttccattattaaaaatttataaaatcatgaggcatttattataagatttaaatttggtctcagagccatttgttaacatgtaggaaaagcctagttacataaaatgctttatttttgtagcattctctggaattctaattacatagcatcccaatataaaggatgattaggaaaaactgctttctaaaagataataaatagtgtaacctgcattagattctctagcagagctcataacagttgggctttggtatatcagtttgtgtaaggataaaagtctggatattccagaggtgtcatttaccaactttgtgggcttaaatagatgtttgaaaataataaaaccatttgtgttattagccacgtaaagattaaacatatgttggagtcagattgtccagtcatttaataaaataaatcatttagattatcatgtaatttatttatttatctgtaaaaatggatagaactcttcttattccttttagaatgagaatatcctaggtttctctttaactcatatgtttttgttgttgttgttgtttttgtgaaatggagtctcgctttctctcccaggctggagtgcagtggtgcgatcttggctcactgcaacttccaccttccaggttcaagtggttctccttcctcaggagtattatgtttaaacttcttttgttttatcacaatatatatatatcttttttgagatggagtcttgctctgttgcccaggctggagtgcgtgaccttggctcactgcagcctccacttcccaggttcaagtgattcttgtgcatccgcctcccgagtagctgggactacaggcacccaccaccacacccggctagcgtttatattttcagtagagatggggtttcaccatgttggccaggctggtgtcgaactcctgacctcaagtgatcggcccaccttggcctcccaaagtgctaggattacaggtgtgagccactgcacttggccttaatgcatat

SEQ ID NO: 33162 - DNA, 1050 bp, Homo sapiens
ttctttgtttgtttttgttttgagagacagagagcctcactctgttgcccaggctggagtgcagtggtgcgatcttggctcactgtagcctccgcctcctgggttcaagcgattctccgtgcctcagcctcctgagtacctgggattgcaggtgcaccaccacacccgcctaattttttgtatttttcgtagagacagggtttcgcaatgttggacaggctggtctcaaactcctgacctcaagtgatatgcccgcctcagcctctcaaagtgctgtcattatagtcatgagccatcgtgtccggcccccttttgctcagtttttatttgggttgtatgttttattgttgagttttaagagttctttgtatattttgggtaacagttctttatcagaaatatacatataattttttttggtaaatattttcagtctgtggcttctcattgccttaagcaatatttactttaaaataaatgtgagacagttttgtctgttgactatacttttctaatgaactgatgaatgttgtgacataagaaattagactgtggtgtacctcaaccaaagaaaatacggcaatagcaatacaattttaaataagcaaagactttcaaccaaaactacttacaaaaggaacaaagtttaaatgccttaaggtctaaatttaactgtggaatatgacaaaaatcacattaactgttcaaccatgaatattttaatttttcttaaatatttaaaatggaatcttctgttactctgtgtcctcttatcctgcttttcttaaaagcacttgtaataccttacatgtatacatatttcatatctgtttactaattgtgtttccttcacttagatgccgtgagagcaggggcttgttttaccgcttgctgtttcctaagtctctagtacagtgcgtgacatccagtaagtgctcaaggaattttttatgaggaaacaaaaaacacaacttatactctactatttaagttattttttaaattactacttatttcaaaggcagttacggttttaatttgttatcttca

SEQ ID NO: 33163 - DNA, 1044 bp, Homo sapiens
agtattggaaaatatacatgaaaatgtatgctagcttgggaccaggacagtctgtctaagcatgacaccaaagacaaatgccttgaaatagattttactatataaaaatattacccctccccctggctggtctgaaggtagtcagtgatctcagttgattgttcagtcagttacagattgatctccttgttctgctccttcccctcttctcactactgcatttaactagtcttaaagaaaaaatttcttctcccccagtaagtgaaagataggaaaatatttgaaaaaaagtgaaataactttcaaatcctatgtatttggagagcacggaaaaatgtcctgcaattccagttgaatgaaatgttgcatataggccgatctacccagacagaaagtcgattaatggttgcctagggctgggcgcagggaaagaggtaatgggaagtgactgctaatgggtatgggatttctttttgggatgatgaaatgttctaaaattagactggggtgatgggtgcacaactctgagtatattaaaaactattgaattgtacacttcaaatgggtatggtatttgaattttgtctcgataaggcagctaaacatttttttatgctgatactacctcagtagaaaatgggctaatatcataaaaaaaggaaattgaagcaaagaaacagaatagaaaacaatacagtctcttgcaagcatctccatgttattatatagtgtctcaatatttttgaatagccccatatataatatttagggtgtggtagtcactacaaaacacttatgtaggacagtgtttttatctggacttattgtttatctctttaatagttaagcaactattataaacaatcttgaagctgcgttttaaggcagaccgagcaaggacctgaaacaagttaatggcaaattgatagagcagttacttggcctgggtgcggtggctcatgcctgtaatcccagcacttggggacgccgtggtgggaggattgcttgaggccaggtgtttgagaccagactgggcaacatagc

SEQ ID NO: 33164 - DNA, 1009 bp, Homo sapiens
caacttatcaaatgagcaagtcacaagcaacaagaagttccagtaggtcttcttaaggtggcaccatatgagctaacaaagtaaaagtgagaagcggtgacgttttcagcaccagatttaggctgtaggaaaaccagtcacccaagagggtgggggaaaactgaaaccagcaggtgctttcaccatcatggcagatctgccatgtaaatggtggtgcccctatttttgtctgcagggatactgacctcaaaggaggtcatacagttcatgatggtactgggattaagctcaggctcactccttgggttttgctattccacaactaatgttaattctgccatcactttagagatgccgactttcatatccagtgtcccctgctgacagtttcttctacttcactaactttcgaagatttcctagcatttttggagtctgttttgtaatacccttatttaaatgcttgtttttgcaagctattgttgtctttttttggatctgaataattgtactaatttttttttctgttagtgttctgttgagaaaacaagttgagtgagactttgaatatttagaacttaaaatttcatttacagaagaaagtaaactaaatggcaaacaaactgggaaaaattgaagttatataaaatgtggtttatataaatctaaagagctcaaatttatgggaagatttctgataggcaaaggatgtaaacataattcacatgaggaaattaggcaaagaaacaacagttttaaaatactgttttatacctgctgaaatggaaacacacacacacacacacacacacacacacacacacacacacacacacacacacacaaaatagctaatcctagcaatggtttggtaatttactggggacgttccaaacagtcctctttttttaaaaaaaaatctgtatggcaacatggagtgaactataaagttcttaataaactttaattcagactcttacactagcaaattttctttaaaacagcattg

SEQ ID NO: 33165 - DNA, 1817 bp, Homo sapiens
ttgcatctgggatgcaggcactccgtgtcacctgtctgtcgctgtctcgggtggttcttactgatttgcacccgggacgcaggcacttgctgtcacctgtctgtcactgtctcgggtgtttcttactgatttgcacctgggacgcaggcactccgtgtcacctgtctgtcactgtctcgggtggttcttactgatttgcacctgggacgcaggcactcgctgtcacctgtctgtcactgtctcgggtggttcttactgatttgcatctgggacgcaggcactcgctgtcacctgtctgtcactgtctcaggtggttcttactgatttgcatctgggatgcaggcactccgtgtcacctgtctgtcactgtctcgggtggttcttactgatttgcatctaggatgcaggcactccgtgtcacctgtctgtcgctgtctggggtggttcttactgatttgcagctgggatgcaggcactccgtgtcacctgtctgtcgctgtctcgggtggttcttactgatttgcatccacataggctttgggctctatcccacctgtcgtcttcggattctctaatacgcaggagtgctcttctgttagtttactcatagtttattaaagtacagagaaaagacatccaggatgataaattttacagtccttgccggggactgccagcttccagtggtgttgcctggcaccagtgtgacccccggtgcctgccccgctgaaccttctgtaaactgtttaactgtgctggtggtttcccattctctaggcgctgagatgcgtctggagagccagagggcctgcctgaaggaatcacctgagcctgtccgtccaccaggagtggggagatgcccccatccagtcctggaggacccgctgctcctgctgctcccggggatggagcaaggccaaggctgcgggaggctgggagccctgccctgcccatccctcctgcaccagcgctgtccctgcacactttggttcagtcccggtgcccctgccaagatgtggaaggggccgggtgaagacaggcttgagggctgccccagcaggctctgggtatgacctgcctctggccctggtcctgggcggggcctgtgggtggagtagtacccccaggccctgccctgggtgacagactgggaggaaaccaggctggacctgggcaggcgggatgtgttggccacagggagaggcggaccggcacccggtgggacctcctaggactgggccttcttccagggggcccctggcagcagctggggtgtcgggcagaatgtgacttgtggccttaccatggacttgaatgggacttggctggcctcaggatcttgtgcctggaaatagcctgaggtggctcaggaagcggagaaagggtgccagaccattctctggcggggaccagggcccaaggccccagggctggaaggagaccaaggggcagccgccctggagggacatcagtgcttcctcttccacccaattcccccacgcggttccatgttttcccaccagcctgttggcgaagttgctgctccggcattcagtacctgcttcttccagagaaataaagttagtttctattttatgttacttacttgtgcctgcctgtttctttgcctgttagtcagcaagctccaggccccaagcgaggctccccaggccaccagcatctgctccgggcagcaggccttgtagcaccacctggaggcagcgggagggcgcgcaggcctggacaccgggaggcctcttcccttacacggccggcagcggggccagagtccccgccggtctggtcagtgactttca

SEQ ID NO: 33166 - DNA, 1009 bp, Homo sapiens
acccggccgccggccgatggcggatgaggctatgggggctgagacgcagtagcggccctgcacttctggaggatgctcgaggcccggccccccaggacgcagggcagtgacgctgccggtgccgctgcggggcgggggctgcgggcgctgcttctctccctgaccgcagccgctgggatttggggctccatgggggagagatctgcttaccagcgcctggctgggggcgaggagggaccgcaggtaatggggaaggctaggggatagccagatacctgggccccagaccccttcgtctgctgtgagccgggctcagccctgccccctgcggcggcctcaggagtgagagtgtctgctcctgggccaggggacagagagcggtgtgtttatgtgggtgtggcggtggtgacttagtgatgctggcatctgcctgtgtgtgcatggatcccctgggaccccaaaaagctgcccgttgggctttcttccatgccccaagggagtccaggaagtactgctaggattggggttcagtcttttaggagaactgagtctgtatgtcctgggcattcccgtttactaggcttctgaatatgaatatcaagccagatgtccttgtttgcttttgaaaatatggtcacggtgttgatggatggggtagcttcccttccccttggagagaacgcacttcctctcccgaccggcagagggcagtagctgacaggagaaagggggactcggtaggagcgttggggcttaaggtcgggctgttttcctgggcgaggagaaagggggccgggccgggccgggcgcggtggctcacgcctgtcatctcagcactttgggaggccgaggcgggcagatcacctgagacgaggacgctgaggtcaggaattcgggaccagcctggccaacatggcggaaaaaaaaaaaatagctgggcacggtggcgggggcctgtaatcccagctactcgggaggctgaggcaggagaatcacttgaacccgggat

SEQ ID NO: 33167 - DNA, 1282 bp, Homo sapiens
ggatacaggagcgcagaagcagagtttaaggggtgatgctgagcccagtttggatatgcaatgtgtggtacctgtgcagcctcctggtggagctgccctgtaaatgtctggaaatgcgggtctggagccacaggaattcaggaatggagatagcacaaggtggtaataggagtccctggaggcataggtgaccccagggagcacagcatcagtggagaatagaaggaaacatgagttcaaaagtcttaggaaataccaacagttaagaagctgggggcggggggtggggggggggtgggggggtgagggggtgggcaggcgcagtggctcatgcctgtaatcccagcactttgagagagcaaggctggtagaatgcttgagcccaggagtttgagaccaacctgggcaacatgacgaaacctcatctctacaaaaaatacaaaaattagctgggtgtgatagtgcacgcctgtaatcccagctactcaggagatggaggcaggaggattgcttgagcctgcgaggcagaggttgcagtgagccaagatcgcaccactgcactccagtctagggcacagtgagatcctatctcaaacaaacaaacaaaaaacatgtggggtgaagaggcttcagggctggaccatgggcctagcactgccagcagacacagccttgcctgccctcaggacctcagctgccaggcccccctgggagggagtgggcccccgtgtcctggagatggagagactatggacagtcatggcgtgtgtctgaatcactcccttttctttcttgggccctggccagcctcctccccagaccagtgtgatgtcaggcccagccgacctgaaggtgcagggttgcctggtgcaggttcctctgggatgaggttctgagggcacccagcctggccttgctccagaagcctgggctctgcgcacagaggggtgagttaaggctgactaaacttggtggggctgacatgtggaagcaagataatcctctggctgggggaggagctgtaagcccccctctcctcatcagtatgttcttttttccttcagggcttggagaagaggtaggtggaggtgggagagggcgggctgggaggtagggttggcatatattcctgagaatacggtagattgttttggaaaaatcctcttggccggaaattgcctgtcatgtctgcgccttggtgtggatttgtcacttcgcatgcagttggagaggctggagaggggaatggacagcagagctgggctggtttccagcctcttgt

SEQ ID NO: 33168 - DNA, 1037 bp, Homo sapiens
gcatgaaacggtttcacagtactttcaagacttgatacagatggatgctcttgtctccacgtgtcagccccaccaagtccagtcagcctcaggttcagtgtggactgggtcacgctgtttagtcagatcctcacccctcctctctcaagtgacattcccttctccactggagttggaggggacgaggcatagcagggccctgcctggtgtgtctgcctctgcctctgtgctctgccctcccaccctggcacctgcctgttcccctcctctctctcggtgagctgggatcctgacagacccaggcccccttcccatcaccctgtgtggcagcccgcgccccagcaccccttcgcagtccgatgagaaggcaccttccttaagaccaatgtcaggctctccctctgcctgagggactggctgagttgttctggttctgagatggctttgggggactgagttgcttagtgggtctggggtcggagtggttgtgatgacatggacagcccctcttcccagaaaggtgctggcgtctctggattagaaatcatggggggaggcaaagccggggctgggagagggcaaccaggcttgttcctggcacccactgggaaagcaacctggcagcagctcacgggggaagaagcagccaccgttctccagtgttcctcacaaagactgagtccttctcagcagacacacccagggcccctgccaggttctcccttcagggcgacagatgtggacagatggttcccttacgatgtacagaccacagcagaggtatacagaccgctccttcagcacaattatgtgctgatacaaagagttacaggaatagtgaccctttaaggataggaacgtgatggataatttaaactttttaaaattcttggccgggcgcagtggctcacgcctataatctcagccctgtgggcggctgaggtgggcggatcatgaggtcaggagatcgagaccatcctggccaacagggtgaaaccccgtctcaactctactaaaaatataaaaattagctgggc

SEQ ID NO: 33169 - DNA, 2238 bp, Homo sapiens
ggtatgtgatttacaaatcttttttccagcttgtggctttgtattttgatcctcttaacaatgtcttctaaaaaattctcatgatcagtagtgcaaaatgctgtgtttttgaagagaagttgtaaattttgattaatttactaatttgttactttgtggattgcatttttggtgtcatgtccaagaaatctttgcctgacccaaagtcccaacagttttcccctgtattttcttgtagacattttatagttttgggctttacattgagatctaggattcgtttggggttaatttttgttacgtggtgcaaggtatgaatcaatgtccagttttttgcatgtagagatctaattgatctagtagcaccatttattaaaaagatgtatctctccactgaattgcctttgaatctttgtcaaaaatcaattgctggctgggcacggtggctcactcctctaatcccagtgctttgggaggctgaggcgggcggatcatgaggtcaggagttcaaggccaagctggtgaacgtagtggaaccctgtctctactaaaaatacaaaaaattagccaggcgtggtggcgggcacctgtaatcccagctactcaggaggctgagtcaggagaatcgcatgaacccgggaggcggaggttgcagtgagccaagattgcgccactgcattccagcccgggcgacagtgtgagactccatctcaaaaagaaaaagaaaaaaatcaattgtttgtgtgtgtctaattctggattctgttttgttccattgatctatttgtctgtctttatcccagtatcacactatcttgattactgtgggtttataaactatagtaagtcttgaaatcagggtaagatctcaaacttggttttgtcttttcaaaattgctttagctattctgggttctttgcacttccatatacattttagaattagttagtcaatttctacaaaaaagcctgctgggattttgattgggattatgatcaatttggggagaattgatcggttagcagtattgagccttctgaccatgaacagtgtatatctctgtatttgtctaggttttgtttactatctctcagcagtgttttgtagtttttggtatatcagtcttttccatcttttattgaacatatccttaaatagtacctatttttatgctattgtaaatgatactggtttttcctggtagtattggttttttatttttaaaaacttttaattgtggtaaaatatacataatatactgccattgtaaccatctgcagtggtggtaaatacattcatactgttgcacagccgtcaccagcatccatctccaggacttttctcatcttgtgaaactgaaaccgcacctattaaacagtaacttcccattccctcctctctcagcccctgagaaccaccattttaccttctgactctatgaatttggctcctgtaggtgcctcatagaagtagaattttacagtgtttgtgcttttgtgcctggcttatttcacctcggcctagcgtattcaaggttcatttacattgcagcatatgtcagaattttcttctttttaaagggtaaataatattctattgtatgaatataccactttttgtttatccatttacttggattgctttcaccttttttttttttttttttaaagacaaggtctcactcactctgtctcccaggccggagagcagtggtgtgatcatggctcactgcaacctcgacttcctgggctcaggtgatcgtcccacctcagcctcctgggtagctgggactacaggtgtgtaccaccatgcctggctaatttttttttggaattttctgtagagacgggagtttggcatgttgcccaggctggtttccaactcctggcctcaagcggctttcaccttttggctgttgtcagtaatgctgttatgagatggtaccgttgtttaaactttactttccagttgtttgttgctagtatatgtaaataccattgattttgtattttgagcttgaatcctgcagtcttgctaaattgacttattctagcaagcttttttgtaacttcctttggattttctacatagggcgccgtgtcatctgctaataaagttttacttcctcctttctgatctttatgcctgttgcttctttttcttgcctgattgccctggctggatcctctggtataatgttattgtttttttgagatggagtttcatgcttgtcgccc

SEQ ID NO: 33170 - DNA, 1195 bp, Homo sapiens
tgcttcccctgcccctgggtggggatgggtgcagggttgctgcttgcccagggccttagctagaggaccctcctctgccccagcccgaggtgtggctgtgagtcagatggacccagacccctgtcccgaaccagactgggtgctctcctctgggggcagagggagtggtgctggaggtagcagctgctggaggagccggttagcccgctcctcagacaaactcaaacccgcctgtcagcttcatcccatgcctgtcgcgctgccacccaaacactcatgcaccggaagttcagctgctgtgcccacggtgcctgacgcttctggaatggccagagtggctctcactgtctggcttcagtggagagaacggtctgttttaaacacatacacacaatcttcacctacttatttcaggtcggcgtttttgaacttgtggtagatgaatgggagaaaggccttggcatcacacagattgcttttgatctggttatatcgcttacaagctgtgtaacttccttgggcaacataatgtctttaggtttcagtttcttggtgtctgcggtgggccaggacttcccctgcagtgtcgtgagtaaagaaacctcaggccctttggagcctggtgcccacctccccggagccccggcagatgttagggaggaagggtcagactgttccctctggcccctgagcccgggattagcccccaccttgtgcttcgtctagaagatgcagtgtttctttttgtttgttttaaataacagttttattgagatataatgacatatggtaaactgagcatatttaaaacacacaatttaataagttgtggcctgtgtatatacccgtgaaaccacccccaccttcaagatagtgaacatcccccttattcccctgtccccagaagttttcttgtggaacccctccatcccccgctcctctgccatcccctaccccaggtaacaggctggtctactttctgtcactgtgtctgagtttgcagcatttactgtaaacggaatcgcgtctttcattcaacagaagtattttggagtttgtccaggtggttgcgcgtatcaacagtcattgtacacgtgtgccaaagtctgtttatccattgacctgttgatgggttttcagagaaagctgctgtgaacgtgtttgttagtctttgtgtggatgtacacttttattt

SEQ ID NO: 33171 - DNA, 1032 bp, Homo sapiens
ttttttatttgcatctcagttcgtttatactcgggaagtgcaagacatggctactagaaagagatgtcaagagaaccggaatccagtaggctacaatttggcaaatcttagcttaaaacttcctaaatgttgaccacagtggatgcaaatggctctgtgcatcgtctgttcaatatggtcaggtgaccacccaggttcacgtggtttgtcaccagggtgatacgagccacatggagtgccctcctcagaggccatgtctcagagatgtgtattttgagtggttttccagcaagtgatgcaagatttatgatccattttaagagcctgctttttatgcatttgctcaaatttttagattttaagtttagttttaggttttctgttaaacttgctcaactaggagtggtggtcaaatactggacctcattagcatggtagcctgcacaccttggcaggctccactggagtgctttggggcctgcctggattccagtcctggctctaccagttttgtgtcctcgccattactgggagggagaattgaggaaatgcatgtgaggtgcttcccgtgattcctggcacggagcaagtgctcagtaattgtcagctgtgagtattagtagtagctaatacactactactattcttggctaacaagccagctcaaagctttgatggttttccattacctgatgatggtgatgatggtttccacttcctgaacactcacacccctgggctaggcacttaacccaaatccaaggtcagcgttattgtttgggggtgggggagacacctcctgctctgactcgtgtgtttgggttcccgtattttcaccagagggtgttagtcctgcccaagttcagctggtcctcaaagcgtatatagctctttaaccctcagcaagtgtcagtcagaacataatcttgatttcagctgctactaaatatctaccaggagcctgcttgagagagagaattgcctgacaggtgctgagtccaccattcctgagatactttgaaatcagtgtct

SEQ ID NO: 33172 - DNA, 1062 bp, Homo sapiens
ctgaccgtcgctggctgtcatggatgagtcacagcgtggaggagagggagccgcaggaccaccggagaagctccgtccccagcagggcagctttctcttagaggtttcctggagttcaacacaagactggtgcttacatctcaggcccagatattgatcatgtcttcatgcctggcttccagcagctcggaaacgtctttaagctggacctgttgctgcccctaaatatactcagcagagagggagagtgggcggccggtggacagtgatctgtgtggcctgtgctgctgggagtcggtccagtaggaccgtctgtgatgatggaaatgttgactgccgtccagtatggcagccattagccatggggccgtggagaacctgatatatagtcagtctaagaaactgaattcctctaataacaaggattcttgtccatgaatgagaatctcttgtctactatttgcaagaattgctgcgtattttctaggaagaagtccactgctttagtcctattctgaaaggcatttggtgttagacacaagagaacaggttccctgctgacattttcagaggcccgtgcccttcggtcttcaggtgaggctgggcttgagggaggctttgtggaacggtgagaagaacagcgtgactaaggcacagaaggctgagtgatgccctgcagtgcttttgtagggttggaggccagctgggaaagaaggaacccttgcgttagagaatgggaacatgccttaggatatagaaatggcaaatctgagatagtttgaagtgagaatactagaagtgttcccaccaaacaaggtgtgtcttggtgcctgctgtatcccaggctccgtgaggtgccggagtcagcactgaacaaacagagcttcctatgcttgcggaaatgcatttcgttgggggaagggatttttctgctgactctggctattaatagtaacaatcaaaaaaagaaatgaggtaaattgttagaaacaggcccccaaatgtggccataaactggccataaacaaaatctctgcagcatgtgacatgctcgtgatggcc

SEQ ID NO: 33173 - DNA, 1023 bp, Homo sapiens
tcggggaggagctgatggtctagtttgagggtcgcactgttgaggacttggggaggagctaatgttgtttgcattgagagcctttcagctagagactcagggaggagctgataatcttgattgagggtcatggagctggagacctggacaggagctaatgttctagttagtggatcttctagctgcagacgcggagaggagctgatgttctagattgagggtcgtgcagctgaagactcggggaggagctgatgttctagattgagggtcctgcagctgaagactcggggaggagctggtgttgtagtttgagggtggtgcagttgaggactcggggaggagctgatgttgttcacattgagggtctttcagctggtgattcagggaggagctgataatcttgattgagggtcatggagctggagacccagacaggagttgatgttctagttagtggatcttccagctgcagacccagggaggagctgatgttctagtttgagggtcgtgcagctgaagacctggggtggagctgatgttctagattgagggtcgtgcagctgcagacctggggaggagctgatgttctagtttgagggtcttgcagctgcagacttggggaggagatgatgtttttcgcgttgagggtctttcagttggagactcagggaggagctgatgttctagatttagagtcacggaactggagacctggagagaagatgatgttctagtttcagggtcttgcagctgcagatccagagaggagctgatgttctagattgagggtcatgctgctgaagactcgggcaggagctgatgttctagtttgagggtcttgcagctgcagacctggagaggagctgatgttctagtttgaaggtcttgcagctgcagacctggagaggagctgatgttctagattgagggtcatgcaggtgaagactcagggaggagctgatgttctagtttgagggtcttgcagctgcagacctggagaggagctgatgttccagtttgagg

SEQ ID NO: 33174 - DNA, 1840 bp, Homo sapiens
gacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggtcgcttactttgagtgatcctccaacttcatttgatgctaaataggagataccaggttgaaagaccttctccaaatgagatctaagcctttccataaggaatgtagctggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccattttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaa

SEQ ID NO: 33175 - DNA, 1052 bp, Homo sapiens
atcacaggcatgagccaccacgcccggcatcttatgtctttcttgaaactaattgtaactgttgaaaatggaacttaccaggtggaaataactaaatcctgaagtaccttgaaccaaaatgttttcccctatagggacattttcccccaaaaggagaattgaactggaaacaatatagtacataggattatataattatgttcaatttcttaatgagaatggttttcttacatgctgggctcaaatatgagtgtatatcacagtccatagagcttggaacccctgtgcaaggtgctttcggagtcttgagcttatctgcgagttccttttatcagaatcttacttaacgcacgttaaattagaaaggcatacaaaagaatgtccttagaaataaaacttctcatagcgaataatgtctgtttcaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtaagtgaacttttgggaaaggaggaactaaagtatgtgtaaaataaccgataaatcttacacttctgcaaagtggacaaactctaggagtctagaattcctttaagaagggagcattaatggtttagctgtcattttctgtttctgctgtctaattcagaacttagtcaaacctagtctttttggaagagacttgctgtaaaacttccatgtatgctccaatggggaaaagaatctgaacacatttaaagttttcctttgtaaaatgaatcagtttcctttaaaaaaattttttttttttttgagacagagtttcactgttgttgcccaagctggagtgcaatggcacggtctcggctcactgcaccctccacctcccaggttcaagtgattctcctgccttagcctcccgagttgctgtgattacaggtgcccaacaccacgcccggctcattttttgtatttttagtagaaacggagtttcac

SEQ ID NO: 33176 - DNA, 1936 bp, Homo sapiens
cgggctgtagtttgccagtccctggagttaactttaaatgcaatcaaacagccaacacttactaagaaataagtccttggacttaagtagtcagtaaatttaattagtagtgtaggaaaaaagtagctctactagtaaggtaaaattaatattctcatgtgaatttttaattcccagagtttttagtcagatttgaagtaaggctcttttatccttaatacatatactgtgcttttacctttctactgatgtgctaattctagaaaagtttagaagctgattatataagttctttcttcctcttttttcttttttaaagatcactatgttgtagttggggcccagagagatgcatggggccctggagctgcaaaatccggtgtaggcacagctctcctattgaaacttgcccagatgttctcagatatggtcttaaaaggtagagtacaaattttgattcttttgaatattggtgcactgcatacagttctagatgttatactgtgctttgctcactttgcctgcattcctgtggttctcatgctagactctagttcttaaatacaaggcagattgtcttttgttgtagctgccttttcctttgaaacagctttccataaagtgtcttaactgtgctagaaatcaccagtttctttgagacagtggagttactgagccctagtgcttagtgtggtggatccagagtgataaggtggatcatagtccctaagcaatctatttgaaagcagtagcatacctctctactcatgtactgaggcctaacagctattgaaattttgttctgtttattcatttattcattttttgagacagagtttcactctgttgcccaggctggagtgcagtggtgtgatctcacttagctcactgcaacctctgcctcccgacttcaagcaattctcctgcctcagcctcctgagtagctgggattacaggcacccacaaccacacccggccaatttttgtatttttactagagacagggtttcgccatgttggccaggctagtctcctgacctcaagtgattcacccgcctcagcctcccaaaatgctgctagtgagccaccgtgccctgcctcttttgtttatttttgagcctttctgtcctactttccactctttcacactcctacccacccacacattcaaaatcacgtcacattcttgaatctttgggtcttagggcaaactgcaatgcttaactttaatacagagtacattaatggagaaaaagatacagtgagggaagtgggagggatggagggcagtgtgatacatgtaacctcaaaaggtgctgtcacaaatatagtttctctgcaaactcttcttgtaacttaaatttgtgaatttttattttattttagaattatttttttaaaaatccaatgtttggatttacctctgaagatttttctcaagatgtgcatcatcatgcttacactgttttcaatgatctctgggtccagaagttaaggaactccaagaatgaaattgtgaaagggtgactactggcccctgctatgtactcaaaatcttatttgcagatctcctatcttgctctttgtaggttactttaaaaaaaattattcctattcttttattcttttacctggggtctcaaaaaaagattttgttagttttttttttcttttttggctcagaaaaaaaagattttggaatctgctatcttggaattagaccttctgattcatcttaagtgggataccttccatccttgtctgtgtataacctttcctcaggtaaagctaacttttttctctttcagatgggtttcagcccagcagaagcattatctttgccagttggagtgctggagactttggatcggttggtgccactgaatggctagaggtattctttatcatcccttcccatattggacacgagcttgtg

SEQ ID NO: 33177 - DNA, 1050 bp, Homo sapiens
tttttgagacaggacttgtgctctgttgcccaggctggagtgcagtggcgtgatctcggctcactgcagcctccgcctcccaggttcaagcgattctcctcctcatcctccttagtagctgggattacaggcgcatgccaccatgcccagttaatttttgtatttttagtagagtcggggtttcaccatgtcggtcaggctggtcttgaactcctgaccttgtgatccacctgcctcagcctcccaaagtgctgggattacaggggtgagccacttcgccgggctgagagtaagttttgtttatatgtcctcttaatctgtaacttcactggacaggagtaaaccctgggcaaggaacaataactcagaacttacgcctgctttctgattctaggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccaggtaaagaccgcccccccccccccccgccccgctttttttttgttttcttttctgttcctaaggatgtggctagagaaggagcgagtgtaggaatgctggcttggcttggttttatgaagtgctcaatcttgtctgtcctaaagttaattgtttatgtgttagtttcttttttttttttttgagaaagagtttcactcttgttgcccaggctggagtgcagtggtgtgatctcggctcactgcaatttccgcctcccaggttcaagccattctcctgcctcagcctccccagtagctgggattacaggcatgcgccaccacgcctggctaattttgtatttttagtagagacagggtttctccatgttggtcaggctccatgaggtcagagctcctgacctcaggtgatctgcctccctcagcctcccaaagtgctgggattacaggcatgagccaccgcgcccagcctatgtgtcagttttattgggaggtaataagg

SEQ ID NO: 33178 - DNA, 1046 bp, Homo sapiens
aagacataggaggccaaaaatcttgattttattccaatagctctgacctaaaagttgtaaagttttttagaactcatgtcttttttaggccttggcctccttttatctcttacttgggttgcctgtcttaggtttgatctataacactcttctgtctcaagattttagagctgttccgataccataatgctcattaaatctaatgtctttgttctagggtaaactggtccatgctaattttggtactaaaaaagattttgaggatttatacactcctgtgaatggatctatagtgattgtcagagcagggaaaatcacctttgcagaaaaggtgagtatgagttattataatattaaatacagtacttttggtatcttactcttcaggtaagtgatatttcttgttaatattcttacattctgaaaatcagcaatcttaaactctcataccagataatataatttattaaaatgctcaacaaatgaagtaagttccacttacctaatcagaagtgcttaagtgaaagctatttctctgtataactcagttttacgcatatacagaattcagctaaaagcatgttttataaaaaggaaaattaatagccaaacatacacaaggaactagagtggaacatatcaaaagacagtggtgatttctgcatttttaaaaaaagtggcagggctcacacctgtaatcccaacactttaggaggctgaggtgggaggactgcttgagccctggaggttgtgagatgtgactcgtgccactccagcctgagtgacagtgagactcaaaaaagtggttgtcttagatgggtttttgttatttttcttttcttttttttttttttttttgagacggagtctcttgtcaccctggctggagtgcagtggcgtgatctcagctcactgcaacctccgcctcccaggttcaagtgatgctcctgcctcagccttctgagtagctgggattacaggtgcccaccaccaccatgcctggctaatttttgcatttttagtagagacagggtttcacgacgttg

SEQ ID NO: 33179 - DNA, 1033 bp, Homo sapiens
tttgttttattcttgctcccttgctcccaccaacatcatggtctgggttactgcatagtatcctgaactgatttgtgcccctagtcccagctactcaggaggctgaggtgggggaatcagtagagcccaggattttgaggctgcagtgagctgtgatcacaccactgtactccatcctgggagagagagggagaccttgtctcaaaaaaaaaaaaaaatttacaaaaagggagagactgactgagaagaccagtgtgaactagcccttgactgggcccagggaagaatgttggtttgaaaggagaacaccctaaggaatatatagcaagttatagtaatggcccaataacaagcatatacctaaacgagcttttcctaaacattcccgtgcctgttcttcatcatgcctttttccgcaacacagtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggtgagaatgaccattccaaacttcaatgttttctataaccaactctgggaagtctgttatgtcagctcagcatatagttattttgtaccttattttttttttttttttttttggagacagaggcttactctcttgcctaggctagagtgcagtggcaccatgttggctcactgcaacctcagcctcccaggtttaagcgattctctgccttagcctcctgagtagctgggactataggcgcccacgaccacacctggctaatttttttttttttttttttgagttggagtctcactctgtggctcaggctggagtgcagtggcgtgatttcggctcactgcaatctccgcctcccaggttcaagcgattcttctgcctcagcctcctgaggagctgggactacaggc

SEQ ID NO: 33180 - DNA, 1028 bp, Homo sapiens
gcattttgcttttcttttcctttttgtatttctgaggctgcaaaatacatcttcacaagagtggctttaatagttacctaacattccatcctgcacgtacatttcaaggcactgccgcagtgcaatatccaacatttaagcgtcaacgccaacagattggacctagcactgcagggactggaggttggtcaaggtcaggcggaggctgccaggctaccagggtggaggaaggcgccgaggcagaggccagtgcgcccatcgcgcggctcctcggggcacctgctgccttggcgccttttcccttggccttcgcctcgcccgcagcgccctccgcatagggccccgcccgctgcgcgcgcatccccgccccccgggcgatctgtcagagcacctcgcgagcgtacgtgcctcaggaagtgacgcacagcccccctgggggccgggggcggggccaggctataaaccgccggttaggggccgccatcccctcagagcgtcgggatatcgggtggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggtacacggggtcggcggctgtgcgcagaggcgtccctgcgcctctcgtcccttcgcctctcgtcccttcccttctctctgccttcttgcccgcctcctcggtcacagagcgacgaatgacgagaccaggtgtacccccactgtcgctctcagccccggggacttcgggtcctcgcccttgaaggccgcaggccctagtgcgccggctccgggctgcgggtccgggagcgcgggcgcagccaaggtgcagctgcgcggcgtgcggcgccgggggaacac

SEQ ID NO: 33181 - DNA, 1057 bp, Homo sapiens
gagaatcaggcagggaggttgcagtgagcagagatggcggcagtacagtccagcttccgctcggcatcagagggagaccatagaaagagagggagagggagaccgtggggagagggagaggggagaggggagaagggagaggggagagggagaaaacttctcttatggccttcggtttgtatttctcaggccaatagatgtatctattccagtcagagggctcgtggttgctatttttatattccctcttttctcacggactgagagaaactagttaagaaagaagtaacctctttctcatactttttttttttttgagacagagtcttgctttgtcacccaggctggagtgcagtggtgcgattttggctcactgtagcctctgcctcctgggttcaagcaattctcctgcctcagcctcccaagtagctgggactacaagcgcccgccaccatgcctggctaatttttttgtatttttagtagagacggggtttcaccatgttagccacgttagtcttgaactcctgacctcgtgatctgcccgccttggcctcccaaagtgctgggattacaggcatgagccaccgtgcctggcctttctcatacttttagaaacccttatttgaccaaatccttccagacccaggacagggagatttccttctttcctaggctccacccactaaccggttcaccagcaaaccctctggccctattgaccacagcaagatgactggtatacagagtgagggtaacagttctagcagactaggagaaatagctacaaaagcagctggctaacttcatatgtatactccataaatcattaggttgggtggtttgtgaatagattgtagaatttatgagcaaagcaaagagagatatgaagtccactgaggcctggcctctgcctattgtcctttttctgggcctgagaacattgactgggtctttctgaatggcagttatcatgggttttaatgatgtttccttattttcagattgattttgtagcccatgatgatattccttattcatctgctggcagtgatgat

SEQ ID NO: 33182 - DNA, 1034 bp, Homo sapiens
gagtcagagttagagtagaacagaaactagattgagtaaattaagagagtgaggccaggtggggtggctcacgcttgtaatctcagcactttgggaggccgaggcatgtggatcacttgaggtcaagagtttgagagcagcctggccaacattgtgaaacctcttctctgctaaaaacacacacacaaaaaattagccgggtgtggtggtgcacgcctgtaatcccagctacttgggaggctgaggcaggagaattgcttgaacctggtggcggaggttccagtgagctgagatcgcaccactgcattccagcctgggcagcagagcaagactctgtctcaaaaattaaaaaaagaaaaaagaaaaaagtaaaaagaaataagagggggattccatctccagttctgtcactttctaattgaatgacttcaggtaagtcattggatttttctcacattgtatcagtgacattaggaagctgaagtacattttcccaaagactggctgtgactgcctaaggatcatctgggaagttgtttaaaatatagacgctgggtccctattcaaatagattctgatcaaataggccaggggttagatcagtgaatcagaatatttaaaaagttccccatgattctgctgactgccagatatggacactgcttatgtagatgattttaaggtagcttttagctctaaaattctatggtctcaccaaggttttatttttatttttattattttttgagacagaattttgctcttgttgcccaggatggagtgcaatggcacaatctcagctcaccacaacctccacctcccgggttgaagtgtcctgcctcagccttccgagtagctgggattacaggcatgcaccaccacacctggctaattttgtaattttagtagagacagggtttctccatgtcggttaggttggtctggagctcccgacctcaggtgatcggcccgcctcggcctcccagagttctgggattataggcgtgagccactgcgcccagccccaccaaagt

SEQ ID NO: 33183 - DNA, 1031 bp, Homo sapiens
cataataaaggtgcttgggaaagccttaaatttgaagacacatggaggcggtagaaaattaaacttgtaagaggagaaaaacatgccattaggtaacgcagagttgtaactactggctaagactcaatggaacttccacttgctctaaaaccagggaaatcttagataactgggtgtgatctacctatagatctacctagtctataggtaataatttccagaaggaggatcttgctgtcagttggggatcctctggtttggtctgtaccaaattgtgaatactcttgctgtgttgtacccagttgctttatattaatactgcaacttgaaacggggagggtggggggacaatggggtgggggagggaagggagtgggacgataagtcttttgaagacatcagctcactgtgctgagagagggaccaaactcaaggaaacctctgatctatacattcaactgctgcatttttttataaatacatgtaaatgtcctgttgtaatatttgatcttggaaataaaaacaaaaacttttcagtattagttttttttgtgttgttgtttttacaagataagactctggatattactttcagtaatacaattgagattccaaaagcttgccccctcacgttctcatttaggtcagttactattgattgacaaaggttactttgtagtcccgttgttatgtgtaacgtttgctagccttttttctgctctttgtggtatgtcaaacattcatggtaaacactctgtaaatattagtccagttgttacagaaacattgggtaagctaggcttgttaggtaagtatgattctgtgtttgacatacttgggcgaatattcagtgtctgttctttcagaccagcagtaattactaatggttaattaaggacttagcttaattgaaggaaagataattactaaattaatgggcaaaaaggagatacgattatatggtatgacagaaattgttattgctgctggatgcagtggctcatgcatgtaatcccagccctttgggaggc

SEQ ID NO: 33184 - DNA, 1568 bp, Homo sapiens
cttactgcgatgactgaaatctccaaagaggagagtatagtagttataggtctagtaataataatcttgtaaacaattcattattttttaaaacttaatgctgtgtgcctaatcagtgttgagtatgactaaaatgtaaatgagaaccaaatatgacactaacgctggcactaaattttatttttacttgtgtacttaaagtactttactggcctgttgggaaattgatttgtataagattcacacctggttttggcagaaacagctttttaaagatacaattaggctgacttaaaaatgttttttattccacagaatgtatctttattatgtcattcttaccgtctctctgccttttttgaccatcatgtaactacgcagtagtaaatcatggggtgcaggctgatgaattagtagtctttgtaaaactaaaatgtaatgagcataggaagagacagctcttctggtgaacatggcagttttccggtaataccagccttgatgaataggctaaagacagctgtgtactatggacattcaacttcactggattgcctggcttagcttttcagttattgtcttgccgtgaaacatggtgttgcactgtacacattttagaatagtggcaagaatgttctttagaactgcagataacccaacagagaataccataccaatatatcggtttctcctgttacatagagatttggtatttcagtgatggttatggtttttgactcacctgtgtgtcagtcctgctagagagacagtatagaatcaagaatttcttgatgtctttttaaaaatagagattataatggccttgctagttgtcctgtgaagtgacagacccttaattagaaatcttttaatcctgctttccattttacttctccaccatttatttttaacattcattctctgaaaatagttatgatttttagtgtaattggctatgtttaagaaattccatttcaaagtcttaatatgtaacaatcttcattttttataaaattgaaggacatttttgaggcaaacttacttttatagctcattttctccctagttaaggagaattctctggtttcatatagagaatggctagctctgtgataccccaccctctttgtggcctaccagttgctgttgtgttgcttaaaattgcagatattctcataaacatgatgatttttggcacaggcctttctttgctattgatttcaaaataaagttgggcaatccaatttgaactactttaataaacataatttagcattcctgtaatgagaaagtattttcaaaagataaccagatttatttctaggattagagatggcaaataccaatgatagtatttttcccaagagcaatcacagattaatctataaatatgagaagtcgcattattgtacttaattctttggcaacaaacagcaagtttttattgtttaattgtatttcctctctagagatcacaatactctgggtattttatatcccttctaaaggtcatttgggttttcaaatgggaagaatagtcaagctaagctggactaaacctaagtaat

SEQ ID NO: 33185 - DNA, 1073 bp, Homo sapiens
attccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaagaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgccc

SEQ ID NO: 33186 - DNA, 1048 bp, Homo sapiens
ttcactaatatgctctttcctctttttccgtctaatggctttgtctttctcttgtttttataggctttggtgaagcacgtgcagtctaaaggatacccaaatgaacgttttgaacttctcaccaactttcctcgaaggaaattatctcatctggactatgatattacattgcaagaggcaggcctttgtcctcaagagactgtctttgtacaggaaagaaattaacaccatggcttgacctctctcagcttaccccttttttcccttttcctgtgagatacatgtcactaagtatgcattttggctcataggaccacagagccaaagttgggcaagcaagtcaccttccttctcttatttcttgatctctcctataatcagtctctttctccccctttgtttctttctcctcttctgttttctcgctccccactccgtacccttctgcctccccctccccccacacttttctttcttacctaatctggtgaccaaactgaagtgtaaggataagacctctcctagtactagcagcaggaattgtgtgttccagtaagtggtctcttgcacggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatttttgccagc

SEQ ID NO: 33187 - DNA, 1073 bp, Homo sapiens
gccgctcagatgaagaatctgaatctgaacttttttctggcagtgaggagttcatatccgtttgtggctctgatgaagaagaagaggtagagaatcttgccaagtccagaaagtctccccacaaagatttggggcatagaaaagaggagaatagaaggccgctgactgagccaccagtcagaactgatcctggaacagccacaaaccaccaaggattgccagctgtggattcagagatactggagatgccacctgaaaaagcagatggagtagtggaggggatagatgtaaatggtaagttacatttagacatactttacttcaaacttagatattggggccgggcgtggtggatcactgaggttaggagttccaagaccagcctcgccaacatggcaaaaccctgtctctactaaaaatacaaaacttagccaggtgtggtggcacgtgcctatagtcccagctacttgggaggctgaggcaggagagtggcttgaaccagggaggcggaggttgcagtgagctgagatcacgccactgcactccagcaaaacacttgagtaattgctgaatggctgtatttatttacatatttatttaaactaatattctgtcttaaactcctgtatcccgttttttttttttttttaaacccttcctttaggaccaaaagcacagctgatgttgcggtatccagatggaaaaagggaacagatcactcttccagagcaagctaaactgctagtaagtacaggcttgctttggttcagttccgaccactgcaataagacgagtcccaaattgtttggtttcctggtgcatataaaagttatgtttacattattccatagtctattaagtgtgcagtagctttatgtctaaaaaaaagcacataacttaattaaaaaaagcttttgctaaaaagtgctaatgatcccctgaatcttcagtgagtcatctttttgttggtggagggtcttgatattgatggctactgactgattggggtgatgggtactgtggcagtttctgaaaatgtgacagcagtgaagttgctgcatcagttgcttcct

SEQ ID NO: 33188 - DNA, 1031 bp, Homo sapiens
taatgagagtgttcagaaggattctaggtattatatttatagatcctggagaatgttcagaaggattctagatattatatttatttatagatcttggtttttaatccttaggtcagaagctagtagaatggcaccagttagatgtatcttctttcttggaccaagtgacgggatttctgggtgaacatggacaactggatggactttctagcagtccccccaaaaaatgtgcccgttcagtaagtataattaggaggtggtgatgggaaaataaatgtaattggtcataagcatcttatataaaatgttcgatgttaagatggtaaagataatctaactagtggacaactatcactgtggctatagcatcttagatatcctccttatattttgataatttcccacatgagagttccatcttcttggtgaaatcatgatactcatactcctgccagtctgtcttgcagctagagtgcaggcagatgccccaggatctggatttagaaggaagcaatgtgaataggttgggcaggaggactgacctggcaagcctagtggtaaaggtgtctacttcctgaggggcagctctgggagggcttctgatatccaggtctaaatagcagtgaaagtggttggtttttttgtgtgttttgttttttgttttggagtgggatcttgctgttttgcccagactgtcctagaactcctgggctgaagcagccttctcacctcaactgcccgaatagctaggactacaggtacatgccaccacagccggctggaagtggtgttttttgtttttgctgaaacaactgtcatggtatagttgagcatttttattggttaatatagctttagggcctggctctctggccctcctagaatttacttctatacttaatttctagaatatactattactaggtagacatgtttgataattggtatcaagattggttgcaaataagagactgaacttgcaaagatacagcaatctcacattggttttcatggctgtttggctttgatag

SEQ ID NO: 33189 - DNA, 1064 bp, Homo sapiens
gcatttgctgaggagtgctttacttccaactatgtggtcagttttggaataagtgtgatgtggtgctgagaagaaatgtatattctgttgatttggggtggagagttctgtagatgtctattaggtctgcttgttgcagagctgagttcaggtcctggatatccttgttaactttctgtctcattgatctgtctaatattgacagtggggtgttaaattctcccattattattgtgtgggagtctaagtctcttctctgtaggtctctaaggacttgctttttgaatttggatgcatatatatttaggatagttagctcttcttgttgaattgacccctttaccaatatgtaatggccttctttgtctcttttgatttttgttggtttaaagtctgttttatcagagactaggattgcaacccctgtgtttttttctttttctttttttttttttggagatggagtcttgctttgtggcccaggctggagtgcagtggtgcgatctgggctcactgcaagctctgcctcctgggttcatgccattctcccacctcagcctctcgagtagctgggactataggcgcctgccaccacgcccagctaatttttttgtatttttagtagagacggggtttcaccgtgttagccaggatggtctcgatctcctgacctcgtgatctgcctgccttggcctcccaaagtgctgggattacaggcatgagccattgtgcccggccaacccctgcattttttttgctttccatttgcttggtagatcttcctccatccctttattttgagcctatgtgtgtctttgcatgtgagatgggtctcctgaatacagcacactgatgggtcttaactctttatccaatttgccagtctgtgtcttttaattggggcatttagcccatttacatttaaggttaatattattgtgtgtgaatttgatcctgtcattatgatgttagctggttattttgcccattagttgatgcagtttcttcctagcatcaatggtctttacaatttggcatgtttttgcagtggctggcaccggttg

SEQ ID NO: 33190 - DNA, 1034 bp, Homo sapiens
tagaggagtgagactgggcactgtggctcacacctataattcccgcactttgggaggctgaggtgggaggcctggagcttgagatcagcctaggcaacatagtgagaccccatctctacaaaatgtattaaaattttatttattaaaaaaggagttacatctgatttgaccttttttttttttttaaagaaagagttacttggctataatggagaagagataggcacagagatcagtagaaggctgttatattaacccaagaaagatagtggtgtcctgaaaaaagttagtggcggagaagtggactccaaaaggtatgggaagaaatcagagtcaaaatgaagtttaggattctgttttggacacctaggtatgtaacagtgctatttatgaaggtatggaatagcagaaaggtgtggggagaagatggttagctcagttttggataagttaaggtgctgctaataggacttccagatggagctgttgaagcagatgaatatttgggtctagaaagaagagtgagaaatctgtcatattcatggcagttaaagttataaaaatggggctaggtgcggtggttcacacctggaatcccagcactttgggaggccgaggcgagtggatcacctgaggtcaggagtttgagaccagcctgaccaacatggtgaaaccccgtctctactaaaaatacaaaactagccgggcatggtggtgtgtgcctgtaatcccagctactcaggaggctgaggcaggagaattgcttgaacctggaaggcggaggttgcagtgagctgagatcacgccattgcactccagcctgggcgacagcgagactctgtctcaaaaaaaaaaaaaaaaaaaggttataaaaatggatgaggcgaggcctagtggctcacaccggtaatcccagcactttggaatgccaaggtggaaggattgcttgaggccagaaattcaagaccagcttgggcaacatagcaaagagcctgtttctacaaaaagtaaaaaaaaattaactgggcctggtg

SEQ ID NO: 33191 - DNA, 1055 bp, Homo sapiens
tttctcaaaaagaaaaaaaaagccacttattattattattattattattattttgagacagtctcgctgtgttgcccaggttggagtgcagatctcccaggcacgatcttggctcactgcaacctccacctcccgggttcaagcgattctcctgtctcagcctcccgagtagctgggactacaagcgcctgtcaccaggcccggctaatttttgtatttttagtagaggcggggtttcatcatgttggcctggctggtcttgaactcctgtcctcaaatgatccactcacctcagcctcccaaagtgctaggattacaggcgtgagccaccgcgcctggccctaaaagccacttaattaattttcagtttcttatgctaattactactcttcccaaactctgattggtttaacgccacattacttcttctgttgcaacatttttattaggtacacacaaaaaccgaagtgtggtgagttgaattgactcacttaattgctttaattctgtttctgttcgtctacgtagcttgattgctggatcaagttggagtccctcaatcagtagacagtggtatctggagatctacagagcgaaaatacctttgagtgttcttcaaatattgtgaatttctattgataatttttgggattctttttacaagatagtgattaaccgttagaaacacatgattgatttctttttgccttttttacatgtcttaaaatttttttggggttctctccacatacgttttaatcgtagtgtttataattaaaaggtattttatatttattttagtgaccttaatagcttatgctctgatttcacaaaggttttacttggaagctcaatattcttgtaaaaacaaatgcatcatcaaaaatgtgagtccttactttttaggcaggagcaaaaaaaagaaaaagaaaaaataaaaataaatgtgagtcttatctttttttggcatttagaaatagaacggaaaattgaaagattttagaaaagtcttatttcttactgaatagaacagatctctctctgattcagtgagt

SEQ ID NO: 33192 - DNA, 1050 bp, Homo sapiens
gcgacgacggcgtcggggtctccgggttcaggcgggagacagcccccccccgctcccgataccctcgttctctgtctcctagtagcgtggagggagatcccccaaccccccgccagcccagacctgggaatgggccgagtccgtccgcccccgccggcccggggacccgggggcgggaggagtagggggccgcacccgggccaccgccctcctcctcctccttcatcatcttcccttctctgtgcagccctgcggtgcggtgcatctcctcacctccttttttcctttcttccccggccaggtcattctgccccggtccccggcctgcccttcccctttctgggcccctcggagccatcgccgtggccctggcgggttcgggccctcccgccttcacggcaaggccggtgggttcggccgtgcctttacacttcacgggggacaggccgccagaagcggggggtgctgaggaggacctcagggactgaggctttgagggaagaatgagggggaacccccaagctgaataggggaggcctggaagaatccagggtggcgtttcccacctccccataataaaatcataaagacggagacgatggcgccggggcctcctgctgataagatagggatggcggcagaaacttctttgagagaaaatctgtttctgggtgtcggtatccccgaaaccctaggcctaggttctctccctttggacccctgcgaaggacacacgcagatcctcttaccgcctggaggaaaggccctaaagccattctatgaattctctctgtcttgtttctctctgatggtgctgaacttttcttgcatgagttattagagggcggagcaaatgatgaagttctctgtggagtgatttgagagaagagtactccaatgtgcctgagtgtaattttgccgttctagtttgtcgttttggaaggaggtcagaatgttagttccctctcaacggatctatactttatctcgtaatttgttagatgcggagaatgtttccactgttaatgttcctagagtttaacgtgcaat

SEQ ID NO: 33193 - DNA, 1046 bp, Homo sapiens
tacttctccagatttgtacttcatttgagatcatttaaatttctgccaatttgttctttttctacttttctattcttgttatgaaatattgcaagtataccaaaacgttcagagaaggattgctctttattaatcacttttaaggtggcggcagagcgacgggccagcgaggaagaagaaaacaaagccagtgaagaatacatacagaggttgttggcagaggaggaagaagaggaaaaaagacaggcagaaaaaaggcgaagagcgatggaagaacaactgaaaagtgatgaggaactggcaagaaagctaagcattgatattgtaagttttaggagggaacgctaaggtatggtcatcccttggtatgcgctgctgcagaacccgctcatgggaagagtcagctccttgtatttccaggttctgcatcccacaaatattgtcttttccaccccaggctggttggatttgagtgtttggaacctgctgatacggaaagctaactattaacattccgattgctttgactgtggttttcaaagaacagaagagatggcgttgccataattagaagctattgataacatttttgctttacttaaagtaaaattgttttgcatattgttacatatttgctctaatccaggtttttggggttttttgttttttgagacaggtcttactctgtcatgcaggttggagtgcagtggcacaatcacgactcactgcagcctcgacggccgggctccggtgatccttccaacctcccgagtagctgggactacaggctggcactaccatgcctggctacttttttgtggagacagggctttgccatgtttcctgaactggtgtcgagctcctgggctcaagccgtccatctgcctcggcgtctcaaagtgctgggtttgtggcgtgagccaccgcaagttgtttaacaacttttttatatgtaggaaagctattcagtgaagaatgaaagcttcctttttccttcttccacctctccactcccgttccttttccatttatatcagtctctatcc

SEQ ID NO: 33194 - DNA, 1132 bp, Homo sapiens
aaatttatggggtgcaagggtaattttgttacatgtatagattgcacagtggcgaagtcagggctctttagggtatctgctacccaaataatgtacattgtacccatgaagtcatctctcaccatccacccctgccgcctctggattttcttgagaaagcaaaaaatatggcacggacaggcctgagtttcctggtagtcgtagtcagctggagttgagtagcagctgccccttgaaacagacagatgcgttctcttttttggatgttccctttttacactttataaaacagtgtcttgttttatagaataaaattctcatcagatttgttgaggatacatacccacatttaggttattttctgacccagaattatctttcaactccagggtgatgattttttctctttgtatagcttactgtttccctagtcctgcagatgtatttcaaatgtctgacgatccttggattagcttttaggtttgagaatgaggcccaggagaaaagctctgtgtatgtggaagggtattggtgatgggcagacgttgagttcaagccgatggaaacctggcctttgtgctttgccatccctaactgcccgatcgcagaggactttgctctgggtcaccacctattacattagctgctctggctctctctagatctgtttctttaaagaaatatgcgtgtgtgcacctgcacccatatccagggagaaatgccggtaagtcgaggattctgatttaacagcttataaatctcgagttctgttttcagtcccacggttactcactctggactctatgagcctctctctaggcaaataggaggcagattcccttctaattctacctcagctgtagtcttccctttcaaggatttcttttccttcatttctgctgtatcaattatctctatttcattgccttcccattttctagaaatttgttaaaaattttttaactggagccgggcacggtggctcacgcctgtagtcccagcactttgggaggctgaggtgagcagattgcccgacattaggagttcgaaaccagcctggccaacatggcaaaaaccggtctgtattaaaaatacaaaaattagctgggcatggttgggcatgcctgtgatc

SEQ ID NO: 33195 - DNA, 1024 bp, Homo sapiens
ctggcactttggaaggcaggtggatcacctgaggtcaggagttcaagaccagcctggccaacatggtaaaacccccgtctctactaaaattacaaaaaattagctgggcgtggtgggacatgcctgtaatcccagctactcaggaggctgaggcaggagaattgcttgaacccgggaggtggaggctgcagttacctgagattgcgccattgtactccagcctgggcaacaagagcgaaactccgtcaaagaagaaaaagaaatagcaaatggactggatgcagtggctcacacctgttatcccagtgcttcaggaggctagggcaggagaatcgcttcagccaaggggttggaggctgcagtgagctatgatcccgccactgaactccagcctgggcaagagtgagatcttgtttccaaaaacaaaagaaaaaggcaaatgaagacaattttaacttgtgtctgcagttgaataactcactgatcttaatttagattcagtttatgtagaaataagtaaactttaaaaatctgtcattccacggtttaacaaaagttcagctctctgcttgctgtagttgggcatcttctgtaaatcgcacgtgcctttcctttgcctgttgtggtttttaattgatctgtggaagttctagttatattctggacactaattctctggtgatttatgtatttgcaaataacttctagtttgtttttaactttgtgatgtctttcatcacatggaagttttaattgttttggaatttatctcatatgttcttcttagtcgtttatagttttgtttttttccattttttaatccaccttgaattcgagtattgtatgaggtaggcatcttaactccccctgcccttgattgccacttaatagccacactacttggtagtaatacagccacattgatatacgtactatttcactaatcatatgcttattttccagagcaatttggggctatttatttattttatttatttatttatttatttatttgagatggagt

SEQ ID NO: 33196 - DNA, 1029 bp, Homo sapiens
gaggtggtatcccattgtggtttttatttgcatgtccccaatgactaaggatggcgagcatctttgcatgcatttattggccatttgtatatcatcttcggaaaaatatgaaatatctattcaaatcctgtgctcattcattctttttgtttctgtttttctcccaaaacccagaaaaagccacaactttgcctgtcatttaatcaggttgtttttttgagttgtgggcattctcctgcctcagcctcctgagtagctgggattacaggcatgcgacaccacacccaactaatttttgtattgttagtagagatggggttttgctgtgttggtcaggatggtctcaatctcttgacctcgtgatccacctgtcttggcctccaaaagtgctgggattacaagcgtgagccaccgcgtccgggctgttttagtttttatccaccatagatgagttttttctgttctggaacttcatataaatggaattctttttatttcctagggctactgtaacaaagtaccacgaacttagcagaaatttattctccctcagttctgaagagtagaactccaaacccaagatgctagcagggagcagggacatgtacattgaaggctctgggagagaatctgttccgtgcccttctccttagcttctggtgtggctggaatccatggtgttcctggtttgcagctgagtcactccagtctctgcctccattggcacgtagagtttcccggtgtgtctgtctttacatggccgtctcctctgtgtctctctcttttttttttaccaggacactagttatattggattaaaggctctgtactctttgtatgaactccattatatctgtaacaacctgtttccagttaagaccacattcttagttactgggagttaggacttaagcatatcttttggggggttattcagcataaggttcaagatttattctttttttttttttgagacagtcttgttctgtcacccagtctggaatgcagtgacaggatctcggctcactg

SEQ ID NO: 33197 - DNA, 1079 bp, Homo sapiens
tccagatatgcacctagtatatatcattgctggatcatatggtagtcctatttttaattttttcagaaacctccatactgtttttcataatggccgtaataatttacattcccatcaatagtgcacaagggtcaaagaactaatatttgcctttgataatcctttctattatttatttctttctatttcatgaattcctgctctaatctttattatttccttcattctaataactttaggtttaatttgctctttttctaacaccttgagatgaacacttatctcacggatatgtccagcttttattttgcatttgagacaaaatttcttcaaagtacagttttagctacctccttattgtcttatgtcacattttcattgtttttcaatgaaacatttaaaattttcattgtattttcttctttgagacatgaataatttagaaacatggtaaaacactgaaactttcttcatgatgttggtaacaagagaatagaatgaagcctataatcccagcactttgggaggctgaggcaggcagatggcctgaggtcaggagtttgagaatagaatgaaattcccttgattaattctattcaacattctgttgaaggtgtagacattacaacaagacaagaaaaagaaatgaaagacataagaattggaaaggaagaactaaaactgtcattcacagacaacatgattgtgtttgcagaacaaggacggatgcggtgactcacgcctgtaattccagcactttgggaggaaaaggtgggtggatcacctgaggtcaggagtttgagacaagcctggccaacatggtgcaaccctgtctctactaaaaatacaaaaattagtcaggtgtggtggcatgtgccggtagtaccagctactcaggaggctgaggcaggagagccacttgaacccaggaggtggaggttgcagtgagctgagatcacgccactgcactccagcctgggtgacagagcaagacgaaagaaaagaaaggcgggcaggcgggcaggcgggcaggcgggcgggcaggcgggcgggtgggcgggcaggcaggcaggcgggcg

SEQ ID NO: 33198 - DNA, 1053 bp, Homo sapiens
agaaaaaagaaaaaaaattgaaatcgttaaacaaaattatttgtaacttaaattgacttttcaatactcaattcaaatttgtaggatagcatctttatcatgaggtaagtcagtattacagttcctaagcctaaatactatcagtgcctttcgtttaaaatctaggtttatctggaacttttggcaacagtcttcgttacggcatatttacctgctgctgtttcagtacttgtcagcaaaaatcaaaccaccagggctccctgtttttacctccctctgagtcatttcctctccaattctctcctttaaatattattgcttcagtctccagttagtttcctctgtatattagttgagtgcttctgcttgaaaacaaaagtttaattttgttttttattttgttatttttatgaacatttctgtatttgattttgtgatcacgtttccgttaccttgattactaatagatcagtgatttttttgcagtctaattagtgatcgtatgtgtgactaaaagtagggggaggctgggtgcggtgacgcacgcctataatcccagcactttgggaggctgaagtgggtggatcatgtaaggtcagaagttcaagaccagcctggccaacatggtgaaaccctgtctctactaaaaatggaaaagttagcctggcgtggtggcaggcgtctataatctcagctacttgggaggctgaggcaggagaatcgcttaaacataggaggcagaggttgcagagagctgagattgtgccattgcactccaacctgggcgacagagcaagactccgtctcaaaaaaaaaaaaaagctttgtgttgggaatggaaactttgggcagattgccagattattttaaatgattttatctctgtaccactgggctaaattcaagtatcttatctgaaaatagcacaacagctctgggggctggcactcgggtaagctctcctttcgcttatgaaatgaaaaattaaatttgtccaggtagatttatttgcttccttttgtcttgaccaagattagagttgtataaattgcc

SEQ ID NO: 33199 - DNA, 1716 bp, Homo sapiens
ggggtaggggagatgttgtcaataggaaatgggataaaatatcaagagacaatgaaaacactgccttgacatgaggaccagcaagtttattcttttcattttcagtgatgttgggaatggactgggttttaaaagggagcttgaagagggaatgtttgacagtcacagaaggttcctgcagcagatgcctcttttagccatttctcatttttttcctcaaattttacctactgaggctcaagccttcacagtgagctgatggtctctacagggaggggagtctagggaatttatttggtatttgtaaggcaagaggtgatttctctctaatatatctgagttattgctcatttaaaactgttaagtccagtataattttccctgatatgaaaaaatgtgcatttttttcacttagcaacaaagtaccttctaatttccaatagtccgtgaaagttggggctgaagtacctaagtgtgaatgtctctcccgttaaactgagtgtagaaatctgaatttttaaaagagctgtaactagttgtaagtgcttaggaagaaactttgcaaacatttaatgaggatacactgttcatttttaaaattccttcacactgtaatttaatgtgttttatattcttttgtagtaaaacaacataactcagatttctacaggagacagtggttttattcggattgtcttctgtaataggtttcaataaagctggatgaacttatcgttgttgctgcctgtttcctggcctataaagagggttgtgttctggaattcctgtactctggatacacatgaatgagttccagggggattctatgaatagtgtggacaattcgcgtgtccattttgattgactgacagttggaaataactattgctgcgtgtgaagagagcgcacagattttcttgtgaaagtgatcaaataggcaccaagcaacctctactgatggaagaataggttagttttccaaaaaacatgctctggatgattgcaagggaagggaaattgtgggtggattaagaacatcttatgtttcctgggctagagaacactaaatgtgagtctctttactgcaccattctttcctatttctcatggatagcatctgacctgtttctcactttaatcggagaaaagtgaaaattcaaacgtacagatgaaggcatcactattaatacatgttagtgaagtgtgagaattaaacattcagtttctcagtcaagctaagatgaagatatagaacatttccgttgtagaaaattcgagtgatggtgctgctgctctgagggtgagctggttagggcctgcactgctcactgttctgaaatgacctctgtcgtgactggaatgtcacaagaaaaaaattactcctcgccaaacagtacatgttactcaagacgagagaacacaagtttataaaggcatttagtttatttttcaaaaaaatactttgctagaagggttgagtactgtaattttacatgatcataatctctaaataaattctttttctgaccaacaggtaccagttaagtgaacagctcgtctaggtctgcttttgtaacacccaaatacaattagcacttctctgctggtattccctgggccgtcttaattatctagaggccaggaggcaaagcctagcacgtaacaaagtatgtgctttgtaactgctgattaattcagtttcttaactaggcagag

SEQ ID NO: 33200 - DNA, 1083 bp, Homo sapiens
aggcagggcttctctcccagattgcaggcttgcctcggggatacacaggtttcccaaatgctagaatgaaaagagattttattttggcttgctaacatcaaagatactagtttctccagatggtttattcagaacactgttgtcttatttttatttgtctgagattaaatgtcttcccctttaattaaagggaggtctctgatgaagtaggtttgggaactgctaccttggtgacagcttgagtctttcctttagtgaagtgcagcacaattccacgtgcacggtgaccttctcttgattagggtgccttggaatgtacagaacctaacttgaatatacagcactggtttcttggataagaagtgtacagtgatctaaacttgcaaaccaaaatacagagatgatgggaccaaaaattatcaacaggaatgtccaagaaatatgatcagtgtagccatggatacgtgtcatatttgactctatgtgcttccaaaccaatcgcaaacaggcctgggcaagctgaattactgtctttgaactccatctggttggattagctcttgtactttttaacaactcagcttcatttacatgttgttcccctatttccagaaatgtttggaaaaatgctagtgttccttaatacttaagatattactcacgcgcagatgcggaaaacgccatgcggtacataaatgggacgcgtctggatgaccgaatcattcgcacagactgggacgcaggctttaaggagggcaggcaatacggccgtgggcgatctgggggccaggtatgcaagaagggtctctgggctcagccattgcctgggattccagtcacaatgacaggtgttttggcaatttgtatttactcttttgtaaataactttgtgtctataaccttggcttgaagtggatctgaaaaccacccaacggtttgggtgaattttttttttaaaccgtgaaatggtatgttctgtacgtttctaacaagcaaccattcttgaacttctgctagggctaggtatcttccacctgcaggaacatctaaaatgaaagcaaaacgcactgaagtgagctgaag

SEQ ID NO: 33201 - DNA, 1033 bp, Homo sapiens
tgtggggaagcctggacaacacccaggctttcttgggcagaggtccccatggctttccacagtgcattgtgtccctgggtactcaagactggagaatggcgatgacctttaccaagcatactgccttcaaacacattgttaacaaagcacatcctgcacagccctaaatccattaaccttgagtcaatacagcgcatgtttctgtgagcacagggttggggctagggttacagattaatagcatttcaaagcagaagaatttttcttagtacagatcaaaatggagtttcttatgtcttcctttttctacatagacacagtaacagtctgatctctctttcttttccccatacagaccttacgatttcattcatatggaagttcaggatagggaattctatagagacagaaagaagattagtggtttccagagtctggggtggtggacaaggatgggaggtgataactaaatgatatggggttcttcttgagtgatgaaaatttgtaaaactgactgtggtgatggttgcacctgtctacgaatataccaaaaaccattgaattgtacactttaaaattatacggtatattaattatatttcaataaacctgttttaaaaagagatagcctcaaaaatacagacacttctcagtttgtcatgtctggacgagatggctggaactgaggattatgtccacacaaagagaaaggcagcatcaaggctgacctgagaagcggcaagggaccctggcagtaccaagtctggttgtttttttatgtgacatgatcaattgtttcctgctttttcttttaagagatgggggtctcgctgtgttgccaggctgaccttgaactcctggggtcaagcaatcctcctgcctctgcctcccaaggagctgggactacaggggtgcaccaccacacctggcaacatgatgaattgttgaagcagcttgcattgtttttgctgttgttgtttgcaaacaactaaatgttttatgcaaaaaggagttaatatagggaattagctgc

SEQ ID NO: 33202 - DNA, 1020 bp, Homo sapiens
gccagtgacaggatttcattcttttttatggctaaatagtattccacggtgcatgccaatgacattttctctatccatcctctgttgttggacacctgggttgattccacatcctggctattgtggccagtgctgcgataaacatggggtgcgggcatcccttccacaggctgattgcctttcctttggacagattcccagtggtgggattactggaccatatggtattcaatagttcgatttgtagtttgtggagggacttccgtactgttttccatagcggctgtccgggtttacatccccagcaacggtgtgtaagagtttcctttattctgcatcctcactagcatttgttattttttatctttttgataacagccaccctaactggggtgagctgatacctcactgtggctttgatttgcatttccctgatgatcagtgatggctgctggcattttgtatgtcttcttttgagaaacgtctgttctgatcatttgcccgtttttaagttggatggttttctgctgttgagatgtttccgttgcatgtgtattctggatattaatcccctgttggatgagtagtttgcaaatattttctctcattccataggctgtcttcatttcactctgttcgttgttttctctgctgtgcagaaacttgtttgtttgatacaattccctttgcttattattgcttttgttgcctatgctttcgaggtcttttcataaaatcttttctcagaccaatgtcctgaagcgttttgcctatattctcttcagcaattttattgtcttgggccctgcatttaggcctctcatccattttgagttggtccctgtgctgggtgaggggtagtttagggccccgttcattctgcacttggacattcagcttcttcccagcagcgtccactgaagaagagatcactcttttcccaaagaggttcttgaaacctttgtcaaaaatcagctggctgtaaaactgcgggttaatttctgggttctctattctgga

SEQ ID NO: 33203 - DNA, 1031 bp, Homo sapiens
gaagatgagggtctgattttttaagcaatttgcaaacccctgcactggatctcacctaccagcccttcctggcatttttctcctcttgcctggagaatttgtccctcatccctgggaaggtttaagatatagtttggtgttgaggctgggcacggtggctcatgcctgtaatcccagcactttgggaggccgaggtgggcggatcacgaggtcaggagaagagaccatcctggccaacatggtgaaatcctatctctgctaaaatacaaaaaactagccgagcgtggtggtgggtgcctcaaatcccagctacttgggaggctgaggcaggggaattgcttgaacccaggaggcagagattgcagtgagccgagatcacaccactgcactccagcctggtgacagagcgagactctgtctaaaaaacaacaacaaaaaaaaaacccacaaagactggtgttatatattgagccatcatgtcatttaagttttttaattttgaaagaactgagctttggaaaacttacaagaataactcaaagagctcccttctattcttcacccaaattctaactgtttagcattttcccacattttattgtgtgtgtgtgtgtgtgtgcgtgtgtgttctgacccatttgagagtacatttgcctatgtcataccccttgaatactttggtatgtatctcctaagacaaggaggtgtgtacctagccacagtaatccaaatcaggacacgcaactttgatacaatcctgttatccagtctatagccgatattgcagattcactcaccgtcccaattctgtccttcatgcccatttcttgcagaccaggacctaaactcttaccacgcatggggtttagttgttagatctctttactttcctttatcttggaacagtttctcagtctttgtttttatgacattggcattttgaagcatcaggccggttattttatagaatgtccctcaatttagatttgcctgaagattgtttctttttttaaattgagatataatttaca

SEQ ID NO: 33204 - DNA, 1370 bp, Homo sapiens
gtggattccgcccgggaactcgcggccgcacttaaggagctcgggccagcgcgagggggagcagggaggaagcccggctgctgcggacctcctcggacccggacccagccccagcccggccccagccagccccgacggcgccatgcggggtccgagcggggctctgtggctgctcctggctctgcgcaccggtgaggccccgctgtgagagccaaaggcgggcgggggtcccggggcgccgcggcccggctgagcaggtcccggggctggaaatgtgcctgagcctgcggctccggggcagtgagacgggggaggcaggggctcggggtcgagtgaggacggcggagggaactagcactgaagcgcagacggggaagtctggaaggcttcttggaggaggcggcctcgaacacccgaggcttccgacgctccaaggagaagcgcgggctgaggcgtggtggggaggcctcggggtgtggagaggagctcccggagggcggcccctcccgacgggcgcaggaactcaggaagactttgggggctcggagcagctctttctcccgagcccccgcgggagaagattcagagggactgaccggcaggcgcgggagtccgcccgggggtttctggcacatgcagggatggaggtggagacggaggccgggtcccctcgcgtcggcgccccggggagtcagggcccgggatggtgggacgggaggcgggacctcggggagcggctcgcggggatcgcgggcggcgaccgccgaggggatggagttcgtggcaccgctgtggccgcaggcgacgcactcatcaatgcaaacgatgaagccaccgccacccccgccccgtctgaactttgcagtttcccgcctgggtggtggggggcttggagcgctgcggaggggagggcagttcgacttcccaggcctccgccaggagtggggaggggagggctgtggcggaagcttcagtctcggcccttgggctggtggggctgccacgggagggtgacctggtttcgggcggagtcatgcgtttccctccctcctgcacaggcctctggcagtgctggctggggcagggtgaatggcagaggagctcaggcctgaaagtcatcggccccaaggggctccagcaccccttcctctgggcccctagcctgggagctctcggggactctgacccggtcagatcctgaggcataagcagaagtccactgaggatgtgggtgtctcaggctctctacaagggggtttactttcaacacagaaggtggggtttttatctgctctctcagaagatgaagcaggctcagagaggcttgaacctaccctgatgggtcctcagcctcccctctgtgcctgccg

SEQ ID NO: 33205 - DNA, 1018 bp, Homo sapiens
gaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggagtctttcttgagtactgatttcatgttgaattgtatcccacacatcatggtctgcagcttctttttcacatgtagtgtctccttcaagttacatcgtgtgtattatttaatgtcactattggttagtggccatttttcagaactgaagatggaatggcctgaccagctattaagaacgtggggagacgcagaaattgtggtaaaattccttaatgtttaagggaaagtaactttaagagatttttggaaaagctttatatacattcttttcaaatttcagtacaaatgaaaaagtggttttaatcagtgatttagtagactttgagcaactgtgcacgcttcagtttaatagcatggtttggccagtgtattactctcaagtccttttctcaatcaacttctatcatcaaagcaattgtttcattatagataaataaggacattttttaatttaaaaattcatgtctgagttgactttcataagggatttcattttttcctcaacattcttaaagccttttagtatttgacggttcttttttcccaggacatttgctaggaataacaacgtttcaatgtttttaatctacttgagcaacactatcgtgtcttacaaaagttgttcatatgtaaatgatcatcacatttcgtgaattgaggccatgttcaggtgctaaggaagttcgccttttacacagaagattgagaaaatttcctagatataaatacagataaatcagacgttacagtggtgacgtagtaaccatcatggcaatggaaaggagtccaattcatagcctaaaacttcaaatgtattcttaggagtcagattttactgaatattttacccacaatagctgcc

SEQ ID NO: 33206 - DNA, 1043 bp, Homo sapiens
ctaatattgctcatctgtgtttgaaacatatacttcagaaaatgttaaggaaaaaatagaaaaggaaaagaaaaatagaaaacctaaataatctagtacttattaaagacttgaacccgtcataaaaagcctttccacaaattaaatactaagccaagcagacttactaaattctaccaaaagctaagaagctatgtcaattttatacaaacttttcaactaatttatgagcattaatttgatacccaaacctggaagggactatataggaaaggaaaatgataaagtcagtcttaattatgactatagattgcaagaacccttaccaaaataggagcaaattgaatcaaacaatttttttaataaggcaaaatgtaacaaccaagttgggtatattcctggtatgcaacactgctgcagcatttaaaaactaatcagttatggagctagagggaagatggcagagtaggaagctctgggaatctgtctccccacccagacgacaactgcactggcagaatctgtctgatgttactatttcggatctctgttcaccatttttatcaggttgggaactctgaagtctattgaaggcttatgacttccaggggaaggtttgaaaggttaatttcagctcttaacatggtagcaactacctgttcgtctaccctcagtcccatagcatgtagccatgtacacattttcaagcagctttgcatagggtttgtgggagccagtgtggacaataaggattctgtcctccaaatagcaggaatctttgctctgatagctaattactgcttctgatcatggaggtgcagccatacagtgagccattgttgcaaaccccactgccactgttacaagcccctccacttgaggctgaagtgacttaaagatttaaagggccattgccttcagtggtgattagtgaggagaaagaaaaaatattaagtaaaaacaaagggctagtgcttccctcttccccccacaccacagacacacacacacaccttttttccccctccccttttgggggccag

SEQ ID NO: 33207 - DNA, 1033 bp, Homo sapiens
gaagtttgggagaatgcagctaagtcatcatttgcgaaaagctagaaataaaaacccgtgccgctttcatgctttaagggaggtaattttgaaaaagctcaagggactaaaactaggtaagattcctttaacagagactgaaaggaaacataactcaataaaagatacataaggtgctcagaagtaaaattatgacataagatttgagacaaggtttgttcttattacatgtaggctttccatttttacaactttccatgttgtacaacacctcaaaaatttcctcaggcacgtaggtttcctgttacatatgtcttttctttcttctcactttaaagacgtacgcatagttgtgcagagcttctaaatgccaaaaacagacttattttcatttgcattacgaataagatgtaagagtagtttcattgcttcagattgatgatgtagtattagaggagagcagaagagaaacatgatgtactgtatcaggaagaagcatttgagtacaatgataaaacttggttagagagatttgagatagatctgttcatcaaacatcataaacaggctgggcgcggtgactcacgcctgtaatcccagcactttgggaggctgaggccagcagatcacctcaggtcaggaattcgagaccagcctggccaacatggcaaaaccccgtctctactaaaagtacaaaaattagcaaggcatggtggtgcacacctgtaatccaagctactcgggagggaggctgaggcaggagaatcacttgaacccgggaggtgaaggttgcagtaagccgagatcacgccactgctctccagcctgggtgacagagcaagactcaggttttttttttgtttttttgttttttttttttttaagacaatcataaacaaaaataaaaacttgaagaatttatttgtaccatgtatgtcacaaggataatatctttataagtttttaacaggtaataagaaataagctaactctccattagaaaactgggcaagagtgctcagaagataagcaa

SEQ ID NO: 33208 - DNA, 1031 bp, Homo sapiens
tctttgattatctttttattgcttgctctctggggactaccctctacaggagatccctgacgacatgggatcaaaaggcctgagtaagtgatcaaaatactcccaagttattttttaacctccatctgcagacctaccttattcagatacattttgagattcatggtagtgcctttctggcataaggaggtgtatgatttagattgcttttagaattttcatgtttatcacatgcttgggactttatttctgtaatacataactttttgtttttatttttcacatgtcatttgaaaaattctcttgctcgtaactatattttcctttttgtaatttttacgacagttacttttgctaggaacttttaaaatataaaaacttttaagatttttttaaatgtaccctcattattagaatgtagaaatatgcttccttggagttttatgttccccttttttttgttaaaataatttaaaataattttgattatgtgttagaaaagcattactataaaagtataaagcacaatagaatactacgcaagtagcagtttattgaggggataggttgtgtatctcttttttttttttttttttttttttgagaaagttataagttaccacaagagtataagaactattttgtttttcctttagctaagatgttgcctttgtttttggtttttgttgctgctgttcttgtttaattttctagctagttacttaatcttcatgtaaagcttcacacagggtctagtatgtagaagacattcaataaatgttggcatgaatgaatgaagcaagaagccattttagcaaataaaatttttaatttgcatgttttcaaattgcttaactgaaaatttaccaaacattactgagtaactttaggtgacagtgagtgatagaagtaatcttttaatctaatattttctaaatggttctttctatttagattattaaatattttgaaaacttctttgtcattcattgatcattaagcctatagccagtatcttttaactttctaag

SEQ ID NO: 33209 - DNA, 1054 bp, Homo sapiens
ctccaggcgcgtgtcactgcacccggctaagttttttgtttttgtttttgtttttgtttttgtttgtggagatgggttctagctatgttgcccaggcaagtcttaaactcttggcttcaagcgattttctcaccccagcctcccacagctctgggatgacagctgtgagccactgcagccagccctaatgattcattttagtgattcatgggtgtatacttagcacatagcaaaagtagttaaggacaggccctctttgcaaaggatggtcccagcttagaggacctcttctaaggcctgtgaagtgctgttgagtgtctctgcttttgtggggaaggtgttaaaatgtcatttcagaattcccctgagatagcttatttatgagatctgcttcatccaaatcattgtctggaagttcttctttaagagctttttaaagtagtagtagtaagatagccagcaaaaatagttaatgagatcataaagaaatgtttattataactagttaattcattttaagtcgattatgctgtaataaacatctttttcttattagttgaatttatacctatttcgtaactatttctagacctttatttatttacctgtttgtagaagttgaaaagtaatattattaaattataatcaagatttataattatgattttcgggcttataactgctgttggctgtatccatatatttagcatgatccaactatttggctagatctttcagttgatgacaaatcctcttttagcaatgcagcaatcagcataacttttttccagaaatagaacatagtctgctttaaattcggaaatgcttcctctatgccttgttgagtcagtagaaaccttacatcttaaatatcaaggtcagagctcctaaaaattgtcttggttcttggagtctcataccttacaaaggctttctgtgcctacacccaataataaacactgttggcttcactggagagatttttttttcattttgtacaaaaattctataagattgtgttttaaagcaagcaataatgtaagaaagatatctt

SEQ ID NO: 33210 - DNA, 1039 bp, Homo sapiens
aagaaaatatattgccaatcagtgttgttttttattattgattctctctgacagtgtgcctttcaagaattggaatattattgtattaataattttattaatgaaagttatgtaatccttgaataatgatgatataataaaggaagaaatttctgtggaccagaaattgttttcagattgatgtgttagtagtgactacaagcttgatgatatcatgtctaacacttagatttaacctctgtccttttctaatatattttccattcaagtaacatttaattacctggcaatttccatagtagcaaaggaggcatatgtaaataataatttaaaatgtgaatagcctcggtaaataatgcatatttggaaaatttctacatgcattttttaaacacttgggagaaggcaaatatgttattttcctataatatataaaggttaagtggcaacataggtctaataaataggtgatattagtatataaactggggtgtttctttttttttttttcatttcgttggcttataagacttaaaacagaaatccgaatgtatttgtattctgtatacttttagtagaactttaactgataactttattatactgttactgtaacattagcactgtaagtaatctgaaccattctttataaattatcatctcagtcgtcctgattctgttgggggacctgttcctaatacgtttcatttatccttctgatgagagagatatgttacatatataaacatgtatcctatacacgtgtatctatacacacaaacaggtactctgtacttgtttacatatgatatgacttactgtcttcacataatcttactctgatacatcatgaaagcaaacctttctcactttcttctttctgttccttttgtcttttgctgtacttggtacttataaccctaccagtgatgtgggaatcttaaatgcatcagatttttttttcccttcgccaattctagcagtactcattaaactcttgtgttccaaagtcattaaaagtattttatatatacaaata

SEQ ID NO: 33211 - DNA, 1025 bp, Homo sapiens
tcaggagtttgagaccagcctggtcaacacggtgaaacccctgtctctactaaaaatacaaaaattagctgggcgtggtggtgcacgcctgtaatcccagctactcaggaggctgaggcaggagaatcacttgaacccaggaggcagaggttgcagtgagccgagatcgcgccactgcactccagcctggatgacagagcgagactctctctcaaaaaaaaaaaaaaaaaagaaagtacaaaaaaagatagtagatttaaaactgaatcgcccaaaactcctcctctccctcaaaaaaattaggaaagccaaaccaaaatttgttaaaaatctacaataaaactagacaaaaagatgaaagatatcctatgaaccccaaatataagctgatgtaaacaaggtattaacagctacaagaccatctgatatcagcatctgtgcaaggggatgcaacaggagaagcccaatgttaaccagtcctcacaagaaaatgcagtaggtaaatttgagaacaccaagtgaactataagagtttttgtacaatctgcatgttgagtgcaaggaatctacactaagatatgaaggggccacgagcagtctgggccctatgacacagttaaccagctgtagttccctttccatttaaagccccacactaaggaagaactgctgggaataaaatccaaattgagtaggatagggataatagagccaaaggaaatagaaggttcagattaatgggggtaagtaaagtttcaggaaatctcacagtgtctgaggtcatgtctttaaacacttgagagaaacaacaaaatagagagttctagagctgtgaagttagaaaacctatcttgactcgtaactcctatgtaaaagttggggaaaactaatttcatattaaaatgagcagtaggaaaagatcacagtcaaatccatggaaacctatttgaaaagtgaaaataaggattagcgtaatgtctccacagtcaagctgtaccagaaagacatatagtttatgaagctag

SEQ ID NO: 33212 - DNA, 1050 bp, Homo sapiens
taatcttatatatatacatacaagacagacagatagagacaaaggtaagcttttggtagaattaagttttttatctttcaggatctatggtttgccttattagtcttccaaaaaagtacttttatgggtttttcagcttgtgtactttgaactttcttgacttggattctgattatgagaaaaaataatctctacaagacatatgaaggaacattatcttctaactcctttcagttttattaattccaaaggcaaggaataattcactttggggggcctttactgttaatctttttggagaatcattatcagaaattagctggacgtggtggctcaggcctctaatcccagcactttggaaggcctaggtgggaggattacttgagcccaggagttcgagaccagcctgggcaacatagcaagatcttgtctctgctaaaactttttttaaagttttttaattagccatgcgtggtagtgcgcacccgtagtcccagccaaggcaggattgctatgatctcaccactgcacttgagcctgggcgacagagtgagaccccgtctcaaaataaaaataaaaataatcgaacatgggaactggaaatataatactatactcgttttggactccatatcccaaagttataaagttttatcacatacttcctatagtttaagaatctcttggccaggcgcggtggctcacgcctgtaatcccagcattttgggaggcctaggcgggcagatcacgaggtcaggagatagagaccattctggctaacacggtgaaaccccgtctctactaaaaatacaaaaccaaaattagccaggcgtggtggcgggcacctgtagtcccagctgctcgcgaggctgaggcaggagaatggcgtgaacccgggaggccgagcttgcagtgagccgagatcacgccactgcactccagcctgggcgacagagcgagactctgtctcaaaaaaaaaaaaagaatctcctgtgatagtatataatagtaaaactgtacgccatgcatgatacgaaccatgttatgttt

SEQ ID NO: 33213 - DNA, 1063 bp, Homo sapiens
gaatgacagcatatctgttgacagcatggtttactgaatattttaagccaactattgagacctgctgctcagaaaaaaacaaaaaaaaaacactcctttcaaaatattagtgctctgagacaatgcacctagctgcccaagagctatgatggcagtgtgcagggagactgatgttgttttgatgcttactaacttgtcatccactctgtagtccatggatcaaggaataattttgactttcaagtcttactatttaagaaatacattttataaagctatagctgtcataggtagtgattccgctgatggatctgggcaaagtaaattgaaaaccttctgcaaaggattcaccagtctagatgcctttaaggacattcatgattcatgggaggaggtcacaatatcagcattaacaggagtttcaaagatgttgattccagccctcttggatgacttggaacaggtcaaaactttagtggcagaagttactgcaaattggtagaaataataagagaactagaattagaagtggagcctgaagatgtgactgaattgctgcaacctcatgataaaactttaacaactaaggagttgcttcttatagataatcaaagaaagtggtttcttgagatggaatctaatcctggtaggtgaagatgatgtgaacattatcgaaacggcaacaaaggattttgggatattacataaacttagttgataaagcagcagtagggtttaagagaattcacttcagttttgaaagaagttctactgtgggtaaaatgctaacaaaccagcatcacatgcttcagggaaatcttttgtaaaagaacgagtcagtggatatggccaactgcatttttgtcttattttaagaaattaacacaggcaccccacccttcagcaactaccaccctcagtatcaaggctatcattattaaggcaagatgctccaccagcaaaaacattataacttgctgaaggctgagatgattgctagcggtttttttttagcaataaagtatttttaaattaaggcctgtacattgtatttttagacata

SEQ ID NO: 33214 - DNA, 1021 bp, Homo sapiens
attaccaaaattatcacagggggagcagccgcccaagatggaagattgcggtatgttttgcgctttttattgtgatgctgaatccactttgtgtatttttcttgaagcagactggataagggataaatacaaataacaaacacgatcatgataactagcatagggtagatgctttaacaacattcaagtcaatgaatgagataattatgctctaagcattgtgttcctgttttcatttagactccagttttatcttagatattataacattttgaataacaaatttggttgatggtttaaatctttgtgagcatatttatagaaatcatgagtttccctttgtgttttcagatacactcacagaatattttccatttcctctctggctgggaaacatgtgtataaacttatttaagtacactcacagaatattttccatttcctctctggctgggaaacatgtatataaacttatttaagatacggaggatagaggatcacacatccatgttgaatcccacaccacaaagactatatgcaaactttaaataatatattttcttattgactagatgaaaataacatttgtctctgtttaaatttagtgttccattttggaagatatattttgcaaactttgattttttgagggtcataaattatgtcatttttcctatttccttgtttgttgttcaaataccctgaagttttaggactaaagagtttatgtagtctgttaaaaacagcatcttattttaaggacgttgatgccttacgcagtttttgaatttctaagctttataattctcactgggtatgacaggtggtatattaatgaaatcaaatagatataaaaattaatcatttgaccattcatgtaaatgtagacatttacttcctgattctgttagatatagaagcttgtcaggaccagttttaatattttaattatgttttgtttaccctctctacccaatttgagatgaccatctttttttcctggtggaataccatgcaatca

SEQ ID NO: 33215 - DNA, 1068 bp, Homo sapiens
cgctttacagtgatggagaggatgcttaatgcacgtcaggtactggcacataatcttagccgcccatatttttagtgttatctcatatttctctgagacagcaaactaaggaacaagttttgttttgtttttttaaatgaggatatttattgaggatacacacaaaaaagacctatttattctgcatagcttcactttaggttttaaatacactacggaagttcatgaaagatagttttaccatttttgttgtgttatgtgagaagccaatgagtgcacctcattttccagaataagtgtgttcctaattagtgaagtacaatgtgtacattataaaattaaaataatggactaaaatatccgtccccaagtaaaatttaaaatacatactaacatataacccaatttcaacatattaagtgaatatgtattcttaaaagatccactactttacatttagatgcgttaggatgtattagaaataaaaacagaagaaaagatttagaatctagtctgtctttgccactcaagctagttaccctctctgagttttatacccccttcatctattaaaatggggggtaacgccaacctgactcctttaaaatgagtttgagagtcaggcaaattagaaagatacatagatgaaaactttttaaaaagtatatagtctttcatgatttgtagaacacttttatacttttcagagtactttcacattgatcatattgtttgtactttatgaaagtcttctacaaatcagaattatgcttattatacagagtggcacagataaaggtaatatttaatggctgcttaatattgcagaaagaacgtggagtttatagtcctacccgactccaccacttcctagcttcacctgtttctacgtgtgatggtgtggaaattactcaacttctgagagcctcagtttctccacatagaaactgagtacagagtaggtgacagttactagttcttcttactgggagtgtaaacacataatctctgtgatactagcctattaaatccagaggcttatttgcaccctagagtaaatactctgct

SEQ ID NO: 33216 - DNA, 1022 bp, Homo sapiens
aaaatacaaaaaaaaaaaaaaaaaaaaaaatagctgagcatggtggcaggtgcctgtcatcccagctacttgggaggctgaggcagagaattgcttgaacccgggaggcggacgttacagtgagctgagattgcaccactgcactccagcctgggcaacagagcgagactccatctcaaaaaaaaaaaaaaaatcatacccattgtgtgtatattatcacgttttgtgtatccgttcatctcctgatagacacgtggtttctttccgccttttgactgttgtgtgtgatgctgcattgaacattggcatacaagtgtccaagtccttgctctcacttttgggaatatgcctacccagtgcatatttacctacccaattgctagatcagatgctgattctatggttggtttttaagaaaccactaaaagtttcctcagaagctgtaccattttacatttcccaccagcattgtaccagagttccagtttctccacatccttgccaccacttgttactttgttttttgttttgttttaattagacacttcccttgtagtggtgaagtaatctctcattatagcttttatttgtattaccctaaggactaatgatgtcgagcatcttttcgtgtgctaattggccacttgtataccttctttgcagaaattattcaagctcttcacacattcattaattgggttgtttctctttgtgttgttgcgttgtaagagtctttaaatgttctggatattaaacccttatcaggtgtatgatttgcaaataccttctcccattgtgtaggctgtcttttcacttgcttggtaatgccctttggtgcacaaaaggttttaattctgttagagtctaattgatttttttctttcatcatttatgatttctaaggttccattaccaaatccacggtcacaaagattaaccctatgttctcttgtaagagttttatgttttcaaatctcatatttaggttgttaatcaattttgagttaatttttatatataat

SEQ ID NO: 33217 - DNA, 1029 bp, Homo sapiens
attcaagttatatacctttggtagaaatatcctggaagtattgtactctcattacattttatcacatgatatatgattttgatttttcccgttactggtggtgttaactttgatcacttgattcagatattgtctgcagatttctccactgtcattaatgctttgaaaggagacacttttgtatgagtatatcccattcatccactggaatggacgtttcacttggcaacaggaagttttaatattcattaatatttcttgaatgaattactctattactatgatggctgccaaatgatgattttataattccatcattacatttttagttagcattttgttgtaagaaaatgctcttatcttcatttatttattgatgtatttatttatatcagtatgggctcccagattcctattttattcagtggatgttatgccattgttatcattgagttacagattgttcccagtctggccagtggcagcccttcaagccaacttctgtgtcctttgtcatcctctttgagtacttcccttatcttctggtacagcaagatgtctacacacatcttgtgcttgctgagctctagcactggagtcagccatttcttcaaagacccatggtttggttttgtttggttttgtgttgtggtttttttccccccgagacggagtttcgctcttattgcccaggccggagtggaatggcgtgatcttggctcactgcaacctctgcctcctgggttcaaagcgattctcttggctcagcctcccaagtagctgagattacaggtgcccgccaccatgtccagctaattttttgtatttttagtagagacagaatttcatcatgttggccaggctggtctcaaactcctgacctcagatgatccgcccacctccgcctcccaaagtgttgggattacaggcatgagcctccgtgcccggccatgttgtgttgttttaaattgcagaatgagtatttagaaatcaagatttggatgccaggtgtattcgtgctgttgagct

SEQ ID NO: 33218 - DNA, 1026 bp, Homo sapiens
cagtcagttcaactttagtaaaaataaaaggacgagaaatggtctaaaaacaagttgagaatgcatttgtcctctgacatcagtgatatttaaattaggaaaatacatacatacacattccttaggaccttttaaaataaattcccttaaagctgtcttttaaagaaaataatagaagcagctcaataaatataaactataactgtcaacagttctatatttctttatatgttttttataaatttctttactgtttttggttactagaattgtcttttaatggtgttgatttaaaataacatcagctttcttaagtaagaaattctacttacttttctcaaatatttgggagaaatggaattacctaggaagggggagtcattatgtaggcattgaggttaagttacaatcaaaacttattgaatgggcaacgattgatttaactcttaaattgaatactgccccaagaattttactaaccttattttgactgcaattacatatatcacgaaaggatgcaaagactaaaggttgacaatgttattcattgtagattaatactagatgatattttccattgtcaacaagacagatatctttagaactttttatatatatatatggtttatgtaaatgcacacccttctatatatgtatgcacagataacactagcattgatatatctgtcactcggtttattaaaagcaggcaaatgaaaagacaggaaaagtagttcatgtataaagtgttgaaaccacagagttacgttatagccgcttgggagtaggagcagaacgttgctgtgattgcgccagaagagagtcatgacccctgttcgcagtcagctctgcaaagccattttacatgacagcccccacccagtttggttcagagcattcctgtatgctagtatatgagttattaatagtttttatttctttcagacctctttcctgattctcatcttgtctttttcattacctttctattttatttctagaaataggagtattagggtagaggtt

SEQ ID NO: 33219 - DNA, 1104 bp, Homo sapiens
gattaatatgacaaaacccccctttctgttgttgttttgttttgttttgtttgagttgaagtctcgctctgtcgcccaggctggagtgcagtggcgcgatctcggctcactgcaagctccgcctcccgggttcacgccattctcctgccccagcctcccgagtagctgggactacaggcgcccgccaccacgcctggctaatattttgtatttttagtagagacggggtttcaccgtgttagccaggatggtctcgatctcctgacctcgtgatccgcccgcctcggcctcccacagtgctgggattacaggcgggagccaccgcgcccggccgacaaaacccttttagcagccatctccgtatatgattcttgtaattaaatgcaaggtgatcaatcttgggatgtgaattggaacgcagactggcctttgggaggtttacaagttctccaggtgtttctaatgtgcgggcacagttgcgaagcattgtgccaccactattacggctactatagttgacccttgaacaacacgagttggaactgcactgctccacttatatgcggatgaaacaaatgcagatttcaaacaaatgcaatcaaacataaaagtatttgtaggatgcaaaacccaagtatacagagggctgacttcctgtaagtgcatagctgacttcaggacttcagtatgtgaggatttgggtacagtatgcgaggattcacgggggactagtcctggaactagtcccccgtgaatgcaaagcttgaggtattttcctgcactactgtgctatctgtgttgagctattaatatttacaagtaaacttctgacatcatttgtcgaatcctccttctagagtgagagacttaaattgatagtattgagagagaaagcattcatactttaagattttcactgctttcttaatctgattcatttcttccttaattttctgaccataagagatgagaagtcagttttttggtatctgctttaaattgctttttctttacatatacttgctttttgtttattctgacaatgataaaggattatgtccctcacagctttttaaagaaatattttatagaggcttaaaggag

SEQ ID NO: 33220 - DNA, 1035 bp, Homo sapiens
taccagccttcttttctagtagtattcttttataaatgtttcttgaaacagcatttttaaatgtatcccacaagtttgaatatgtaatgttttcttattgtatttttttaatgtctgatgtgatttgttttttgttagcctcgtgagttacttagaagcgtgtttaattcttaaacattagagactattccttccattttgtcttttttgtttttgtttttctgagacagggtcttgctctgttgcccaggctggagtgcattggcagtcatagcttactgcagccccaaactcctaggctcaagtgatcctcccagctctgcctcccaagtagctgggtctacaggcacatgccatcatgcttggctattttttttgtttggtagagacagggtcttgctctgttgcccaggcttgttttgaactcctggcctcaagtaatcctcttcccttgacctcccaaagtgctgagattacaggtgtgagccactgcacctggctcatatcttcttttggattgtattttctcatctcactttcccttattactagcttggaagttaaaaattgtttctcttcctttagtggttattgtagaaattttaatatatgtttaacttttaaaagtctaaagtaaataaatgccattcactcttactccagacaacataagaacctcagcacgggtaaagccctaacactgcttgttgaatgtgctgttcttgtcagcctgcttttatcttgattgagttaatctaatttatttattatttttgtccaaaaacactcccaggatatgtataatttttttatttctgatgttttgaatttccggtcatccttattgttacaaaccaaccaaagccaatttgcacatggccaactctggtcttttggtaggtattttagtagttattttggtgtgtttgcagattatgacacaagcagacatttaaacagtgagccagcatgcatattttatgtagcctattctttaaatctcatgaaacctcagctttccgttgttgcctaaaa

SEQ ID NO: 33221 - DNA, 1032 bp, Homo sapiens
ctgtgtcctttctggttttgataacagggtaatactggcctccattcctcaacacatgttaatcctcatctgtttcaagaattcatattaagcctcactgctccttttatgttaatgtgttgctgtttttcttaaaatgaagtatattggcttgcatggaacaatatgtggtaccaaatatttcttttaaatttactactgaaataataagtatttgaggggtagatagggagatatttgcacactaataatatttgttcaactgtctggtattgatttaagaaccttgtactaaatattttattaaatacttagtttttggccttaattttagttattttggattttctaatagattcaggaatctgcatcatttccataatcagaaaattgtttctaaagaaagatatctggaaattatctaacaggaatgaagtagtaatttagtcacattcctatatgtaagtcatagtagtgagtaaaataatattgctgatattgttaaccaagattaagggcagtgtaaagttttatgtcaaaggtagtggcctgaaaaacataaaaaaggatgaggaaatgtgtttagaatgttcttactataatcatttaaaaatatgtttcctccttcatccctaaccctcatcacactttgtaattctttttagtataagtgttaggtaagttagacttggaccatccttagggaggccttagttttctacattctactttattggcaaactggttttatatgaagttttcagtgttacaaaaaattggaaataggctgagataaacctttagataacaagaaatacagatgaatattgctgtgtaatgtaatgatggccctgaaagctacttggaagtactttctcaaataataattgtaatgaacccaaggtttctcttttttgaataattacaggttgagcatcctttatccaaagcacttgggaccagaagcgtttcggattttggaatttttcagatttggggatatttgcatatacataatgagatatgttggga

SEQ ID NO: 33222 - DNA, 1091 bp, Homo sapiens
taaattgtttgcttgttcttgttccatgcattagagagagggctggagggttttgtatctttttcttagggactaagaagtttttaaatgtgtttgtgaaattagtcctttggatttaagttacaattttttttcgtattttttaacgttttgacttctagtcaaatttatcagtctttttttaatggcttctcagtattatgttacagctatataggtctttgttatagttataaaagaatttctctagaagaatcttgtgttatagtctcatttaaaaaaatcttcaggatatttttgttgtagctacccattttcccccttgctatttattgaataatcttttaaccaatgatattggttgaagatataaactttattaaaaatagtaccaaatttctatttatatgccgattttcatctttgtttcactaatctttctgttcttgtaccagtaataccatatattaatcaaggttttataatagattttaaaatttgttgaagattgtgcacacttactccttatctatagactttctttttttcttgctggttttttacaagaatttcagttacctcttctaattcctgcataaatatttgaataaatgaataaattttctgttggcctttttattgggattatgttaaagataaaagtatagataaacttaggaaggagatgatatctttgacttgattctttctgccaagaacgtggtctgtcttcttttcatttggtaaagccggacatttggatactttggttttattcctgggcattttatcttttttgtttctatttcagatatggccttctatttccttgtaccatctaattgcttattattagtttaaatcagagatttaactttgcgtaaagtttgtgtaactttgcgtaaagagcagactttgcgtgaaggacaaactttgcgtaaagagcaaagagcaaactttgcgtaaaggaccagatagtgaatattttagcctctgtgggccgtctgcttcccagctccgccaccgcatcacagaggcagctagaaagcagccatacatcatacatggaaatgagaatgagtgtggctgtg

SEQ ID NO: 33223 - DNA, 1020 bp, Homo sapiens
cccacctcagccccccgagtagctgggactacaggcgcctgccaccatgcctggctaatttttgtattttttgtagagacagggtttcgctctgttgcccaagctggtcttgaattcctgagcttaagcgacccgcccgctcggcctcccaaagtgttgggattataggtgtaagaccacacctggctgtatgttagtattcttacaacaaaatgtaatcagttgtatggtatttttgctaaatcaactttgtaagcctacttataacagaaatgtccacattattgtgggctattctttgccagacaaattgatggcaaattcataggtatctaatgtcactgcttaattcctgccgtttcaaaaagacagcaaataagcaaaccacagcattaattcttcacgtaatttaagaaaaatagtgtttctctaactccattaatcatttaaatcccatatggttctcttacagcagtgtgatctagctgcatttcttcactgttaagaactgttaggcgcttctgttggagatagtttctaatgttgaaattatcagtgaatgttcattaattcttcatgttgaagctgtcaccatggaaacttaggtgttatagcaactagttatatgctataacttacttagcattaagatgattaaataacatactatatgtaaagcagttggaagaatcatggaaagcaatgtcatttcttagcagatactactatcattttattcttgttttttggcaagtgtgaaaattaaattcaaatattctttaagatgtatacttctggtcttgagatgtaacatcactttgtgatcttacctaagtcctctgctctgtaggaattacaattgtttacataaagatgctattactatctttggtatgaaactcaaatatttatcaatagatttaccatgatgttttgaaaatcagtgggattggggacagtgacatgtcaaaatcatctaggaattaaaaaagaaaagcacaacactgcttatttaaacac

SEQ ID NO: 33224 - DNA, 1011 bp, Homo sapiens
tcaaaaaaagaatttaagtttttaaaaaaccttccaatagaagtagttgaaaaatgatagttgctacttttacttggcagttcttctaatccatgaatatggaccatctatttatttaaatcatctttaatttctattaataatgcgtttataactttcagtgtatgagtattgcacttttattacatttattactaaattttttatgcttttaaatgtttttgtgcatggaattattttcttaattttgttttcagattattcattatatgtaatcataatttttttattttactcttgtatcctgcagttttaagttttctgacgattccttccttaggattttctacatattttgtaattacttcttcctttccagtcagttatgctttttatttttcttgcctgattacactggttagaatgtccagtacagttttgaataggaataatgagagtgtaaatccttctttgtttctggtcttaaggagaaagcatcgtctttcaccattaattatggtgttaaatgtaggttttttgtaggtgccccttatcatgaatagttgttggattttgtcacgtgctttttctgtggagatacttagtagttctcaaatttggcacaaggaagcttttcatagttttttttttttttctgccagatagatggtaattttaggatcaactgtgcgttgcatatcatgtagccttaaatgagaaccacggcagataatttaataccatttgttgaacaaatattcatgaagtgcctgcaggatgcatttctaacaagttcatttgcttctgatgaatgttcaagatttggatctagtaggttagaggtcagagtttcagacccatgataacaaagttttgtttcctccatgaatttattttttaaatggttttaaatatttaagcatagagctataaacctaatactgagcccagttccagctttttctaaaataatagttttctttttgttaccatgagcagtatcattagcat

SEQ ID NO: 33225 - DNA, 1034 bp, Homo sapiens
caaaagcctaaaagagcttctattggtgtctctcttttttggcacaaggtaggtctgtaccattggcgtttctgggttgctcatttcttcagctgaaatcctgggatagtctgaggtaaaaaagaaaactcagggactgactgccgtgtcttccttagggttctacattcctagctagtctgccaccctcttttcacctttcagtcttatttttgttttatatataatggccaaagattttagttgtatgtagcatgtggcataggaaagtgtctacgctctctttcaattggaagccctcattgtctttaaaagatatgtttatcttttttttctagttgttatggtacaagccattgtctgtgtgaccttccacattctgatctgagcaggagctcccagacgctagttattgtgggttgtttttgttttttgcactcttaaattttagtcaattaaatgactgcctgtttgttctccagtatgtaaattaaataacctttcctaattcatagtttggtagtaacagaattcattatggacagcaaatgatgtttgaataaaataatatatttattttgaaagatgaatattcttgaataaaacagcaaatgttaacagctaaagtatacttagcatttgttgatctgcttcctggtaagatttcttcccccatctgattatagattgtctaccacctccgttacttggtaaaactgtgaaaatcgacttttcttgactttggttctgcagctgtagctttcccctgtccccctttagggacaacccacctttgaaactaggtctagtgctagtggagagaggtaatgtgattgggcgttgagtcccataaacactgagctgagtagtttggactttatcccataggcaatgtagggccagccaaatgatcattttgaacagtagttcaaataaagttgttaatattcacacagtgtttgatggtctttattttatcttgtaggtcacctgatgtattttttttcagcgtgaagaacttctttaacatttct

SEQ ID NO: 33226 - DNA, 1039 bp, Homo sapiens
gttaggtaagtttgaagaagaaagtgtgtaaattcaagaggggaaaattgttaggaacaaacagtttctcttcaaagggtttcaccccccttttcctttgttctattacataagtagtttttcctgcctttaacaggcccaggcatgcctccatccaccaaccttgtagctgacccatgccgccttactcgaagttgttaggttcaaacaatgaatttcctggttctttttccttttctaaatgctaaatctagtcagtcggaatcagtttagattgtgtggtcctaccctaattaactgggggaggacacagaaacaggaacggcattgggaataaaaacccctgctttcctttgtttggtgtgctcttgcgatcgtaactaacgcaggcagcacccttctgaaatttgccttgctgagaagtcttttgtttgagtgctcattttctttgcaactctgagctcttatttctaacacaaggcatcctcttgcctaattcttcaagcagctgggactacaggcatgtccagactgcaggatcttgaactcctggtctcaagcaatcctgctgtgacctcccaaagtgctgagattacaggcatgaatcatcatgcccagcctatttctacttttttgatgcaggtgtttattgccataaacctgcttaatactgcttttgctgtattccatagctttggtatgttgtgtttccattttcatttgtttcaagtttttaagtttccttctgaatttcttcattgttcaggagcatgttgtctaatttccatacgtttttgaagttcttgaggttctttttattgatatgtatttttattctttttgtggtcagaaaagatatttgatatgatttctatttttttttttatttgttcagactcatggcctatgataatggtccattctggagcatgttttatgtgctgataaaaagaatgtgtattctccagcagttgggtggaatgttctgtaaatgtcagttaggcctattaggtctagtttgtagtttaactccagtgtt

SEQ ID NO: 33227 - DNA, 1031 bp, Homo sapiens
ctgacttcaagtgatctgccacctcagcctcccaaagtgctggaatgacacgtgtgagttcattttctttagttagtgttttatagttttcctgtatagatctttaacttctttggttcaattgattcccatacactttatattctttgtagctattataaatgtgattgctttttaaatttctttcttctctttttctttttctttttttttttttgagacggagtctcactctgtcgccagggctggagtgcagtggcatgatctcggctcactgcaacctctgtcttgcaggttcaactgattcccctgcctcagcctcctgagtagctgggattacaggtgcccaccatgacgcccagctaattttttgtatttttagtagacctggggtttcacaatgttggccaggctggtctcgaactcctgacctcgtgattcacctgcctcggcctcccaaagtgctgggattacaggcatgagccgccgtgcccggtgctttttaaatttcttttcagattgttcactgttggtatatataatgctattgatttttcatgttgattttggatcctgcagctttactaagcatatgtatcagttcttacagttttttttggtgaagtctttaggtttttctaggtatgagatcatgccatctgtaaacaaggctaatttgacttcttccttttcaattttggtgccctttatttctttgttttacttcactgcttttccagtactatatgaaataaaagcggtgaaagtaggcatttttgtcttggtccagaccttagaggaaagaccttcaatttttccccattcagtatgatgttagctgtgggtttattatatatggcccttttaattttgagctatgtttcatctgtaacagtttgttaccggtttttatcacaaaggtatattgaattttatcaagtgcttttttggcatctattgaaataatcatggtttttgttttcggttctgttaatgtgatgtatcatgtttattggtttgtgtatgtcaca

SEQ ID NO: 33228 - DNA, 1041 bp, Homo sapiens
gggataatttcaagttcttcagatacagattacataaagaagattgtagggcacgtgacagactctggtttcttgtattttagatagtagaaaaattgctacctctaagaatggatcctggagagatctagttacagttataacttcttcatttatggttttatctcacagctttatttatttttatttacatgttttgttcaactaggcaacttaaaatagttttgctttatgtataaaatattgtaatggtagagtaatggattgcctgtgcattgtaaccacaaaggtaagatataatatgcttttctgtatttcattgttagtgacagatgtgagagaccctttgttcagtgtcttttaaaaataaggtgtaaccattgttatagatttgaaaatagatgtgtgaatccatgtgatgcttagtttatatcctttagaaagggcggtattttgaaatgtgttttagatagccaaaagcgtgttgcacagatgttttttccctgagatttacaggaagcctttctcccagcagcaagggtctgtaaagtcctgattatatttaaatcttctcagtgtattctcagagctactcttctcccctttgtgtcccaacatgccatgctagttgaaagtataactcgttttgagagcattttctggactcttccatctattataattatagttaattttttgtttttttaggaagaggaaaatagtcaagtgctgattgtgttgcctttagaaagatgttgatgtggatttaaaatgattagacttgtacaagcactccttgaaagtacttgttttgaagtctgttttgctcattgtgttcaaagtgcagcatgcttcacttaatctctaagtttggcttcttttatttttgagcaccagtttgcagacattgtgtgatggtgttatagattcagcgtgcttacatttaaaattcatccattggtttttaaaatatggaataatttacctttttttatttctatgcacttacgatgtctcatagtgattgctagacaaacttgt

SEQ ID NO: 33229 - DNA, 1096 bp, Homo sapiens
agttttaaattggggttcacacaaccccttccttgggtttggttaatttgctaggatggcttacagaactcagggaaatgcgtttactagtttattataaaagatgttataaaggatacagatgaacagccagaaaaagagatacatagggcaaggtctggaagggtcccaagtgcaggagcttctatcctggtagagttggagtcctcagccttcccagcttgcctttgccaacccaaaagcacatcacatgttgttaagagtttttatagagcttgatctccagcccccaacccctgcccctttcctggaggttggtgggtggagctgaaagttccagccctctaaccctctaatcctctaatcccgtggtctttctggtgatgagcctcatcctgaggctttctaggggtctcactttaagttacctcattagcattagctgtgatccaaagggcttgtcatgaacaaaagaagaccttcccattacttaggaatttccaagagttttaggcactctgacagaaacaaagaccgaatatatttcatattataccacaatagatctatagctgtagctggcatttactgagcactgttgcactatttattgccactattgacctaacaagtcagcattattctaagtgccctgtgtatattatttaatcctcacacaacagccccattagataaagtaaggtaaagtcccattgggcctgtctcaagtataccctgttaggctttaaataaaaggctgtaatttgatacatactaataatagtaataacaacattgataatgcttactatttgataggttctaccaaatggtatctatgtattaactccttttcataacgcttaacagtgaaatgtggtttagtctgaaagttgttagtgcagtccatgtgtatttgaaatgttaggaggaggaatggggtataagaggcaagtaggaacagttcagttgtttgaacttgaggtcattcataatatctgtaaactgtgaggaaactttgtggacaaaaattgcagataatactcttccttattatgcattaaaaatttgttagaaaatttcttggattttaaag

SEQ ID NO: 33230 - DNA, 1025 bp, Homo sapiens
tttccttatgttatttaactcattccactaatccttgtatttctggtaagaggaagttaggtgtaaaggttgatgagactcgtttttggtaagcagacctcacagtgatacacagtgttgtatttcatattgcatcatcaggaggctcacaatatcaggttgttgctcttgtggtgctgagttggattgcgtaaaggtggggacctccagatcttccacgggaaaggtacgtttttcttgttgatattgtgaagtgtgtatggggttgtactttggcaccttgtagtgagtcagtttccccccattggtgatcattgccaaatcactacatttgaggtttcaaaatgttatttttctccctaatttaatcattctgtttgtagttattagttggcattcttctataacactctttttcttcatcaactagggatgaacttctgttccttctaaaaagacaggctaaagtttacattactttcttttaatgatcagttatttgagtagcttgtgtgataatcccctccagaggttgctaagttccccctttttcttgatctctctctttacaaagttatcactgtataccgagaaatttttatttactaaatgtttacatacatttaagtttgggtgctcatattacttcatatttgactagacgaatcacttgaaggagtatctgtgttttcttaggatatgctttactagtctttgagcatgtccttgccttccaacaattttcccaagtttattttgagttttcactgctcctgaactagaatccacgcataacgatggtttccatttttctattcctaggggttgctttttctttgaggtgttatttttgagaggtaagaaagtggacaggcaggtgacacattcttccaactttagccttttgccccagaactggtaaaataaaatttgagaaatatcgcgtgagaagaaagcacatattgtattcattttaaaatattaatgcaaaatattgtattaatagtttacaatattaatatttt

SEQ ID NO: 33231 - DNA, 1043 bp, Homo sapiens
catttctttaaacagttttttgaagactgggtctcactatgttgcctaggctagtctcagactcctggtggtggtctccagcagtcctcccacctcagcctccagagtagctgggattacaggtgtaaggtaccacacccggctctctctcttaattttaaaaaataacacatcatttttataagaacaactctattctaaaataagagtgagttagttttagagattataagaaaggatatagacttaaaaaaaagcaagagtaaagagtaggaggaattgcctgatttaatgggatatttcagtagaaaagggttgatttataaggaaggatagatgactcttaaaaagatgaggccaggcctggtggttcacacctgtaatcctagcacttttggaggcccaggcaggtgaatcacctgaggtcaggagttcaagaccagcctgagcaacatggcaaaaccccgcctctactaaaaatacaaaaattagccaggtgtggtggtgcgtgcctgtggttccagctgcttgggaggcagagacgtgagaatcgcatgaacctaggaagcggaggttgccaaagaacccaggaaggcaagatcgtaccactgcactccagcctgggtgacagggtgagactccctctggaaaaaaaggcaagatgaaagagtaggaggaatttcctgatttaatgggacatttcagtagaaaaggatgcaccctactcctaacatcacaatacatttcaactagactagagattcaaaggttaaaaaaaaaaaaaccataaaagtaagattttggggctgggcgcagtggctcatgcctgtaattccagcactttgggaggccaagctgggcagatcgcttaagctcagaagttcgaaaccagcctgggaaacatggtgaaactccatctctacaaaaaatgcaaaaattagctgggtgtagtggctccctcctgtggtcccagctactcaggaggctgaggtgggaagatcgcttgagtcctggaggtcaaggctggagtgagccaagatcgt

SEQ ID NO: 33232 - DNA, 1371 bp, Homo sapiens
taactgctacttacagcttcggaatagcgggaataattagtgttaataagtttttataattctagctgattgcaaagtcatttgatcttttaaattatcctgtgctattataaataaatttatcatttattttagagttttgtcatgactttaactgattgtttctaaagtagtataaaatatttaatttactattataaaatattcagactagaggatatccgaaagcccttctagttctttgattttaatttcctctttttttttggctttggctttggctagaagggcaattaaaaccacttgagggatttacattcccagcttagatattggtggtgaacggtaataactcctatctgtagaattcacagtaatgatattagctaccatctgttaggagcctattctgtgctatagtgctaggcatcttatatgtattatacttgagccttgaaacaattcacagtgctaagaggcaagttaccagaggttaagtagtttgcctgaacttgtagctagttggtgatggagttgggatttgaatcaagtgctgactttgaagtgtaaaaagcctatgaattttacactgtgccctgcaggttctgatatgattgtgatataatgaaataagataatattcactgtttaagtacattatacgatgggaattgatttactaatctagagtaaaaattgtgcttttgagttatgttgttatagcattgcataatttagttagaaaatataaatacttatgaatttttattttccttcttctagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagaggtgagataaaaaatgtgttctgaagctgttttttggtgatcaatttatttatgttactatgtttctttattttattaaaataatattttatacaagtggattttgttatggaagtataatttataatagaataaagagaatggggttaaaaatatttttgaaaagcaaagctcagattctctgttgcccctgttttaaaatgttatgaatgtttgaagtctgaaatacttgatttagactattaaaaaattctttgcatgatagacctcaacaaggcttcatctgtgtggtaattaaaatggaaatggtactttgaaaagatggttttgctctggtattctttcctagaaataggatatagttttgtggtctgggctgctaagttgtacccatttacctcaaggaatctcttctttattgg

SEQ ID NO: 33233 - DNA, 1027 bp, Homo sapiens
gcaacctctgcttcccaggctcaagcaatcctcctgcctcaggctcctgagtagctgggactacaggtgtgagcccccacgcctggctaactttttctagagacaggtgttgcccaggctggtctcgaactcctgagcaaagttctgggattacaggtgtgagccactgcgcccagctgagattgatgattttgaaaaacgcagttccttccactcttacttttttttaatataattttctcattttgggtttgtctgatgtttccttgtgattagattcaggttttgtattcctggcttaggattctgtacatccagaggtacacagagtcatctgctctttgttgatgatactgattttgattacctagttgggtgttgtctgaattctgtatcctatagtcattgttttttaccccttgtggcttataggcaatatgtgggggagacactttaacaccatgtacatatcctactccttagcaaaatttccacccatatttagcatccattgatgattcttgaaccggtttataatatggttgttgaaaagtaagatttctaacagtaacactcctaggtttaccagttaacactttgcattttattctaaacaagagccttccttctttttttcccgtgtctttcatgaacttgcagatacctgtttttttttcaatgacttatcatttattaccatccttaatgacatttgtgctctgagtgatccagtgggggccctttcaagcttgtgtccttatgagatgccctcatcattttttggagcactttcttaatttttggcataacaagatgttccaggtttatcttgtacctctcctgccccagccctggaatcagccatttctctgagaagctctggttccttttagtacacaccttgttttatggaatatgcttgtgagtcatgtatgattcttagtctaatagtatctaaagtattcaagtgatttatttttgcctactagcttgacatctttcctttctttagtgtgtgaaacaatag

SEQ ID NO: 33234 - DNA, 1052 bp, Homo sapiens
atttgaaaacttgcttttgtattccagttttttgtgcttaagtttgaaaattttttgagtagacgggatatggtttgattataatcagagcccaggtattcaggtccatagtggtttcagttcattcatgattctaaggtgtgtgggatctgagatgacactgctagtccatagagacttcataccagtctaaacccctgcagttatttcttacgggatcagagaactcatctgctttccttgtgcatgagaaaaactggggcccaagattaggctggctttagagacttgagtaagttgagtcatgtgatttgtatattttgtctgcaataaataagcttattctaatgcagtgttttatttctgcagagatttcagaatgaaagtggattatgtaataatactgtccatttatgagtttagttaccagttcatttgttgccactctattaaaatctaatagtttcactagcccttataaaaggacattaccctatctttatttgtagatactagtttcaaaagtatgacccctttgccatcttcaccatctttaaatgtacagttcaggagtgtgaaatgtattcatattgttgtgaaacaaatcttcagaacactttcgtcttgcaaaactgaaatcctataccgaataaacaactgctcccctttcctctcacttcccagccccttgtgaccaacgtgctgctttctgtttcagtgaatttgatcatgttagaaacctcatagaagtatttgtctttttgcgactggcttatttcactcagtgtagagtccgcaaggttcattcatgttgtagttgttgacaggattttcttcctttttcaggctgaataatattccgttgtatgtatataccgcattttatctagccatccattgatggacagttgggttgcttcctcctcctggctgttgtgaataatgctgttaggaatgtgagtgtgcaaatatttcttcaagaccctgctttcagttcttttggatatttacccagaaataggattgtgggatcatacggcagttacattttt

SEQ ID NO: 33235 - DNA, 1041 bp, Homo sapiens
tagagtagtggtcaagaagcaaggttataaacaccctgtaaggactgaggttgctaccgctttaaattccattgagcattcggaagcaaaatggtgcatttttatacagtaattttattaagagaacaagtgtccaccactgtgtggcacccgtatttgttcagccatagattttagaggcatcttgcaaagcctgattctaattaatttaagtccattagatggaatgtgttactgttcctggccaaaactaagttgtcacagtcagattaatttctcctagcagagtggcaaagcaattacgactgcaaatacggcaagtcactcctcaccggcagaagctcatgatatttgagggagtcttatgtacctaaaatgttcggtgataaattgttagatgatatttaattagacaattaactcaacgtgcagcttgattatcagttaggtggagagctccagcctctcaccggtttggttcactgcagtttctcccaagcgctgcttcctattgggaatggatgctcggctcctttcaggctttctgtcttgtctccagctcacgtgcccaagatacgcatctcctggggacttgaacaggcatcaggctggcaaaaaatggtgggaatcatggccgggcgcggtgcctcatgcctgtaatcacagcattttgggaggctaaggtgggcagatcacttgaagtcaggagtttgaaaccagcccggccaacatggtgaaaccctgtctctactaacaatacaaaaattagccaagtgtggtggtgcacgtctgtaatcccagctactcggtaggccgatgcaagagaatcgcttgaacctgggaggtggaggttgcggtgagctgcgatcgcgccactgcactccagcctgggtgacagattgagactccatctccaaaaaaaaaaaaaaaaaaaaaaatggaaatgagaactctgagcgatcttcagtcttaccgaagcctggcttgtcattctgtgaacacagagctagaggtccagtgggagaggcttaaggccacaca

SEQ ID NO: 33236 - DNA, 1024 bp, Homo sapiens
aggaggaaaaatgtatgcatatgtaaatgcttactccaaagtcacctcatctaaagctcttgctcagaaagcaagtcagaatcttcactcctgtgtagcattaccgaatggaaaacacgctaagagtcatcaataaagtcagccccgtgtagccttcccactggagaaatgacaacctgaggtcctgcctccagcgctaggatgtacctgtgatgtggcttctaccttggactctgtccacggcctggaacaacctggactcaccagtgtgcaccatagcaggagcccaagcaggcttagctcaaagctccatgtttattgcatgaagcccttaaaaagtatttgttatcggaaggctttgcccagagctttggagaagattacaaaggaatgctttcttccttcagcttatttcttaggaaattacctccagatctacccaagaaacaaaggctgcaggatctccttggtgtcttcatacattgaacacttatttagaaatccctcatgactttttccactcccatttcttgaggagaaaacagaagatctgagaaagggagaatgggagatggcctgccctggtctcttggctgccctaatggaaaggctccaagttgcagctttagaaacaagggctggcactatgagcaggctataacttcttgcttacaccttctctcttcacatcgggtgccgcctgtcaggtgagggccacagtccttcattccaggtgtttttgccttcagccttgctttactaccatgtttttctccttttctgtcttccatctgtccttccataaatccattcattattcatccatccatccgtcctttgagacatccatccttcaagccaccgtttgaccccttcatcccaaattaatgacttactatatgccaaactgtgtgctagaaactgactctacagatgagctagaacagttcttgccctcaatcttggaagaacaactcattggtagcagctccactgtttattggcagaagggaggattgtgtcc

SEQ ID NO: 33237 - DNA, 1049 bp, Homo sapiens
ctttggctattcttggtcttttgtggttccacataaattttagttgttgtttttttttctatttctgtgaagaatgtcattggtgtttgatagggattgcattggatcatcagatttctttgggtagtatgggcattttaacaatattgatgccttcatgaacatggaatatcttgccatttgtgtgtgtgtgtgtgtgtgtgtgtgtgtgtgtgtgtggtcttcaaattttttcatcaaagttttatagttttaattatagagatctttcatttctttgataaaatgtataataaaggtatacacattttggttaataaacttaaccaaagaaatgcaagatctctataattagttaactaataattaattaaatggttaatgaacttaaccaaagtaataaaagattaaatagaatcctaagtagctattgtaaatgggatgactttttaaatttctttttcagattgtttgctgttggcatatacaaatgctagagatttttgtatgttgattttgtatcctgcaactttgctgaaatttgtttaccagttctaatagttctttggtggagtcttcagctttttccaaatataagatcatatcatctgcaaacaaagataatttgacttcttccattctaacttggattccgtttacttccttctcttgtcttgattgctctgggtaggacttccagtactatgttgaataacagtgatgaaaatgggcatccttagctgggcatggtgctcatgcctgtaatcccagcactttgggaggccgaggcgggtggatcacctgaggtcagaagttcaagaacagcctggccaacatggtgaaaccacttctctactaaaaattaaaaaattagccaggtgtggtggtgggcgcctgcaatctcagctactcgggagtctgaggcaggagaatcacttgaactcgggaggcagaagttgcagtgagccgagcttgcgccactgcactccagcctgggtgacagggcaacactccatcttaaaaaaaaaaaaaaaagataggagtagggt

SEQ ID NO: 33238 - DNA, 1052 bp, Homo sapiens
cgggctcaattgttttgagttttagatcccacaaataaacgagaacatgtgaagcttgtctttctgtgcctggcttatttcatgtaacataatttcctccagttccatccatgttgttgcaaatgattcattctttttcatggctcagtagtacttcattgtgtatatgtaccatattttctgtatccattcatctgttgatggacacttaggttgcttccaaatcctggctattgtgaacagagctgcaacaaacatgggagtgcaaatatacctttgccatacaatttcctttcttctgggcatatacctagcagtgggatttctggatcatatggtagtttagcttttttgaggaaactgttatgcatagtggttgtgctaatttatattcccaccaacagtgtatgaggatttccttttctccacatcctcgccggtgtttattattgcctatcttttggatataagccattttaaccggggtgagatggtatcttcttgcagttttggtttgcatttctctgatgatcaatgatgttgcgcaccttttcatatgtatgtttgccattttatatcttcttttgagaaatgtctatttggatcttttgcccatttttaaattggattattagaatttttcttgtcgagttgtttgagatccttatatattctggttatttataccttgtcagatgggcagtttgcaaatattttctcccattctgtgggctgtctcttcactttgttgaagctttttaaatttgatgtgattccatttgtccatttttactttggttgcctatgcttatggggtattactcaagaaataactgcccagtccaatgtcctggagagttcctccaatgttttcttttagtggtttcatagtttgagatcttagatttaagtctttttttttttttttttttttttgagacggaatctcactctgttgcccaggctggagtgtgatggtatgatctcagctcactgcaacttctgcctcccagattcaagcaattcttctgccttagcttcccaaatagctg

SEQ ID NO: 33239 - DNA, 1013 bp, Homo sapiens
aggacagcttcgacaccctatgatttcatctctgacccaaccaatcagcactccccataccctagcctgctacctaccaaattacctttgaaaaatccctaacctccaagccttagatgagtttgatttgagtaataactctgcctcccacatggtgtggctggcatcatgtcaattaacctctttctttactgcagtgccatggtctccatgaactgatttttttgtgcagtgggcaggaagaacccatcgggcagctacacatcttgaaagagaagctcttcctgtgaggtacatcaactgtggttaagaatcttacatacttatcattttttgttgttgtgagaacatttaaaatctacccttttctttcttttttttttttttttttttgaaatggcgtctcactctgttgcccaggctggagtgcaatggcatgatcttggctcaccacaacctgctgggttcaagtgattctgttgcctcagcctcctgagtagctgggattacaggcatgcaccactcttttagcaattttatttatttattttgttattttgaaaaagtatttttaacttttactttagattaatggggtatatgtgcaggcttgctatatgggtatattgtgtgatgctgaggtttggggtatgaatgatcctgtcagccagatcgtgagcatcgtacacaagcaattttaaaatatacaaatggtgtggtatggtggtacatgcctgtagtcccagctactcaagaggatggggccagaggatcgcttgagcctaggtgtttgacaccagcctagacaacattgtgagactctgtctcaaaaataataaataacaaaacaaaataaaatatacaatgcattattatttaatacagtcattattctatgcaataaatcactaaagcttatttttcctgtctaactgaaactttgtactctttgatgaacttctccgctttccccatccaccccacttccctggattttattaaattaaattgta

SEQ ID NO: 33240 - DNA, 1033 bp, Homo sapiens
agccgcaagccagagactagggacatggctgaggatcgctcccgcccctcggaggccagaaaccgagggtcactcccgctctctagaggcccgaggccccgggccgctcccgcccacctccgcggacgagcgccgccccttcgaccccattccctgaggtctggacgttcaggccctctcggtctgggagatcccggagaaccacccacggggctttaaaaaatgttggtgccaaacacctctccgaaatagggcccgccctatctcggtcggggagcgcgggacctccgtggccacccagcgccaccgtccgcgggtccgctttgcgcaggcgcggcgtccccgccccttagaccccggcccgggcgtggcgtggtgcgcaggcgcaatgtcccccactagcgccccgccttgacccggccgtggtgcgcaggcgcagtctgcgcagggactggcgggactgcgcggaggcgactgcagacgtatcgggggtccggagcctgtcgcggctgctaagcgctcggcgcctggcgctggcgctggccaaggctgtgagtccctgccgcggaccggggcagggcaggcgggggacgaggcggcggtaggagcgggacggtccccagcgggtccgagcggagcgggcgccgggtccccgcgccccctgcccggggatcgggaaggggctgggagagccctgggccggtgcgagggggagccgcggagtgtactcgggggcctggggagctcggtccttagcaggtaggccgcgtcccggtgaaggtcgcgaccccgcgggcttgctgggcgtcccctccgccgctttggtccgggcctggggtccggcgacctcgcgggctgaggtagcccctcgcctctgcctggcgggtggactcggggaggagtcgtgtctgcccaaggtcaccggggtggagtcctggctgggccgggcctctgccgccctctgtgagggttgtcctgcggggccgcccgcagcccgtgggtggggctggcggggcgggtgaaaccgcccggg

SEQ ID NO: 33241 - DNA, 1046 bp, Homo sapiens
ttgcaagttaccactatctgaaaatcccctgctgttgcggggagaagctttgaatgcactgaagagaattccttctaaatgaaggcaggtgatagtgttctttctgtaagtaaagggaaagaaaaaaaacatagtttgcttaccaggtggagacaagattcaagacatagcagaagagtggaagacaaatattttccacttaaatgaggctgtttttgacgttctctgccaaggatttagagctttcgttgaactaacataaaaggagtgcgagtcttagtagagatgttccgtgtgtgccgcccgtgctctgaactgcgtttccacctgctgtggtgcttgtgcagcctggcagttcattgtcatctttaataaactaaggaaataaaattctgtctttcgtcagcctgccttgactgtcaagaaatggcatgtgtccactgtaaagcaggtatatctgaacattgagaaggtttctgtgttataatgtaaagcaaactggaccacacacatcaaggaaagtgaggtggagtggctgtgtctctaacttgccatgagacctcgagcgaaccacttcacttctctgggtttctggtgcatggtgtaactgtcacttaaaatgaggtgtcttcctctccgcaacatctgacttgccttagatgcttcagttcccacttctgtgagcagctagcatctttctcttctgctcctggcccactggagctccagctctacgctgcaactctctcaacatttccccttaaatgtccccttgtcatctccaaccagtgtgtctaaaaccagcataaattccgtatttccaaaaacctaaccattagtcacccaggtttgaaaattaattgtcttcaacttcctctgtaagtggcacactgagctcatcacgcatcgtctcattcctactccctgtcatcaagttctgtggatgttttcctctaaaataaatctctcattacttttctgccactagcacacaaattcaggtgttcttgatcatacattattttcctccctgcgcctcagtggaa

SEQ ID NO: 33242 - DNA, 1030 bp, Homo sapiens
tgcgagcggctgcaggcccggcgggaggcactggccaggcagagcctggagtcttacctgtcagactacgaggaggagcccgcggaagcgctggccctggaagccgccgtcctggaggccacctgaagaaagcacgtgcagccctccctccgggccgggtcacacctgttgcagaactgagccactctttgaaggactcgccccacctggggcttctttttttttttttttttttaattatcatcatctttttttttttttttactgacttgtctgacgtctgtgtgcagtcagccgtcggcaggttgatgggtccagagtctgtggtgacagataatttgtaaacaccaggtgtttccatcagaactgacatgcgggtccttcagtgaagcttctagtgcctctgtcagtggaagagacagcaagaccaagttcttccagcgtctgtggccttctcctctaggtttcacctgcatgtcaggtatcatttccaattttcctttgtttcagttctggagcttctgagccaggcctttctcaaccacctctcctgctgctgaaacggggatggcgttttccctctccctgtcctggactggggtcagactgtgccccgaggagaagcagcagagaataggactacgtcatgggcatttcgtccacttatttgggtattttgggggccacagaacaatcctgactatcctagactcctcagagacctcagaggcagctgtgaatgtccctatgttgccgggagttcctgtttgaaatatttgaagcatagaggatgccacaagctgactttcttcatctaccttggtgatcttgaagcaaagaacagaactgatgctcaggccaggctcacctgtagccttacgccgcaagcatacgtgaggcgccagctctgtcgctgaaggagcgcttactcagaggagcggtcggccccctcttggtgttaaggtctcttagttaacctggctttttggtgcaggtgtgatctttgaagctcaggcaggtccctgatgcc

SEQ ID NO: 33243 - DNA, 1032 bp, Homo sapiens
gtggttcctctgctgtcagatgtttctatgtagtcctactttttttctatcatgctaggaatactcatcctagagtcgctccgtttcctgcatcagaaatacctgccttccaggccaggcagagtggctcacgcctggaatcccagcactttgggaggccgaggcgggtggatcacttgaggccaggagtttgagacctgcctggccaacatggtgaaaccccagctctaaatatatatatgtatatatataaataaaggaatagctcccttcccaaatagcttcctgatatgaggagacctaagaacactgctcccagatttgcttcccagatagtagtaccttctatttacttgaaactttctaaagggaaagtttccatttctctctgttgaggtcatatcagatcccttatattgtgacactggaaggacaagaagacctctttctgccctgtttattcctttttgtttttaaacataacaggctttcgggtcacctccagcagctcccagttcagctcacgtgattcggcacagctctctgactctggctctgctgatgaggttgatgaatttgaaatccaaggtaagaagtgacactttgttacaagggaacttttattctgtttctttccatttagaatgataagctgcgaagtgtttcctaagtagaagatcttcattatggattgttgttagctattgtaagggacagccttctgctaaaaacaaaaccccttcacagtttcagtagggaagaacactggaagcaggtgttccaggtggatggagtggctgctcgttgatgtcaccctgacgcgtcctcctcagtggtgtctttctcctgggttcccactctgactcctcctttcagcttgtagggctggtccataccacttgaaattagaatcctattctcttgggttccataacacaactgaaattgtttcagagtgttcaaaagagaaaaggacaaaaagaatcattgggggcagggggacaaaagaggaaaaacatcaggtttacaaag

SEQ ID NO: 33244 - DNA, 1033 bp, Homo sapiens
tgtttccaatcatttgctattagtaacagtgcttgtgtataaataattttgccctttaccgtaggataaattcctagaattcttaaagggcatgtgcatttgatattttgatagctattgctaaattactctccaggaagttatgtatataaatatcctcaccagaggccaggcgtggtggctcacgcctgtaatcccagtactttgggaggccaaggcaggtggatcacgaggtcaggagtttgagaccagcctggccaatatggtgaaaccctgtctctactaacaatacaaaaattagctgggcttagtggcatgtgcctgtagtcccagctgcttgggaggctgaggcaggagaatcacttgaacccaggaggcaggaggcagagtttgcagtgagccaagatcacacaactgcattccagcctgggcgacagagcaagactccatctcaaaaaaaaaaaagtaaaagattacacttctcttagcatgaaaagatattataagtgtcattgaatttttttccctgtgaactttttcctattttattcctattttcagtagatttagtcttttcctactgatttatagatattctttatttattgaggaaattagtcctttgtaatgggagttgcaaatattttttcctagtttgtctgttgacatttctttctttttttttttttttgagatggagtttcactcgttacccaggctggagtgcaatggcacaatcccagctcaccgcagcctctgactctggggttcaagcgattctcctgcctcagcctcccaaatagctgggattacaggcatgtgccaccatgcccagctaattttgtatttttagtagagatggggtttcaccatgttggtcaggctggtcttgaactcctgacctcaggtgatccacccgcctcagcctcccaaagtgctgggattataggcatgagccaccgcgcccggccgtcttttgacatttcttatggtggcttttactgtgccaaaatatctgacttttagtaagtca

SEQ ID NO: 33245 - DNA, 1034 bp, Homo sapiens
agtagacaaaagttatgtttttattatagaaaaaatctttatttaaagagaaatgattaagagaaagggaaaaaactgaaatctatgggtgaatactaacagagaatatttagatcagcctgaagacagatgaggatcaaaaatgtaatgggaactagataagagttttctaaaaatcatcttagtaagatgtaatttaacaaaacttggaatatctttaactattaatgacaatgtttctaaagcatctttaaaaactaaaatgtaaatataactactcttttttttttttttactaacccttagtattttatgtgtaaaaacccccacttttaaccctcatttttggcagcttaaatttcagaaaagataatgatgaaagtataaatcatttttagctgttttaagaaaagtgtctatttttgaaatctgtccttattggcgtcaggtttataaaatgtgctttatacacctgcctaaatacatattattcatcaacttatgagaaataacatttttaagatagaacagggtctctagattttacaaaaataattttaaacactttctttttttctttttttttttttttaagaataaagtctggagtttagttaatagtaatgtaccaatgttaatttcaacaaatgtaccattgttatgtaaaatgttaacattagaggaaaccaggtgagggttatacaagaactctctgtactatctgcaacctagaataatctaaaactattgccaaataaaagccttttttaaatttttttgttattatactttaagttttagggtacatgtgcacaacgtgcaggtttgttacatatgtatacatgtgccatgttggtgtgctgtacccattaactcatcatttagcattaggtatatctcctaatgctatccctcccccctcccccaccccacaacagtccccagagtgtgatgttccccttcctgtgtccatgtattctcattgttcaattcccacctatgagtgagaacatgtggtgtttggttttttgttc

SEQ ID NO: 33246 - DNA, 1050 bp, Homo sapiens
aatttgtcagaatagtagaggaaaacatttcagatgtaaaaatcaggatatacactaataaaggtataatggtaacaaaattttgcaaattattagtaaataacaactcacttagcatgttgttgaaaagatactattatgaagtagagaataaagtattactttatatgtttttactatatttttaaattttactttgtttccagcagttttgcttatttattttgcgtggaataatttgtgggtgaccctgagacttttgcatggcttgaacctgctgatatctagtgtctccttaagtggtttgttgaggttttagataattagaagtatttctttaaaatgtaaatattccagtaaacattaagcttcatttaaactctccatttataaaataaaagtatatgttattttgtatccatttttataaagattatagtctttatctaagtgttctaagtcattcattttaactaaacatatggatttgtctgcagaacacgacttaaaagtggcttcagaggaaaagcaagaaacgcttgaaagaagtgaaaataaacagccagaggtatgtaacaatttaaatttctggtttaatattggttggttggtttttctttaataacacagcatagtccaaaagaagtgaccttttagactgtccttttagaatccaacagacagatcataatttcttacttaattttaaaacattttagccagttataaaatttaaaatatccttacagtctgcagtaactcatagctatctgtacccttggaattgaggccagaaatttccagaagtctctttgctcttttacttttataagcttcttcatgacaaagaaagtaacatcaaaaattgagttgtattactaagcaagagaaattatgaacaatttaacagtgatggccactgagttcaactcgtgttaaaggagtcatcgttgctagtggttcagactctgcagttttatgttgctggtcaccagtgctgaggttaaagacttcttctgttttttggtttctggttgccttcagtgtctt

SEQ ID NO: 33247 - DNA, 1050 bp, Homo sapiens
cactccagcctggataaaaaaacaagactctatctccgaaaaaaaaaaaaagtaagattacatagttttaatcataaaagagcagtttaaaatatatatgtatatacattttttaaatttaatttatttagtttagaattcagagttaagaagttagttgtagctaattcataatctcacagtattgtctgaaaacaatgcatttacctacttatgttccctgaaattcgacgtgatatttttgtattaatataaataagaaattagatttttaagttagtatgttgtattttcctctataatcacattattacaaattggacttttgatgcaaatggatcttctatttaatttttataataaatggtttgtatttagtaaataaatattaattatagttgattcttgaataatgtggcagttaggggctctgatccctgtgcagttgaaaatctgagtataactttgactccttctaaacttaactaatagcctaccattgactggaagccttgctgataacacaagcagtccatgaacgcatatttggtatgtgctgcattgttatatactatgtttgtacaataaagtaagctagagaaatgaagctgttataaagaaagtcatagaaaagaaaaaaacgtacttactattcataaggcagaagtgagtcttcccaaaggtcttcatcttcatcatcttcaggttgattaggctgaggaagaagaaaaaaggttggttttgctgtctctgggttgcagaggcagaagaaaaatctacatataagtgggcccctgcagttcaaactcttgttgttcaagagtcaactgtattacacaggaatttgtgtcactaagaaagtaactatctttagaactgggaactcaaaaatccctttctgataccataaacaaatggcaataaggaccataaaactgagccagtgtgcacccatacaaataggagattatttttgaagatacctattgaatgcagaagatgggaaagtaattcctttacaagaagcagaagttatgttacatattcttc

SEQ ID NO: 33248 - DNA, 1058 bp, Homo sapiens
ggaggattgtttgagcctaggagtttgagtccagcctgagaaacatagtaagactcttgtctcttacaacaacaacagaaaaaaaaaacacctcagggtttgaatacactcctgattgagaaccacagagtaggtaagtgcagtatataaattcccgtatctcaaaaacataagaaatctctaaaagagttggcatttgataggtgctactttcttcaaagttctcctttccaataatgttagcctgacttatctttctctacatttgtgactggaaagtaaaaggaaatattgctggcaatatatctcagcttacagaaacacaccttttccttcccaccaggaatcattcactgccattcagagagcctttagcaatttgcttgtgggtaatctttcaataggtaaagcctgaccctttcacaatttcatgttcctttgtcaccattcaagtgattatgtgtcaacaaatgttcattacaagtgaaattttctcaattagattagtagcaaatcctgaaccgttttttttttttcagttgaaattgtattatggactatgtcagtatgtctgttaagtttatagagctttggcacaatcaggatgtcagttttaaacactgaaatccatgaagtcggtgagaatactataggaattcttttaataagttagtttcggcagtcttatgatctaattatctatttggttaacaatctgggaaaataatatacaaacagatttcaaatgaataaattttgggaaaattcttcaggtgggtattatgagtcttaacagcaatttttattatatatatatcaggggctgatttttatataaaacacatgatactagagacagaaaaagtttcacatgcaaatacttggtttatacaaaatcatttagtacacattcatggaaactataaatacacaagggctatagtctaactgtggcacatagatttgttcatttgcctctttaagttgagttagcatgtgaaatttagtagactcatgcagaaatctggacctcaggcctgtcttaagaatcaaatctg

SEQ ID NO: 33249 - DNA, 1086 bp, Homo sapiens
atggctgtttatggacagaagagaagtcattatttgtattgtttttgccttgctaagaataaatatttaacttcaaatataattggtctggaaaaacaaaagggttttggttaaattccttgttattgtatgttatagatggggaagtggcaaaatagataaaaattacacaaactctgggaatcaaatttcttttgggcaggcttagaaaagacaaaactgaaactacttagtggcctagagagcagaagcctagggcccattttctgtcccaactttgcccagatcccccctctactgaaccttgtccaggtctgaccccacactgaaatacctcacagaactgcttagagaagatcagagtttggagtagctattcctactgcctctccagagctggtgctcccaatttcctgaaacacaaaagctgataaatggagaaaggcaatgtactttgaatttaatgtacttaaattattttatgtaaaattaaaaccagtatttctagagacatcccatccagcaacctgttctccatctttgcagtttcagtggatttttcacaagtctcaaagtaactataaacacaaaaataaaaaattcccgaattgtacttaaaactttcttctgtgtctctcccatttatctacattgagctattattctatatattttttaaaaatcaatgataggaaaacagaagaaaaaatagaaatgctgggccctgcatttaaatcctgggaagtatcacacactttgtacccacctcccaggatgctgtgagaattaacacacataatgtgagcttcccagcacagtgctctgtgacatactcctgagcacatagtacatgctccacaaatatcgcattaatgcatgtggatgtgctgtttttcaaatgcagacttactcagacattgccaccatctccagcctctgtaacctttaaagggcttgcagataatgccacgtttcaggatgttgattgctggtcttgtcttcggatgaaaagtatttgtgttgtgataagggtgttggggtaagggactctgcgtgctgtgtctgctttctctagctgagtggtac

SEQ ID NO: 33250 - DNA, 1086 bp, Homo sapiens; identical to SEQ ID NO: 33249

SEQ ID NO: 33251 - DNA, 1086 bp, Homo sapiens; identical to SEQ ID NO: 33249

SEQ ID NO: 33252 - DNA, 1086 bp, Homo sapiens; identical to SEQ ID NO: 33249

SEQ ID NO: 33253 - DNA, 1068 bp, Homo sapiens
ggaggatctatatcataggatggcctaacttgccacttgagtcagacataccattccggccagtactgccactccctgggtttgtcatcttgaaaagattgtttacttatttcagctttcatttttattaactgcacaatgcattctatttgtagagcttgaaaaatagaaaaatattctcaaagaggcatacaaatgtgaattttaaaaaaatctagtgatgtatttcatttgttaaaaattcttattttcattttttttttccctgagcaagggtagtaagtttctgaaatctgtacattttgggagctatttcacacagaatctcagggcttagttataaaaatattactgggtgaaaagaaataggaaaaattttcttcttttatggctgcagaaaagtgaatacatttccacaagaaatcgtggtagatacattggtggtttatagagatttgccaaaacatcagtttcttttttctgcatggtggagaatttgcaatagttgataagtctactctgttatcctgttatctgcatatttgagtttaatgttaaattctatggactaggacttgacattcctggaagtgctcataaatgattgcttaattatttgttattatggaaataatacctaaatgacatttgctgtctgaaatggatattttggcttttcttgttgaagtatgaaatgtaagtgccttccaatttccatttctcctgtgaacataagtgctgagtttgaggaattctgctggattcttcaaacactgagttccttttgtataaaatgaagggaataaccttgactgggaatcagacctaagcccattaactgcagggtaaggccaatcttgacactgtcaaaggatgtaatcagtagcccagttgttacttactggggaacctttcctgcaggtgtaccagcctggctcaaattagacatgaaaggagcctttacactgagaaggtacagaactctggaaagctgaggatccacaggcagatgcagtgagagttgggatgggaggttgtttgtgatgtcctctgagagggtgtaattgt

SEQ ID NO: 33254 - DNA, 1068 bp, Homo sapiens; identical to SEQ ID NO: 33253

SEQ ID NO: 33255 - DNA, 1068 bp, Homo sapiens; identical to SEQ ID NO: 33253

SEQ ID NO: 33256 - DNA, 1068 bp, Homo sapiens; identical to SEQ ID NO: 33253

SEQ ID NO: 33257 - DNA, 1046 bp, Homo sapiens
acacagtccagttatacactttaattttttttttttttttttttttgagacagagtctcgttctgtcgcccaggctggagcgcagtgttgcgatcttggctcactgcaacctccacctgctgggttcaagcaattctcctgcctcagcctcatgagtagctgtgactacaggcaggtgccaccatgcccagctaattttttgtattttcagtagagacagggtttcacaatgctggccaggctgttctcgaactcctgagctcatgatccacccacctcggcctcccaaagtgctgggattacgggtgtgagccatcgtacctggccactttaattatttttaaatgtgcaattatttttttactacaggttattttatgattataataagtatatgagtataattataattcacacatttctaagtcatgaatgcttttaaaaaatgttccatatttatctttgaacatgtagcatctctttccgcaaataaatgcagactttggttttgatttacatggagttaaatatgtaaatgtattgctctaaagataaaatttaggtgtaagaaaattatggggcaagcagttgagtttctgtgagagtttgtatctattttccaaggaaaatagcaatattggaacaaagattattttaataaggtggatattttactagaaatctagaaacctaaaacattctgaaatcaaatttatattttcttctattactgtaaaatttaacggatcattgttgagactctcccatgcaaattctgtttttatttgtctgttactcatgctagagctataattgacttctttcttattttttttatttttactttatgaagtatttattatgtgagctggtcagaaattataattttataaaatttagtagcaaacacaaaatatttagatgcaagttcataattcgtgtattaagttatattttagttaggacatttcattttattgctttagttggataaccctatatgagccgtttagttatttgtttcactttttataattgacataaat

SEQ ID NO: 33258 - DNA, 1041 bp, Homo sapiens
aacattgctaagtgtatagtaagctctcaattattaccttatttcttaataactattatcttttaattttgtcttatttagtaggaagcctactgaagttctgttgagatctatctatatataaaaatgtgtgtctcacacacatacacatacctatataagttatatatgtgtataataaattccttacttaactttgctgataggttcttggaaacagtaagtgaagcaacatattaagtaaactaatttttaccagaatttaatacaagagttatgtttgcatgacatatagcaacaatattcatttaaagatgcacttttcatgaacctattttgaacataaagtgaggacttactgtacatacatgtgcaacctggatttttctgataaataaaaattgtataatgtgtacagtataatgatttgatatgtatatacattgtaaaataaaatatagtcaagttagtgaacacatctattacctcaggtagataaccagtttttttgtagtaagaacacttaaggtctactgttgtagcaaattgtaagcatacattacagtattactaactataaataatgctattttgctgatctaatgctgaatgtactttagatttttcagagttactcaagttacaactaaaaatttgtactctttgaacaacatttccgtattttccaccctcaggcactaacaatcaccatcaatcaatgttaaagtttttttgttttgttttgttttgttttgtttttgagatggagtctcgctgtcacccaggctggagtgcagtggcgcgatatctactcactgcaaggtctgcttcccgggttcacgccattctcctgcctcagcctcccaagtagctgggactacaggtgcccgccaccacgcccggctaattttttgtatttttagtagagatggggtttcaccatgttagccaggatggtctctatctgacctcgtgatctgcccacctcggcctcccaaagtgctggggattacaggcgtgagccaccgtgcccagccaatc

SEQ ID NO: 33259 - DNA, 1088 bp, Homo sapiens
gccaattaaacctttttctaaaaaaaaaaattacctagtctcaggtatttatagcaatgcaagaataaactaatacagtgaatattgctgcagtaaacatggatgtgcaaatatttctgtcagatatactttgcatattttgaataggatgctcagaagtagaattagtgggtcatagaataacttcattttttttttggaggaacccctatacattttttaggggctgcatcactttcttcccaccagcagtgcacaagggtttcaattcatctacattgttgacatttgttattttttgtttgcttgatattggccattccaattaatacacgataatacctcattgtggttttgctttacatttttctaaagattaaaaattttttcaataattgtttgctgtgtgtatttattctttggagaaacattttcacctcctgttcatttgttaatcatattacttactctttgttgactttttggagtttattctgggtgttaacttctgtcaaatgtatactttttacttttttttttcttactcgggactgactaaatgtttattttaatgttcagagataaatttaatgtagtccatttttctgtgtttttaaatttgttactcatgtagttgatgctatatgcaagaaaacattgccaagaccaatgtcataatctttcttcctgtattttcttccaaaaattgtagagttatgcttcttacatttaaatatttaatttattcaagatagtttttgtatatggttcaggattttaaatttttatgagtacacagtagctttttgtatctatgggttacatgagatattttgatgtaggcatgaaatgcataaaaatcatatcagggtaaatgggtattcattacctcaagtgtttattctttgttttacagacaacctaactacattcttttagttatttaaaaatgtacaattaaattgcttttgactatagtcactctgtgtactagcaactgctacatcttactctttctaattatttttctacccattaatcttccccacttcccccagtcccctgctacactttccagcctctggtaa

SEQ ID NO: 33260 - DNA, 1048 bp, Homo sapiens
gtttcaatttttagctttgtatgtgttttgaaatcaggagctgtgatgcctccaacattgttgtttttctttttttctttttgtttctttctttctttctttttttctttttttttttttttttcagacagttccacacttgttgcccacgctggagtgcaatggtgcaatctcagttcactgcaacctctgcctcccaggttcaagtgatcctcctgcttcagcctcctcagtagctgggattacaggcatgtgccaccatgcccagctaattttgtatgtttttagtagagatgggatttctccatgttggtcaggctggtcttgagctcccaacctcaggtgatccacccacctcggcctctcaaagtgctggtattaacaggtgtgagccaccgcacccggccttgttgtttttcttattgaagatcgcttggtgctacattgtctcttgaaattttatctaattttggggttgctgtttctatttctggaaaaactcgattagaaatttgacagggattgcatttaatctgattattacattcaacagtccagatggcttcataatattaaatatttcaaacattgaacaagagcatgctaaagagtatattgtttgctttctataattatgtaagattttcagtttttttattctactctctttccagtttggtcataaaaagtaatctgtaaaattttaatttaaaaaaatttgttgagggtctttttgtggcctaaccggtggtttatcaagaagacttttgtatgagctattgagaagggtgtgtattctgctgtcattgagcagtgttttctacaattctgttaggcataattttttaatactgctttcaagtcttctgctcccttatgaatattgtctttttgttttattcattacagaaattggggtatcaaaatatcctagtataattatattgctttgtatatcttggctttacttctgtcagtatttgctttatatatttgaaaccctaatgtgagatacacacacacacattaatatgtatatatacacaca

SEQ ID NO: 33261 - DNA, 1063 bp, Homo sapiens
gggtcactccccgttataggcgccctttttgccccctagcacacaacagataagacccctgccgatcccctcgcgttttggtctcttatattcctccaagatgttttccctgcctaggggctaaggcctctctgcgttaggcctcttcctaggcttcacctacccagccatatacagcaagtaaaggcgccctggttctggaccacttgcacacatcgccagccgctgaccatgtaaacgcagtatgtaaacgcccagccatcccgtagctgcagctctgcgttttaggtcaagctccctaaatgtcccattccaggacccttacgtagggattctcctaccccagtactcttcaccatactgaggataattcactgcttgctactgtgggtccctaagattactcctgttaacccccgtcctttccccccagcactacctaccaagtacaagtcgcctccttttgggttgggttatgtagatatcgcagggtatgtgctggagaagtaggtagaagctagattgtgaaggtgcttgatgctaaggaaagtttagagttcaatttccttttttttctttcaaacacttaggagccagttctaactggaccacgctgccaccacctctcttcagtaaagttgttattgttctgatagatgccttgagagatgattttgtgtttgggtcaaagggtgtgaaatttatgccctacacaacttaccttgtggaaaaaggagcatctcacagttttgtggctgaagcaaagccacctacagttactatgcctcgaatcaaggtaagtttgccttaatgttttatgaatcatggtttggctgttttgaagatttagagggggtctctgtagtctttcgcttggagttgcaattttaagaaagtggaaattttgtgctgtcagttggctggggcaatagaatgttgaaggagcctcacacgggatggaactgagacccatcatttgtgccccatgtcaagtagccaaagctcatgcttcatggcaaatataaaagatttagagcaagatcatccaggctaacctacccca

SEQ ID NO: 33262 - DNA, 1162 bp, Homo sapiens
aacagctgagtgccattgaggggcagagaggatcaggaagggtgacacagccaagggactgtctgagccgagatatgatgggtgagtggggactccccaggtgggcagaacaggctggtagcttctgcacatggcagagctgtaggactccacagcctgttggttctgctgcaagcggagcctcatcgtgccctgagggcaggtggccgactgggtggggcctggtcctgagggggttttcctggagcttttccaacaaaaattagacctgcatgttagaaagcagacctggggctgaggtaggagcacaccagcacacctgcctggcctggggtttagccagcttcacctcctagatggctgggccttatggagcatctgtagtcctatcctgttccaaagtggggcgcttttcaacagttacttttcagtaatgactgagttttcctgactatatatggcatcactgagaaacacttctcttcataggagatttttttagtgggagggagatgagctagctgaggggtcagggctcaccaggctgacagctctattgggggctgatcaactgctcatctctcctccgtgatgtgtttatttcagaaatcaatgtgatcattgagtgctgtgtctttttcagaacagccttcttgtaggacacatgtagatgccctcagcttcatcatcctgctggttactttaacgctgggtactgtcctgtctttaattaactgccctttgcccttagttacctcatgacaacttgggatctatttaacttgcccatttgctcaccttcagttatgcccattaagcccagcagtgatcccacagaaaaatatttttgtcagaagaacccttgctcatttaaattatctgtagaatatattcgatccatagcccagaaacataaaaacaatattagcaaaagtttaatccaatgctaatgttcatttatttattatagacgtggggtcttgctatgttgcccaggtgggtcctgaactcttggcctcaagcagtcttcccgcttcagcctcctcaagtgttgagatgaaaggcatgagctgctgtgtccagcctatttatttatttttaatgacatagattttgttgtgtttcaactcccccaaatcctgtaacctgaataaacccctag

SEQ ID NO: 33263 - DNA, 1031 bp, Homo sapiens
gctgcagaaactcagagggcaggaggaggggctttcaacagcgtgttgagagaagccttccctgaagacgtgtgcagggtgagcagagacttgaagggagggaggggcagaccatgtggtctgtgcacgagtgttccaggaggaccagcagcgagggtcaggcacagcctgcctggcttgtcccggagcagcaaaggatgtgtggctgcaaccccaggggcagagaagcctggtgggtgcccccacatggctcagagctcttgccttttgctgtgtgttgtgttctcaccagagtcctgtgaaagattccatttgacagatgaggcgaccaaggcacagagtagaatgcgtccagagtctcacagcttggcagtggcaaagacagaaaccagatacaaaccgtctgccatcagagggcagaaatgcagcctgctgtgctccatgagctgtgtacaattctgtgaacttcatttatggcattatttgactgtgaccctgtgatctggctatgagctcataggaaaaaaaaatctaattcattgagaaagagctacaactctataaagtaaagctaaaaccgaaaattgtcttcttaagatgatgtgctctcttcagtctgaacgcagttgaaatgtttttcctttgccttaaaggagagagagacgcctttacccaatttgctggttctttgtggtgaccatggcatgtctgaaacaggaagtcacggggcctcctccaccgaggaggtgaatacacctctgattttaatcagttctgcgtttgaaaggaaacccggtgagaatttaggaatgttaacagttggaaattgtattacatttgttttctatagtctggttttaattttgaaaacctattttttagaagctccataaggttgaagtccccaagcaatgtgagcatgaaaagtaattgggcaaaaggcttttgggatctgaagttacgttccttcccgaatccttaaaatacagttattctttgtcagaattttgttgtatgaatgttgctgcctg

SEQ ID NO: 33264 - DNA, 1184 bp, Homo sapiens
ccctgtgtgggcagtacaggtctggccactccagagtcaaggggtgtgggaaggagagcatgcctgtacctggacttccacagagggcagagcaggtctgttttattttcggcctcttgctactagaatgtttgaccctgtttgttgttctgttcccctggtacctggcacctagtggatgttttatcatttgtggattgaatgttgaagactcagcaggcgagccagtggaggtagagaccggcggtgaaaggatgctgctgggctgtgggaatggttttctgaagtgctggaacttctttcatggccccttatcgtcagtggggcgcaatccacaggcctaccctgtgtttgtatttcagaattacagttattaaaatagtttgtgcaggcaagaactggtcacaaaccaatcaaaggtgcaaaatcaagaggccagaaatagacctcagtgtatctggggacttggtgacaaaggtggcatctcagattagtgcagagaagacatggtgctcaataaatgatgctggtacccctggctgaccttttggaaaaaggtaatgcagactctctgccttattctttacaacaatatcaatccaggtcaaagcatgttaacgtctttaaaagactacagtatggaaaattctggatgtagaacggtagtcacagtcgtataataaacccccaagtccagcttcaccagttactggccaattacagccaatcttctttcatccgtgcccacactcatttcccttctcctttattatttggaagcagacctctaaaaggtacgtgctctttacccccataatcttgatacccttatcacatttaaaaaatagtgttaattccttaatatcactgagtagtgttcatatctctaatatctgtttctctctctttaggtgtttcagcttgtttgaatcaggctacaaataagaccatacactgtgatttgtttatgtgtctcttaagtctctgtaaatctgtaggtccccagccccaaaactctttgctttactacagtttactcgtgcacatttccttcttgagacctacagtcagcgatttctccaggatgccctgcttctttttagtggaaggtggtatttcaagatcactgtctcagagctaccagtgctagctctgagtggttggtcattgtttctagacagaaa

SEQ ID NO: 33265 - DNA, 1042 bp, Homo sapiens
gcgtgaatcggtttctaagttagtggcagcacgtgatggccagggttctgttttcctggtcagggtgtaattggtgatgaggatgatgagtggatgtttcccagcagctgggaaatgaagcttgctggaaaatcagaccgtccttgtaatttataacgagcccccgtaaggggccaggagctcctgttgattggcgggagggctcagtcaggaggaccattttattttctttgtgtcaaagcaactgtgtttctgattttaattgtgttgtggtggtgaacacaggagtgggatgagcagaggccgttctggagggcagcttgtaacatgtgggtgaccctctatttaaatttaaatagctgtttccatttatctcaagaatataagcagaggcaggagcctgggatgggacagaggcatgtccactgaagtgtccttcacaaagtgtccttgcaaaaaggaacaaccagggtaattatccagcagcaatacagtgatcctcccagtgaggtcggtgctctgacagtgaccgtcccagtgaggtcggtgctctgatagtgaccctctcagtgaggtcggtgctctgcagaggggtcttctggctgttaggcagcctattttcacagaacagagaagcatgttgtggaacaggtatgaccccagcttactaattgtgtacctgttttttttttcatacttatatgaaagactacatacttaaaatactggtgattatatttaggacctgaaatcataagattgtggtcttgctttttacttatttttgtatcttagcgatgtctagagttaataagtgttgcttttctaatcacagcaagtcaaggtgactgctgagggctgtggccagcctgaggggtggccgtggggctccgggggcacccctggaagtacttcctggctgagtggggagtaaggggtgggagttagggtgacctgaggcctggctgaggcagtgagagtgtagcaggccgtcatacggggccggggcctggggcagagaggatgctgacgtgcaggtacc

SEQ ID NO: 33266 - DNA, 1030 bp, Homo sapiens
gctcagggaggggcacccacctcagaaaaaagcgccgtgctcatgagaaatgacttctacaggttgttggggaaagaggagttattttaaagatcacagagcccgtgatgtgccaggcgcacccacacagggcatatagtccccgcagctgcctctgtgctggggccacgtcaccgtcctgtcctaaagacaagcaatgtgaagcccagagatggtatcttaaaacaatcgtgtggtttttttctgattacaacagcaattgtgttaatccaacaatatttttcctatcaactgtaaaccttattttaatatttacatatttattagcatttaaaattcaatctcctagaatattgacttcaattagtttggctgattctaattttttttttctaatttgtttatcacttaactttttaagtactttttttttttagacagagtcttgctctgtcacccaggctggagtgcagtggtgcaatctcggctcactgcaacctctgcctcctgggctcaagcgattctcctgcctcaacctcccgagtagctgggactacaggctcacaccaccatgcccagctaatttttatatttttagtagagatggggtttcaccatgttgtccaggctggtctcgaactcctgacctcaagtgatcccccacctcagcctcccaaagtgctgggattacaggtgtgagccaccgtgcctggcctgtttttagtacttttatcctttatctttttaactacgtaagtactcaacattttaaattattaatcttcaccatgttatttccaagaacaatcacgattgatctttcagttacacagccacggtgtgtgcctctctgtgtaactctgcacagctggtgatttactgaaagaacttactctcataaaaccacagccagcgagttctcagagacacaataatgcaccttaattatgagtttaaaagctcttgtcttgtgaaatgtaatcgatccacagaaaaatcataaagtatacatgtaatagcttaatgactt

SEQ ID NO: 33267 - DNA, 1060 bp, Homo sapiens
ccaggatggtcttgatctcttgaccttgtgatccacccacttcagcctctcgaagtgctgggattacaggcgcgagccaccgcgcccggccagagtgatttatattcttttgagtatacacccattaatggggttgctgggtcgaatggtatttctgcctctacgtctttgtggaattgccacactgtcttccacaatggttaaactaatttacactcccaccaacagtgtaaaagcattcctttttctcctcaatcttgccagcatctcttgttttttgactttttaataacagtcagactggtgtgagatggtatctcactgtggttttgatttgcatttctctagtgatcagtcatgttcagctttttttcataggtttattggccacatgtgtgtcttcttttgaaaagtgtctgttcatgttatttgcccactttttaatggagttgtttttttctcataaatttaagttccttgtagactctggatattagatctttgtcagttggatagattgcaaaaattgtctcccattctgtaagttgtctgttcactctgatgctagtttcttttgctgtgcagaagctctttagtttaatttgatcccatttgtcaatttttccttttgctgctattgctgttggcattttggtcataaaatctttgcccgtgactatgtcctgaatggtattgcctgaattttcttctagggtttttatagttttgggttttataatacatttaagtctttaatccatcttgagttaatttttgtataaggtataaagaaggggtccagtttcaattttctgcatatggctagccaactctcctagtacaatttattaaatagggaatcctctccccatcgcttgtttttgtcaggtttgtcaaagatcaaatggttgtagatgtgtggtcttatttctgagttttctattctgttccattggtctgtgtgtctgttcttctaccagtatcatgctgttttggttactgtagccttgtagtatagtttgaagttgggtagcatgatgcctccagctttgttcttttt

SEQ ID NO: 33268 - DNA, 1035 bp, Homo sapiens
gtagccccaagcctgtccttgtagggagtggcagccggagtctgaactgtcctgggggaccaagcaggagcttaagatgggcaagacctggggccctgggcagacgcatcaaagcaggcagaagcaggcatggtgagcaggccgccgtgcatgcctggggcaggcgtgtgggtgtgagctgtgctgtgcatgtgtacatgcgcacagacgagcgtgggcgtgtccgtgcttgcgtgtgaatgcaggtgtgggcgtgtgctctgcctgcatatgtgtgtgcatgagcgtgtgtatgtgcgtgtgtgtgaccttgcgggtgtgggctgtgctgtgttgtgggaagtacgtgcctcacgttgctctcctggtgagagtccggagcaggatgagggggttcctggctttcacaaaatcccggtacccagaacaagcccacccagagtccacttgcccctcaagccttcagaggccaagctggctcctgctggacggcgatccctgaccactgtgctctgtgggccttctggaagccactgtccctcccccagtccctgtgctgaagccagacacctgcagccgtcctgcccccaaccccagctacccaggcctgaggctggcatgctcctcagctgtctggccccctccagcccgaagggctgaggtccacccttcatctgagttaagtctctcaaaactctgggtgccctggagggtttcgtcagccagcccaggaccctcagccatggtgctcccaccgcaggccagcaggaagaccaagaagaaggaagggggtgccctccgggcccagagagcctcatccaatgtcttctccaactttgagcagactcagatccaggagttcaaggaggtgagactttcctgcttcactgggagcccccacccccaggagcctgtgctgggaagaccccatgtgggctggctccagggccagcaggagtggaagcctatcctcagtcaggggtgctgaggaaccgggagcagggggcggggcagagcccagccgggttggcagca

SEQ ID NO: 33269 - DNA, 1102 bp, Homo sapiens
gaactgggcgtgggtgctgggaccctctagacactgtgagtgtgagaactgggtgtcggtgctgggaccctgtggacactgagggtgagaactgggcgtcggtgctgggaccctgtagacactgagggtgagaactgggcgtcggtgctgggaccctgaagacactgagtgtgagaactgggcgtcggtgctgggaccctgtagacactgagtgtgagaactgggcgtcggtgctggaaccctgtagacactgtgagtgtgagaaccgggcatcggtgctgggaccctgtagacactgagggtgagaactgggtgtcagtgctgggaccctgtagacactgagtgtgagaactgggcgtcggtgctggaaccctgtagacacttagtgtgagaactgggcgtgggtgctgggaccctctagacactgtgagtgtgagaactgggcgtcggtgctgggaccctgtagacactgagtgtgagaactgggcgtcggtgctgggaccctgtggacactgcgagtgtgagaactgggcgtcggtgctgggaccctgtggacactgtgagtgtgagaactgggcgtcggtgctgggaccctgtagacactgagtgtgagaactgggcgtcggtgctgggaccctgtggacactgcgagtgtgagaactgggtgtcggtgctgggaccctgtggacactgcgagtgtgagaactgggtgtcggtgctgggaccctgtggacactgcgagtgtgagaactgggcgtcggtgctgggaccctgtagacactgagtgtgagaactgggtgtcggtgctgggaccctgtagacactgagtgtgagaactgggtgtcggtgctgggaccctgtagacactgtgtgagaactgggcgtcggtgctgggaccctgaagacactgagtgtgagaactgggcgtcggtgctgggaccctgtagatactgtgagtgtgagaactgggcgtcggtgctgggaccctgtagatactgtgagtgtgagaactgggcgtcggtgctgggaccctctagacactgtgagtgtgagaactgggcgtcggtgctgggcccctgtggacactgcgagtgtgagaact

SEQ ID NO: 33270 - DNA, 1011 bp, Homo sapiens
gaggagttccttagatccttcaaaggggaaccttccagtgtgttcttcacacctgatgtgcgtcctcacacctgatgagtctgtgctttggtgttagaggactcacacctggggctggacctgagtgtttttctaagtgtggctaccgctgacgggcaggtgccatccatcaggctgaggctcggctcttatgctaacctgaggccccatggctggcggccctgctggtgtggacgaccgctgtgtgcgtctcttgatggctggggagcattttgtttaaacaggatctttaaaatgaagtgtacgcttataatacaagtgatgcttgtgtatttctcactttaggaaataaaatatttgccaatttgatagaattttgactttaacgttaatcgtatttttagatattggttagcatattttatgttaggttattttcatttgattttatctagttgtacgtagaagatactgtcatcttttaggacaaagtattgtaaaattatctgttttagcccatgttctgatgacccacagctctgtcacctttgagcatcatctccccattctaagtttttttcccacttaattcctaaccctgcctctttgaggaagcccattgacggggcaattaaaaccttctcattgctcctgagaccagaacggcaagatgtttcctttcagaagctgagagccacaaggaggacagcagtgagcatctgcacagaaacgagctcagagacgcccgtgttcagtggagcacgccgatggggtgggcgccctggctctagacgctctcctaacacacctgtgctttgatgacagtctgcaggagctgcctggtgaagtacctggaggagaacaacacctgccccacctgcaggattgtgatccaccagagccaccccctgcagtacatcgggtgagtgtgggccttcccaggccacagtacgtggggtgagtgcccctgggcgtctctgtgtgtgggccttcccaggccattagcgctgt

SEQ ID NO: 33271 - DNA, 1024 bp, Homo sapiens
attcgttagcgttatgccaacagtgagctcctcagatcaggctggactgccgcagctcaagagcaatgtccagagacagtgagctcttatttatttatttattcaatcatttttgagacggagttttgctcttgttgcccaggctgagtgcagtggcacgatctcagctcactgcaacctccgcctcccaggttcacacagttgtcctgtctcagcctcctgagtagctgggattacaggcaggtgccaccatgcctggctaattttttgtatttttagtagagacgggggtttcaccatgttggccaggctggtctcgaactcctgacctcatgatccgcccgcctcagcctcccacagtgctgggatgacaggtgtgagccaccgcgcccggccccaataaatgtttcagtgcctgtatacacctgacactgagtgctgctatttttaatccttctttattcttacaggtgaaaattaaagaaatgggaactagagccaagggtcagggtctgaagctgagttgctttccactgtgtccgtggggctctctcctttgcacggacctatgtggcctgttgttcccgtcacggctcttctgcagactgatgggaacagcctcctgctgtcagcccctgtcttgcaggcctccattccagctgctgggatgtgattatttaagggaaacattttctttcaagctgctctcagattctccaggctaatctttcagcatttcccttgtgaggctccagcactccatccacctgcggccggccccacctatccccttggctctcagggtcccctcctctctctgcccaggctctcggggtcccctcctctctctctccccaggctctcggggtcccctcctctctctgcccaggctctcagggtcccctcctctctccccaggctctcggggtcccctcctctctctgcccaggctcacggggcatcctcctctctgtccaagctcgttgcctcacgcgggcattggtccctgcacggttggtgtttg

SEQ ID NO: 33272 - DNA, 1768 bp, Homo sapiens
ttttttaattttttgtagagatggatggagtcttgctgtgttgcctaggccggtctgaactcctgggctgaagcagtccacctgcctcagtctcccaaagtgccaggattccaggcgtgagcccacgtgcccgccaagtctttgtaagcgcatttccggctgtgtttcctgtgtgctcctggctgctccctgcggactttgatgaataatattttcactggcattcatttctaaagaagctgtaatttcatcagagttcctttttaatcgagaagtttgttctgaaacatttgagtaacgtggcctttttgggttccatccactcctctttctagtctccttcccgggcggtcagggagtgttgtctacacggatctctgccttgggggattgagatcttcttgcttgttcacttgggtgcagattttccaggggtcctggggtgattttcctttggctgagtttgctggttggtgtggtgggtaaacaagcggaccccgggggccagttgcccacgtcctgctctgcctttagccagggtgtggcccttcacaagtgacctacctctgcctcagtttctctgtctgtggcgtgaggtggtggtgagattgcctcgaggtttttatgaagattaaatgatttcctatttgtgaggcactttgaggtgttaagttgaatgaatgagaaacaagcaggcagcctgggagattgtgaactccgacatccaagtccggtcgtttttcttgtggattcttgttttctccgtgtctctgtaacctcgcggtgttgcttaggagccgtgctgctggctatgcaggctgatggttcttacgtagttttgatgacttgcaccttttgccagtgtggattctttttttttcttttttcctgttcagtgtgttttcgctctaacccccgattctcttgtactaacatcgctacagttgctgttggtctctgcttccaccctccctgtcatttgtttcagctgtgttacggaggcctttgctttgcttttttgcacacatctcaggttctctttgataggagagtttaacccgttgtctttgttgtgagaatacattttttcccctctccatgagggcttggatccggttttggtgtcttctttctctgctctaatggtttgggaattttgcattctctttctgttcttcttgtggctgcccttaaacttggattccgtgtccgtttgtgggattatccgcgtctataacttcgtgatgagttcctgatctccgtcttccaaaacttgggaagtcatccgagggtttgttccagattgttttgggtaattttaaaattttatttcacactaattttattctaggaatcgcttcttcatcttactgaagttttgatgcgacgttatagttatttaggcttaacgggaggttgcatgggttttgtggccgtttctggtgtcttcctggtgtgtttggatttgtgcttcgccacgtccgcacgtcacttctgagcccagtgcggtggcccctgagctcctgccggtcacgggctgtgtgttgtccccctcacaccagagacagtcgtttcttctcttaactcttaagccctcctcagtcactcggatgaactgattaaattctgtgcttttaatactaagcattaaaaaaaaaaaaacatatgagggaagcacctgccacccaggcccatgtttctgctctcagccttgtgccctcccccggtggcccctccaaagggcatgaagctgtggatgctgtgcctg

SEQ ID NO: 33273 - DNA, 1681 bp, Homo sapiens
gagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcagggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttc

SEQ ID NO: 33274 - DNA, 1028 bp, Homo sapiens
gaccacccgccctgtactactcaggctgtgaaagtgcctccaaattctggcagtggccgctagtctgagtgtgcggggctgtgtgccacaaggaactggggtctggggaattccgtatgaatcggatgacattttggctttaaaggcctgagacatctggtggagttggttggggtgggggcagtttggacacatgccccccagcacccagctggcgccatcctgtgatggccccaccgcatctcccagcgtcccgtggagtggggaggctcaccatggcccagttccaggctctggggcctggtaacctaggatttgggggggtttggttttgtttttgttttaacagttttcgttaatggtgaccttccctgatgtgcctctgggcatcttcttgttctgtgtgtgtgtgatcgccattggggtcgtgcaggtagggggcctggggggcctgcactgtgtgtgtgtgtgtgtgtgtgtgtgtgtgtgtgtgtgtgtgtgatcaccatcggggtcgtgcaggtagggggcccagggggcctgcactgtgtgtgtgtgtgtgtgtgtgtgtgtgttcaccatcagccctcttggggcctggggtcctgtgctgtgtgtgtgtgtgtgtgtgtgtgtgtgtgttcaccatcagtgctcttggggcccggggtcctgtgctctgtgtgtgtgtgtgcgtgtgtgttcaccatcagccctcttggggcccggggccctgtgctgtgtgtgtgtgtgtgctgtatgtgtgtgtgtatatgtgtgagtgatcgattgccgtcaggtcacacaggtagggttcctgaggccacctacacacataggatgtggcatgcccagagtccccgctttctgaccagagactgggaagagtgggccctgagaccccccacatgcggccccaggagccagcaggggctcctgttctctctccacctcagcccctgtgcccaaagtgtcccaggtacaagcccacctctactcgccaggtcctcccccaccccaagacccct

SEQ ID NO: 33275 - DNA, 1057 bp, Homo sapiens
tgtcacctgccctgtgggtcctggggctggcggaagtctcaggaagaggcctcctatgtccctgccaagctttgtgggtactgggaccccaagtctgctgggggagcagcactcagacactagcctagcccatccgcctggacttgggacagaattctgagaatatgcctggacgggggccccatcagggccagctgggaggggaggagggtgactggcgtctgtctcccctgcccagacagttctgggacgtgaggcgccctttttcccaggctgcaccagctcactgtggaacggccatgacacactgtcccgaggcagcaccgagagggcccagcccgctgcacacagtcaccctgggccggcagagccggaagggcacctgacctttcccttgatctcggaaaacaccgtggcgttagggaggcggtgcttagaggcctgactggtcccacgtgaggcctcgggtctgtcctgtttgcagactccaatgtactttcactttaaacattcttctcagcgacgttaggcaaagactttgctcccaggacaccaggtgcccaggacaccctggagcctgggctgagcctgctgtttgcacgctggcccagggtgtgcgagctccagtctcctggcgggtgtgttggggcagtgagcccagcctggtaggttgacacatgcaggctgggcacagcacccctggggcacagagcgggggtcctggccctcaggcaacattgcaagagttgtgtccccttccctggaagaccccaccacactgggtccctggatgccctgaagcccaccccaagcccctggggtccaggtgtgtggaatggggacagtagggccacctgccttgagcctgagggtgcccctaagaaaccacgagtccagggcatttctggcctcggctcccacgcccccctctgctgcagctgagatctgggcccaggatggttcttacctgagggagtcctcacaggcgcggagggccctgggatgacgaggggctggcaagaccaccgaggaccgcagggccctctggctcccgcga

SEQ ID NO: 33276 - DNA, 1061 bp, Homo sapiens
aggagctacggggtgaggggtgtcggagagggcacttcagatggggcaggtgttcggggagctgatatgagggcctgtgaagacggggaagggcaggccgcagggggttcctgcctccgtccctccagactgcagcttcttcccctccatcccagggcctgcccacctccaccctccctgggccctgggaaagaggagcctctgtctggggacagtgtgtgtgtgacaaagcgtgtaggcagagcggcctctgggccttgctgctgtgggaagcccctgctcctcctccttccctagttgtgttttttacagctgggcaggggtggggggggcggcgggaggatttggaggcatccgccttcttggcgcactgcctccgagtctagtcctccatacctgacagcagtgaggccctgtctcagactcagtttactctcatgtctcgctcccatgtggcccttggtgtcctgcctgtgctgggggcctctcggctgtggctaagtgtgtgtgcagggcaggggctgtgctggaggaggaggctggggggtgtcttggcagggtgcacggccccggaggtggcacagtgctgctgtcatgccccggcgggggttccctgtgtttcttcctggctgcagtgcgaggcagccggtcttcccaccaggtgcctgtgccctcaggtcctgactcagtttccccataggctgcgtgggttggacgcccgtccaggtggcgtggtgccctggccgctgtcctggtgtgatcattccccaggaatctggggggatgggcttcctcctgggcaggccctcctgcggggggtcttgggccggcaacagcagggggtccggggagcccaggtgggggtgggataggcctggcgagggggagggaggctgtttgctttaggataagcctggctcctctggcccagctgcctctgcccgtgcctacagcgcttgcaggccggccctgggggccacgcttccggccatccagcggtcatttgtctctgccccctttctcagtggtgaccacaggcgggggtcccgcctccctgtctg

SEQ ID NO: 33277 - DNA, 1021 bp, Homo sapiens
tggcctgggtgggagggtcctgagttgagggagagacgtgagtcagagaagagacccccacatgttttctcagagaggccaaggactgggatgggccgggtgagccagggctgagaagaatccctccctccagagcctcagcccaccctttgtgtttctgggcacagcagggaggcgccgtgtctccactcccagccccagcggccaatgatgcctgtgggctcagaacctagaggccctgggcaacgccccctgtgctatcagcactgattgggaggcctccagagaggtgatagggattctctgtgagggtccctgtccccagacttgggggtcagaatgggagctgctccctgagtgtctgaagacgccagtgggagacgtcacagggccactgttaactgtgtattggaggaacacgcggccccaggccccatcgagatggcctggagcagctgctacctcttggtgttctgcacgcagcctggacgctcccagacagcagtggctgcagtgcgggatggacactgtcacccatgggctggcgagagatgccctgggaactgtggggtgcctgcggccgcctctccgacatggagagcagtgagtgggctgtggtcgccgctgcaggacttgggagcagcacgtggggagtggggcacgcagggccctcctttcccaggagctccatccaggtacaggccctgcggtgccccgagtttctgaggcctgcagggtctgtgtgttctaggttcatcttcctggccggcttggcactgcccactggggctggtcacacacacacagaaccctggccctgccttccagcccagaggcacccaggcaggggatggggtggggtggggactgaggcaggggatggggtggggacccaggcaggggatggggtggggacccaggcagggaatggggcgatggggcggggtggggacccaggcaggggaaggggcggggtggggacccaggcaggggatggggtggggtggggacccaggcaggg

SEQ ID NO: 33278 - DNA, 1048 bp, Homo sapiens
agacccaaaaccgccagggccacctgtggcctcctcgtcctcggccactagcctgccgtggcccgtggtcatcggcatcccagccggcgctgtcttcatcctgggcaccctgctcctgtggctttgccaggcccagaagaagccgtgcacccccgcgcctgcccctcccctgcctgggcaccgcccgccggggacggcccgcgaccgcagcggagacaaggaccttccctcgttggccgccctcagcgctggccctggtgtggggctgtgtgaggagcatgggtctccggcagccccccagcacttactgggcccaggcccagttgctggccctaagttgtaccccaaactctacacagacatccacacacacacacacacacactctcacacacactcacacgtggagggcaaggtccaccagcacatccactatcagtgctagacggcaccgtatctgcagtgggcacgggggggccggccagacaggcagactgggaggatggaggacggagctgcagacgaaggcaggggacccatggcgaggaggaatggccagcaccccaggcagtctgtgtgtgaggcatagcccctggacacacacacacagacacacacactgcctggatgcatgtatgcacacacatgcgcgcacacgtgctccctgaaggcacacgtacgcacacacgcacatgcacagatatgccgcctgggcacacagataagctgcccaaatgcacgcacacgcacagagacatgccagaacatacaaggacatgctgcctgaacatacacacgcacacccatgcgcagatgtgctgcctggacacacacacacacacggatatgctgtctggacgcacacacgtgcagatatggtatccggacacacacgtgcacagatatgctgcctggacacacagataatgctgccttgacacacacatgcacggatattgcctggacacacacacacacacgtgtgcacagatatgctgtctggacacgcacacacatgcagatatgctgcctggacacacacttccag

SEQ ID NO: 33279 - DNA, 1022 bp, Homo sapiens
ctcaggtcacctctgacctcagggctccgtccgagtgccctcccagccaccctgcggtgctgcgacggtggccgaccccatcttacccggtcagcaggaggggtggggctgccagctccacccggggcccttgcctgccgggggttccgttagcctcgtaagaaaaggcaccggggcccctcgtgcattcagcaaagcgtgaggcccactgcgtccccggagcctggtcctgctggcgtgcagcgcgcttcctgacccgctctggttctgagagcttttccctggaggaagctcaccctgcctggcttcaaagacgacaggtgggctctggggagaggtgtcagggacctctccccaactggagcttctggggaccccatggctttcaagatgtcccctttttgttctctgtcctccccagggtagaccctacttctctcccctgaggaagtcctgactccttggacggtgacagcttcaggcatggccctggtaagggctgcgtgtggctgatgggtgctgtgggaggcctggccaccctgactgggggacagtgggggctccacgcggcccacagctggcagccaaacagatgttccccagacaggacaggctgcaggccgacgcctggtcgggtttcagtctggagtaggggagggtggaagggagacctcaggcgtctggccaccttgggcagcagggaggcctcaggcagcgggtcatggggttgcagaggacaggctgcccctccccagggagtgggcggagggatgggcagtccgagagggctgtcccctagagcctctgaaggagacactgggaccgcagaccccacgcctgcaccctgcctgctgtgaggtccaggcccccactcagggccacccttgacttgtggtccagcccatcttgcgcctgcccacaggaggtgctgactagtgctgtgtggtcctcaacggacaggtctggcacagcctagcctctgggtcttgggctctggactttgtcatgctgtggccacgttg

SEQ ID NO: 33280 - DNA, 1040 bp, Homo sapiens
ccacccctgcagcaaataacttgatataaaacctgggcccaggctagtaatacccttgaagcccatgacagaagcaggcacagtgatagaagcaaaatcacgtagacattatcaatctagccccctccaattcctacccataaagcccactgaagatgaatttacaatcataaagtacaaaacatgccaagaaagaaccacatgagggaagtcagcagatgtgtgaacagcaggaacggactccgccaccaaaggccttcaaaaggtgaatcaagcaaaaaagagaacattaattaaacatgtttaacatgggtaagaattacaggaataaaagaagtaaatgaacaagaatacgattgcaagggagtggtagaagaataggcagttttgaagaactaaatggaatatctagaatgaaaaaccatgcttgctaaaattaactcaatgagtgagtttaaaaagcaatttagacccagctgagagctgaatttgtggtatatgcagaaattacttctgatgcgaggcagagcatgatgacagaatgaggagatcccaaacatctatgagagttccattctgaatgattagaagaatgaggaagcaacagtatttaaaaagataatcactaagaaagttctatacttgatgaaaaatgtgaatcctaagattcaggaacagtgtgagacttcagctggggaaaaaagatgaaactacacttctacatttaggagtaaaactacagaatacaaaagacaaaaaaattttaaagtgaaaaataaaaccactcagattacatcaaaagcagttatcatgaaagcagcctatcaattacaatgataaaagccaagcaatagtcaaatatcgatttttttcaaagtcacaagataaaataagtagtaacataggattctgtacatagcattatttgttacctattggggcataacaaaattccccaaaactttgcagcttaaaaaacattcagtatttcaccattgccatgagtcaggaatccaggcgtggcttgagtcctctgcata

SEQ ID NO: 33281 - DNA, 1419 bp, Homo sapiens
tgggtttagacctaggggtgatggctccagtcctgcccactttgccccatcctctgggtcccgagcctaccctgggcctttggactcctgccaggccttgcggcaggtgcatcacactgttgggttcctaagtgccacaggcctgggatcagcagacatgaggaacaccaacggtgtccctggaaagcaatccccggggctgggtgaggcaggaggagtgtagcaggtggggaagctggatagaggtggccaggatgggagctgtgctctgtgggccatgagaagggtggaaggacttgggggcagggagagattttgggtttgtcttcataagggtcactctggctgctctcagggggattgaaggagcaaggcagggagacacagtggcgttcatggtcatgggggaagggctgctttccagcggtagggctgagaaacggtgaggaagaagcctggggtggcgggtggcttgcactgactctgggctgcggtcctacctaagctccagggaggacggggtttctgaggagacctggggaacaggacacatccatggaaccccccggtggaggtggatggccgatgagcctggggcccagaggcagcacttgaagtcacaggagctaagagcaacagtgggtaaggcaaggagaggggtcagagaagcgtggcctgggtcagagcgtgccttccagggaggtgagtgaacctaaggggaacctggcaggaggagggatgagtagggtctgcagtagagacaatggggctggcagggcagagttcgggcaacgcggacctgcctggggagaagcggcttggagccgatgtggacgggtgcacatccagtgaaccacagtgtcagggcgtgatccccggggtggggaacgtgaggaccaggaggaggggctgtttgagcagggaattgggtgcagggaccttgggcgcaggtctgaggagggggatatgggcgaccccttcctcttctcacaccaggacgccggggtgtcgctcgtggaggatgggggatgggatcgtttcttcatccgtgcatcttttcagggatgtttccgttgtttccggatgttttcgttttttgttatttcaaagaaatctgcaaacatttgcacgtaggtttttatgtgaatgtaagtttttgattctctggaacaagtgtccagctgtgtgattgctgggttgtgaagtaagcgtatgtttcactttttaaggacccgtcagactgtctcgccagcgtggctggaccagctcaccttctcaccagtgatatgtgagagctctgcgttcttgccaacgtttggtgttgtcactatttttaatgttatccgttttagctgttctaataggtaggtagtgatctctctcattcgggctttcctttgcatttcccgcgtgactagc

SEQ ID NO: 33282 - DNA, 1026 bp, Homo sapiens
catatttttaaaaagaaacggggtttcactgttgcctagggtggttttggattccaggacttaagcgatcctcctgccttttgacctcccaaagcgctgggctgacaggtgtgagccacgcgcccgccacactaatggtttcgcagtggggtttcatggtgcttgtgtgtccagcacttcttttgatcaaggaagggagggcaatgttgctgacgttaccaaaggtctagcctcttgctagatccctccaagatgtaggtggttggtttttaatactcagtgacattggtggatctctgttggtttagagatggagaccctgcagctgagagaagtctatacaaggacattgtggtgatattagtagggagtcctaaccactgaccactttgtctcacgcagtgcacctccaggcctgtcatttcagctaacacacaagaaggtttgaagatcagaaccgtggtggtttgtcacttctggtactggctggtgaatgtgggaaacactagataggaaaagtttccagaaatcctttcattgtgtattgaaggaactaggaagggagatggaaggtctccggaaaggattcttcttcaggtcttctgctgttttgtaatcgtgaatgtaatttgtattccagagtgattgcatagcttctgattaaaatagtcatgcagatagtcatacaggtaaagaaatattatagtgtcataatttctctgttgacacttgtgtcactactgagttaaaactttttttcatagaagttttcaggagtgattcctagtggataatggaggtgttttgctgggaaactagggatccttgatttagaagcatttattggtatagaactaaacagaacatgctgagctcacagctcaagagctgcactcttcagtttccaggaggggccagtgcagatgtcagagaagggaccgagggctgcaggaccggggttgtggaaggtggggggtggatgttctgcttctctagtctgagagcaagtcctcctgcagggtggta

SEQ ID NO: 33283 - DNA, 1021 bp, Homo sapiens
acatctgcacctcacctatgctaccctcacctgtgcccccccacccgcacctgtgcccccctcacctgtgcctgtgcagccgtcacccatgccattcctcacctgtacccctcacccatgcctgtgccgttcctcacccgtgcctgtgcccccctcacccgtgcctgtgcctccctcacttgcgctgtgcccccctcacctgtgctgtgccctttgccttgtggctgctcctgcacttggttctctctctgttggtcggttttcccattggctgtgcagctccctggtgtgcacgtggctctgagtcttcctctcgtgaaaaccccttccttgcccccgtcctcctccagctactactccctgtctctgccccttcatgtctctcttcctgttttacctaaatcagatttttgccccccaacactccacccagatgttcctcttgaggacaggatgatgctcctgaaagcggtcagtccacagcggaccccactgcctcgagacgctcccatcactcggctcccgtgacaccatcctctgggctctccccacccctcgctgcatgtcctcacttgcctatgctgtcttctctagtcttggaggccttttgttttatgtcaccagccagccctccagaggttgtgtggcttcacagacggtctccaagctcctgtccccacactgctgccctccccaggcctctctccctgaggccatcccgtgtagtcacctcccggagctctcttcgcatgtctggaaggcagttcaaagatacgataccaggcgcaaaaccaaatgccgcatctcggccttggggccccagacgagccccagacctgccttactaagccacccttcccaagtcagttgacagcgatgtcccccggcacttgttcagtgacagccgagaactcggaggttttctcgatttctgtttctcacgtttatccttgagtccacgatggctgctggggctgcggccttcgcggccaggaggagggtaagggggaatcagtgccgc

SEQ ID NO: 33284 - DNA, 1755 bp, Homo sapiens
catcaaagcgaacatgcaagaaaacgctatgaaggggcttcagaaaagaaatcatcaaagcaaacatgcaagaggccgggcacggtggctcacgcctgtaatcccagcactctgggaggccaaggtgggcagatcacgagttcaggagatcgagaccatcctggctaacacggtgaaaccctgtctctactaaaaatacaaaaatttagccgggcgtggtggcaggcgcctgtagtcccagctacccgggaggccaaggcaggagaatggtgtgaacccaggaggcggagcttgcagtgagtggagattgcgccactgcactccagcctgggcggcagagcgagactccgtctcaaaaaaacaaacaaaagcacacatgcaagaaaatgctttgaaggggcttcagaaaagaataatcaacatgcaagaaaacgctatgaaggggcttcagaaaagaaatcatcaaagcaaatgtgcaagaaaacgctatgaaggggcttcagaaaagaaatcatcaaagcaaacgtgcaagaaaacgctatgaaggggctttaaaaaagatatcatcaaagcaaacatgcaagaaaacgctatgaaggggtttcagaaacgagaaaccgttaaagaaaagatgcaaggaaacaacactgtgaggggtttcagaaaagagaaatcatcaaagcaaacatgcaagaaaatgctatgaaggggtttcagaaacaagaaatcatgaaagaaaaggtgcaagaaaacaacgttatgaggggtttcagaaaagagtaatcatcaaagaaaacagcgcatctgtgaggccggtggtccagacgtggggctgtgggacccaagtggtgaactgtggcctcatcctgggccgttgggtcctgggctatgtgcaggcggaggtgccgtccttggtcccactggggaaggtcgggagtcattgctgctgaggaccacctgagcgcttgccccaagccttgccgtgcctggtggagtcccgtaccagctgctgtcctgcccctgccagagaccatgggttccactgctaggcactgagcacccaccccctgtgcccggccactagcggagacttgatgctaagcctgggttactctgttttttttgttgttttttttttttttctttgctttcatataaatcattggttgtaactaccgcgatattagccataatgtgtttatgtattatttagcatgttattatttgcttactgttgattttgaaatgagggggctgcccagggagggcctgtagatgtgctggggggctgtggggagtggagacagggccgcctggcatgtggcctggccctgcctgcatgtgtgtctcagcagctcctctccatggacaggtggggccagcctggctcccttgcccggctatggctgctgtctacgtgagcgtccgaccttttggtccttgggggctgttctgttcctaggatctcagagcggccctgagtagtccacgagtgcagacccacagtgtggactggagatgcatctcgagtggtggccggtgctgggcctgcctcatggaggctggggtgtgggagggtggcatgggggccttgagccagcacattctgatcaggtgctgcttccttcctctaaggacctagtgaatattgagatgttcctgacggccaaagaggtggaggagtccctggagaggcgtgagacggccacctgcctggcctggtgccatgacaacaagtcccggctccggaagatg

SEQ ID NO: 33285 - DNA, 1034 bp, Homo sapiens
agcttctcgggaagatcgcctgagcctgagagttcgaggctacagtgagctgtgactgtgccactgcactgcagcctgggtgacagagtgaaaccctgtctctaaaagttaaaattaaaacgcaaacttaaatgtgccaaaatgttgttttttagacatgcaagaaagcacttcagccaagcagaagggagccagctggacgaggtgcgccaggccatgggcatgctggccttcccgcccgacacgcacatctccccgtacaaggtagggcgtgcgtccctggggtcggtgtcatgctggggtggggatccagggtgtgtctctggtctgtagctgcttccacacgtggggcgggacgtgagggccccatcccagccacacagcctgtccagcctgccaagacaagcttttcttgtttgactcccattttgctcataagaaatttgaatcagggctgtgtgtggtggctcacccctggaatcccagcactttgggaggctgaggtgggaggactgcttgagcccaggggtttgagaacagcctggggaacatagtgagaccccacctctacaaaaaaaatttttttgaaaattagctgggcatagtagcacctgcctatagtccagctacccaggaggctgaggtgggaggatcacttgagcccataaggttgaggctgcagtgagccaagattgtgccactgcactccagctggggtgacagagcaggaccttgtctccaaaaaaaaaaaaagcagttgagaaaggttcaggaagcctttcagcctggagcgttcagccggggcccagcttccttgcctgtccccctggttctcctttctctacagcccctgagtcaggagttaggctgcaccgtcttccgtggttctttctcttgctgacgctttgtattttatctgtaaatattggagcctccgactctccgcggtcactggggtagggttgggggttctgccatcactaaccaggcaccctgtgctcagacctggccccaacccagcagctggctgctcc

SEQ ID NO: 33286 - DNA, 1048 bp, Homo sapiens
ggtacacagagattgccttgcaggcccagctgctgagctgggtgctctagtaagcggttaaaaagtgcagcacacgactgggcgcggtgactcatgcctgtcatcccggcactttgggaggccagggcaggcggatcgcctgagtccaggagtttaaagccagcctgggcaacatagcaggaccctgtttctacagaaaagttagttgagcatggcatcacgtgtctgtagtcccagctaatcaggaggctgaggcggctgcactacctgagcctggaaggtcgaggctggggtgagctgtgattgcaccactgcattccacctggtgctgaaaagtgacaccctgcggggagtgggcctctgagtgtggttttgagtgggctggtgcttttgctccacatagcgcagcaaacaggtgtcttgatcttccggcagaaatgtctggagaaattgaatcctgcttgacggaggtagagagctgctttaggctgctggtgccttttgactttgacccgaacccggagacggaatcccttggcatggcttctggcatgtccgatgcccttcgctcctcctgcgcgggccaggtgggcccctgccggtctggcacccctgacccccgggacggggagcagccctgctgcagtagagacctgcctgcctctgcaggccaccccagagcgggcggcggggcacagccatcccagacagccacaggtgacccctcagatgaggacgaggacagcgacctcgaggagtttgtgcggagccacgggctgggctcgcacaagtacacgctggatgtggagctctgctcaggtaactgccttcgcggggtctctgtggcgccaccctgccccggctcccgggtaggctcctccctcactggcacccggcccaggagcctggggatgcaggggcctcccctggggagctaggtcaggggtcaccaccaggtttttcctttctgtgtggcctctgcactgggctccccccacccatgccaggcctctgtggccacagggacacttctaagagctcatggcag

SEQ ID NO: 33287 - DNA, 1022 bp, Homo sapiens
gggctgggaagctgctgggagaactgatcctcgggtctcagctgcccagaggtgcctcagcagtgaggctgcaggcctgtgcggggtggacaccgctgctgcaagcctgggctgtcctcgcctgtatagagctctgccctgcgccggacactgagggtgccacagcgggggaagccacggcagggcagaactggagttggggtgtccagcggaggagaggccgggggggtgggggctggtgaggctgggctggaggggcgccatcctgtggcgtgggctgtggaggggaaggttctgtgcccggcgtgtgggggcggtgagtagaagaggctgtgggtggtctcgccctccagatgggatggctgcagccaaggagactgagacacaggcagtggagctgcgtgtgaggggaggctttggtgttaagccacagtgttcttttctaagataataaaacacttccttctcacagcatcaggtttgggattcccgggggcaggcatgggcgtctggcaggttcccctcaggctagagcagccttccttgcatggtctgcctctccggggcctgtgggagacgccagtcggcgccctcttgtgacctctgtgtgcttctccccagagggcctgaaggtgcaggagaacgaggacaaccttgctctcatccacgccgcccgcgacacactcaagctcatccggaacaagttcctgccggctgtgtgctcgtggatccaggtgagcctcgaacctgggacctgtgggtggagggacgtgtgcagagtgccatgcatggggggggtccctttcttggggggactgtggcccggtgactgaatggcccttaacccgcgagggctctgtccctcacccgcagctttgtcctctgcatcccaggtgtgccagggaccccccgggccagtggacctggcatgtgcctcccagcaggacagcttcccaggtcctgcccggccggcccctgagctgttcgcacccccgtttcgcagcgcttcacccgcgtcggga

SEQ ID NO: 33288 - DNA, 1088 bp, Homo sapiens
caccgtgtctttcctttttaacatttcccacttggtttctacgtaatactgttttccttttgacgcagatgttctgtcttcagaaaatacttaggcgggtttgaatatgtgtgctgtgcatttggagtgcctctgagtggcttccgtctggggacagatgttccgtcttcagaaaatactcaacgctggtttgaatatgtgtgctgtgcgtttggagtgcctctgtgtggcttccgtctgggagcaggccgagggtgaatctcctggatcaatgtgcagcgtcatttggtagattgcgtgtccagccttgccgcgctgtagggtgggtgtgatcatccgtggctgcgtcattcgctgagctgataaaaatcctctggaaactttcacgttgcctgctgccaaattacatagctcaaatcaccaattactttgtattgtgtaattaacaaaatattaatttcctatcagccagtgagtcagaaacgcatcttaagcatcgttctctttagtaccgtcagcgtggctctgtctttccttctgctagttaccgggttacttgtttccgtggctgaaagatacgggtttgtttttgttctcgccgatgttgagtctgatgtggcagccacatgggtttggccgtggatgcatcctccattgcccacagaaccagagtcgtccccccgactctgtggttttctttctctgtcggccgcctgcctgcctcctccaccggcctcaccaccaaagctctgatctttggagttagatgccagaagcattctgccctctgatgttcagtgggctccaggatgcagctgacagcctcccggggaccctgtcagcccctgggatcgaggccccacctccttttcctgctgtgcgtgagggaaagttttctgtgatgctctggagccatgggagtgtctgacttccaggaggtgaaagggacagaaactgaaaacccaggaatgaaacgtggacccaccaggcacaggcaggggaggagggacctaaatcagcgctgctgggaaaccttgtaccgccctagggctgggaaacaaccttcctgggtgatggggcccctccat

SEQ ID NO: 33289 - DNA, 1044 bp, Homo sapiens
ggggccctgctgggcaggcctggcttcacgttccacctgcctggcccgtcagcaccacgcacctggtgcatcgagctcacggcttcatgtttcccccaactgcctgcacactgctgtggtcggcttgatggagttgcagcctacacatggcagcggcccgggctggggaagggccccatgtcagctgcgtggatgggggtacatgggctggtgcaggagatggcacctgggtgccacatgtgccccacagccagttgagggccacactcctcctggctggcccctagccaggatggcaggggctgctcaccccacattccctcaccaagtggaggggtcctgccctctggctctcagccacatttagggatctcggagagcctgggctcgcccctttcatccaggaggtcaagatgatgcgggtccgggaagccagggcctggccaggccgtggtgggagacagggctgatgggggtggcggccacaggcaaccactagaacaaagccgtcctggtacacagagggctggcgggccctggctgggtacagtggctcacgcctgtaatcccagcactttgggaggccaaggcaggtggatcacttgaggccaggagttcgagaccagcctggccaacatgacaaaaccccatcactactaaaaatataaaaattagccgggcgtggtggcgtgcgcctgtaatcccagctactcgagactgaggcgggagaatcgcttgaacccaggaggcggagtttgcagtgagctgagatcgcaccatcacactccagcctgggcaacagagcaagagtctgtctgaaaaaaaaatagccagtggtcctcggccgaggggagtagagggaagcatccctgcacctggacggggaggaagcggtggagcccgtggtgtggctgctgtgcgccggctcctgagtgttctcactgcgatccacggggcgtctctggtccgagttccgggtggcagaatgcatcgctgcttctcccacggggccttgggtgcagcaggaagcatttggccgggcgg

SEQ ID NO: 33290 - DNA, 1021 bp, Homo sapiens
ggtgtttggccttcccctgtgcctgcaccaccgtggccacgctcttctggggtccctgcagatgctatgagggcctctggctgtgtctgcaggtctgactcccagcaccgcttctggaagcccagcgaggtggaggaggaagtggtcaatgccgacatctccgagatgctccggagccgccacatcacttttgccgggaagtttgagcctgtgcagcactggtgccgtgccccgaggccagacggccggctctgtgagcgccaagaccggctgaaggtgaggccgtggcccgagggcgggggtgggtgtgggctggaccaggtggggcagccagaggggtgctgagccccacctgcccctgccctgggtcagggtgcttgtgagcactgagaagcccatggaaggggcttatccgtggtgggcagaaattgcttagccgttggccatcagagcatggtgtctggggctcctgcccacggccctgaagcctgacacctgggtacatggcttggggactctccaggggccaagacacacagtatcctccatggttgcagcccgggtctgtgctgggcctgggatcctcaaaagtgaggagaggccagggggccagggcagctcccagccgggcagctgggcatggtgcaggggggtcgctatggccatgctggatgagggaggcctagactttccacagctgcccaagaccttccggctccagaggagggacggagccatccccacgtccctgtggctctcaggacgccctcctctgaggggcgcgtgattccaggttgtgtacactttggctctgtgataccacccaccctggtcgctgtttgtgcccaagtcgtggtggtggggggaggtggtcaaggcaagcggacccctccccgccatcagccaccgtgtcctcgctgtgcagtgccctttccatgggaagattgttccacgggacgacgaaggacggccgctcgacccggaagacagggctcgtgagcagcggcggcagctgcagaag

SEQ ID NO: 33291 - DNA, 1071 bp, Homo sapiens
aggctgagtgcagtggcagaatcatagctcagtgcagcctcaaactcctgggctcaagccatccttccacgtcagcctcccaggtagctgggactacaggcacacaccacaacacctggctaattttttaaattttttgtagagatgaggtctcactgtgttgcccacggtgatctcgaactcctagcctcaagcgatcctcctgcttcggtctcccaaagtgttgggattacaggcatgagccaccactcctggccaggagtttatatgtatactgtggatactagatcctcatgtgatttgcaaaaactttatttatttatttatttatttttgaaatggaatcttgctctgtcgccaggctggagtgcaatggcgtgatctcggctcactgcaactaccacctcctgggttcaagcgattcgcctgcgtcagcgtcctgagtagctgggactacaggcgcgcaccaccacgcccagctaatttttgtatttttagtagagacgggatttcactgtgttggctgggatggtcttgatctcttgacctcgtgatccacccacctcggcctcccatagtgctgggattacaggtgtgagccaccgcactcagctgatttgcaaaaactttcttccatactgttgtttcactttctggatagtgtcctctgaagcacaaaagttaattttgatgaagtacagcaatttatctgtttttttcttttgttgcttatgcttttgctgtcacatttcagaagccatcacctaatccaagatcacagagatttacacctagtttctaataagcattttataatttcagctcttatgtgtagatctttgatccattgtgaattaagttttgtgtgtggtgtaagagcccacattcttttgcatgtggatatccagttgtcccagcaccatttgttgaaaacattatttttccccattgaattatcttcgcaccattattgataatcagttgaccaaaaatgtacaggcttatttctgggcacttgactctattccattgacctgtttaaccttatgccagtgccacagtgccttgatc

SEQ ID NO: 33292 - DNA, 1017 bp, Homo sapiens
tgtggccctgaccccgtaccccaacaacctccttccctgtgtcagagcccgtgtgagtaacccaatagcaggcctggggaccacagtgtggctggccccctcctctgcaggcctgggctccgggggcaggtggcccctgcatgtaacttatgttagaaatgcacaatgcttgttctctggtgccacaaagaaatagtgctcgaacattaattttctcagcaaggcagtttttactttctgcagaaagggtgcccctcgcagatggagcaatggcaagagcacacctgaacaagggaggggaaggggttcttattcctgacacaggtagccctactgctgtgttgttcccctgttggctaaggttggaccacacagtctaagccaattccaattggctattttaaagagggcagggtaagagtcagagtggtggggtgagtagtttgacgggaaggacggttaggaacaggtaactcaaggtgacttaggtcagagcaggtgaccgggatgagtcaggatggagcaggtgaccagggaacagatgtgaactactgattaggactggcgggaaaattgtttactgaaactagaagcaaggggcgaagagaaccaggaattttaaatggagaatcaaagaagagatctggccgggtgcagtgggtcacgcctgtaatcccagtactttgggaggccgaggtgggcggatcacgaggtcaagagatggagaccatcctggctaacacggtgaaaccctgtctctactaaaaaatacaaaaattagccgggcgtggtggtgggcacctgtagtcccacctactcgggaggccgaagcaagacaatggcttgaacccgggaggcggagcttgcagcaagcagagatcacgtgactgcactccagcctgggcgacagagtgagactcttgtctcaaaaaaaaaaaaagagatctgaacatactgacttactgattctttgaagacaaacttggagttcactatatttaacacttaggaccccta

SEQ ID NO: 33293 - DNA, 1057 bp, Homo sapiens
ctgtcttaggctgagtgtcagccggcggcaggtgaccgcctggcccttgcagtccctccaggaccaccacgaagcacgacgcacatcctggagctcgccataccggctcccaggcctcaccctaggctctagggtgttgggcgccgcctcttcagggacctctggcccaggctccagttccctgcggatctgatgtggaggaaacagctgtttcctgggctttgcatccggcctagaagatcctgggtggagggacccatcaccctccgaggctcacacccactgcccacctctcctcctggcgctcgagtcccttgcctcattccttgggctgtctctggcacccatcgtttcggttgcctcctcatcctgaacgtttgcttttcttttctcaagaggaagttcagaagcagaaggaactttccaaagctgaaatccagaaagttctaaaagaaaaagaccaacttaccacagatctgaactccatggagaagtccttctccgacctcttcaagcgttttgagaaacagaaagaggtgatcgagggctaccgcaaggtatgtctccgccaccctggtgtcctcacctcggaggctgatggactcatggtccaagccagcggggctacaagctgctgtctttgcaccttggtccttggccaagcctccccttgccacgggggcatgggatgacctgtgaacgagacagggtgcaggagtcacagcatagctggtttgcgaggcagctgagggcggcaggaggcagagtgagcagggaggccatctgagccgtccgctgttgtgtgacagacgactcggctatgatcaggcatctgtgagatttgagacagcgctggtgcaccggggcctggggcacctcggaaaggtgtctgggctgtccgagcgcttgggtcccaagggttggggacccagggcatgcagtatccaaggcgggaggcccactgaaaggtggtcacggctgtgcaaggccaccctggtgtcctcctggccacgggactctgagcgccccccaccttctgtgctgggcaaggcccaca

SEQ ID NO: 33294 - DNA, 1605 bp, Homo sapiens
cagctacttgtgaggctgaggcaggagaatcgcttgaatccgggaggcggaggttgcagtgagccgagatcatgccacttcactccagcctgagtgacagagtgagtctccgtctaaaaaaaaaaaacagaaactagaaaagaaccaaatggaaatttctaacaggtacacagttaacaacattaacaattcaaagggtacaggtcagatgagggaagcagaggctgagttgggaaccagtgtgtggacggcagcccccagagccagagggagagacgccgctgtggcgggaggcttgacctgtgcacacgtgagagcttccggatgccgcctcccggacagacgctgttgggaattttccacagcagagaaacacagtgctgtgggtttaagggaggcgtgacctccgcaggacatcaggggctgcatgctgggtaggggctcagggagaggctgcagtgctgagggtgcttctgggatacagggctgcgacagaggagtgaggatggctgggctgtgaggccgctgggggcactgcaggaagaaggcaggtaggctgagccttcccaagcagaggccactcggggacccaggaacccctcagttagggcttctcagtcactgagcggaaggtgcccccagagggggcagcagcctgtgaggagcaggcgtgtctgggtaaccatgtggctcctgctggcctcccctgcctgtccccaaagcacagggctcagctccagagggagacgggctgggctgtcagtggtcccaggtgcatcccactttccagcagcacttggtgccagcagaggctgcaggtgtggcaggagggggcccagccgtgagggcaccaggttcaggcccggcatctcagggtggagagccagggctgtcctgaacctccagagggggtgagctgggaacttgtgtgaaggggctttttccaaaaggaaaacgggagctactggctcacggctgatgccccagacagcctcgaggatctgcaggtccccagacaccaagcctgggtgctctccagcagacggcgtggtacccacagctaatgcctgccccttcctagaacgaagagtcactgaagaagtgcgtggaggattacctggcaaggatcacccaggagggccagaggtaccaagccctgaaggcccacgcggaggagaagctgcagctgtgagtgctgggcgaggccccaccctggagggagaatctgagcacctgggccccagctcagcctctgccccgcccctacccctccagggcaaacgaggagatcgcccaggtccggagcaaggcccaggcggaagcgttggccctccaggccagcctgaggaaggagcagatgcgcatccagtcgctggagaagacagtggagcagaaggtgggtgcgggaagcccagctcaaggggccgtctggcagcaccttctagaaggcccttgggcctgctgctccctccaagcagggagaagccccgcaactcatcttcctcctccagactaaagagaacgaggagctgaccaggatctgcgacgacctcatctccaagatggagaagatctgacctccacggagccgctgtccccgccccc

SEQ ID NO: 33295 - DNA, 1034 bp, Homo sapiens
ggctctggggagctgggcagctactggggagggacccaggggccacctgcacatctgcccctgtgggtgggcccccaccccagcttctcagcccccagggaggggccagggctgctgacctgccctggctctcacagcttcctgcccccagcctggtcgtcctctgtgagggggccccagtccccctgcaggcagcaggactccaccccccggcccccttgagggcccgcctgggcctccccactccccggcctgtgagacccacttggccggacccagcgccgtgtttgtactttgctcttctcggtatgttttccgtcatgaccgccgtgtggagcttccataggagctgcaggatacagaaccttgcccaccccaaggagcccccacccccgccccggccccctcgcgctgctccggcctgtgctctgaccggtgaacccgcgcatcgccccccagaccgtccacacggccacgtgaccctgcacctccttccttctcgcctgttctgttccctggctgtccatctgaactgcttttcaggctcatatggggtgcgggggctactgaggacggacccctcctggggtgaatctgcaccacgagggggctggctggccaaccctggcaccccctctgagctccatttcagtcagaggccagcaaagggcagcctgtcccctttgcccgcagcacctgcccgtcgtggtgccgcctgtgagacaagcatggattttatgtttccaagcaattgaacaaattaaaagaacgaagagtcacattttgtgacactttgagatttgaattctccgtgtccatgagtgaagcatcatggggccactgctgtggggttggctgcaggttgtgtggggaaggcggctgtcacaccgaggcagaccggagtccttgggacagactggttggcaaagctgaagatagagacctttggcccttttgggacacagtttccagcccctggtctggtgggaccctggatctgggtcagagccttcctcactcagggccgccgaggc

SEQ ID NO: 33296 - DNA, 1028 bp, Homo sapiens
gtctggtcccctcaggatacaggaggggctgggtcactgacatggctctagatgccccaccctggtggcagggctggggtgcaaggggacaccgtgttgctgatggggagactgaggcacagggccctgggggttccaggagcaggaggaggccagggctggcctgtggggctctggtgttggctataggtgaggtggaccccgcagacattagcgcagcagggcagggcactcaggtggctgccgtggggtggatggacccggggtgagggcgccggggcacctgccacaaccagtggcgggcagggtggctggcaggagggtggctggtgggtgggctgcggctgtgagagagcagtcggggacgatgcctggcgtcccggcctggaacggtggcaggtggactttgccaagttgtagggtggggaggtggggcttctggttttggagggagctctgaggggagtgcgtgcaggtgagggtcatcgtggcacagacatggggggcagttacgacttgcggactgatggtgtgtgcgctgggtccctgggccagtggggtaagcaggtgaggaagggaggctgagtccatgagagaaacagctgggggaactcaccctgggggtctccaggaggcctgggagggagctcagcaccgtggggtgcctctttccagcctgtgtccacactgctgcttgctgggcctcagtgcccctgatgggcgtgtgcctggagggggctggcagtgagctcactgaggggagggctgcttccctcctggggaatgccagcccatccttgcctggagtcccggcaggaaggcagcaccagccctgaggaaggagaaaaaccagttgggctgtgagaggggtggtgggagccctggacatcgagatgggaggaggcagggcctccagggtgccaccgtctctgggtgcccgccagacttggagctctgcagagggtggtgtagggtcttgatttccgtgggcccatgctgcccagctgcctccaaggctcctggctctg

SEQ ID NO: 33297 - DNA, 1024 bp, Homo sapiens
atatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctggccctgtgctttctgtctccagttctgggataggggaggg

SEQ ID NO: 33298 - DNA, 2095 bp, Homo sapiens
ttatattcactctattttgtgtatttcaaatatcaacgtggaaaataacttaggagccatcccatttatgaacttgggacttaaactttttaattttcccaaaatgttttaagtgccctagttacgtatttaaatgtgatgagaacaacaatattttaaagagcagaacgccaacaacataaagcaaacaagttctgtgagcacagcctttccttgtgtacttgatgtgtgctctcattccccacaactgatggtggttcaaatctaaactgccaaatggagatgaagaggactcatgctttaagcacgattactttgagtcatttccttttctttccttccattttctcagccacccaaacccagcaaccttcagttttgggctgatggttggtagagtgaggacttactgcacaattttgagtttgtgtaagcttttgtgaagagctctgatctcagtacaaaaattgtcctctcctgactgcattaataccagagtctggcctctgattataacagtaaagattttattttaagagtatgaggtaattaactgagaatttgaaagaatgatggacaatttatcgtatctattcgtatgtaacatataaactaatataacttttggagccatgcacaacaaaattataaggtcagcaggctgcaggtgcgacttgctttgtttctatgcaatcagcttatccagggctttcaaaccagtacttgctgaagtgtgcggacccaaatgaagcattaagcagagtcctagaatgagtcaggaagataatctgaataggtagaagacaacccactcctcctaatcctgtggggcttacatgggtacagccttctgcctattcagattatcttctccttctaaaagtaatcaaatcttacaaagtttactcacatggcagaatgtgaactttttttgtttgaagattcagtgtaaaacatgcaaaagtagctggaattaggcttactaagctacaggattctctttaccaagcaagaacttaaaagaagtgctaagatggtgctgaagttcataatccaaacgtattttgtcctgtgctatttatttatttttagagacagggtctctctatgtggcccaggcttgagtgcagtggctatttcagaggagagcaatcatggtgcacttcagtcccaaactcttgggctcaagtgattctcccgcctcagcctcctgagtagtggttactacaggcacactcagccttcctggctctgccctgtcctttttagctgggcaagtgggcaaataacctttctaagtaaataattaatcagcagcaacagaagccataaggctttttactcatatattctgatctacgtgtttggttttgcctttttgtttttgttttgttttttggtgggctgctcatggccatagaatgcatacaactttggataagcattttagtcttctgagcctcagtctcttgttttgcttgattgtagtaagtgtgaccttgttctccaaatacgtggtaccatgtcctgactccaggcctttgtgtgggctgttcttgggtgtggactacctgccacctgtccttcctctttgagcataattcatggctttttaatggccacttgtgacctttctcccctgttgggttaactcttagaggtaggactctgtcattgccttgggcagcattgcctctgctggtgcattctcatggcatacactcagtaagtgccgaataaatgggtatatggcttagggtaaacaaacagcccattttaatgccgatatctggcctgtttgcctctctgttttgtaagtaatggagcatctgggagaagaagctgagtctagaaaggaaatggcttggctaaggtcactctgaaacattgcaagtatataagtccaacaagtagtagaacagatctgtactaccaccaagatggagcaagaaatctacctcgtcaatttctctatccttggtgaagataaaaaaatataaagtacacagaatacgaaagaggagatgacatgggggctttagaggattaggcttgtatttgtaaactgtatgatttgctaattcctttttaatga

SEQ ID NO: 33299 - DNA, 1026 bp, Homo sapiens
atggtgaaaccctgtctctactaaaaatataaaaaataagctgggcatggttgcagtgcctgtagtcccagctactcgggaggctgaggcaggagaatggtgtgaacctgggaggcggagcttgcagtgagctgagatcgcgccactgccctccaccctggttgacagagcaagacccctgtctcaaaaaaaaaaaaccaagacagatttcaaattagttttgttttagtatctgctttcctaaaaccacctggccccagatgagttttcaaagcattttactttctgtaatacttagtggtttcaacaaaatatacaaggatagaaattgcagtgttggttagctgagtgatggcctcagctcaaaaactccagtagtggataggcacagttgctcatgcctgtaattgcagcactttgggaggctgaggtgggaggatcacttgagactaggagtttgacaccagcttgggcaacatagggagaccccatctctacaaaaatttttgaaaattagctgggcttggtggtgtgtgcctatagtcccagatacttgggtggctgaagtgggaggtcacctgagtccaggactttgaggctgcagtgagctgtgatcataccaccacactccagcctgggagatagcacaaccctctctcaaaaaacaaacctaaacacaaaaccccaatagtgagactaccctagtgggtgtgtagaaaaaatgctttttttttctggaaggaattggaacctcaatttttaagttgacttgagttggcactgagagagttgatgatgtgaattaaatttgttatgccgtttgctggtgcggtgggtggctcacgcctgtaatcccagtgctttgggaggccaaggcaggcagatcacctgaggtcaggagttcgagaccagcctgggaaatgtggtgaaaccccgtctctactaaaaatacaaaaaattagctgggcgtggtggtgggtgcctgtaatcccagctactcgggaggctgaggcaggagacttccct

SEQ ID NO: 33300 - DNA, 1046 bp, Homo sapiens
tcctctgggcctttgtgtggtcaatttttgttcctttcttctgcccatgtgcccccttaccccatgtgtttgggggataggcatgctttccctcttccttccttctgccaggtctcagcttgggccccacactgaatgctgtgcctgactcctgcctgttttgggaggctcttgtcttttccatcgtcacccactcccattctcattctgttccagccacacgggcctcttgcctgctctgaagccctgcagctctgctgcctccgactagtgcccttgttccttctttgacctggaatgctgtccccaggtatctgtgtggcttacccctcaccctccttcaggtctttgtgcttctccctctcgggcaccttctctgaccactgatttaaagtactctgttgtgaccaggtactattacagtttatctgtgatcctggtgctttatgaagccaagacgagaggatcactccagcccaggagtttgaggttgcagggaaccacgattatgccactgcattccagactgggtggcagtaagactctgtcccaaaagaaaaataaaatttaaaaaaagtattatatatatacacacacacttctgagacggagtctaactctgtcacccaggctggagtgcagtggcacaatctaggctcaccacaacctctgcttcctgggttcaagcggttctcctgcctcagcctcccaagtagctgggattacgggtgtgtgccaccatgcccggctgatatatatatatatatatatatatatttttttttttttttttttttttttttttttttgtatttttagtagagactaggccatgttggccaggctggtctcgaactcctgacctcaagtgatctgcctgtcttggcctcccaaagtgttcggattacaggcgtaagccaccatgcctggccaaaaaaactttttttaattattctgttgctatctggcactccacatctgccttagattttctccatagcacatacctccaacattccatgtgaattcctggctgcattgggtca

SEQ ID NO: 33301 - DNA, 1129 bp, Homo sapiens
agccctagatcttgagcatggcatgtggttcctgcctgtctttcctttatgtatctatgtgtatatatgtaaatatatacaacactttttaaaattattttattttattttattttatttttttgagacggagtctcgctctgtcacccaggctggagtgcagtggagtgatctcagctcgctgcaagctccgcctcctgggttcacaccattctcctgcctcagcctcccaagtagctgggactacaggcgcccgccaccatgcccggctaatttttttgtatttttagtagagacggggtttcaccgtgttagccaggatggtctcaatctcctgaccttgtgatccgcccgcctcggcctcccaaaatgctgggattacaggcttgagccaccgcgcctggcctacacacattttttaaaaaatgtgtattttttctttcctctgtgactctggccagtgatcctgcctgtctttctagcatctttgctggccagtcctttgtggttgctgtgagatctcatcatgctgcctgtagctcttgtgatgagccgtgccctgtcccatggatctttgcatgtgctgttgcttcttcctgagttgcctaattttgtgttgctgtggtggttttatggctcacctctcatctctgtgaagcctttccctatttctaccagaaccgggtgttgcagaccctgggcccatggcacttgtgtgtgtgtgtgtgtgtgtgtgtgtgtgtgtgttttctcccaagtttgtcatgcctttgtgagtactgggccctcttatgacagttagcatgttgcacaggctcttgccccattctcttctccaggttgtgaatttttcaaggtgagggccctttgatatgtcttcagtgcctaaatgtggaaagcacttagttaacaagtagagatagtttttgggtattattctgttttcctaatgatttttatttcataaaaatgtgaatttctagatttttggttaaaatatgtgttagaaataggaggcttctgtgttctttcccctccaaaattcggagttggtgtaatctttgtagagccttgctacacaaatctttcagcagcaaagcatcttcttctcattgaatcctcacagcag

SEQ ID NO: 33302 - DNA, 1048 bp, Homo sapiens
gggcgtggtggcgggcgcctgtagtcccagctactcgggaggctgaggcaggagaatggtgtgaacccgggaggtggagcttgcagtgagctgagatcgcgccactgcactccagcttgggcgacagagcaagacctctgtctcaaaaacaacaacaacaacaacaacaaaaaactgggttgagccaagtaacagttttgggcttgttactgtaccataacctagtctccagtggttctcaaagtctggtccccagactggcagcttcagtggcctggatgctagttagaaatgcacattttcatgtctcagacctactgcatcatgaactctggagtggggcccaacaatctgtgttctaatgtgtccttcatgtgattctgatgcccttgagttgagagctactgtctgaatttcctgactgataagtcaggaggctgttggcgtcagtcttggtgaaagagcttggtggttggccattcttgggattgtgggtgtggagaaaagtggacaggcctagctaggaaggcctctggagtaaaattgataagttgtgttgtttgggataaggagagatgaggggaagttctggtgccagtgatagccctaagtttttgtctgacagaaccagatggctagaggtgccatttactgtccagatagcattctttctgtgtgcatttacattaccttccatttcaggttcagaaacaagagaaagcccattaagaaataaaaatttgtggacttccttagctcaagtaacagtttctcaatgaaccccaccttgatacccctccccccatttaaaagtgtaccccctctgcagggctgggcgcagtggctcaggcctgtaatcccagcactttgggaggctgaggcaagcagatcacttgaggccaggagttcaagaccagcctggccaacatggcgaaaccctgtctctactaaaaatacaaaaaatagctgggcgtggtggcgcacacctgtaaccccagctactcaggaggctgaggcacgagaattgcttgaaccagaaggtggaggt

SEQ ID NO: 33303 - DNA, 1034 bp, Homo sapiens
cgcccggccttttttttcttttgtgagacaaggtctcactctgtcacccaggctggagtgcagtggcgtgatcttggctcactgcagtctccacctcacaggctgaagtggtcttcccacctcagcttcccgcgtagctaagaccacaggcacatgccaccacgcccagctaagttttgtatgttttgtagagacaggattttgccatgttgtccaggctgatgtcgagttcttgggctcaagcaatccttctgccttggcctcccatagtactgagattacaggtgtgagccactgtgccccgcctacgtggaattgttttatatgagaacagaggttctaccatcattcagtgatagcagggctgaaatatatttcaggcagactagtgtgatatattagaaaatgagggtattttaggtatgtgtaaatcatatttgcaaacttgggttttccatttcagtcttttccgcccccggaggaatgggttggagcttggtccgtctcacggcctggctctggggaatgtcctgaatatctcactgctgtcctagggttgagacctccttctgctcagttggattcacggaattatcagagtgggctttagctgacatctaagccagtgggcaaggttggagcagtgaggcctactgtgtctgaagtgttaaagctccccagagaaccgggcacggtggctcatgcctgtaatcctagcactttgggaggctgaggcgggcagttcacgaggtgaggagatcgagaccatcctggctaacatggtgaaaccccatctctatcaaaaatacaaaaataaaaattagccgggcgtggtggtcggcacctgtagttccagctactcggcaggctgaggcaggagaatggcgtgaacacgggaggcggagcttgcagtgagccgagatcgcgccattgcactccagcctgggcgacagagggagactccatctcaaaaaaaaaaaaaaacaaaaaaaaacaaacaaaaacgaaaaaacgaaaaacctcaccagaaatgc

SEQ ID NO: 33304 - DNA, 1034 bp, Homo sapiens
tgaaaagaagaagttgtctttccctcatcctcccaagcctctccaactagaactgcattggaatgtaagctccttgaaggtagaggatttttgggggtatacgtaacataaaatttaccattttaactattttaaagcatttagttctatggtcttaagtgcattcacattgttatacaaccatgacactgtctccagaactttttcatcttctcaaactgaaactctgtcccataattccccatcctcctttttcttcccccagtttctggcactcaccattctacttcctgtctctatgtattctattctggggacctcatgtacgtggaattttacagtatttgtcttttttgtgtctgccttatttcacttagcatagtttcttcaagattcgtccatattgaagcagatatcagcatttccttccttttaaagctgaatactactccactgtgcagatagtctacattttggttatctattcatctgttgatgggttacgtctaccttttggctactgtaatagtgctcctgtgaacatggttgtacaaatatcttctggttcctgcttttaattcttttgggtagacagactgtttttcaccctgttttgttcaatgttataatcccaacacctaaaatcagtgtcttgctcatagtaggcactttatatttgaaagaatgaaacattcatgaatgttatgtcttaatttatcttacatggttttcatctctttatcagcccttttccttgctgattctctcagatttatcttctaatctattatatttttagctgtgcctggtctgctatattcaactcaactgagtttttaatttcaataccaatacttttttttttccaagtctgcaaatcatgaaaacagtaatttcctgttctcctgtagaagaccttccatactgtcccatgcctggctcctggaggatctctcactgctggtgggaggctgtgtttacctcaggggcatctctcagtggctctcccggggagaggggggctccccatgagc

SEQ ID NO: 33305 - DNA, 1032 bp, Homo sapiens
gtgagaagtgaccagaagacgagtgtgagccctctgtcacgcccagacagggccactagagggctccttggactagcggtaacgccagtgcctgggaaggcacctgttacttagccgaccttggtctagcggtagcgccagtgcctgagaaggcacccgttactttgcaaaccaggaaagggagtctccctttccgtgggggagttagagaagactctgctccaccacctcttgtggaaggcctgacatcagtcaagcccacccgcagccatccagaggcctaaccgtctccctgtgatgctgtgcttcagcggtcacgctcctggtccactttcatgttccgccctgtacatctggctccgccttctagatagcaatagcagaattggtgagaatattaaagtctttgatctctctgagaaatgcatagaagaaataatgtaagctgtcccctctctctctctgcctcggctaccaaacagggaagggccccctgtctggtggacacatgactcgcttgaccttacctatcattggagatgactcacactccttaccctgcccccttgccttgtatacaataaataacagcgcagccagacattcagggccactaccagtctccgcatcttggtggtagtggtgtcccctgtgcccagctgtcttttcttcaatctctttgtcttgtgtctttatttctaccatctctcgtctccacacacgaggagaaaaacccacaggccctgtagggctgatccctacagttctatgctgtgttctttcttggttaagttttcttttttcctggaggctatttttggtatcttaagacagtttgtatgggaagtaaatttgagtccttgcagttcagagtatgctacttttgtttttgtgaggtggagtcttgctttgtcgcccaggctagagttcagtggcgggatctcagcttgctgcaacctctgccacttgggttcaagtgattctcgtgcctcagcctcccgagtagctgggactacaggtgtgtgccaccgt

SEQ ID NO: 33306 - DNA, 1061 bp, Homo sapiens
tatctcaggagatagcacatgataaaaagaagtaatggtgtcttgtctcttcagatttgggttttataaacctgagccaaaccacatatgacacccaatgtgcactgagcacttctgacatgctaggcactgtcccaagtgcattctcctgtcgccttgtccatgatcctctggattccacctcaccgcatcctgtctcactggctctggttccaggcaggtgggtgagatggagtatgagtgcaggagtggcaagtcattccctgggcagcgctgctctagtgctatggggacaggacagttttcagccacacctttcagaatctcagcccttgagaaaagcttcatgatcccttctcccatttcttgcttttctcagttgtgacatgttttactgatgatctttgttcattaggtgtatctggtgtttgtctaaaaattggaaatcctcagtatagtgatactagtaatgttggtcctgacttagcagggctgagtctaacttgattgggcacctcttgaatggaaggatccatttttctcatgttcatcctctgctttgggttcagtggagagtctaggtgcatgttcaataagactcgtatcaggtgtcttaaccacatgactgcagcgggtcttggcgtggccccacccacctcgccctcctgacagatgcgagagcgggaggtgcgaagaaagaatcagtccagattgtgaaaaaagtctgagattgggcaaccatggatgacttatgtgtggaacacatttccaaaggaagaagtttctgccacgaaacttttcagcaacctgtgttcattcacatgaggagattttttttcctttcttttccttttgttgttctttttctttttttttcctttttttcttttcttttttttttctttctttttttttttttttttttttttttaaataatagagagacacaatcactgacaaaacggccagaacaagctcttacaaggccatggaggcagcctcctcgctcaagagccaggcaggtaatgtggtcagcgccctttccttcttggcttctgggt

SEQ ID NO: 33307 - DNA, 1049 bp, Homo sapiens
gaggagtgtaggccttccagtgcaggaaggtcagggacctaggcaacctgggcggggctcatagagctctgcggcttgccactctgaatcctcagcgaccactcctccgagtgggattttctgcagggactcaaaccaactcagtggtggtcgagacctgttcacggatggtgggactggggctgctttacagtttgatacgtgtagataattaagcattttgtgatgtttggacacactggagaaaaggcagtaagaattatttactgaaacatctaggagcttactgaaatatgaaaaggcaaattttatacaaattatttttcctttttcctttctttcttgtccaagttcaggttaaaatcttagaaaattaaatgaaaggtcatttacagttccaaagaagaatattaaacatttttcacttaagttgagatttttgctttaaagagcttttaatgagtttttctgttatcataattttggtccggttattcacttgagttgttgcttatactgttgtcaggtacagtagagagaacatggagcctgctgagatcttctctgttattcctgatcctaagtcatgtatatcgaaggctttgatttagagtaatgcatgaggccagtgtagcggggtcgaggcctgcccatgagtcaggggagctcagtctccctggcctaggcagttgtcctgaccttgagaagacatagatgaagcattttatcatcattagacttaaattttaattcttcagaatgtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacagtaaatgtt

SEQ ID NO: 33308 - DNA, 1248 bp, Homo sapiens
atccaaggccccggaccaaggggatactgtaatcaggttatgtacaccaacctctgcatcagttgcttctatagagcatcagccctcatgtttcattgtcttaatgtcggggagcagcctggtgtcctgccccaggtgtccgcatttttgcatggtaaggaaaaggcttacttgcccttcagctcataaaagcagaaggtgtgctattcacagtaccatgcgagtagcccacagttaattcccggcagattctttggctgtgttttatctttaatgaacgtttctgactaatattttgttgtaaaccattaagtaatgtaacgcatgtaagatgcttagggtgcctggccaggactccgtggtttcctgttgtgacagtaataatggttataataataaaaatgataaaattgccatcattctatttttatccaaaagtataaattttgctttggcatgaaaagtggtcctcttgactgcattatgcatgcgaggatgaaataaacctagaagtggcagaacactggatttgtgtgtgtggcgctttagggtgctggactgtatggctgagggctggttgggttcctctattggctctgctcaaatgttgcaggatacatagccccaaagatggtctaggagcaatctaagctgtgttactccaaaggacatgaaaaagctcaagagtaaaattaaaattctcaaaaaaaaaccccacgaaatttaaagatggggaaaaaaagatggtataaaaatggctctggttcaataagcagtcacccaaagtaaagactctatcttgaaaggcttttggtgaaaatgaagggatttcatttgaaattacagcatgatgaattttgcatgggtggccagccagctagcccataactgatagatgcattagaagtcagccagcgcataggtgctccctctatattatggagaaagcaaaaccctgcaaatgaccaaatggtgtccaaagagcagcatgacattggcatcagctgaataaccaggggcacatgggggaacgtggatgggaatgatagtgtatctcagcggggggtggggtgacatcgttccctggggacattgggaaggtgggcaggggcaagtgaactcagcactctgcagtgagagggacagtcccatgtgtggcagcattgtcccacttcagatgccaggagtgggctcatcctagaggagcggagttttccgagaggaccatctcctggtttcctgaaggag

SEQ ID NO: 33309 - DNA, 1047 bp, Homo sapiens
tataaaagcttagattgtagctgttctaaaaacgtaagtactccattgtaatagggtggcatcttcaggtagtgcacatattggcaatagaggtcctgaattgtttttctaagactgatctgagagccattgggccatcaagcctttatatatctgcttctaaaattgccccacctgctctagatggatctttgggcctttcctcagtgttcatgcaaaaattaaatgtcttttttcagcatactgactccaggtgtagttacatctcagtgctgtcttgagtatatattttatctcttatacctgtatctcccaactagaaacagctccagtgtttttaagagaatgtttcttaaaaccaataggaaacttaagcgaggtttcatgacacaacctttcatgtcgtgaaaggcagagggtgactgtgtgtgatgtgcagagtccttggacaggagtcgggggctcctctgtcccactgctgcttcttgagtgggtggagtggtgcttagaggatctccgagaggtccccgcagctctagggagatctgattttgtgttttttgtttaagtacttcacacagaagcctaggtagatttaaaatggggtgctcagggactggggaacaagacggggtggggtggggagatgggcatttggagagtctcatgtagctggagacgttaagagctgagcacaccacaggaaaggagggaggatgctgtgtgagagccatgctgtcaggagcaagcttgctgctcctgtgctgccctggccctggccttgcttgcccatggtgtgtgtgtccagaggtgtgtgtgaggctgccagaacaagtgctgggtctgtcacagagaagtttaaaaaagaaaactaagattataaattagcatctagttccaaaaccaaaaaaagtgcctgtggatgtatataaaattaagatgataagaaagtgctcctgagaaggctcttgccagaagcctgatgtgagtgtgtggcacctgtgatggcagggctgtgagctgggcttctgtcctcctctgtgtccc

SEQ ID NO: 33310 - DNA, 1035 bp, Homo sapiens
cctgaaggaatgtatttctaaggcaaataggcaacttggtactatcttattctgagtagagagtggagaaagtattttcagactgaagaaaactttgaaaagtcaggagctaagctgctcggagctcagtgccgcagcatggctgtggtggacgcgggaaacaacgggaaagttcttgacagagtctgtgtccgctcagtccctgcacttttcctttccaaatgcatctcgttggatatggaatagatcgtagatgttgtagactgagatttgggactatgttgggaccgtacaggtgaatgtgccacctccacaaatggcttctccgagtgagtcacgtcacctggtgcgtggaggtggagcctgcggctggagtaaggcttgctgtgggacgccctcgtactttgctctccttgcgggtggttgccgagccgagagcattggatcctccccgactgtggctagttgtctgtccggtggctgggagggggtgtggtgggaaaaagtcggaatctctgcaatctgtgtcatggactgtactattgtaaggtctatattctgtatgtgggtcccagaccctgatcaggaaatgagcctcatgtgtgtcgttaacatttatatatttccattcaaaatatgtattcagtgtttatttcctcaaaacagactttgttaatgtaggaaatctctccaagtggaaacgtgctaactttttctgtaaatctgaaataaaaggtgctgttccttcctctgacccaggactgctttgtgttttctgtctttctctccatgcattttttttctcatttttaaagctttttaagtttgttccaccacgttaagggaagagcatgggttggtggatagcgctggggctctctcccctgagccatgcagaaggcccctttctctgggccttggttcccccatcagatgggtcagcttgggcgactgtgtgggtgactctctgagtggggccccagacagtgtggccactgcttccccatgccctgtgctcccctggctccccctcca

SEQ ID NO: 33311 - DNA, 1034 bp, Homo sapiens
catgccaggcagtcgatgcatgggaagtgtgaatactgcctgccgtcagcgtggcacctgccatctggattagggtgcctttgatttctgttgattttcaaatctgatttgaaatatcttggatgtatccttcagggttgtgatcctgttacttcctttgccattgctgaggactggcctctttctgtaacagtcatctggttttaatctgattctgtatttgtacgttctgtttgggccagacgtttgcccatgcatgttattatatatccttgagtagcaaaatgggattttctgccactggagacagaagcagacggcttcccttgtggtaagaggtgcagaagggactgccgggcgctgcttacccgcctgctctgcccccgcagctgtgtgagaagccgggcagcctcctgctctgtgaaggaccctgctgcggagctttccacctcgcctgccttgggctttcccggaggccagaagggaggttcacctgcagcgagtgtgcctcaggcaagttcccacgggcgggcagctctgcagcctggccggccacctgctcctgcaaccccctgcaccaagtcctgccctgagctgcctgcagaggacaagccccctccccacccccaccgcctggccctctctggagcttgtagcccacagctggcaggtgtacccacctctcagtagctgcagggtttgctctgatttcagtcgtatgtgcccccttggtacctttccatcaggtggcgggcagggtggcgggatgacaggtcatgggcttttcatcccgtgggctggcctgagcctgtgctatgtgtgaggcggccaccacagggcactgccgctcagacagtgcagcattaagggtacaggtaacctggttggtcaccgaacactgaagtccataggaacatggagttctttatgaagacacagtgtcaccttgagcctcagtttcaacagaaagaacagctccaggcttgtcctgggttgtcagtgctgttgttctgcctccatgttactgcatcagg

SEQ ID NO: 33312 - DNA, 1074 bp, Homo sapiens
ggtaatccttgatggctggatctttttgctggagaatgcttggactagtgagcaaggttggaaacagggccaggtgctttagcagcatggctgcctctgaagaggagttgcttgattttagtggctcagaactgcaatttaattcttgttctttgcacctctctctccaccccttctttaactttttgttagggattcactcatgtttcgtgtgtaaagagagcaagacagatgttaagcgctgtgtggtaactcagtgtggaaaattttaccatgaggcttgtgtgaaaaaataccctctgactgtatttgagagccgaggtttccgctgccccctccacagctgtgtgagctgccatgcttccaacccttcaaacccaaggccgtcaaaaggtacaggtgcacctgcgcagccttgctgtgggttcagatgcaggccagacgcaggcccatgggcgcttgggaaggtgggctgttgggattgtcaccaaagagcattaattatcttgagtgactaactggacatcggctgggttgggttttctttgacaaaggacctgtctcccttttccttctttccatcctaaatatcaccctaaagatgcttaactataggagaggggcaacctttggaccatttgatagattttgtttaccctggcttttttttttttctttatagagatagagtcttgctctgttacccaggctggagtgcagtgcagtcacagctcactgcatccttgacctcctgggctcaagctgtcctctcgggctcaagctgtcctcctgcctcagcctcctgagtagctggaactacaggcacatgccaccacacctggctgatttttgtaaatttttttttttttggagaaaaaaaatctccctctgttgcccaggctggagtgcagtggcacgatctcagctcactgcaacctctgcctcccaggttcaagcgatcctcctgcctcatcccttcagtagctgggattacaggcacgtgccaccatacctacctaatttttgtatttttagtagagacggggtttcatcatgttggtcaggctggtcttg

SEQ ID NO: 33313 - DNA, 1034 bp, Homo sapiens
attattagttgctcttttcactatgactggagtcagtgtttggggtccttagggtgtgtttctttgccttcaggtaaaatgatgcggtgtgtccgctgccccgttgcctatcacagcggggatgcttgtctggcagcaggatgctcagtgatcgcctccaacagcatcatctgcactgcccacttcactgctcggaaggggaagcgacaccacgcccacgtcaacgtgagctggtgcttcgtgtgctccaaaggtgaggggcctgggggtgtctgcggcacacgcctctcacactcccaggagccacatatcaaggcaggctcattccttgtctgcgctgtgttcattgatgttgacagtgttctgtgcgtcttcacgttaatagtatatcacagtagctctaaattaattgtaatcatttcgcaaacatacaggaaattatttgtggtgaaaatgacatttgctctcgtgctgatgtacagatcgctgttttaaaactgatgtttataagttaaggctgtaataagtgtagactgtgaagcactgaatctgggctgagccatagcagacaggctaagcctggccgcctcgccctcctcttgcaggggggagccttctgtgctgtgagtcctgcccagcggccttccaccctgactgcctgaacatcgagatgcctgacggcagctggttctgcaatgactgcagggctgggaagaagctgcacttccaggatatcatttgggtgaaacttgggaactacaggtgtgagacatagaatcgtatgcttttatgtcttttctgttcacatgtgttcgctttacagtacttaaagtattgaaattattatcgctgtctctgaggagtctgtgaatcctgtttttaatatttataatagatggtggccggcagaagtttgccatcccaaaaatgttcccccaaatattcagaaaatgaagcacgagattggagaattccctgtgtttttctttgggtctaaagattattactggacgcatcaggcgcgagtgttcccg

SEQ ID NO: 33314 - DNA, 1089 bp, Homo sapiens
aattgggccaggttcaagtggagcatctgtacttgcaaaccaaattggcagcatattaaaagaattacacaccagggaaaataaccctagaccttgcattctagtgctctgcttatctgtgacttcagacaaagatggagagagctgaccatcagtataatttagctgaatgaaataatgagatattttaggaagaagaacattgaatgtcagaagttaaatgtgagatccaagaagtaacagtgaacagacaagtttgtgggtatgtggatatgtcttaaataagtcaggttgtgtcaaattatgatggatgatgatgactgcgaggcaggaaggaagatgaaaaggaggaggcattgaacactaatggtcacagggagcaccgggagcgtggtgacgccagggtgagctgcttgttctgtgagggtggagggaagagatttattaaccttagactttgttaaagtatacatgtgacgtctacatgggaaactgctaaatgaatagaagtggaaggtgtaacttccacaccattaaagggtaaaaaggagaatgaagaaaagtcaatttagtagaacctgcgggaggaagatgggggaaggagaaataatagtaattagaaagcacagattaaaaaaaaatcaaaatgtcaataatcacaatatatgtaagtggtttaaatgtataagttaagactaagattcacattagggtcagtacatagtaacaacaaggaaaggctcccacaggccttaatgtttgtagttattggggtggaggagacacaggagacagcatggagaggaagaactagattagatgcacgtccgacagttggaaagatcctaaaggtagtgttcaaagaaaaaactaagagaatgtgattcacagccaaacaaatctatacataggattctggtagcagatggcagctgctcacttccagaacaaaaaatgtacacaaagtacatcttcactgaaactgtgggacaaacagacccatccactgaaagtccaacaggcagaggaaagtactggagacctgcagtgtcacccggacacagggggtgcagagacacgggagtgcgg

SEQ ID NO: 33315 - DNA, 1084 bp, Homo sapiens
aatctcttcttacgagcccacaatagtgccgtgtacttttcagaggcacatgtactgaggcgtgaggtccgagccagggcgtggacctgtatgtgaacatgggaggaggggacctgggacctgtgagggtgtgtgccagccggtggggtgcacctgaaaagcatggagagcagttccttgtgaccgagtggggtttaccccaggactgcaaggagggcttaacaaccctatcaggtaaaggaggaaaacaaatccagagtcattttcatgaacaccagaaaatcatttgagaaaattcaaacctattcctgatgaaaacttcccaagaaaccaggactacaagtatgcttagcttgctaaaagacatcagcggctgccagctgatgctcagtgagccagacacttgtggccggttcagaaataaggcaggacgctcacgccgctcctgtacccccaaggctgcgggtgctgggtgatgcaggcagggcagaaacagcagagcagcaagaggcaaacagtgtctctcggagaatgtgacggctgtgtttggtgatggccttatgtgaactgtagtgacaacagtgagaggccaggtccacaggttttcccctgccctcctcatgtatgcagagccacaaagagcattgatgcgtgtattgaatggagcaggcttctgtggaaagttcggcagtgtcactgacggacacaagagatgatatggatgagtggcggtacaggctatgtctcagctgggaaaggagaggctgtgagggtggaaatcttccccagtgcaagctcgttgtaggtgcgataaaaatagcaaaaacgtttaaatatacctggacaggcaatttcaaagtccatgtagaaggaaagatctgcaggtctagccagtgctttatcttgaagccttactgtgggaagggtgggcgtgtcctgggggtgacagtgttccccatggcattcctgtgactccagcggggcccaaacccaggcggatggccagggggagtggggccaaagccagggccgggcagcccacgtaccacgcactgatgcctcccctcacaccacttataaaggc

SEQ ID NO: 33316 - DNA, 1802 bp, Homo sapiens
acatcagcaccgcggctcagcgcgtcatgacaaagcatctgcagagggcagatgagcacccccacttctgtgttgaagagtggcactctgggttgattagtgcattttattattgtgaaaagcatcttgcagagaaccacattctggtaccatttctggttttaaagggtggcctgtgtgggtatgtagaaaggacacggggccagcggtcccagacaggggcaccctgggagattgcaccagggctgggtgcgtgggcagttgtgtcagaggccgcgtgtgaatagtgactccgaagcctgccgcttcctgggaccatgtttatcccagtgtttatccctgttcacacacgtggttttgtttgaacacgtgactgttacgctttatgtggccttttgatttctccccacgcggttgtgcggtggatctggcggctcctcaggtggaggccggggccgtccattccctgctgctgggtggagatgttgtctccagttcctgcctttggcctccaggcacctggatttgagtgggtcagttctaggccacatcgtgcttgcatttgtgattcccgtggcccttatcaggttgctgcctcgaaagccttcctgccggccctgcagccacccctcatctcagccaacgccacatcagcgccatgggtgcaaagtcagagctcactgtcactcggatctgcatttctccacctctgcctggatttgctctttgggaattgtttctttgcatcctttgctggttttcggttgggtgagtcttttttttttttgagacggagttttgcttttgttgcccaggctggagtgcagtggcgcgatctccactctctgtaacctccgcctcccgggttcaagtgattctcctgcctcagcctcccgagtagctgagattacaggcagccaccaccacgcccagctaattttttttgtatttttagtagagatgggggttcaccatgttggctagtctggtctcaaattcctgacctcaggtgatctgcctgcttcagcctcccaaagtgctgggattacaggcgtgagccactgcgcccagccagggtgagtcttgttcttgtccttgagtgccacttggctaggctgttgctgctgaccttagctcccttgtttgccatcatggaggatgctgggagctccagctccctgtcctgtcctccccggcgctcactaaggctcggtcctctccacgtggtcctgacctgtcctctgtgagcaagagaaacaggactggtttgggggtgtcctgtctcagtggacacaggacaccacggttttcagtacaacaaggaacacaacttgttcaatgtgctttatgatggtgaaaattccctttaaaaataacatgcgattgctaacacttgaccgaatatatcacttgaccttacaggaccgtataatagacgctggccccaaaggaaactactctcgatttatgaatcacagctgccagcccaactgtgagaccctcaagtggacagtgaatggggacactcgtgtgggcctgtttgccgtctgtgacattcctgcaggtacaagctctggggaccctgcatggggctcctggctatgggggcagagtggccatcgctgagggctgcgtggggctggactggaaaggctctgggggaggtgggtgctgatgtggagtctcttttggtttgaatatctcttttaccaagcaaaattgaaaggccatgggtcaagccagtacagatacaaaaataataagagtatttttgttgacctaatacacgccccttagctttt

SEQ ID NO: 33317 - DNA, 1034 bp, Homo sapiens
gtggttgtgtgcagaaccctgccgcccctgaggtgagcagaggcactggtgtgcctgccaggctggggcggagctgcccggaacccttgccaggccaatgtgtagcttggtggcgcccttgaaggccactggggggtaggtgtgtcctcccccggggctggaggccgggtgcctggtgggtgggcctgacctggcccacctcatccctccagcctgggatctcactgctctgcacatgtgcactgacgtgaattttatacgtttgtagaaactctgatgtaacttcttctacctctgaagcgccctcctgggccctgctgtcacgtggctggtgcggcttccccgagtgctggccccctgcccgctccccatgggcacccaccactcaaactctgcgtggtgaggcccggggaaagccaggccgggccctagcactgctcaggggcctggggctcctgggatttctgtgtgtttggaagcctctgtttttggagtggggggcgtggaaggcgggaggggctgacagtgcctggggccagagctgggcgaaggaggacatcctcactggacgagcactgcaggcctgacgagaggctccgggcagctgagggctgaagcgcctcgggatgccccacactgcccagagccacgggtcttgctgtgctgggggtggggtggccccaggcagctgccactgcccaggtgtgagtcgctgcagacctggtccctgagggtgggaggcctgcttgtgctgaagctgccatgtggtctggcccccagaagggctcctgagcgtagggagttgagccccgcagccgtggcggcatctcctcctccttcctccgccccatgcccagccttgcttccggctggtggcatgccttggggccgggcagcaggtgagaagctgcccccggagggaggggccaagggctgggtcagtctggcctgaggggtggatggctggccctgggggaaggctgggcctgggaggccctgtggacagcaggcctgaggccacgaggtcctggggc

SEQ ID NO: 33318 - DNA, 1027 bp, Homo sapiens
gaaggtggttgccccgccgggcagggggctgtgtgggccctcgtggggccaccttcctgtcagtgcccgagggacggtgggacagttgcccctgcgccaagggagcccactgccatcccccgtgggctggcgctgcagtcgcgcaccctgtgttgcctgctgacttgcttatgtctgtttggaagctgcttctgtttggccacaggcctgtgttcctgggctgatggccacagagctgacacttggggtttgagttccagacttgcagaccctgggatccgcttactcctccgcgccacggctgctgtgcttccagaggtggcgtgatgcctcccggggccatggtggggtgaaggatggcgagccggacataccattgttggatgtattttttttaaaacagcaataattagccattttaaaggagggatgtacctgtgtgtgtgcatgtgcacgtgtttgagcgtgtgtgtgtgtgcaagtgggttcttggatatgtgtagtgtgagcatgtgtgcatgtgtgagcctgtgcacgtgcatgttgtaggtgcataagcatgtacacgcgtgagcatgcatgtgtgtgtacacgtgtataggtgtacatgtgcatgagttgtgtacatgcgtgagcacgtgtatagatgtacgtgtgtgtgcgcatgtgtgcgtgtacatgtgtttgtgtcttgggtatgcataagcatgcacgtgtgtatgaatgtgcgtgtgtatgcatgagcacgtatgcatgtgtgatgcgcatgttcttgtgtacttctctgagggggcacatatgtatgagtgtatgagtgcatacatatgcatatggtgtacgtgtgtgtactttgtgtgtgggcatgtatgcgtatgagtacttgtgtgtggctggtgtatgggtgagcatgcacatgtgtatggatgcatatgtgagctgtacatgtagagtgtacatgtgtgttgcatgagcatgcatgcgtgcgagtgcctgtgtgtgtacttgcatatatgtggctgtgcaggta

SEQ ID NO: 33319 - DNA, 1059 bp, Homo sapiens
ctagattcccacagaaaggtattaggatacaagatctatatacaaaagtcaatagtatttccatataggagcaccaaacaatcaaaaattgacatttagggccaggcacggtgactcatgcccgtaatcccagaactttgggaggccagggcaggtggatcacttgagttcaggagtttgagaccagcctggccaacatggtgaaaccccgtctctactaaaaatacaaaaattagcagggcatggtggcgcatgcctgtaatcccagctactcaggaggctaaggcaggagaatcgcttgaacctgggaggtggaggttgcagtgagccgagatcgtatgactgcactccagcctgggcgagagagtgagaccccacagggtgagggctcagtcccacaagacggcgccccttcagatgctgatcccaagtccaggcatggtctgtgcttctgtccagctggctgtaaactggggctcccatggcccccttctggggttggattaatttgtagagtggctcgcagaactcagggaaacacttcgtttatggttctggcttatttttaaaaattgacatgtaatagcaataccacttataatgtcataaaaagacatgaaatacaattatccctcagtacacgcaggggacaggttccaggacccccagcgtatatcatatctgcacatactcaagtcccacggctggaccagcggaacttgcacagccctccatatatgtgggttttgtgtcctgagaatactgtattttagatccaagttaggttgaaacaatgcatgtataaatggacctgtgcagttcaaaccatgttgttcaatgtccagctgtgctgggcgtaaggtgggccctgtgagatgccctcagggagctgggaggaacaccggggagcacacctggatctgcggggaggagaagctgagagcctcccctgggggtgctcagcacagacatggagcaggatgaggccgccatgtcggggggtggacaggaagaggccaaggactgggcgtgggacccacatggaggaggctgggggag

SEQ ID NO: 33320 - DNA, 1033 bp, Homo sapiens
cgcggccatggggcttagttcctagcctaggaagggaaactgagactctgggaggggcaggaacgcccccaaggtcacttggaaagtcgggcaggatgtgctgttagggggaagacccgggcagggtttttgttccccgctgacgacgcctcctttgtgtgttcgcgccgccgccccgccatcgtggggcctgcgagtttgccggggtgcgtgggccgcgtggcggggccttttgtaggtcgggaggatctgagtacgggtgcgggcctgaccgtgggggcgccgaggtcgcagtctaaaacttagtagggcctcgatttccgggcgcgcttccgggccccggctggtggttggtggaacgtgcgactgtgaggcttgcggcccagccctgcaccgctcgggcccttcaccgctctggcgcgcctatagacaggtgtatgaagattctcacgacccgaaacagagttgctagtaaacaccgcttttccgcctttgatccatcgagggaagagggaaaaggatagagcttgggcaagccgttttggtagggatttcagcttttgtctttcacttgtcagttcccatagacgttcacaaacttaataatcttcgttctgtttctgcaccaagttcttgagccagacgtagggtctcagctctggagcctggcttagactgtccaactgactggggagactgaggtccagaaaagtgaagtggtctgcccaaggtcacatagccagctatttggcagcagatgaggttaagtcctacctgcaagatttgggttttgaattcattgaccaggagttttgggaccactgtcaataaaagagacattgaagggaatcttttgttactttcttggtgatttgctttttaatggacaaggacatattgggttcagttttatctgtgagtttgaggtgaaatagaggcattcgagtagcaagatatattgctggcttttgtattgcctgaatttgagcttccaaaaatcttactttaacacatcgtttattgatcttttctt

SEQ ID NO: 33321 - DNA, 1049 bp, Homo sapiens
attggctgtgtgccggctttcttcaacctcctctgagtcctgttctaagtctaagccgttgtgattagctacatcctgccaagtctgttctggaaatgaataaagcccttgctgagagccggaaacattggttccagttcctcctggggtgaaggtttgttttgcctttatttaatagcactcatacctgtaagaagggacatgctctccagcccttctgatataatacctatttattacttgatttgttgatcatctttccagctaggatatatgctccatgggtagttttttgttgctgtttcccatcccattcctagcccctggagcagtgccttacccagactaggcacctgtgaatagttagcaaattagttgatagagctgccttctgggtgctaggaaccatactgggtgtttcattcagcggtcactggttccacagaggtgaggtgttctactcaattaaagatgtggacactgaggcacagaaggcaagtatttgtccaaggctgtagggcttattggccagccacatcattgctgaccgcttaaccacataccctcatttgtataatgagcaagaggctcatatttcttctgagtattaaggtgtggttattgatatgactgagggtatcaaagttctgtttaagaggtgtttgtgaacaggtgcggtggctcacacctataatcccagcactttgggaagtcaaggtgggcagatcacttgaggtcaggagttggagaccagcctggccaacatggcaaagccccatctctactaaaaatacaaaaattagccgggcatggtggtgggttcctgtaatcccagctagttgggaggctgaggcacaagaattgcttgaacctgggaggtggaggctgcagtcagccaagatcacaccactgcactccagcctgggtgacagaacaagactgtgtctcaaaaaaaaattatttgtttttattgatttttatttatttatttattttgagactgagtttcacttgttgcgcaggctggagtgcaatggtgcgatctcggc

SEQ ID NO: 33322 - DNA, 1032 bp, Homo sapiens
ggtgcctgccaccacgcccagctaacttttgtattttcagtagtgatgaggcttcaccatgttggccaggctgaccttgaactcctcacctcatgattcgcccacctcagcctccgaaagtgctgggattacaggtgtgagccaccatgcccagccgacctgctgatagtttgataaaacagaagttttactttctggaatttctactcattttatgttttggatggtttctctctccgtaagcattcagtattcttgaatctcaagttttgaaaggagccctaacttcaagtctactcgctggcttcttaatgaagtgaaccatttctattgcccatttagttcttcctgaaaccctgacattctggtgttcatgtgactcttctttcccccttgctactcagagaaagcgtcgtggtggagcaataaattctagacaagctcagaagcgaactcgggaagcaacctccacccccgagatctccttggaagcagaacccatagaactcgtggaaactggtaagattgccagggacactacaactgtggggtgttaaagtggagagagaacactgtaccagggtgagctagtagaaggtgctttcagtgtctttagaaggcctatgcagtctcacactcaccatgtacaactcaaagcttcacagattctgaaatagcttctcaactgggctaactgttcaactctggtaatgtgcagcagtggggtaggatccatttaaaaaaaaatctagcgcaaatgagatagcccaccttttctatctgaaactgcatccccaattgctggaccttgtaaagtacttcgctttcctcttctgtttttcattaggacatgaaatcacccaagaaggcaaacttgtccacagagctccctgtgttggagcttggtataggcagaggccagattggatttccccttctgcctgctcaagaagtggttgatggctggcctaagtccctttgctctgcatatattgtttttataactaggatacctgcaaactggcattttat

SEQ ID NO: 33323 - DNA, 1028 bp, Homo sapiens
actattgtcgcctaggctggagtacaatggatctcagctcactgcagcctccacctcccgggctcaagtgattctcctgcctcagcatcccaagtagctgggattacaggtgcccaccaccacacccggctaatttttgtagttttagtagagacagggtttcaccatgttggccaggctggtctcaaactcccgacctcaggttttctgcccgcctctgcctcccaaaatgctgggattgcaggcatgagccaccgggcctgtgcttttctttttttctttttgagacagtttcgctattgttgtctaggctggagtgcaatggcgtgacctcggctcactgccccctccacctcctgggttcaagtgattctcctgcttcagcctcccaagtagttgggactacagccacgcgccaccacacccagctaatttttgtagttttagtagagacagggtttcaccatgttggtcaggctggtctcgaactcctgacctcgagtgatccgcccatctcggcctcccaaagtgctgagattccaggtgtgagccaccgcgcccagcctgtggtgttgttcttatactgaagactcatctggaagctgtttttctctcattaaaagcggggacagtcagaattgttaccagtgaggaaacactctggcgaccctgttcttatgcaccccagtagttgtgtgtgtatcacctgctgcttgccagcagcccctgggctcagtgctcaggacaggcctcagtttggtaccatccacaggcaagctgggtatgactcacaagagaccataaagactcagtacgcgcactgtcatggctggggcactgggagtgtcataccctttccaggtgtccacacctaattagtgggtcatcttggcagagggtgggggcatgttggagctgtagaaagctggggtcatttctagccacagaagaatttgcttttgctcccagctaaacccaaggctttccccaagggccagcactgttaccagagcctccttttctagatt

SEQ ID NO: 33324 - DNA, 1034 bp, Homo sapiens
gctagtgtttactggggtccctcataaccctcttgggctgtcacactgttgagatgccatggcccctgcctcctgctctccagctgagagagaccacagcagacacagttagctctccagacccctccctgttgtagcctggcccttgctttcctttaattagtcatcttaggcataggtgggtgggattctctggccccatggctgctctgggacaagggcaaactcggaggctcttctttttaatgccttctagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggcc

SEQ ID NO: 33325 - DNA, 1036 bp, Homo sapiens
tccccgccactgctctacaaaaaattaaaataaaaattagccaccatagggaccgggcatagtggctcacgcctgtaatcttagcactttgggaggctgaggtgggcagatcacttgatgtcaggagtttgagaccagcctggccaacatggagaaaccccatctctactaaaaaatgcaaaaattagccaggcatggtgacgagcgcctgtaatctcagctactcaggaggctgagacatgagaatcgcctgaacccggggtggggggtgcagggctgaggttgcagtgagcagagatcacaccattgcacttcagcctgcacaaaagaatgagacattgtctcaaaaaaaaaaaaaaaaaaaaaaaaaaccaaaaaattagccaccatacagcgtatcctctgctttgatggtatgatcgttgtataaacatgctggtatgattattatggatctttggggtacatgagggtgcacttagaagccttccctgtattgtagaaattgcgaccacggtgaaattaggttatcattaactctagttcatatttgcctagtgacctgaggaaataggttgaagaaaaatgtagaacttcctgtgtcttaactaaaattaacaattttaacttttaaaagtttaaatggttaccatacacgctttagaaatggtgtacctgcagagagcatgtctgtgattcagtattttttctatgtgtacacctatgtaataaatatatcaagataaagaatataggttggcacagtggcccatagccatgatcccagcactttggaaggccgaggtgggagaatcacttgaggccaggagttcaggaccagcttgagctatgtagtgagactctgtctcaacaaaaaacttaattctaattagcctggccaggcgctgtggctcacacctgtaatcccagcactttgggaggccgaggtggaaggatcacgaggtcaggagtttgagcccagcctggccaacatggtaaaaccccattctctactaaaaatacaaaaaaattagct

SEQ ID NO: 33326 - DNA, 1009 bp, Homo sapiens
tcagagatcattctttttatgattttaagtttttcaaaaaatttaaggttttatggtctgttttggtaaatgttacatatgaacttaaaaatgtatgtactactattattggatggtttctgaatgtcaattagatccagttggctgatagtttttttttggttgatggttttgttcgcttctgtattcttgctgagtttttgtctactagttcttttgattgctgaaagaggaatgttgaagtctctgcctaaaattgtagatttgttcacttttccttacagtttatttagcttttgcttcatgtatgtttgaagctgtgtttgatgcatatacatttaggattgttaggtcttggtgaattgaccctttgtcatttaagctgtatccctcatccttggtagtttgcttgtctctaaagtcgcttttgtctgatactactaatatagcctctccagctttctgctaattaatattggcatgttatattttttctatctttttgctttaaacctatctatattatttgaaatgaatttcctgtagatagctgcctgattattcttcattaattgtgcttattcatattttcatttttaattgtaatgtgtatgtgaaatatacttattggagaccttttttcctggcctaataactaatttaatatttatttggtgctattataggatgctgctttgcattgtatttgataaagttctctttactagactttttgaccttgtaggctttgtaaactgatttgctagattacatgaacatggtgacacaagccatcttcattttagagtttgaccagtatgagttcaaatcataggcctctatatgtcatgggcctgtataacatttattttgtttttactatggaagtaagttttagctgggctctatggctcacacctgtaatcccaataatttgggaggctagaggtaaatatataaatcccagaaccatctaaaaatctataacttggtgaccaaattctagata

SEQ ID NO: 33327 - DNA, 1050 bp, Homo sapiens
atcaagaccatcctggctaacatggtgaaacactgtctctactaaaaatacaaaaaattagccaggtgtggtggtgcacgcctgtagtcccagctactcgggaggctgaggcagaagaatcgcttgaacccaggaggcagaagttgcagtgagccaagaacgtgccactgcactccagcctgggtgacagagtgagactccgtctcaaaaaaaaaaaaagttaaccatttaatagtgtactacaaggctgggcgctatggctcatgcctgtaatcccagcactttgggaggccgaggtgggtggatcagttgaggccaggagttcaagaccagtctggccaacacggtgaaaccccgtctctactaaaatatgaaagttagctgagtgtggtggcgcatgcctgtaatcttagctactgggaaggctgaagcaggagaatcgcttgaaccggggaggaggttgcagtgagcctagatcgtgctactgtatttcatcgtgtttgacagagcgagactgcatctcaaatgaaaaaaaaaaaaaaggaaagaaaaaaatagtgtactacaatctaattacttttcctaaaaatacttggtaattatttcacttaggtgaaagtagcccaccaaggcaaacattgtctacgagttactagttagagtacagtccctattgcccaggctggagtgcaattccgccgtcatagctcactgcagcctccaactcctaggctcaagagatcctcccacgtcaggctttcaagtacctgggactacaggcacgggccaccacacccagctaatcaaaatttttctgggggggatgagatcttgtatgttgcctagactggtctcaaactgttggcctcaagcaatcctcctgccttagcctcctgggtatttgggatgactgggatcacaggcgggagccactgtacctagctgtttctgtctttaaaagcacacaaaatcaggctgggtgcagtggctcacgcctgtaatcccagcacttcgtgaggccgaggtggacagatcacttgagggcagagg

SEQ ID NO: 33328 - DNA, 1147 bp, Homo sapiens
atgggggcatgtgctgcactctcttgacatgtgctgtggaacgtcgggagtggggcgaggggtctcttctgtggaacatggggagtggagcacaggtagagactgagagggccggcctgtctcacaccaaggctgctgcatttgctcaccttgtgttgtctttgcagtagacagtgcccaggcgtcctgtgctctcgttcactgctgctgcagatgccaccatacataaatttggcttgggacatgttgagttcagagtgcctttgagatatccaaggggatatgtgaattaggcaattgtactgtagacatttgacccctaaatccaacttctgggagtcgtgtgtattgacggtcatggatgtggttggcggaagaagagcatctagtggaaagtgactgagaagggagccctgaggatctctaatgctcagaagcaaaaccgtgctttccaggactgcagcctcttctgtagtatccacgtttatgtctaacctgccttaaataaatgtggagctgggggagggtaaataaatacttacatgcatggcatttttaaatgacatgaattaatcattttaaattaattaaaaagaaacatttaaaaattttatctttttagtgtttcttcaaaaacaacattaagtcattaattctggccttttggcgtattggaagcattgaaaagctgaatgaaatcaagaaaaagttctggagaatagaagcttccagccttttgggttcgtgacccgcctgtgggaaggaggcctgccatccctcccctctgttggctcacactcctctaacttcttcctcttcctctttctcccacacacaaatgcgtgccatgctcctctgcccaggccttgggttaaaggcagcactaggccttccaccaagagacatgagtgaatgatcaggccaggcagcagagtgcacagcaagcttcagggcgaaggtggccgcgacacttgccaagtgagatgtcagaggcctatgccccaagaaagcatagatcaggtcaggtgacgagacggtggaagagaatcccaggtggccgtggcagcatgtgcaaaagtgtggtacaccagggacttggacatggtgatcatggaaggtttgagaacaggaatagtggcgctcagtc

SEQ ID NO: 33329 - DNA, 1028 bp, Homo sapiens
gtgtgaatgtcagcacagtgaaaaaggcagaggacattttggtacaaatttgaaaatagttttgactcgtgggcctgctgaagggtgttagggtgaaaatcctattttgctagccattagtagttaaccacagatttcttgaaacttgctcaactttttaatatctgtctgctgatacatatttaacataggtgtcaaccagatttgtttttagtatttggaaaataatgctttcccttctaattcttcattatagctttaacactgaaatttgtcagagaacttagttaattatcaatgatatgttcaggttggcaactaggcttatagcatggccttaccctcgctgcggctctaggctatgctggaccatctgaatggggtcctcggaccacactttgagaaccacagctctgttgggttgtctttttcttattgacttgtgggatttctttatatacactcagtagcagctctttattggttgtatgtgttgcagatattgcctgtttcttttttgtctgtttttcactatgtgatggtgtcgctttatgaacacagattcttttctttttttaaccttgagatgctaccagggcagccactcaccacagcccctgctggggtgtgaatgtgcaccacgcacttcacgtccgggtgtgcagcataaattgcagagtgtaaggtgaagccggcctgattcactcccagattagtgcttccacgatctactatatctccttgtagattgatcttaacctgaaaataaaaaaataaaaatttaaaataccaagaggacttcatttttcttttctgttttcgagacggtcggtctcgcccagtatggagtgcagtggtgcaatcctgattctctgcagccttcacctcctgtgttcaagcaacccttctgcctcagtctcctgagtagctgggactacaggtgcgcaccaccatgcctggctaatttttttatttttaatatagacggggttttgccatgttgctcaggctggtctcaaactcctggg

SEQ ID NO: 33330 - DNA, 1032 bp, Homo sapiens
ggcttcgccatgttgcccaggctggtctcaaactcctggactcaaacgattagcccgtcttcacctcccagagtgctgggattacaggcatgagccaccatgcccagcccaggagcacatctaaaaatgctctgtgctctggctcaggaaggaatgcatgtagccaagtgggggccaaagggtgggggcaaagctgcccattaagtaccttggaggtgaaggccaggtcagcagtggggatgtgggtaccctaattgtggacattagccacagatgctcctgtcatctgtgcagtggctaagatcttacgcagagtgcaccctaggagctgtgctggggatgccatcacccccctgcactgacagcagcctgattgccggctcctgggagctgggcaaggtgcaagagcctgggaggtcctctgaggacagtgtgctaggtgaggaagggcagcagattgtggtgactttctaaccttcctgtgttgtctcacagagaaatttcggcagaggcggaccgggaacctcagcagctgcagaactactggtcagaagtgcgctacacggtgcgctgcatctaccgccaggcaggaaccccgctggcagatgaccaggaccagtctctggtgcctgacaaggagggagtgaaggagctcgtggataggtacatactgccctttcctgttgtggccccatgcaaacccctgccctccctgctgcacttggagccactcctttcaggatgggctttccttacagtgctcagctgggtttgcttagcctttggtgcctgtcaagactgcagcagatgaactggcaaaagtgagccccctaggtcaaacgtcttgaatttttctgattttgatgaaacgctattgcctgtataattacacaagaaatgtttctgtcacttgtttgtgtgaagactgataataataccttcctttttgagtccccctgtgccagggatgatgcagagtacttttacaagcactcttgcctttatcaacccaaggagaaaggccgagttagc

SEQ ID NO: 33331 - DNA, 1003 bp, Homo sapiens
actgacaccatctgcaatgacagccggagcccttcctcctggccatcagttcttgagcccagagaagcccacacaccctgcactgcacctttaccctcacatccatggacatgtgcctttgcacactgttccacacctgccacgccctctcatccaccccaccttgtatgcaacgccccccttcacacacagtaaggtaagtcagggcaaaaagggtctgaaagctcactcttcactgagatcctacaggagtacatagtcaaacaaagaaatctgtgaattagcaacttgcataggatagcatctgctctggataggaaggtctccaagtgtttcctttcaccataatctcttaagcactgtaattgtgaacctttacagttgtaacaatcattaaaaacaactgtgaaggtcatagttcttttattcagaattaaatagaacagaaggatttttcaggtgctatttctaacaggttaaacctagggaatatttccacaggagaccagtaatctacttgtgatcttccagggcttgctcttcttcttaatttgataggtaaaataatgtgaatacaacatgagtcctctaacactggctggactctacagggtctaaaatgtctatgctgctttagcatttagaaatacacgagcctaaataaaggaagagccctaagtgtgatgccacagaaaactataacgccctgcaggtgatggagcactggggaggggagggtacagaaaggagaagctgccagaaacccagtgtgaagagcccattcaggaagtggagtgaggatgtagaaataagttgatttttatgcatttcttcccagagaacctcatgtgtatacttagtatcttagactttacagtgaaattcttaggctggtttctttctttggaccttagatagctttgcctctctagttattttgagcttaactttaccagaatgactcaccgtaattctgattgttttcttttttttctttgtacca

SEQ ID NO: 33332 - DNA, 1035 bp, Homo sapiens
ttagagatggactcttgctatgttacccaagctgaacttgaactcctagcctcaagcagtcctcccaccttggcctcctgagtagctgggactataggcacatgccaccatgcttgttgttttttgatgtactctgataatctttgtcttttcattggtgtatttgactattcacatttaaagtgattttttgatgtatttagattaatatcagccatgtttgtaattgtttcctattcattatgagtctttttctgccttctctacttttaattaagcgttttatggttttatctcctctgttagtatatcaattttatttatcttttttaaaatttctgcagttgccctggagtttacaatatacattttgaactaatctgagtcctttttcaactaactaatgtaaaaaaggtaacatttaacagattactcccgacccttccctattccctgtgacattgctgtcattattttcacttatccacatgtttatcacccagtacagtgatgatgattactttcaacagttatcttttagatgaataataataagaagaagatattttactttgtctttattccttctctagtattcttcctttctttatgtagatccacgtttctgaccttctatctgaaggaaatcttttgacatttcttgcagggcaggtctgctggtgatgagctccctcagtttttgtttgtctgaggaagtctttatttctccttcacttttgaaggataatttggctggacacataattctaggttggtggtttttttctttgaacactttagaactgtttaacttccctctgtccttgctggcatggtttctgatttctgacaagatgtcctctggaattcttttcgaattcttttccctgttcttctgtaggtccacttgcccccacccagctgctttcaagattttctcttttttttttttttgttttttgttttttgagacagagtcttgctcagccgcccaggctggagtgcagtggcgccatctcggctctctgtaaccac

SEQ ID NO: 33333 - DNA, 1001 bp, Homo sapiens
gactctttccttggccgtgtcgtctcctgatgagtccatcactgatagtcttcgtttctcttagattgtttttattgccagcatttcttcccatctctctgctcacacggcccccttgttcttgcatgctgtctactttttccattagagcctttggcctaccaatcattttcaatttcctgtatgataattgccatccatgttatctccatgttcctgcaaccattcagttgtctctctcagcctctggtgagattgttgttagaccttcttctgttctgcattcctaacactctcttgcatgtttctcatctccttttctcccagttccatgttctgagaacttttttgggatcagtcctccagttaagtgattctgtagtggtgcctagcctgccacttaagtcctgattctgactatatttattatttataagttttaatttactttttttttccaaagatacttagtagctctttatattctcttgttccttgttttttttttctttctttaagcatttcacacatagttactctgtgtttgaatgaaaccttgagcatccagattcgttttctgctgatatcacctgtgatgtattatttccttttgcggatggagtatattaggaggttatgttttgctcagcttactctgtgagaaccacagccctccatagtggatgcttccctgtgagggttggcgtctgctgatgcgagagctgcctgagacctgggctcctcttgagggcctccagactgctgcccccacacgtcactgtggcgatggtgtacggctgttccttcccctcacctccacctcgcttctctcatgacctcctgatacttcttttcatcctttgcctttgtcgatagcagttggttaccaaagtgttcagtgtcatttctctcagatctagagctaagtagcccctcttacctagcaaggcccagaccaggggggaagaacggccttcaagagaagagcaaagccgagcagg

SEQ ID NO: 33334 - DNA, 1023 bp, Homo sapiens
aataaataaataaaatcatcttgtcccagtgattcaagatgccacctttgtcctacaataaatttctttctttcttttttttttttttttttttttgagacagagtttcactcttgttgcccaggctggagtacaatggcatgatctcagctcactgcaacccctgcctcctgggttcaagcgattctcctgcctctgcctcccaagtagctgggattacagccatgcaccaccacacccggctaattttatatttttagtagagacagggtttctccttgttggtcaggctggtctcaaactcccaatctcaggtgatctgcccaccttggcctcccaaagtcctgggattacaggcgtgagccaccgttcccgtcctgtcctacagtaaatttcaatatgcacttgggtctgtttctggaatttctcttcctttcctctctgtttacttgtgtcattattgcatttagttagttatttttagaggctctacatgttgtaatatctcgtagggctgttctctcctcatagcttttccagctcagtatttcccaggctatttcatgtttgtagttctatatgaactttagcatcaatgtgcctggctccatttaaaaaaagcttgttggggccgggctcacacctgtaatcccagcactttgggaggcctgggcaggcggatcacctgaggtcaggagttcgagatcagcctggccaacatggtgaaacaccatctctactaaagataaaaaaaattagccaggtgtggtggcgagcgcctgtggtcccagctgctcgggaggctgagatgggagaattgcttgaacccaggagccagaggttgcagtgagccaaggttgctccactgcgctccagccgaggcaacagagtgagactctgtctccccccacaaaaaaaaaagttgttggtatctttgtcaggattccattacacttatacattaatttagggagaattgatgtctttatgatattgatcattccttccaagaacaagggatgt

SEQ ID NO: 33335 - DNA, 1031 bp, Homo sapiens
ctcactccattgtccaggcagtggtgcaatcacggctcactgcagccttgaccaccaggcccaggtgatctttccacctcagcctcctgggtagctgggaccacaggcgtgctccaccacccgctgcctgagactcagttttctcaacagtcagaagacataatgaaaatggcatgaggccaacagaatgtcttttttttttttttcagcttactcaaaagataattgacaaagtattttattatctcttattaatactacatgaaatcttattgaaaagagaaaaccagttgcatcagtgtattactattaattgtagtaaaatcttttaaacagatccatctaatttcaatcagctttgaccacacaggatttccataaatcttttataacctcttagaattttcccattcacttccttttcccaactttctatattcatttattttcttttccatctgtttttcaacttaagaccacttttaaataacctctaaactagtcaaaatcactttttcctttgacaaaaccacatcctcatgtttttcttataaccttccttaccaaaacacatcttactttttcttatgtattttatatgtagaactgttttcctgcttatctctactttgagttaccatgttagtcagaattttagcttttagtaaccttaaattatagtgaaaacttaagaaataagcaattattaatattttgtttatctgaaataagccaggcacagcgttcacaccttgtaatcccagctctttgggaggctgaggtggaggatcacttgagcccaggagtttgaggtgtgagctgcgattgtgccgctgcactccagcttgggagatagagtgagaccctgtctcaaaaaccaaacagaggataaagaatttaagctttccagtcaatgaagctttacattattggcagaaatcatgtcaacaaacagaaaagcgggctgagaaagtgcatatcgttatcaagggttacggaagagaggaattcagtcaactgagaaggttttt

SEQ ID NO: 33336 - DNA, 1027 bp, Homo sapiens
gcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttt

SEQ ID NO: 33337 - DNA, 1051 bp, Homo sapiens
tactgctaataataatagtgatagctaccacttactgtttactatgtaccttgtgctaaacacttgacataagttaactcgtttaatcttaaaccaaggaagtagataatgattctcattttacagatgaagaaactgaaatagacagagatgaagaaatgtgcctaaggttacgcggtttagtgaactgggatcagaacctgggttctctggccttagactataaaccatagataggaattgagcacatttattaatcagcattgcaaggctggtggaattttgataaacacccaaaccagattcttttctgcactagtgataccagacagattttggaaatataaacaggatagggtgcattaaagttcactcacatttgttcagttaaacagatggttggcttatctttagttgcttcactcagtcatttccaaaaccacacccaaggccaggcagtggctcatgcctgtatttctagcagtttgggaagctgaggtcagaggatcacttgaaaccaggagtttgagaccagccttggccacgtagtgagaccatggctcaacaaacaaagaataataaacatatttactattatgggacgtctatgtgccagacattgtgctagacattttacatttattatttctaattgccccaacaacctgggaacatatcaccgagtgtattttattacaaatgtggaaactgaagtacagaagacaataagcctatgaagtgatcgtagggcgttgctggtacaaagtcaaaacctgcatcattgggccctgcgcctctatgtctgtggggagaagggattgttgatgatgtgatagctggaaaacataccattcatcaaaataaatcccaggtggattaaaaagaaatgtttaaaattatagaggcactgtggagaaaaagcaaaataaaatgtttatcagagataacgccttaacattttcttggaacattttattagatgtgtgcctgggaaggaatgataactttctttttaaaaccagaagaaatcacaaaggaaaaggtttgtcaa

SEQ ID NO: 33338 - DNA, 1038 bp, Homo sapiens
gagaccagcctggggaatccgcatctctaccaaaaatataaaaattagctaggtgtggtggcatgccccggcaatcccagctactcaggaggctgaggtgggaggatcactcaagctgaggctgcagtgagttgtgatcgtgccagtgcactccagcctgggtgacagagtgagaccctgtctccaaaaaaaaaggagacgtgttcccagctgaggaaccagctaacatgaaattcctaggatagggatgggcttgatgagcccacagaggcagaaggcagccagtgtggttcggcctgggagtggcagagtgaggttggagagagaggagggagcagatcctggaaggctgtgtatgctgagattgagagtttccattgcattctgtgtgtggcagaatcattggagggctgcagacagggaaaggacaaacggtattttaaagaaaattattctgggtttggtttagagagaaaattggctggggcaagagaaaaagctgttgtccaaatgagagatcatggctgcttgggccaaggtggcgtagtagaggtaggaagaagtagatttgtatggctttcattttgaaggtagtgtgaataggacttgctgatggatggggtggaagaagtgaaagggaaaaaaagaatcaggatagcaccgagacttttggcttgagcagtttacttacgtaaaaacaacaagaagctaagtaaaaatgactcgggatagttgagtcatttttgagttgaaactgatagcacctagtgtgtgccaggcattgttctaggcactggggatgcagagataagagagtaaagttcctgcccacaggttgtttagaacacagtaagcatcaaggctgggcgcggtggctcatacctgtagtcccagtgctttgggaggctgagataggaggatcacttgagtttaggagtttgaggctgcagtgagctatgattgcaccactgcactccagcctggggcttgaggttttgccagatggtttggtagagttggagatgttagcaagaaagg

SEQ ID NO: 33339 - DNA, 1347 bp, Homo sapiens
cagggattacaggcacctgccaccacacacagctaatttttttgtatttttactagagatggggtttcaccatgttggccaggctggttttgaactcctgacctcaagtgatccgcccacctcagcctcccaaagtgctagggttataggtgtgagccactgcacccagccaataatgaaaaattttaagagtccttaagtattcagcagtagataggaaatggctcagttattcaatatcaatttgagcaaatgttgtatactatgaaaaacaattacaaagatcatgtagaacaagtgaaatatgaaaaatgaaaggtatcagaaatgagaaaatatgaaatatatactgtttacagctatatgaaatatgtacatatatatatggagagagagagagagacaaaagagaaatgactaacaaaaatggttgtgtaatactttttaaatgtggaacctgacagcatgcttctaaaatttagatggaagagcggaaggccaagaatagctaagacactcctgaagaacagctaggcaaggagatttttcctaccagatgtcaaacttaatataaagtggtaattaatatagtgtcctttgggcaaaggaagatgcagagggatcagtagggccaaattgcatgcattgaaacagacatgctgtagtcggcattgcagctcagcggggtgggggatggacttggcaatgatggctgctgggatgcttgggtagaaaagtcacaagtggaaataattatatgagacttctatactatacataatcacaaagcaatcccagtgaattaaagattaaatgtgaaatgcaatactttaacaattttaggactaatataggtgaaaatcactggccttgaacctctggcctaaggagagatgtcttatgacacaaaaatcacttatcgtaaaagaaaagatggataaatttgtctacatttaaagtagacaaactttttccttattaaaagataccataggccaggcgtggtggcttatgcctgtaatcccagcattttgggaggctgaggtgggtggatcacctgacgtcaggagttcgagaccagcctgaccaacatgatgaaacccatctctaccaaaaaatacaaaaaatttggccaggcatggtggtgtgcctgtagtcccagttgctggggaggctgagacaggagaattgcttgaaccctagaggcagaggttgcagtgagctgagattgtgccactgcactccagcctgggtggcagagtgagaccctgtctcagaaaaaaggtaaaagataccataaagacagtaataataaaagccgcaacctggaaggtttgtcccacatgt

SEQ ID NO: 33340 - DNA, 1025 bp, Homo sapiens
aacagcagccatttatttcctagcttctgtggggcaggagtccaggcacagcgaactcaacctagggtctcataaaggctgcattcagggtgttggctagggctgggttctcatcaggagacttgactcagaggatccacatccaggctcttctagactggggacagaattccttttcttagggctgaagcattcttggcagctttacttcttcagagccagcagtagagacagagactcttataagataggtgctaaactcttctgtgatacagcccatcatcaccttttgtgaattccgctacttagaagcaagtcagagatctcacctgtgctcaaggtgggaggggattacaggagctgggggcctggggccactgtgaagtctgtctgtcacacttaccaagtgtggccaggagagatgcagaggacaccgtccatgcccttagagatgctgtctgtgggaggactctgcagatgagttggtccagtagaggcatgaagtaagtggggctgtcttttaccacagagcacatggtcatgaggcagagctggaggtgaatttgaatgttgttgtattcagacgtaaagtaattttgctgagaaccagttgtcatgaggtatacttacttaccttacttacctaaagattatcacagtatttaaactgtaacttaagaggtaaaagtctattaagtatgttgatgaatataacctgcacagtggctggcagcaagtaaaccctgtttgggtgttcaactttaattttttgttgaaatatgtaagcaggagagtgcacctaccgcaagtgttcagtttgttcatttttaaaaactgaaccccctgtataaccagcagtcaataagagcaacggtagcagcacctcagaacacccccagcacctccttcagttcacttgtcccatcccaggggtgacaactgtcctgtctcccaggacaaccaaaacaaaggttgttttgcatcttctgcacttttaatgaatggtattacatggtgtatgttct

SEQ ID NO: 33341 - DNA, 1536 bp, Homo sapiens
atgatagctgctggttcaaaatacggacctgctgatcctaagctattaatcttaaacttctgaaataaagacagagatggaaggagttagaatagtgctggtccatattttccccgaaatgagaagtagacttggaatccttttctatatccaggatcctagttcctgcattttttcctctggttcttattagcatttttcactttaaaaagtaaaaatacgtattacagttgccaagtttaaattattgggataaaatgccctaccacagaattaaaaccaaaataatgctcatgtgatgtcccttaaggtggtgagtgggttcaggaccctcagccacctgctcagcagggagaaggcagggagggaggggtccctactcgcacaggacagcgggggacaggccagggcataccattcgagtccatcacagaagtggctctggcagactctctttggaataagaatagaaataagttttgtatctgaagttggttaagtttctctgaaattcgcatcagtcaacacccaggtcacagcttcctttatcctctcttggagaggatcagggaaagggttgagagagccctgccttctcagagggcggccgagcgggctgccccatctgccatggaggcaggtacaggctcatggcgtggcgtccacagctcctaccatatccttcttgcttctctgcagagaatctggacgaggctagagaacagaaagaaaagagtcctccagaccagcctgcggtcccccacccgcctcccagcactcccatcaagctggaggaaggtgagctctgggtggcagcggccgccactgtgggagggtgcacggctcgtgcgcgctgtggcggaatgtggcgggagtcgtgttaacagcaacacggaagtgtgtgcttgcatcagcgccaggacgtgacacctttctcctcctatattgcttctgtcctgggtaactccaggcaaaacagatttgtatgtgagctgtgaccaggtaggaaggccggcctcgggggtcggaacccaccatggttgctggtgtccacgttgcccattgctcgcacactcctcgtgccgtgttgtcatgcagatgccaccttcggaggtgccctccgctgtgtgagccacacgccggctgcctctcagccaccgtgtgtctgtggtgtgtgatcccgggtgtctgtccctcggtctcgtacatccatgtctctcgtgaagcccgtggccctgcctttcttcttctgtaacctgatggctgtgactgaatgcatagattctctccttgtgcttttttctccctgtggctgcgtcacaagcaggagacggatgcgctagagagtacctgttaccctagtaagtaccgtgctgcctccgctctccaccggtgccctgcgctttgcctcattctcctgcttctttgttgtttattaagttttgttttctgtttatttaaaataaaaacagaagccccccttttttgtacccagtcccttggaggccttcctggaagtggttcagtcacctgagt

SEQ ID NO: 33342 - DNA, 1003 bp, Homo sapiens
ccttgggaggcaggtggtggcagaatgggagcactgaaccggaagagtgggccagacccctcttggaagggactctgctggtggtgtgaatgatgccacagcacctgctcctcaggtcagtcccctggacatgcaggcgcttagcactgcacggtgagctggaaatagaggacaggggtctgagccttgaggtccaacctctggtcaggctgggagaggcgtccacagacatggaagagctcaggaagaggctgtgcagctcctcaccccccagagggaagcagcaagtgctgaggaagcatccaggagcagggctggcatcaggggaagggggaggagcacaggggctggggtgagggcccaggagggcagccagtgtgcagactgctcctcatcccaacactgctcttgccgccctcgctcctgaattcagagcgttaagagaagcgacacagcagcgcggcctgtgtgagctgcacgagaactttcacactgccttgtcgtcacgtgagaaaaagtaaaaagttaagattgattttaacaatagaccttatctaaccccaaataccaaaatattatgattttaacacataatacaaaaaattaagatattttaagtatttctgacactaagtcttcgccacttgggcatatgtcacaggtagggtacgtctcagttcagactctggcccctggcaaccacgctggacagcacaggtcaccggtagcactgcttttccccatgtggcgcgtgcacacgctcacacagagggacagacagtgcggcgggtggcaggttgtgtgtttcctctactttcgcatattctaaactttctacaatgagtatgaactacttaaaaaaattctaaagtataacatatttgtaggaacctccctcaaatcaactcaccttggcttgctttgtttggagttgctatgtaaagaatcccaagaagaaaattaataagctcaggtataaacctctgggacaaagccacatact

SEQ ID NO: 33343 - DNA, 1017 bp, Homo sapiens
cttggcctcccaaagtgctaggattacaggcatgagccaccatacctggccagtgttgatattttaaatacggtgttcagggaaggtccactgagaagacagctttttttttttttttttttggggttggggggcaaggtcttgctctttaacccaggctggaatgcagtatcactatcgtagctcacttcagccttgaactcctgggctcaagtgatcctcccacctcaacctcacaatgtgttgggactataggtgtgagccatcacacctggccagatgatggcttttgagtaaagacctcaagcgagttaagagtctagtgtaagggtgtatgaagtagtggtattccagatggggggaacaggtccaaaatcttcctgtttcaggaatagcaaggatgtcattttagttgggtgaattgagtgagggggacatttgtagtaagaagtaaggtccaagaggtcaagggagtgccatatcagaccaatactacttgccttgtagatggaataaagatattggcatttatgtgagtgagatgggatgtcactggaggattagagcagaggagtagcatgatctgaatttcaatcttaagtgaactctggctgacaacagagtgaaggggaacaccggcaaaagcagaaaccagttaggaagccactgcagtgctcagataagcatggtgggttctgtcagggtaccggctgtcggctgtgggcagtgtgaggaatgactgactggattttgaatgcggaaccaactgcacttgttgaactctgctaagtataacaatttagcagtagcttgcgttatcaggtttgtattcagctgcaagtaacagaaaatcctgctgcaatagcttaaactggtaacaagcaagagcttatcagaagacaaaaataagtctggggaaattcaacaataagttaaggaacccaggctctttcttttttttttttttgaaacggagtttcgctcttgtcacccgggctggagtgcaatgatgtgatc

SEQ ID NO: 33344 - DNA, 1050 bp, Homo sapiens
aaaatgtagtctgctttaagctctctaaagtggtctaagttactggttcctaagtatggatgagcatcaaaatcatctggaaaatttgttaaaaatacagtaatgaaggcacctcactgtcctttttcccaaacatacttctgcattctgtttgagtaggtagggactacacatttttcacaagtatcctcttgggaatacccaggaatgcttacttgagcaacctcttactaatatgtaccttgataaggtggctaggtaaacataaatatacaaaaatccatagatctcccatatattagcataaatcagctagaaaatataacgtttaaagatctagttcacagtagcaccaatatatcgaactctaaggaatcgataaatatgcaaaaactttataaaaacttctgttaatgtttctgaaagatataggtgaccactttctagataggaagattttatattactaagttgaattttctctaaattaacacagaaatttaaaataatcttgatcaaaattctagtagaggtatttttgaacttgttcactgcaagaataaatacataattgcaaagaatatctcaaaatcatcaccaggcctggtgtggtggcccatgcctgtaatcccagcactttgggaggctgaggcaggcagatcacctgaggtcaagagtttgagaccagctggaccagtgcggtgaaacactgcctctactaaaaatacaaaaattagctgggtgtggtggtgcatgcctgtagtcccagctacttgggaggctgaggcaggagaattgcttgaacccaggaggtacaggttgcggtgagcctagatcgcaccactgcattccagcctgggcgacaagagcaaaattctgtctcaagaaaaaagagaaaaaagaaaaagaaatcaacactaatatggtgagacttaatgtatgtgacattaaaatagtgattggatgttaaaacaggtatagaacagaaagaagagtgtatgtgtgtatctgtatgaatttatgatgggtgtaacatatatgtattaggga

SEQ ID NO: 33345 - DNA, 1100 bp, Homo sapiens
aaatttgacaacttatagatgaaatggatgagttccttgaaagacacagaaactattaaagctctctcaagaagatatagataagctgattagccctatatctattttattgaatttaaatgtaaaaatcaatatttagttactggaaaacttttaagtgtggttggaaatggtatacgaactttttcaactgaattttatgaagtctaatcacaggtaaaggttttctgatgaaaatttagtgtctgaattgagatatactgtaaaaaatgttatatatcttaattatttcttcacattaattacatgttgaaataatactttgggtgtattgggttaaattaaatattatgaaaatcttgcctgttttctttttacttttgatgcgtcagctaggaaatataaaagtgtagctcacattctgtttctgttgacagtactgctttggagcacagtgtttgaatgatctatcatttcaaagacctttcctcagttcgttattcatggctgtctgtattccacatagataaggtctgaaatactgctaagtggcatgttttgttttatgcttttataagtttgttgatcattactgatgtggacttttggtgcctcttaggctcattgctatcttccaaccattgtttgcaatttttacctagagataaagagaaagagacatttggtttcagagtagttagattgggatcatgaaagagcaacctcattttgatgcttcaaaaatagcacatcccccgtattactgggatttgctattcttgggattacttcaagaacatccttgtgttactggtttggatgcttctgaatgctgtgaagtcagtttcatgtacatggctcatcagtttagctctctcttggctttgtttagacagttggagcatgatggcctaaacagcttctttcaattaaacattttaaaatagtttacaaatagtaaacaaactccagtttttgtgactctttgtctcgcacaacaaaaacacaatctgaccatgatcatctggcatcttagggtgaaatatggttatactttggcccataccgaaagcaagattaaaaaggggcaggagagatag

SEQ ID NO: 33346 - DNA, 1036 bp, Homo sapiens
ctgccctggagcagtgagcttggtgggtcctgtctggcatgagagctgcctttgggagctggatcccagcctctaccactgggtctggtgcctagcaggctatggataaacttctgctgactccggcctctcctaagccactgcaacgtggtcggtgtagtgcacagtgtgtgtgcagcgtggccttactcacagcctccacattagagagaatctgactgaagtcttactgctgcctcgtgtgaacataaatgtttgccagaaccatgagcaggaaatgttaatctgccttgtttcctgtcctttacacggaagaatttttttctgtatggaatgcgtgccttacaaataatgagtggaaatacccatcgctaatgaaaagttatacttgactgttagtcagctaaataatctgagatttctaatacttttaatttggcttttacaatgcaatttatcttagcttttttgatttcttaggtcatatctttagaactatatatttgaatgttaatgtaattttcatattgaaattaaaatgttgaactgcgatgttaagtgtttcctgtggaaaaacgttcacattttctctagttttaaagttgaatcaagctgtttgaagattttcacatttcttctagattttatcagcttgttactttatctgtcactttctgtgatttgcagctggagggggttcctcatgcagccctgtcctttcaagaaaacaaaaaggtgattatttcagaaatcagagtcttgtgttgaatcttactgattttcttgtatttctgtaatgtaatgtatcttgtatttcttgtaatactgtattggactctgtgtatatctcttctcagatgagtgattatatgtgtgaatgttgctggaatctgataaccaggcctgaatagttttgtagggtggcttttaaaaattactttcatatcagaattgctttgtcataaattttgaacgcatcataaatttctaatgttcggggtcagcagactttttttgtaaagggacagagtgtaaa

SEQ ID NO: 33347 - DNA, 1078 bp, Homo sapiens
taaaatgtgctctttcctcattgcacttccatgttggagggcttgtctcttggtgatcacacttcaaaattctcacagccccccttgaaccgtttaggtgttagacggtaccgacaaccagtatttgggcctgcagattggacagccccaggatgaagatgaggaagccacaggtattcttcctgatgaagcctcggaggccttcaggaactcttccatgggtatgtggactacaggtgatgcgctacaaagtggtttgtattcagacctggacatcttaattatatctttgcttccaagaagaagtcctttgatactgttttctgagttctgaatagctgatgaaaatgaccaattgaggaataatcatactttttcttgatctaaatcttatacttttgagttatcttagcataaatgtataattgtattttaagtggaaatttgtcacttaatcttgatttctctgtttttaaagcccttcaacaggcacatttattgaaaaacatgagtcactgcaggcagccttctgacagcagtgttgataaatttgtgttgagagatgaagctactgaaccgggtgatcaagaaaacaaggtgagggacataggcttgagacgacttggtgtttctgagcttgtgtgaggatttaaaatcgccctggctactgtctactttattgctttcccatccctgggcctttaaatttcccctttaaataccagctcttcccaggcctgttgttttctgcctttccaggtactacccacagccttgagaattgcctgagttctgcctcctttgagagtgtgccccagacaaatctattctgtactgaatgtttccttgtctgatttcttggatcattcatttgatggttgcgtatggcctgcaacgtttcttgttttggttctactgaactgttctaaaagtctctcttcatattatctttttacatgtaaatgtaactgtcttcacttttaattcctcaaggacaaggaatagcgtttcacagttcgtcccatcaatcagaattatagcctttggcatctccctatctaccaggcccacttcctct

SEQ ID NO: 33348 - DNA, 1028 bp, Homo sapiens
ttccttccttccttccttccttctttccttcctcccttcctccctcccttccctacttccctctccctttccctttcccttccccttttcccttccccttcccgcctgcctgcctgcctgccttccttccttccttccttcgtttctttctacatatacacatttttttaaatttcaatggtttttggggtacaagtggtttttggttacatggctgaattttggttacatggtgaagtctgagattttagtacacctgtcacccgagtagtgtaccttgtacccaatatgtagttttttgtccctcaccttccagccttccgccttgtgagtctccaatgtccattataccacactgtatgcccttgcgtacccacagctcagctcccacttctgagaacatatagcagaaacatgccaaagtatactcccactaccagaatgtgattgtgcctgattcttctcaccagtacaaatatttcaaaaaaagttaaatatgtatcagttttttgggcagaagttgatacttctctttatttatttattttttttgagatagggtctcattctatgatgcccaggctggagtgtggtggtgcgatctcggctcactgcagtctctgcctcccaggttcaagtgattcccacgtcagcctcccaggaagctggaattacaggcgagggccaccactgccagctaatttttgtattttttggtagagatggggtttcaccatgttggccagactggtctcaagctcctgacctcaagtgatccacctgccttggccttccaaagtgctgggattacaggcgtgagctaccacacccggctgatatttctttttaaaataacttaccttcttttgaaagtaatacatgtttaatgaacagaatttaaggaaaatataaaaaaacgaaataatctttgtaatcaaactactgaaaagaaaaccaaagttacattttggtgcatattctttttcattttcatcattgtaatttgcatttctttgattacttgtgag

SEQ ID NO: 33349 - DNA, 1076 bp, Homo sapiens
acctccacctcccgggttcaagcaattctcctgcctcagcctcctgagtagctgggattacaggcatgcaccaccatgcccggctaattttgtatttttagtagagacagggtttctccatgttggtcaggctggtctcaaactcccaacctcaggtgatccgccctcctcgaccccccaaagtgctgggattacaggtgtgagccaccatgcctggccttacatttttataataagaatttatgttgctgacattagaaaagaaccataatatccaagaatccaagaataattaaattatgtacatatgctagtatatagtgtgatgctttggagaatttttaacaatatggagatgtataatctggattgtaatattgagtgaaaaaaggcagaatacaaacctggtgggggtatagtcggatttcagttaagaaaaataatatttacatatatacatttctcacactggcagataatcaccaagataaattttgggattgtggatgatttttttcttctttatatttttcagatattctcaaattttctaaaatgagcaagtataacttttgttatcagaaaaaaataatatacaaaagtaatgttaatttgctggtgaccaggttaaacctttttatttttattttttgagatggaatctcactctgttgcccaggctagagcacagtggcatgatcttggctcactgcagcctccgcttcctgggttcaaatgattctctggccccagcctcctgagtggctggaattacaggcgtgtggcaccacacctggctaatttttgtatttttagtagaggtagggtttcaccaggttggtcaggctggtctcgaactcctgacctcgtgatccacccacctcggcctcccaaagtgctgggattacaggcgtgagctactgcgcccagccagacctttttattttatttgacaaaagaaatacttccatgttatagaagactaaatattgtttgggctgtctgcagtatggtcttcccttgatttgttcaaaatatcgtaaactttgcttatttatttttattgtggccgactg

SEQ ID NO: 33350 - DNA, 1088 bp, Homo sapiens
tggatcttcagaacagcacggaaaagtttggagggtttctccgctcagccttggatgttctttctcagatactagagctggccacactgcaggacattgggaaggtttgtgtcttgttttttctccttgggttgtggctggcacacttgatgtgcgtcttctgggctgagttcatctaggatggagcctggttctccagggtgcctccgggagactcctccctgccccacgtgcttgcgtcacaggacccaagtctgactctgccttagccatgaagtttagggggaagtttctatttgtattctatttttgtctgttatcatgtattagcttagacccagtttagtttggaaaatcagtgggtttcaaaatgtgtttgtagagtcctttatttcttaacttgaccttttcaagtggaaaggggcaaaacagacgggtaagggggcggggcgggaggtgtgacttgctcttttgtgcctgaggaagtaacagagctggggttgacagtcatattctctgacacagatagtctctgacttatctcacagaaagtcagcggcagagcctgagttaaaagtctcgtagattttctttttcttttttttggtggctaatttcagttttatttatatttgtttatttatttattatactttaagttctgggttacatgtgcagaatgtgcagttttgttacataggtatacacgtgccatgatggtttgctgcacccatcaacccatcacctacattaggtatttctcctaatgttatccctcccccagtcccctcactccccatgggccccggtgtgtgatgttctcctccctgtgcccatgtgttctcattgttcaatttccacttgtgagtgagaacatgcggtgtttggttttctgatcttgtgatagtttgctgagaatgatggtttccagcatcatccatgtgcctgcaaaggacatgaactcatccttttttatggctgtatagtattccatggtgtatatgtgccacattttcttaatccagtctatcattgatggacattcgggttggttccaagtctttgctattgtgactagtgccacaata

SEQ ID NO: 33351 - DNA, 1044 bp, Homo sapiens
tcggccaccaatctttaaatggctaaacaaaagggttgctaaaacataatccaaattgacataagaaataccatttttccaaccaaaattttggcattcatatggctacttttacgtatttcagctgcatttgaacatctttttcaaactttagggtggttggtgtatcactgaggtcttggatgacactttagctttgattttgtttttatgaattaaaattgtcataccaaaatttttatttcaagcaaatccaagagcataaaaaattaaaatattacttaaaatactaagagagaacagatatatattttactaagcatatgttgaatgaaattgttcaaatatttataacaggcatagagtagaattttcttaaaaatatttttgatggtataccaatttgtattttctcagaaacatttgccttattcttttttctgttgtgtttttcttacctgattgaaagctcataatctgttgttattgtttgttaacctttaatgctctgatttcaggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggtaattaaaattaaaatttatcttatttttaaaaagcattccagggccagtatagtactttgcaccaagtaaatgtacaataaaggcagtggatctaatacattgaaagcgtttacagaggtagctaaagagcagcacgggtgtcctcggctcagaatttcttcctgtgtgtttgccactttgccattcattgacatggtcatggacatagggctctaagcccttgaggaaggctgggccagacctcaggggagatgcagccccaaaccacgtgcagtcctgtggacggatgtgtagatgtgccactgagga

SEQ ID NO: 33352 - DNA, 1034 bp, Homo sapiens
actgctgctgcctggccctgcagctgcctggcctctggagcgtggtctcctccacagagtttgtgacccacgcctgctccctcatctactgtgtgcacttcatcctggaggccggtgagtccccgtccatgaacggtgggttcctatcatagttcctgtctgcttcaccatgtttttattttgtgctgcctgtttgccaggtactaagctaggaattggggatggagaggtagataaaatatgcatcaggaagggctgggccccatctcttactctccaatatattggagtctacactggaatttaactggaatttgcttttttagtcattttatttagattttgaagtttcagctttcatcaaaaatacctctaaactttatgtctctgtgatctttggtcttagctgttttatgtatttagtcttatatgatcataagattaataacattacattcagaagattatttgttttctgtcagagttaaaatgtttgtttttatactgcattgtaatattaacgtactgtaaaataaaagtggcttgttcttttcaaggaacagtatcctcaacaagggtcattagccacaatttttaaaaaattggacgtcatagtttacatgttagagggcgttttgaagctttgtatttttaaattaaatgttatagagtgatgttttcatgtttcataattgttttcatctgtgcatttgtagccaacttgaaaacaaagatccagggattactacttaaaagccagacttcttggaggttatagtgatgattttgatagtatcttgagccgtctcataataacctcagggtgagagatggccaacaggagacagtcgagggacttagaaatctgaatgaaatctgaagttcaaatcttcagacatataccactaaccaagagattggtacctcagtctagtattgtctgtttgtctaaaattggttctaaggaatctaggctagtctgtctatccctttcaacttttgtgaggctgcacaaatgtaaaatgttgaataaa

SEQ ID NO: 33353 - DNA, 1069 bp, Homo sapiens
tttgatggcaagaggtgtgatcttgtggtgggactgtaatcagtcagttctcagtgactgtgccctgctgtggtgtttcctggaatgttcctgtcttgtcctagaaagtctggcaggggcaccctgactccactgtccagtcctctccccagtccctcgggcttctgcagatttgaggcttgtttggatcccagaaggttgtggcaggagacaccttgcctctactttcccctttataattcaatgtccaaagagagccctgagcaggtacctcacgccagctgcctcacggagctcctcctcttcctggctgtgaggatcggtatcagtggcctcctgctctctcccccttgcctaacacgagcacctttgcttacttgggtgcccttgctcttgaactgcccatcggacgtgcgtgacccaagactgtgccgcagtccttgccttgtctgtgctcattttctttgttcatttttttccctgtaacgtaaattgttatatttgtctgtatctgtgtctgaatcagtcctgcacgctctccttctctctgtctcttgttctttctttaccccgtttatcacggggaccccgatgtccattgctctagttctcctgtcctaagcaccccatcccgtctctctggccttaccacaagtggcgtggctgcctcagacatcatgatggggacatgaagcacagctgtcagaaacaactgttcgttagatacactcgaatgcagctcatcaatagggatggagggtctgtcggatgtattttcactgaatccccgttcctaccttgatacactctttttaatctattcttctagacaggtcagaggaaccattactttgacttttaaatttttagcagctttattgaggtagaattcacatactacagatttcacccactctaagcggacagcttggtggccattagttttatccacagagttgtgcagccagctgcacagtctcagggctggactccagggaagattttagcccatttagtgagtggggcagaagtggccctggccctgcacgaggttgcctgcatgggcgtc

SEQ ID NO: 33354 - DNA, 1598 bp, Homo sapiens
gctgtatctgggcgggcagcaatcagaatcggctgcaatggggtgctcatgctgctgatgaagactcaaaaggggtgtgtgctacctaaggcagggcctagcttgaggctgaggaccccgggaccatttttggctcatactgccatgctgagctgaccatctgtgcacaagtcctgttcattttcctccttttctgttggtcatgaggaactcactgtgtggccctaggtttgggctgacagagctgtgctggtgccctggtgaatgatatgtgggtctgggccacgtgctctgcacaacctgccccttccctgctgggtgtaaacttctatctcatggtggattgctgctgggtgtgccccatgccagggtcagtgccatgctcctgatagacagctccagcgtctaatcactgggtgtccccagtggatgctccatctccaccagggccctgctgctttccacatggcttgtggtccctgctgtctttgccccacaccttaaacttcctggctgtaaatctcttactggggccaaggaggatggcccaggtggcagggctgcctgtccttttctgtgtgggccctgctcgctgctggctgccttccatgactccttggagagggatctgagcagccttcccaagtgaggggtggtttgcctcttgagcccatcgtcctgaataacacggaggaaggctctctgtaagaaaacgatatttattaatatttgggaataggcattgcaatgagaatatgcatgctgtagtaaactatgaatattcagggaggtcaagaaagacagcagtttttcaaggaaaaatgaggaggatcacaggattgttttgagataattatcttacaaggatgggaccagtccaaggttggacaggcagttgcgggacagatgtcctcagaggaatatttttgtatgtgaggctgagatggcctgtgtgcaaggttgtggttttgcagtcttttgtgatggatttgttatcaggtctatgagcatgagaaccctcccttcctggccttctctggctctgtaacactttgttagggtttttaatacaagtgactccattttctttctgacaactttcacatttcccccttttaattgagatctttctccaaaagcatagctgaccagtcatcctgcagtcaggctttgattgccccttggtgctgggatggagctgtcccagtttggtgtggtctggttccacatcatcaggaagtgactggtgaccaggagtcagtgtcagagctcatttagccacatttgagcaaccagggaggtgtggagggagtggccctcaggcgcagtctacctgagtccactgttaagtacggttttgtctgttccatgggtgttggcatcatctcaacgcgctgggccagcacgattctgttaggagttgtacttctgcagagacttaagcaacagataaaaaatttataaagggaaaatgcagagtgaaattaataataatatgacaatcctagtttgcataatgttttgagtcatgaacataggcttaaagacaaccagttgaataaatcaaatgaccatagggaattgggtgagacttttta

SEQ ID NO: 33355 - DNA, 1033 bp, Homo sapiens
acctttttggcaccagggactggttttgtggaagacagtttttgtactgaccagggagcaggggatggttttgggatgaaactagatcatcaggcattagatcctcataaggagaacacaacctagattctcataaggagaacacaacttgcatgcacagttcacaatagggttcatgctcctatgagaatctaatgctgccactgatctgacaggagacagagctcaggcaataatgcttgctcacctgccactcatctcctgctgtgcagaccagttcctaacaggccatggactggtactggtctgcagcccaggggttcgggacccctgatctaagacaccattgccaaatcacatgaagatttttcccttgtgttttcttctaagagttttatggcttagcttttatatttagatatttgactcaattgagttagtttttatatatggtatgaggtaagggtcacattcttttgcatgtggtcctaacagcattgttgaagagactgttctttccttattgaatgaatggtcttggcccccttattgaaaatcagttgaccatggactcatagttttgtttctggactctcaattgtattacgtggatttatatatctcgtcttatgctaataccactccgttttgattatcgtagctttgtagtaagttttaaaattgagaactcctccaatttgttctttgttttcaagactggttttgaaaacagttttggctctttagggtcccttgtaatttccattttcggcaaacaaacaaaaagacctttgggttgctgacagagatggttttgaatctgtagatcagtttggaaagtgttcccatcctaacaatattatgtttttcaatctgtgaacacagggtatctttccttttatttatatcctctttaagttccttcaaaaattttttatagttttcagtgtacaaattccttcactttttaatgtaggcagtaaaccacagaggtattagtagtacttgtgactttgtcaccaatgcataccag

SEQ ID NO: 33356 - DNA, 1045 bp, Homo sapiens
caaattgttttgtccaaaatgtctcgtttattataatttcattgataaagcccttgattgtagcccagggactttcacatattggctgcctcctgttggacccacaggcctctattggtgattccaaatcagccgtgcatggcccttgatcccctcctgtagagggactgggtgatggtatctataaaccaacagaatagctcttttccagtaaatcccccacagagtccagaaaaatatgcaagcagtccttttacttcaagtttctacccacacagggtcaacagagggaggagaggcagaggcagctgccctagaagcagccatcgtcccagtcccatagccagtgtgaaatcttagccctcttttccttacacatggccgtggccgctcttctagtcagcaccgaaatctcctccctgaagagcttctttctcttcctcccttcttccttcctccatttcttggtccactgaagtccctggagatcccctgggtcctgtcctctttgagttgtcattgtctttgcttctgttgctcatgccagggctacaggaaatttgctgcgtccccctaggtactgttgtcagagtggactctgggtcaaagagtcagacctttcattggtgtgcttcaagtctaagctttgcaagctctttctctatgttacgtctgcctccttcctctttagtttgtcttttatttgtcctagccttgaggagtgaaggttccaggaaattgaggatgggaatatagtggaaaatccattccccacaggaaaatattctgaaatttctggcttgggtgacaggctgtcattgatagagctagataacgatgaaggtgatgataatgatagccaatcctatgtagcactcattaagtaccaagcactattaagtgcttgagggagaataaatcatacaatcctatgtggctcgtattcttgtcatatgcattttgttgatataaaaaaaaaatcaaggcacagaatgattaagacacatacctgaggtcatacagctagtaagttgcagagcaagaa

SEQ ID NO: 33357 - DNA, 1054 bp, Homo sapiens
ttccccaggaggatttctgtactagtcgctattgctgattatgctgtgtaacaaataacccccaaacattaatgaacattttttcctactcgcaggtctgcaggtcagctgaggggactctggcccaggatgtgggttcaggtctgcttttgtgtctctcattccagaaccctaacttagggcacaccatgtacctaggggatgctctcctcatggtggattaggagagcaaaaaaggacaaaaccacatgagcacattgaaagcttctgtttgcgtcgtgaccactcatgttccattggccatagcaagtcccacagctgggtctgacgaggaagattattcttcccaggagagggaaggagaaagcaagtatttgctgaacaggaatcaaatccattgcaccttctcaagccaaaactaggttaggagtcctctttgggcacccatggtccttaatgcatccttctgttacagctttggattctccattgcccttacctattccgttgtctgtcttccccagtggattgcaaaaagattgctatggctgagatgtgtaagtcttttatgagatctaggtgacagctgataagtgtagttatggtcatgatggtcaattctttaacagtttattaacaaaataacaaaagttacaaaatgaaaatataaaggataagttattcgaggactatggttggactctagttctgaacattatttaaactcgatgttaacatgctgtagataataacatatccacagaacagaagctaggtcttccattggccataacatatgcctctaaatgccctcccccctaccaaagtagcatccagaggtatgtgctattacttgagagatcattctgcaatttaaaatttaaactcgacaaattattaataccataaacatttcagtgtcaaacactgaagatgcaatgataacacctggctatcctgctcaggtagctcacaatctgaagggtagatggtggtgggagcagagcagttaacagataaaatgaaaagtagtaagtggagctcttatttgttg

SEQ ID NO: 33358 - DNA, 1050 bp, Homo sapiens
gtcaacaagctgctgggcaattctgtgcctcagtttcctcatctgtgcaatgaggttaataatagtacctgtttcctagggctgctttaaggatcggatgggatcatgtgtgtaaggtacttagaatggtgccagttgtacaatgcaaggtcgccataaatgttagttattgttattgttatcattataataaactaggacaatcatgatcatggacagcttcactttaggtcctaaggccgggcagaggtgagggaaatgaccccatttgtgaggtcctattatactctaatcacttccgttatattttttagatttctcctccccacatccctttgaggtagataaaatggtgttcatttaaggaaactaggctcagagaggttgggtgacctgcccaagatccacagctcatttgtaagaacaggatggacatggatcagctgcccaggtctctccccagcccctttccatggtggcctgcatctggcagatcaaggtaggggtgtcccggctctgccagcatggcccaaagcaggacaatgctgaagagctgtcccagctccagaagcagccccaggatcatccaaggccatggctggacctacactgcagttcagcttctctctctgtccaatcctgattccatcttctgtctccgaaataagcatcctgctcatgcatatgtaggtgtgggttggactgacagctttctcgggaccgagaactttcagcaccaaaactgggaatgtcctgggtctactgggaagagttggttccctgtgcatgctgaactccaccagagtctgcctcctggggaccccttctgtgactgcagctcacagcgagctcagtctggtgctcaagatcaggctgtgtccgccacgcaccccagagaagttgtagaaggaaaagagaagctcagggctgctgctgctgtccactttgctaccttatgctgtccagcttggggcaagactcggttctttcccagattgaggtgaaagtcatcaaggcactagaaggtgaacgcgcgaggtccagggctgg

SEQ ID NO: 33359 - DNA, 1031 bp, Homo sapiens
tgttgcccaggctggagtgcagtggcacaatcttggctcactgcaacctctgcctcctgggttcaagggattctcctgactcagcctccccagtagccgggattataggcacccaccactactcccaactaatttttgtatttttttttttttgagagagtcttgctctgttgcccaggctagagtagagtggcacgatctcggctcactgcaacctccaccgccgaagttcaagcaattctctgcctcagcctcccaggtagctgggattacaggcacctgccaccatgcctggctaatttttgtatttttagtagagaccatgtttcaccatcttggccaggctggtcttgagctcctgaactcatgatccatgaggatcatggcctcccaaagtgctgggattacaggcatgaaccatcgcacccagcccaatttttgtatttttagtagagacagggttgcaccatgttggctagactggtctagaactcctgatctcaagtgatcttctgccccagcctcccaaagtgctgggattacaggtatgagtcatcatgcccagctctttctatttcctatattgccctggcaaccatgaatctcttttctaatagtttatcttgcagatctttgcatatcagagcacagaacacttttttttttttttttttttttttttttttttttttttttggagagagggtcttgctctctcacccagactggagtgcgatggcacaatcacagctccctgcactctccttgaccttcctggctcaagcgatcctcctgcttcagctttccaagaagctgaaactacaggtccatgccaccatgcctggctaagttttaaatttttggtagagacagggatctccttatattgctcaggctggtcttgaactcctaggcttaagggattctcccaccttggcctcccaaagtgctggaattacaggagtgagacactacacctacctagtctttcctttttttatttgagtaataggtagggtctcaatgcacag

SEQ ID NO: 33360 - DNA, 1050 bp, Homo sapiens
cctctgccccttttcttctcactggctggagtgcagatgtgagggcaggagccagaggaaccatattgggccatgagtgggagtttcctgttaggcagagcaagaagacagaggaagcttgggtccctggtgagagagaaacaaacctctctctcgagtttaagccacgattattctgggtctctcttagagtcactatacatgaatgacagtttctgtcctcctgccagtgtgtgcctttcactaaaccagaggctgcaaagagacagccaagctgtttttactttctggatattgaatctcactctgtgccaggtgtggtcttgggtgctggagtgtggtgtggccagggcagatgcagtcaccttacctggggaccatcacacaagggcctgcaggaggggctgagctggaatggggctcaaaggtctcctgaggaggtaacatttaagctgagacctgcaggaggcagggccaacgcaggaagggaatgtagtgtcaggcagaggaaacaagagaatggcaaatttgcggcttggcaagaagttgtggatggaagtggagagtgcagtgacacgatcaaggctactgtgtcgctggccactttgtccaggacaaagtttaggataaaaactctcacaccaagagaacacagcctgccctaacttccccttctgggtgggttgtggtcattgggaaatatttagtgattggccgtttaacttttagaaagattcttcctagatttgggaccccgtgagaaattaaacaccaacctgcatctggaacttttcttcccagcgtcaatgttacgaagttatccagtgggtccctcttggtcatcccaagctaaccaccctcagggaattaatcatatcgctgttcctgccaacaacaatattcattcaggagaaagcaaacagtcaaaattgcacactgataagatgggtttggaagctcataaagaagagaattttctacagctagacaaattacaattttctcgccgggcacggtggctcacacctgtaatcccagtactttgggagg

SEQ ID NO: 33361 - DNA, 1047 bp, Homo sapiens
acttgcaccattcataggaaacacatgttggctggtaattgttttgaactcattttgagctgggctgcaccacgttgggctgcccttgcgttttcgcactggtttgagatggccgtggaatttgcaaggaattttcttcccaattccagaggctccacgagggggccgttccttggccaagctggcagaagagcactgtttggcttcctgcctcctggagggaagcactttccccttattgggagagggctgcccccagcgccccttggccccgcattcttatcgggagattggaaagaatcaaagggtctcacggccctaattgagcctgaagggcttccttccctcccacctgggagttttctcagaagaagaaataaaaggttgggtgattttcccaagagtttctgttggagttttacagctgcaaggaggcgtcattccgaatttgggtgtcacccagcttttcgaatgctaatatgcatacgatttcctggggatctcgtgaaatgcagattctgattcagtgggtcgggggtggggcctgagattctaacattctcgctgattgggctgatcagagtcccatacatgacgttctcagaccttcccttccagcgcatcagaatcagggctcgttaaaatgcagatcgcggggcccctcctgcagaggctctcattccacaagtctcgggtggaacctgaggatttgtgtctctagtaagctcccaggtcatgctgatgttgctggtttggggagaacactttcaaaccactgtccaaaaccaatgccctgagaagaagcgagcgcgtttttccatggggttccctactgtccaggcaccaggaatggctctgcttgagggcagaagatggggtttgactgagaaggtctaggctgccgttctccattggacgtattttctggagctgttcgcttaccctggaaggccccttttcttcctctctctccaaattgcctcccactcatttccaaagctcagtgccggcgtcacctcctccagggagccttcttttcctccaggc

SEQ ID NO: 33362 - DNA, 1027 bp, Homo sapiens
cacttgagtttccattcccagcaccagggtggtgccaagtacacagtgacgtgccactccctttggacacgtttattacatttactgtcctttgttccccctggaatgcaagctccacgaaggcggggatcttcgtctgttttgttcactgatatccccagagcctagtgccctgctgatatagtaggcacttgataatgtatttgtcggatgaacgggtaatatagtcactcacaggcagctttcaggatgagaatgtttgtctgatcctctcatttataaaaatcctcacaacaactactctccaccctgtccccagtgttgaaagaatctatagagtagaaataatcagcccattggctatttcaataatatatttagttctgaaaagctcttaattgactctgactcctctctgagtcctttccttagacctcccttaaaactctagcctggtttgttcactgtaggacgaaggagtttgggagactctggctctgaaggctgcctaggagcttggcaaaagcgtctgtccggagtcctgcaataaccacgcccctcacccctttacgaccacacccacttattcccgaccacgcccacgcatccctcctttagtcccagcccctgtccccttcaggaccacgcctaccccctccctgaccactcccatccctataggactagcctctcctcccctcaggaccacgcccctctcccattccaggccacgcccaccccattcaggacctcgcccacctcctcctcggaccacgcccgttctcctcacgcccacgcccagctcatcttccattcaggtcttctactgcgagtggacttttggaagcctctttgatggttgcagcattagtagtatttctctgcacacattatcctgacgccgattcagaccacgttcccttaccccctgactttgctcaaagagacagatctccatacttcttccctccatttgctatcttaactccacccaccatcatcacacgcatattgtaggaaatttaga

SEQ ID NO: 33363 - DNA, 1213 bp, Homo sapiens
accttctggacccccgtgccagttaccgtcctcattttaaaagggtacttggagccagacgcagtggctcacacctgcagtcccagcactttggaaggctgaggaggtcagatcaattgagcccagagttcaagaccagtctgggcaacatagcaagacctcagctctacaaaaaataaaaataaaataattagccaagcatggtggtgtgcacctgtagtctcaactacttgtgaggctgaggtgggaggatcacttgagccttggagtttgaggctgcagtgagccaagatcacaccactgcactccagccttggcaagagagtgagaccctgtctcaaaacaaacaaacaaaacagaagagaatttgacatgcagtttatctatccatgtcatatgcattgatcccagtgaagcagtcctcctccattctccagcctggccgcctctgggcacccttttccaggtggtgccactgggacaccatgaccatgtgaagctgtgcgcagacagccagaggcctccccctggagcaccagactccattgcctcttgctctcgggctttcctcactcaggtgttcaccaagtattgcagagagcttccgaagatgacctcaatgatttcctcctcctggtagtcacaccgttgtgtaagcccctgcccttgactgtgggctggacctagtgaatcatttctaaccatagaatatggcaaaaatgatgggatgtcacttctgtggttaggttcgaaaaaggccatggtttctgtcttgctagcagattctttctattgacttcttggcttgcatcctttgatgaaaccagcaggaggcccatgtggcaagaaactgaaggtgactttcagccaaaaatcagtgaggaaccggagcccccattcagcagccacatgaaactgaacgctgccaacagccactgagtgagtggacccttcccccttagagtcttcccatgacatcacagcccctggactgacacagcttgatggcatcagccagagaccgtgaagcagagcacccagataagctgtgcttggacttctgacccacagaaaccacgagataataactgttgtttcaagccactaagttttggggtaatctcctacaccatgatcaataactcacacagcacccactctcccactctgtgccattgtcctaaatgtcttctttggacaatttgcatctatt

SEQ ID NO: 33364 - DNA, 1051 bp, Homo sapiens
ggcatggtggtgcacacctgtagtcccagctactcgggaggctgaggcaggagaattgcttgaacccaggaggcggaggttgcagtgagccgagatcaagccattaccctccagcctgggtgacagggtgagactctgtctcaaaaaaaaaaaaaaaaattaggctctgccaatgagaagcacatgtgcaacatttggaaagcagaatttgctctggcagtggcagctggtgggcaggctttggcaggagtgagctttgcagtggtcatactctctatttatcagttcatgggtaagggactggtggggcatcagctggaattgcctacagtatcctgagttcagaatcaagcagagtgaccttgaagcctaaagcccagtaacagccttatcactttcactcctccagctcatccaacagttttctagcacctatttatttcctcatattgaatacctcgctgccaaaaatacctagacacatttctggttccttgactgaactctgctgatagagccattcactatgcaaagccctggggctacaggtgaacctgacataattaattccataacacgacactcacactctagtgatggagacagaaagttagaaagtaatgtcactacaatgtacctgtctgttagaccccactcagaggtgagtatacagtgaagcatgaagcttaagcttcagtgtccctcacttgcctgggtctctacccaggtctgagaaaggccttgcgattttgttttcacaattttctgggttttgtttctctttctttttcttttcttttctttctttctttctttttttttttttttttttgagagagtctctatctgtcacccaggctgaagtacagagacgcaatctaggctcactgcaacctccgcctcctgggttcaagcgattctcctgcctcagcctcctgagtagctgggattacaggcacctgccaccaagcctggctaatttttttgtatttttagtagagacagggttttaccatgttggccaggttggtcttgaaaactcctgacctca

SEQ ID NO: 33365 - DNA, 1152 bp, Homo sapiens
agacccaccagttgtatgaagttgggtgagccattaaatcatggaagcattttgtactcatctacaaattagggataaaaatagtttccttcctcttgacctcacatggtagccatggcaattaaatccatacatgtatacagtaggtgagcaataattgcagtcctaatgtgaagagcgatttttctaaagcattagtatgagcaagttctatcttttattcaaattctgcggtggttttcttgtgtcttcattcattcattcacttattcaacatttactgagcatctagtatgtgccaggcactgttttagataccagggacaaaggaacaaaacaaagtatctgttttgaacttacaatataacagagaaaacagacaacaagcaagatgaataaacaaaaatggaataagtaaaacaaatagtagagtcctggagtgattggggaacacaggatgcccttgagtctagagtgagagaaagagtgggactataaaaaatgaggactgaaagacagtgaggggttgggggatgcaaagtctcatggcttttactctgcattagatggaaaagtcttcggaagattttgagcagaggagagacatgatcagattatattttaacagaatcactctgattgccaaagtgaacacactgcagtgacaacaagggcaaaagcagtcatcccaggtagaggagatggtggctgggaccaggtgttgttaggaaagtggcgagaaacagtaggatatgatagttctgttatttgcacttggttgcgtctgttagcttgctgccactgttttgtgactgtggtgtgtgagcttatcttcagcggacataccttgcagctaaggttgagggatacatctccaaggaaattttgcatatgcttcttctgggcatctcagacactcatcctcatcaacactgggctactaccttaatttcgaaaacagtcaacaaatattgattcatgagatgagcctggccttttaggtaaatttctctgcttcaagtttcatcagctacatggggagtatcaatgctaatagtaaatatgaatgcagacaagctatgggtgtgaaatcttttttctaaatttttttttttattttcataggttattggagaacaagtggcatttggt

SEQ ID NO: 33366 - DNA, 1057 bp, Homo sapiens
acaaccagaagttcttgaacaaaattactggtcagccaaactggttttttgtttttgtttgtttgtttgtttgtttttgaagtaacaggctatatgttttagagcagttttaggtttttaggaaaattgaatggaaaatacagagctcccgtggcccctcccctccattcccaaaagttcttattatcagtgtcctgcattcacttgatgcatttgttacaactgacgagagccaatatgcctactttattataacttaaagtccacagtttacattggggtttattctttgtgttgtgcattctataggtgtggacagatgtataatgatactgatcccccgtgagagtgtcatacagaatcatttcactgtcttaagactctccagggcaccatctgctcatccctccctctcctcatccccaactgccgggaaccactgatctttctactgcttccgtagttttgcttgaagttttgccctgcatggcttattgtaccttgggatataagccaataatagtaggacatgtaatgaatttataaagaaaataatcaatatatattaatggcgcaaatttgttttactaaatgaggaccagatccaaaaaaacatggagactactgtcctagagatgaactgataactaaactactttctataagggtctacaagctattttacaatttgaaataaaaagttcatattttaaagatattatgttctaaataagaagttagaatattttaccacagagggatgaatttttgaatttgcaaagtgtctttgcctccgttttctcattttactcctttgtggaatgagaaagcaaggtgttttttatctctttagtggcaatatttaagtgactttcttggcctgtctccctttcttcctctccctctctttctctttctcttgtagtgatatgtgcaataacagaagttttttttccattgacctcagcttatcttatgactctcccagttttttcattggggataaacgtgtttttgccaattccagataactcagtcactcctagtttaaaacaca

SEQ ID NO: 33367 - DNA, 1031 bp, Homo sapiens
ttagtggggaggttaattttgtgttctattcaggccttcaactgattggacgaggctcactctcattatagatggcaacatgctttactcaaagtccaccaacttagatgtcaacatcatccccaaacaccctcataggaacatccagaaaaacgtttgaccaaatatctgggtactatggcccagccaagctgttgtgtaaaatgaaccatcacagagtgttcacagggaaggagctggtttgggcagaagttgagatctattcagaaaattattttggacccagtcacccttgcaaatggtgtgtttgagggaacaacagctaagcaaaagatatgggaatgtgaactgcaagatttgtattgttgatgcctagagtgagacagcatggtagcctccataagtaggtgcagcccagcagcaggagcaagtgtgttaggcaagctgcacagagtttgtcttcaacagtgacacctgtggccatgcaaggcaatgacagcagtaaatagatcagactccgcttctccaagtgaacctcagaagcaggaatgaccccttctagactgagcaagcctctaagtatttcaaacgattatgatacaggtgcagggtgggttcaggtgtgtggaaaggtgacctcagagggaaaagagcttctgctagttggacacaaaagcctttggtgattgactggcaaagttcagaggtgtccactgtgcccggagttggtaaaacaaagaatacaggttgctacataaaaattaataagggatgacttcctcccctcactttccagcatgcataaaaatagcagaagctttagcagagtcccccatgctgtaggtgacagagcttcagcagtgacttcttcttgtttcccttctggcttttcccaggaggcagcttaggtttgaagcagcatttcactttccatctctaaacaagtaccatatgtttacaactttgggagttctcactcctctttctggagtcaagggtgttccctgggtggtgagggaaagggtgtgtgc

SEQ ID NO: 33368 - DNA, 1028 bp, Homo sapiens
aaatttgatgaaatctttaacacacagagccagtgaacccactgcaaaaaaaaaaaagaagaaaaagaaaacattatcaaggttcatcataattaaattgctttaaaacagtgataaggagaaaatctcaaaaggaccctgtaacaaaaaagacattacatatagaaaaacaatgataataatagctgcagatctctcattggaatcaatgtaagccagaaagaagtggagcaaaatatttaaagaactgaaagaaaaaaaaaaggttggataaaaatcttatgaccagcaaaaagttctttataaagaaaggggaaataaaaagagaggattgaaaaggacatacaaaaattaaaagcagcagagcaatattacaagaagtattaaaggaaattattcaggcaaagtaacatgagatgggatgaaaacctggatctacacaaagaaaaaatgaacagcagaaatagtaaatgtgttggtaatgtaaagggtttcttttctaaatttctgaccactttgaaacataattggcagtttatattttaaaataacaaccgtgtggtttataacctgtagaggctgagtatgtaacaacagcagcacaaaggctaggaggtggttcattcttatactacaatgtgaagcggtgcaatactacttgaaggtaaaccgtgataggttaaaaatgtatactatcaacactaacgcatcactagagaaagaaaacattcaacttttgccaaggtgccaaggcaattcaataaggaaaagataatctttcaacaaatgatgctgtaacaattggatagccatatgcaagaaaatgaaccctgacatttacgctaaagcatgtgcaaaaactaacctaaactatatcataaatctaaaatgtaagagctaaaactataaaacttcaagaggatagcatagaagaaaatcgtagtgatctttgatttgttaagatttcttaagtaggacacagaaatttccaactataaaagaaaagtatctaattgtatttaatcaaa

SEQ ID NO: 33369 - DNA, 1069 bp, Homo sapiens
ctccatctctggtctgcgggaactactcctagaatcccgtaggagcgaagtgttccggggaaagtgtagaatttgatttggattctatgccacaaaactgcctagccccacactgaagcactccgtgggcactgataaatgtttggccaacgcgtaaaactaaatgtgcccttgggctgggcgcagggcctctttctgcatgttcgtcaactgtattaacatccacctttcctctggatggccctgggaggaggcccgccatgaaggccttcctaagccgccgggcagcacaaaggtgatttcacatcttcccagctgtttaggcctaagatgtggacatcgagccttcaacgtgggtatttttctcctggaatcttagtttcttcatttgcaaaaagtagacaggaacttctcccctgcggggttgcaatgggaattggagaaaatatatttcaagtgccttgcgcgatgcccggcaccgaggcacttggcggcactcaatatctggtattgtttggctattattactacttcttgggctgatcatgctccaatgcttctctcttaaccccttgctttttttttctttcggccctcagggcggctgagccccccagcctgcaccctccgcaaacacaagacgaaccgtaagccgcggacgcccttcaccaccgcgcagctgctggcgctggagcgcaagttccgccagaagcagtacctgtccatcgccgagcgcgcggagttctccagctcgctcagcctcactgagacgcaggtgaagatatggttccagaaccgccgcgccaaggcaaagagactacaagaggcagagctggagaagctgaagatggccgccaagcccatgctgccaccggctgccttcggcctctccttccctctcggcggccccgcagctgtagcggccgcggcgggtgcctcgctctacggtgcctctggccccttccagcgcgccgcgctgcctgtggcgcccgtgggactctacacggcccatgtgggctacagcatgtaccacctgacatagagggtcccaggtcgcccacctgtgggc

SEQ ID NO: 33370 - DNA, 1064 bp, Homo sapiens
agatggaacctccagaggcaggcaggcctccttgagctgtggtgggctccacccagttgcagcttccaggctgctttgtttacctaaggaagcctgggcaatggcgggcgcctctcccccagcgtggctgccaccttgcagtttgatctcagactgctgtgctagcaatcagcgagactccttgggcataggaccctccgagccacgtgtgggatataatctcctggtgagccgttttttaagcccgtcggaaaagcacagtatgcgggtgggagtgacccgattttccaggtgccatctgtcacccctttctttgattaggaaagggaactccctgaccccttgcgcttcccaagtgaggcaatgcctcgccctgcttcggctagcacatggtgcgctgcacccactgacctgcgcccactgtctggcactccctagtgagatgaacccagtacctcatgtggaaatgcagaaatcacccatcttctgcgtcgctcacgctgggagctgtagaccggagctgttcctattcggccatcttggcccctccccccaccggcagcttagaattttacttttcttcctcagtctgctaaccaggcatcttgggagagtttgttcattcattcattcgttcattcattcattcattcaagtattgttaagcacagctttgtgcagcatgtgtatgcttggcattgcagcagcagcagcagtgaggccagtgtaagggcagtggggaagctggggaggaaggtagggagaaaggggcagaagaggaggggatgagtccagagcgcctcatcttggaagacgttgcagactgttccaagatagttgcatttacttctgagtgagacaggaaatcaccagcatgttttgagtagggaagtgacttgctttatgttttacaaggaccagtgtggtttccatgaggaaaacagactgtaggggcagaggcagaagcagggagccctggtaggagactgctgtggcccgtgtaagagatggtgctgactgacggggcagggagaaagcctggagctttgtgtttgtttggacga

SEQ ID NO: 33371 - DNA, 1050 bp, Homo sapiens
atggttttgaggagatgccagagttagagagctcactgtgggaggagagcaggtgtgaagcttggcaaggagagcagatgtgaaggttggcgaggagagcaggtgtgaagcttggctgagtggggttgagagggctctaaggtgacgggtgcatcccaaggctgtgcgtgtgtgcgtgtgtgtgtgtgtaggagtgtgtctatgtgtgcaagtatgtatgagtctatgtgtgattcatgtgtgtatgtgtgcacttgtctatgcatggatgtatgtaggagtgtgtgcatggatcaaatgtgaacgaaagtgtgcatgtgttcctgtgtgtgtgcatgtgtgtatatgtgcctgtgtctgcatgcatatgtgtatgagtacatgtgcatgtgtctgtgtgtacaagtgtgtgtgcatgtgggggagttacttgtctgtgtgtacaagtgtgtgtgcatgtgggggagttacttgtatgtgtgtctatgcatgcttgcatacgtgtgacttgagagttcctgtctgtggatctccttgtgtcttgtgggaggcttgtggaggagaggcagagagcagctcaggccccacacagggtcctgccgtgacctgtaaccccatctgtggttctccgctccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgcgggcatttgggaacccaggggctggggtctgcattttagaaacacacgaagaagcgtgagagatctcacgtcctgaacacccactagtgcctattgtaggtgctctacggagatgactgttgcctccctttcacaatggcccaccacaggggtgggatgagagagcagagcccttatctccctcaacaggaagtcg

SEQ ID NO: 33372 - DNA, 1021 bp, Homo sapiens
aaattgcctttcccacattgttttctatccaaaaagacagtgggtcgtttcatatcccattgctcagggaagttattaaaaattaatggaatttgtgaattaccccgttagaacaggttgtagaatggtgtttctcaaaatttaatctgctctaatgcagatttctgctctcagtccccttgcggtaggcagctataatggccccccagagaggcccacatcctaatccctaaaacccgtgaatatgtctggttacaaggcaaaaaggactttgcaaatctttgcgaatgtgattaagcaaaggatcgtgagatggggatattctcccgatgatctggcttggccccatgttatcacaagggtccttataagtgaaaaaggagcagcagtgccagagtgaggagtgaggaagactctgcagccattgctggacttgaagacggaggaaggggctgtgagcccgggaatgcaagtgccctctaggaactggaaagggcaagaaaatggattctgccccagaccctcggggaggagtgcagacctgccaaccctcatttcaggcttccgatctccagaagcgtaaggtaataagtgttgttttaagccaacaaatttgtaataaagtgttatagcagccacaggaaactaacacaccagtgagtaggagtggggcagggaatgtggcagttggtgcactccttagcataacagtaaagaacaccagtgctagaggcagtctgtctgagtttgaatcctggctccccacctcactctcctctccctctggctctgcaccccactccgggtggttttcatcatttcatcaccaagtctgctctcctctgtgccgagctttcaggcctcctcttactggacaaggtggtgtttggccaagttggtctctttcctcctccttgaaacacccgcttgactctcttgcttctcctcccagctcacttctttctccttctcagtctcctttgctggccccttcccagctccttaatttctgaacactgga

SEQ ID NO: 33373 - DNA, 1805 bp, Homo sapiens
gggctttgtaatgtgtgttcttttaaaaacagaggagattaatagccctaaaaacaagacactgtgaaacaaaacaagacactgaaaaaatatactttatgaatgaaaattatagtaatgaggctgggagtggtagctcatgcctgtaatctcagcactttgggaggccgaggcagatggatcacttgaggtcaggagttcaagaccagcctgtccaacatggtgaaaccctgtctctactaaaaatacaaaacattaactgggcgtggtggcgggtgcctgtaatcccagctactccagaggctgaggcaggagaatcgcttgaacccgggaggtgaagcttgcagtgagccgagatctcacaggagatcacttagcctgggcaacagagcaagactccatctcaaaaagaaaaaaagaaaattatagtaatgaaaacagaaatctaattggattagttaatggaatagcagattaaattgtggctaaagaaacaatgtgcgaactagaagataaatgtgagaaggtggtcctggaacacagctcagagatctaaagagatggaaaatatagaagaagagacatggagaataggatgacaaaatcctataggagtagaaggtatctaattctgaagaaataaaatagacaattttcaaaacagtaagtgagaacagagggagtgagagggaaataagaaataatattgggcaaaggaacattgatgattcaaacaatgaactgaagagtttagaaaggagcgctttagatgaagagtttagaaaacagcgcagaaccaaaataatgaagagcagtatccaggaaggcagagagaacactggaatcttatttctccttctagtctggaggagggcagaagtatgaactttatatttacaaattaaatatacaacttaaaaactgaagagtaatcacctgggagagaaaagaatagcccctcccatccaggagccagcttgttactcacagctgggcctgggtgttctcctattgaacaaccaaccaccgagcatccacatgatgaggcccctctgttacatgaaagatggagccaaaaatgagaccaccctgccaccatacctgaacacagacccaacgtgaacactgtccaactccccacccctgaaatgcccagacaccccgccctggctgagccaagcctggcttcattaagccctccccagcccacacctgggcctttctaacccctctacacattctcccttgctgcatcaagtgataacccaatctgttcagccttaggggagctctgatggcctgtgcagtgcattgacagagtaaaataactaagcagaatatgtgacttccaaggtagagaaaaaagtattccaaaatgcaggttagacacctaaaaaatgatgaatccaataaaagagaaaaacattgggaagaatgcacatttcataatatctagaaaagacaagattagatggtgggaaataagtccaagcatcccattagtcacaataaatactagcagatccattcagattgctaaaaaacacatttcctaatctagctatgtggcattacaggagacacagctagatcatcaaaagttagaaagtcaagttaaggaaaacaatatcccaggcaaatatccaccaaaagagagtgcatgatactaagatctgatgaattatactttaggcagaaaactttttttagggataaagagagtcattgcatagtgtaagaggaacatacaacaatttagccacaaaacacatgaagcaaaattggacagacttgaaagacaaaca

SEQ ID NO: 33374 - DNA, 1031 bp, Homo sapiens
cccagcactttgggaggctgaggtgggcagatcgcctgagctcaggagttcaagaccaccctaggcagcatggtgaaaccctgtctctactaaaatacaaaaaattagctgggcgtggtggcaggtgcctgtaatcccagctacttgggagactgaggcacaagaattgcttgagccccagaggcggaggttgcagtgagctgagatcgcaccattgcactccagcctgggctacagagtgagactccatctcaaaaacaaataaacaaacaaagaagaggatggaaacataagtaggctcggaccagggacacctggtgagccatactgaggacaacagagagcgattggggaatttgtctcgcctgaaaacctgtgtcttttaattgcattaatgtttagtccatttatgtttaatgtaaatcctcatgctgatatatatttgggttttcatatcagtttatgaaaattctcagatgttttccctttagatcttcccctgcctattctctccctcctctctttctgggactccagtgacaggatttctgaggcttttccactttatcccatatgtctcttacatgctcctctgtatttttcattcttttcttctccgtggttcagcatggatattttcctttgaggtatcttccagccactctctcttcagccatattttatcaggtgctaaacccatctcctgagttgttcatgtcagttattgtgttttcagttctaggatgtccatttgattccttgtatagtttccagttatctgctgaaattcttcgtcttatcatttaatttctggaacatattaatcataattagtgtaaaggttgtgtctgacgattctgttttctgatatctcgtgggcatgtttctattgtctgtttttctctttatttttagttaattctcgtctgggtatttttattggatgatgaccactaagcatgagaaattgtagataatttaagacttcaaatgatatgatcttcttccagagaggatttatgttacttcta

SEQ ID NO: 33375 - DNA, 1051 bp, Homo sapiens
gtcacaagagaaagagacacacaggaaccaagaaactacagagaagaccagaggaacaaaatgttgaaagctggaaagcagatgtccaaaaggtgatggatgtgctggagctggaacagctaaatctctgctggcagtgaggagagcaaagccccttatgtgccactcaggagctgggggctgcaggctggacctctctcacactggtgcaggggtgcgtgcacgctgggaaactgtgtagcagtaaccactaacgctgaatctacacacaccctaggacccagccattcctctcttaggtatataccagctaaagatgtgaacctatggttaataaaaggctgaacaagagtggagcaagaacaagcacagaagcctcacgcatcacggttccaaatgtgaaactatccaaatatccaacaactggagaatacattgtgcagattcgtgcggtggaattctacacaccgatgaaatagaaaaagctagtgctatgcctggccaaagatggatctcacacgcctcggattgagcaaatggagccggacataagacagtgtgtgctgtatgcttccatttttagaaagtttaaaatcagctaagatttgtgtggcagcaacttctaagatgactcccagtgatcccgcctcctgcttttcaaggccctgcagggtcccctcccctggagtgtgggctggacccagcaccttgcttctgatgagcagaacaagacaaaagggttgggctgtcactcccgaggtcaggttacagagactctggcttccgacctgctcacctactgctttttggttaatctgctctgaaggaagccgcctcgctggggctgcccatgtgcaaggaaccgagggaggcctctggccagcagccagcaaagaacagaccatcacattagcctgacagctagcaaggagctatatccagaaatacaccacctacgagaggctggatgcaaatcctgcaccagttgagccttgagatgctcaccgcccccaacctgccactcactatggcctgtgagaccctcagccag

SEQ ID NO: 33376 - DNA, 1047 bp, Homo sapiens
gaaaaccgccgggcgggggaggagggccgcaggcgggcggggccgggaggccggctgagcgactggcgcgccggcctatggcgcggggcgcggcgcggggggcgggcctggcgggcggggccggtgcggcgcaaggtttggcgaaggttacagctggagctaggagtgacaggcccacagtcatccgtgcgctgcgcggcaaaccctgtcgcgagggcgccccgagttgctgcggggcctgatccggctcctttccaacaatacgcgtctgcagccggcatttctagagctctctgcttcttcccgctggagaaaccagtgtgtgtcgtgttggaatgcttcgtcttgccctagaattcagcttgcgtcttgtggtgcgcaggtgacaggacctgccgaactcttggtacagacccctaaatcatggcagaactgtcttgatttcttttttgccacctttccgtttttgtcctctataggcaagctataaagatttaacccagttaaaaacaggagggagattcagcggagaggaggcatgcgagattctttggaaaaaattatataaatgtagttcttgctaataattacctgggttggatactttgacttactgttcaagttcctaagaagggattttacatttctgggtcttgttttaaaaactgttagaaagctcgtgagggggtagggacaagcagttttggtaataggcgatgctgtggataaaactgtgcggtaaaatgcccaagctagattcttcctatgcaaaataagacccgttccagaacactttgaccatttcgtggacttagaatttaaaggcgggtgagggcggggggggaggaggagcggattctatcactctgcatcctcaaggtcaaatattcttccatcagttattttggattgaaccattcttaaataggtctcaggatctctatgtcgcttccttatgacagaacctatttccgagagtgtgcctttgcatatctatagaagctcctttcacttaatatatcttataactcagattcaattgctgta

SEQ ID NO: 33377 - DNA, 1046 bp, Homo sapiens
gacctggtgggaggtgattgaatcatggggacaggtctttctcatgctgttctcatgatagtgaatacgtctcatgagatttgatggttttaaaaaggggagtttccctgcataatctctcctcttttgactgtcaccatccatgtaagaggtgactttgctcctccttgccttctgccatgattgtgaggcctctgcagccacgtggaactgtaagtcaatgaaacctctttcctttctaaattacccagtcttgggtatgtctttatcagcattgcaaaaacagactaatacacagatctactttaggtacagatttgctttaccatgttctttttttaatatgcctagtattaccttgtgtgaaggtgcctgaatttatttaactagttgatatgaagagtttccaggtttttgttatttgtaacacagtgctacagtaaacatttttgtacatatgtcttagtgaactttcatgagtaaccaccttactctcagcagccttaaaaaaattgaccaacaagtttctaactactctgaataatcatttgtcatgttaaaaattttcttggtggctatattagttttactacttttgttaaggccggatgttttgttttctgaagtagtcctgtgagataatttcatacaattaagcacagattttttatattgcatgtagaatattaagctcataaagtttataaaggcacagggttggctttatgagcctgtaattgcatcatacagggcccttgcttgcttcagtgatctgctgttgtagtcttgatagtcttaggtttttttttttttgttttttttttttgagacagagtctcactctgttgcccaggctgtagtgcaatggcatcatcttggctcactgcaagctccgcctcctgggttcacgccattctcctgcctcagcctcctgagtagctgggaccacaggtgcccaccaccacgcccggctaatgtttttgtatttttagtagagacggggtttcaccatgttagaatggtctcgatctcctgatctcgtgatc

SEQ ID NO: 33378 - DNA, 1030 bp, Homo sapiens
gcagcgaactatgattgctccactgcactccagactgggtgacaggacgaaaaggaaaaaaaaaaaagagaaaggtgctattaagtggcttacagtgcttaggactttaattagcatatccatgtttttaaatgtagaacatagggttttcataaagtagaaacgtggattctggtttatttgcagtacaaagaaaaatacagggcctgcgaggatgatcattttgtgcatgtgctgaaatcatactcttttagctttagaagttatttgtatacatgccaccattaccttccagataaagtttgtatccctcactgtgtattgcacataataaatacccactaaatggtggtgggtatttatttatgcaataaaggggcccttgatcctgatagggctgttagttccttcatgagtgtcacaagttgggttctctgggaaggcgggtactttgggaagcaaatgcagacaatttagcatgcagaatgttgattagggcttgctcgtagggtccagactcagggaatggagaagttgaactaccttgcatgcccaattatagcatagccttggccaaccccattagaatagcccgtgggagctgtcccggcttgggctgggtagccaggcctgtacgctctctgagtcagtcaggatgacttgcctggaagagggcaagatgtcgggtgaggcagttctctgtagccacagcagtacttgaaggggctgacggagcactcccagcagctggggctgcatggccttcagttgagggtctgggttgtacatcacagcgtgccatggttggacaatatttttcttagaaattttttgattgatttcatttgactcattggttggcgttctggagaaatatggggtaagtctctttctctttctctgtgactcttctcaaccccccccaacccaccagcccccttactaaataactatgtgtgtgtgtgtcttatgtacgaacagagttacagtgcacaattaaccttttcttctgatggaagttgactccaac

SEQ ID NO: 33379 - DNA, 1051 bp, Homo sapiens
attttggtgaaaagtaatagagtccaaaagccagagtcttaatatttcaaatatctgttttctttatgctcttttctatattctttcttttactttatgttatatatcctttatgccttccccctcaagtcttttccttatgtgaaagtcctgtaaacacccaaattgaataattatgaaaagacagttgcaggtaatgcagtgtcttgggtactgagcacaccagcaatgtgagtatgaactttgtagtgagaaaggaccagttaaaaatatagagagttcaagcatgacttgcagaagtaccatactagatcaaagggaatggtagagggcttctgtgggaagagtacaagttgctttacataaggcgaaagcctgctaatacaggatggtaaatacctaaaggaaaatcctgagagagtcatgattgtctcgatatcactgacaccaggcacagtgccttgtacacaagaaacctctagtacatgggatcgtgagagaatgagttaaaattcctatgttagttagtccctgcctgtggactcagagtgtgatctgagttggttttttctcccacctgctagtattatgaatatcattttatttaccaaacttctctttttcagaatttattctcctccatttagatttgggaagtagttagttcagcacagttttgatcacctgccaaggcctaagcattctactaaatggtacatgtggaggatgtcacagtttggcctgaagaactttaagcctatttgatgaggaacccattcccaggaggcagttagagaatagtataaaaggacatcatcacaaggcagcaggtcatgaggacagccagcactctataagtgttgggaggaagacagtggtatgcccttacataattagaaagggcttcttcaggaaggcagggcaggaatgattccattgccagttgggtgttagtgtttcagccgtgtctgtgctttctgaaacttttatgatcctattattattgtctttgatagtttgtctgtgtttaccagaatgctggtttcaataa

SEQ ID NO: 33380 - DNA, 1048 bp, Homo sapiens
ttactattcttcatataatcctattagtaacagaacttgtaatactaagcatataaaaacaatttgagtgtggtagtctttaacaataccttcaatttgtatgctatttggagaaatgcacataccccaaaatacacagatagacttttcattttcccatgcaacagacttgtgagaggttgaaaggtaggaagagtcagtatacattattctgttttacagatgagaaaacaatgaccctgggaagctgtgggcacaaaagccagctattaagtggcagaggtgggactgtgtgcaaaaacctaagatactatgattgctgaactagtgtactttccactcgccatcctacctccgtgaattaaagataactcaaatgatatataaacttttatgggaactatctatattgtttttacatttttaatagaaacgatttaaactttaaagtaaaaaagacaaattttaaaataagtgtttccatgtgggaatacacatgaattaggatgatttgggctaattttgcataagagaaagataagatgatttgaaggtccttttctcttggcacaagcctctgaagagggaagggaacgttaaaaaaaaaaacacttgatatatagtggtgctttttctttaaaacttttttatagaatttaaactaaaatttaacttcgtattgactaaattccatgtttggaatgagtgtaaaggcagatagacagtttgaaatttgagtgtttgccagttgtgttcctcatcatgccaggtgaataaacatgggtttttgcctgtgcttgtcaaaaccagcactgaccctcagtgctgtgaccattagaggtaagtttcaccacggtggatcatacgtgaagtaagttttaattaaacagataattcgtgaaccaacatacctaggagtctcctttcagttcacaactagaaatagtctctaatttggtcaaatgtttacccctctaccaaaggcttgctgcttaggtagagaaagcttagtgcccggtattctgtacgtgggtcatctgctaacagt

SEQ ID NO: 33381 - DNA, 1031 bp, Homo sapiens
tcttctgatatccttgtatcctctgggtttgatgtatatattattggattcaattacctgaaaatttgtgtaaaatttttgcatctgtactcatgaggcatattggtcttctttgtttcttataatgtcttttttttgttttttttttttgagacggagcctcgctctgttgcccaggctcgagtgcagtggcgtgatctcggctcactgcaagctctacctcccgggttcacgccattctcctgcctcagccttccgagtagctgggactacaagcgcctgccaccacgcctggctaatttttttgtattttagtagagacagggtttcaccgtgttagccaggatggtatcgatctcctgacctcgtgatccacccgcctcggcctcccaaagtgctgggattacaggcgtgagccacctcgctcagcctgtttcttgtaatatctttattggcttttggtatcagtttaatgctgtcttcataacatgatttgagaagtattgggaaagtttgtatagaattggaattacgcttttcttaaatatttggtagaattcacctttgaaactatatgggcctagcaatttctttgtgaattttaaactataaattcaattccctttatagatataggactgttcattctgtttcttcttgagtaggctttggtagtttgtatctttcaaggaatttttccatttcatttaagttattgaatttattggtataaagtttttctaatatgccttattctcatttttatacctatagaatctgtagtgatctcacctctctcattcctgatactggtaatctatgtcttctctctttcctgatcagtctggctagaggttaaagaacctgtttttggttttattgtttttctgctttctatttcactggtttctgctctgagcttttttctgcttagtttaggcttcgtttgctcttctttgtctagtttcttaaggtgaaaactgagatcattgatttaagaccttttctaatgtagacagtgctctacattt

SEQ ID NO: 33382 - DNA, 1056 bp, Homo sapiens
gtctgaatacattatgtacattgcaggaagtgatgctgtgctctctctacagaccagaaccccctgggaagaagccagtgattacaaaagctgagagtgctcacagttgttgtgtgatcacagccagtcctgcctgaggaagcctaagtcctatgtctttgggtatatagatggcagtggagctggagcatttgaggacacacgggccatgctagggacttgggcttttcccctgagcagctgtgaagtgttagggtttggagaggagtagtgcaacctgacttacttgccaatcagatgctgatcagaccatactggttgctgcactgagactaactaaacacggtgagtgagctgtgctggagggacagagggcagattgtgagcacccagtgaagatgcagttgcaggggtccaggaggcagatggctgggggattctgcatctgttttcgaagatggaactgtcaggattagatgtggggtagagataaggggaggagacaaggaagacagccaagggttttgatctgagcaactgcaagaatataattcctggcccggcacagtggctcatgcctgtaatcccagcactttgggaggcaggcaggtcacttgacgtcaggagtttgagatcagcctcgccaacatggcaaaaacctgtctctactaaaaatataaaaattaaccggacgtggtggcgcccacccataatcccagctacctgggaggctgagacaggagaatcacttgaacccaggaggcagaggttcccgtgagctgagatcgtgccactgcactgcagcctgggcaacagagcaagactccatctcaaacaaagaaaaaattagccggatgtggtggtgcatgcctgtagtcccagctactcaggaggctgaggtgggaaaattgcttgaaccaggcggtggagccaagatcacgccactgcactccagcccaggtgacagagcgagactcggtctccaaaaaaaaaaaaaagtaatttctatttactaaggaaaaggaacctaaggaaggaacatctttgtggtatgaa

SEQ ID NO: 33383 - DNA, 1003 bp, Homo sapiens
ttaaactttctataaattataccatactctatatatttttgtaacttcttttagttaaaaattttaaaattttttctatattgttaacatgatcttataatgtcttcattcttcgttcctaagtagttctccattgtgaactatgtaacactgtttattctcctggtaatgggcctttcaattgcttctcattttgggctattaataaagaaagtagaaaggaacattctttttttttttttttagacggagtctcgctctgtgccaggctggagtgcagtggcgttatctcagtcagctcactgcagcctctgcctcctgggttcaagcgattctctgcctcagcctcccgagtagctgggactacaggcacatgccaccacgcccagctaatttttgtattcttagtagagacgggatttcaccatgttggccaggatggtctcgatctcttgacctcgtgatccgcccacctcggcctcccaaagtgctgagattacaggcgtgagccaccatgctcggccgaaaggaacattcttacctgcttatccttgtgcgtatgtacagtactttttcttgcatgtatacttaggcatcagattccttgactgaagtcagtgtttttttgtaactgtcagccttatagactggagtatttgatgaaagctatggccctaaccagaatgttatacttaaacttttcttatatgaattactttgttacatgcccattagtggcctccttaagagttcatccttcctagattaaaaataactggtctaagttgtgactattcttcttaattgaaccatgaagtgaaacaagtagtatccagacattcagctcatagctttctgagcttctgtagccaaatatccttcaggaagtttacttgttagatatctaaagggaaaagaaactgccatctccatatgaaagtaagaaacaggacttttttgcatatcataaaaaatagggtttgcctgggtgcgatggctcatg

SEQ ID NO: 33384 - DNA, 1084 bp, Homo sapiens
agttagctagggctcagctgggaggttcttctgctgttcttgcttggggtctgtgatggcaggtggagctgaaacatccaggattgctttcctcatgtgactggtgcttcagcaagcatggctgggagctgtgacctttcaccacatggcagatggagaacactcagaaggtagcattccaggagggcatctgtcacactcggcaacatcttattgtgaaacccagtcactgtgggaggggcccaacctaggggcaagtgcagggaggcacagttcattgggggccccagagtaacagcctttcctctgacagttactttctggagagattaagtagacagcttctggactttgggatactaggcacccctgaggcaaagcatgagacaccataatgaaaattggggactgactgattcccccatccctttctggtgcctgactgacaaataggtttatcttccaaagatagaagtgtggaagatttcttaacgaggaagaggttgctggaaagaagaaacatttgagggatgagatgatcctttaaaaattataaccatgataatagaaatgaaaaactcaatagacggtttggaaggcagctctggaaatcttccagaaagtagaacaaaaagatgaagaaatggtaaacaggtgacaaaagaaattaggggaccagtacaggaaattcagtaaccagctattaggaaatgtgtccataatactagcacccttttccagatgtagaaactgaggctttgataggtaaatgatttatgtagggtcatgtggttaaccctggggtgaaatttagaaccagatctctttgactccattgagccatgtgcaaatggaacaggcagttaacactgagtatcatgtaggttagtgatcacactatggcggcacctgtccagcatttagggaatatccagtctaaatgaaccctccataaaagagaaacctgtaagatgattaatatggcacagaaacctttgagtatggagaggagagatgaggcagaataagtcaaattgcctttcttttactttacgcttaataactaaggtccaagttgagaagg

SEQ ID NO: 33385 - DNA, 1035 bp, Homo sapiens
tgcatgttattggccgggtgcagtggctcacgcctgtaatcccagcactttgggaggccgaagtgggtagatcatttgaggtcaggagttcaagaccagcttggccaacatggtgagaccccgtctctactaaaaatacaaaaattacccaggcgtggtggcaggcacctgtaatcccagctccttgggaggctgaggcaggagaatcacttgaacccgagaggcaaaggttgcagtgagccgagatcgtgttctgtactccagcctgggtgacagggtgagactccatctcaaaaaaaaaaaaaaaaaaaaaatacatgtattatgcttaaagcaaaaacctaacatgaaagtgttctaacattcaaagttgatgaatcaggaagtggctgctattaaagtgtagcaaacctgtctaactgactcttagaagttgatcactttatcaaaacttgtgttttacatataaaacaaattatatctctatggagttctcaaaaatacattgtggtacatgtagaaattcacccacagcccaaatgcaacaaaatttcttctacagaacctatacagatgtatcttgctttatacaaagtacatattccagaagctgtgtggattatatgttaaggctatggaatgaggatcacattaagttgtgttaatgagagtcattgtacctctccactgtatgcccaagaaatggcttaaggttaaactgattgtacaagaaataacacttaagacaataaactgtttcacaaaaaaagcacagcagtctgcccatttttccactgttttcgatatgtgagtgcctagcctttctccagaaatagtttatttaattttgtttttgtttttgttttgttttggggacagagtctcgctctgtcgcccaggcttgagtgcagtggtgcgatctcagctcactgcaacctccacctcccaggttcaagtgattctcctgcctcagcctcccaagtagctgggattaaaggcatgcgccaccacgcccggctaattatttgtattttt

SEQ ID NO: 33386 - DNA, 1057 bp, Homo sapiens
aatttgtaatttgttaagagcaataatttctttttctatgaatatcagtccaagaaacatttaccaagaggtttctgtgtgggtagcactttgtcatgcactggggacacagggaggaatgagaactgggccctgctctgaaacagccacaatctgatggaggggaaaggcatggaaatatatccaagcgttactgaccatggatgaggtgtgtataagccaccactgagtcacagaggaggaaacagcgggcagtccctgtgaagagagttgcctgcacagaggcaggagggtcgccgccaggggaaagcacagggctccatggctcagctgagttgtagctgacgcgggagagacagacagggcaggagcctgtcagaaggtttgagggcttggctaggttaggtagcgtctgacatgcaggaagggaatgccgttgacaggatttaaattggaggttgtcaaggtcagatgttgtttagaacaattctagtaacagagtggaaatggaattgaaaaactgaaggctattggccagggttttaagcccttgcagtagtttgggaggcatacgctaaaggtctggactgaggcaatcaaagcggggacagagaaaaggaaacaggaccgagaggttttgtagaggaggagtttgttggattactttctatgaggagtagttatgggagtctaggtagagagggagacaggagtgggcgctgatgcggtgaggaagattttagtttagggtattttttgaatgagcagtctgtgaggccttccaggtagacacccagaagttgttaagaaaccctgaattgaaattttgggagaagtaggaactaaggatgcaaccagaattgattagctcaagaagttcagcttgtccagattgtggtctcctgggcttctattggctaccacatttatttaacaccagtctcctgtcagagtcccgaaggggttatgcaaatctcttgcatttaaatttacgggttcacgtgtttgtcacatcccctcagctaatttgtagttagtgtggagccaagtgacttct

SEQ ID NO: 33387 - DNA, 1106 bp, Homo sapiens
ctccccgtgctccccacctccaacaggccctgttgtgtgatgttcgctccctgtgtccatgcgtactcattgttcaactcccccttatgagtgagaacatgcggtgtttggttttctgttcccgtgttagtttgctgagaatgatggcttccagcttcatccgtgtccctgcaaaggacgtgaactcattattttttatggctaatgcagtgagtttttgtgtataggccttgctaacttcggttactaattctaatagcttatccatagttcatttggatcctctctgtagaaaatcgtcctgtctgtgaatgagtttctttctttcaactcttacacctttcattttgttttcttgtcttattgtatggccaggctctcccatttagtgctgaattgaagtgggactggcagaaatcctagtctgggtcttgggctctgggaaagctttcattatttcctcgttaagtgtgatgtttgccataggataccttttatcagataccttactctttattagatacctttattagataaggaagtctccttttagtcctagtaaaggtgttttaaaaaaattatgactgttgtattttattaaatgcttttttcctgcatctattgataacttatgttttctcctttacatggtaaagaacgtatttttctaatgtaaaattaacttcgcattcttagaataatcccaacttgttcataatatattatactttacatttatcattgatttgatttgcatattttgtttgggactttactgtctatatttataagggtatgggctgtaattttccttttggttttgatatcaaaattatgctggccttataaaatgggttgggagagttctactttctgttttctcaaagagtttctataagatttttctctggtgattacatgaacctaccagtgtgttaaaactcgtagaactgagtgggcgcagtggctcatgcctggaatcccagcactttgggaaaccaaggcgggcagatcaactgaggtctggagtttgagaccagcctggccaacatggtgaaacaccctgtctctactaaaaatacaaaaattagccgcgtgtagtggca

SEQ ID NO: 33388 - DNA, 1004 bp, Homo sapiens
gtctctcgcagaaggctactatccattccgggtagctttattcaagagaaaagcactttgaactgacgtgagaaaagtgactgtgtaagatagaaatactagactacagaaagtttcagccatcaacgacacgtatatttctttccctctctgggttgttttttaaagttccaagaagatattttgataaaattccttgcaacacttaaactctttttctaggagattttaaaaatatataacatggatgtgagggcgatttggctgtcatatctgtcactccattgatcaccagggttgattcggctcatctgctggctagcccggtgtccccttccccactagcactccatgtgcgtccctcccgaagctgtgtgtttggtcaaagagaatgaccatccctgatagaggaccggtcttcagtcagggtatgtgagtagctgcactcccctgctagagcctccagacaggctccattcgtaggagaatgtagagtcgtcaaccttccaagactccagacacatccaaatgaggcactgcatgtggcagtctgcctttctaaaaataaaaataaaaaaggccaggcatggtggctcacgcctgtaatcgcagcactttgggaggccgaggcgcgtggatcacctgagttggggagttcgagaccagcctgaccaacatggagaaaccgtgtctctactaaaaataaaaaattagccaggtgtggtggcacatgcctgtagtcccagctacttgggaggctgaggcaggagaatcgcttgaacccaggaggtggaggttgcagtgagccgagatcgtgccactgcactccagcctgggtgacagagcgagactccatctcaaaaaaaaataataaaaatatataacaatgtggtgtatatgtacagtggaatattatttggccttaaaaaggaaggaaattctggcacatgtggccacatgaaggaatcttgaagataccctaagtgaaaccaatcaatcaaaac

SEQ ID NO: 33389 - DNA, 1065 bp, Homo sapiens
aagatgaataacgtttaacttgtggaaatggttttttaaaagtatcctcagaagttgaggtttggagaaattactgagcatttatttctaaactcttgtctctgcagattggatggaatgcacagtaccttgtgtgtgtgtttaatttttgcttctcactgatgcctgggtggattttatttaaattaaaacctatggaccgtattgttttggattgggctaaaccgctgacgagtcagttacatgtttagacatgagtcttagacatttatccaaaccttggtattggctcgatttgtgtacattgtgtctgtcttgtattgtgaaccgcgcagtgtcagtggcccccgctagcactggtactcaggaagctgggccctcacctgctgtgctctctaccttttcacccttaccaagcctgggtctctgcatggggcaggcccttaagaaatacctgctgtgtgaatgaatgctgccttactgggtcctgcttaatctcgattttactacgtttccaagccagtgtaagaacacaaacaaacttggttgctgagtaccaagcatcatattaggttctttacttatggatcttatttaatattgacagtgcgaccttgacctcattttcctctagagaaggctcagcatcctggaaaggctaggactgtgcccaggtctctggctcgtgtgtgtggggccaggactctgatcctaggcccaggctaatcctaaatcccatgttctgacttggagagccctaaggttttgctcttgtggttgtacaattgaaaacttagtgaaagtcgacctaatagtactattaaaacttcagttttagggccccagtcaatcttgtactttgacattggagcagggggtttgggcagaaggtgtggtagctgtccagcctccagcgttccccagatgcacaccaataaagaaagccatgggggagacttacaactctttgacactttgacccattaaaccccgaggctggcagcctctgtgacttaaatgtcaaatgccttagttgggaagggattccctagtggccatggccac

SEQ ID NO: 33390 - DNA, 1039 bp, Homo sapiens
taggtcctgtccccagtgggattgacctgcatttcctgttccgagtctttgtcatactaaaaaggaaaaaaaaaccagtttgggttcttgatcctgcatacactctgcattggtttgaagtccttgttgattgacgtctatgaagacttttccttttctgtacgtgctacaccatgcctgggggatttctttgttttgagagagggtctcgctctgtcatccaggctggagtgcagcccccgcctcccaggctcaggtgaccatcccacctcagccccccgaaatgtctgttcttgatttaactttttttttttttaatggaagatttaaaatatttacaaaactagaacagcataaaataatgcacccccacacgcctgctctgcagtgtcagtgactgtggaagcgcagcggctgttggagctgcctcccacctctccccttcccaccatattgaagcgagtcccaggcaccgtgtcacctgttggtgttagcgatctctgactcatatgggctcttttaacgtaactgcaataccgttaccactcagctactaactccttcctatcatcagatatccagttttcaaattcagatgtcataaatggctttatagttggttggaatcaagatctaaataaagtccatgccttgtgattggttgaaagctctgttaagcctctgtaatatctatgccacgccacttctcactttttagccctctcttgcttgcctttatttgtcaaagaaaacaggtcatttaggctgggcacagtggctcacacctgtaatcccagcactttgggaggccaaggttgggggatcactagagcctaggagtttgagaccagcctgggcaacatagtgagaccccgtctctacaaaaaatacaaaaattagctgggcatggtgacgtatatctgtagttccagctgctagggaggctgagatgggaggaccatttgagcctgggaggtcaaggctgcactgggctgtgattgcggcactgtgcttcagcctaggcaacagaggaagaccc

SEQ ID NO: 33391 - DNA, 1083 bp, Homo sapiens
acatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgttacttatgttcaccatcgtttgtttaaagttgaagttctcactttgagcatgatgctgtttgaatatcttaagatccatttatcagactggttaataacaggatggtgcagtggtagttgagtgaagggattcgagagttgagtgtgccccttgcaggttggagggagtcgcacccttgtaccccctctcgagctagcccctacccactgctccttcctggtcctgcagcacccttcctggcgtgcagctggtgcttactctgtgccagccacaggaccaggggctctccatgttcccttcagaaccttctcagaagcccatgaatcaggcactgaggtctgtctccccagcaggcagtggggtggcatgaggtgggggtcagtggtgtcttctcaggaggccgtggctgtgtggtggaaggctccgcgaagccactgagaactggg

SEQ ID NO: 33392 - DNA, 1028 bp, Homo sapiens
tcacttcctgtacagtgcaaaggagggtggcactaaaccattcatgagaactccatccccgtgacctccccccaggccccaccgccaacactggggaatacagtgaggcttgggtggggacagagtcaaaccatatcaaggaggaggaggtgtggcactgggtggggatcaggggcccctgtggacctcccactccctccgatccttccccttccaggacagtcctggggcttggtcctctctcatgagctcactgggggccgaacggacctggaggaccctgagcttcattaattatgagttgtttttgccaaggacatttcatctgtgacatctttgctttggtgtaaacagaccggtcttctctctacctcatggagagtgatgtatgcaatgtatgttccataaaatgcttccaagggagagagaaagagaatgtgatccaattatacaaaatatgttggcagactcctattgatccttcaaaaccctaatgcagtattgcctcctccatgtagactttcttgattaccctgacagagttacagagttactcccatcttcccctacccgtgctgtgctgcacacacatttctgcttcaggggaggtctcagggagcttttatttatggtgggaactgtgggtactgtgatcgtggctatagtcatggctcctggatgcctgcgtccagcccactggactgtgaactgtgagcgaagggaccaagtcctcttcatctttgtgtgctgtacccagccctgctcttggctcagagcagaccggaatcgttctctgttgaatgcaaaggagcactgagaacagcattttgcgaaatccgaagcatgacagaaatgtttactgcatcacctcattgaactcttcctctggcttctcctctctctgttgttctgaaccagcatggcacggccaacgcttgatgatggctgcagtcctgggaaggggctgggaccggggctcactgctgctcactttgtggttcaggcccagctgggggttgggggtgatt

SEQ ID NO: 33393 - DNA, 1098 bp, Homo sapiens
gtctatgatttagataacgatgatttggccatttttgtggtcacctaccacttattggagacatattatattctgagaatattatgccatttataggcattaattccaatatgcaaaagaactttgaaatgaaggcgttattattcccaattttacagatgctgaaactgaagctcagagaggttaagttgcccgaggccatacaggacaataggggcaaagatggttttgaatcaatggatgtctgacgacaaaggccatgatctcaccactgcactgcactgtctcctgaagccctttgtgtgaaatgattaaatacatcatgattatgtcacacttcacttacccttctccaggtagttgaacatctggatgattttacatcgtcaaatacaaggttgttaacaattaaaggataaaacagggtgcggccggaaaggcggccgccccctcgcccatcatgcaatgcacattcgtggggaacctggcgctaagccattcgtagatgacctgcttctggctcggggtttcatatgtagcagagcagctccctcgctgcaatctattgaaagtcagccctcgacacaagggtttgtaaaaaaataaataaataaaacaaaaaacaaaaaaaagcaattaaaggatataaaaaatgaagacccctgagacataatcagtgtcttgcaacctctttctctatggccacaccacatccagcaagagcgtctgcccctatttgaatgcctccttccacctgggtcagccagttcccttagcagccgtagcagcaattttaacctgcaagcagcctgattggcccagctggtcatgcccaccctgtcactcatcactgccctctctactgattggcttctcttgggtcagatccccacccaccgtgggcttattccttgaacacagggctgtggcttcctaggacttggcacatagtagctgttcaattcacatttgttgaaatgaagaaaattgggtcagcattccttaggactttggcaaacgggctgaaacccaagtctagaaaattgcccagaaaaggccctgcccaggtcagcctgggacagcagccacctctgtggg

SEQ ID NO: 33394 - DNA, 1030 bp, Homo sapiens
gtgcgccgcgaagagggacgagcagaggagcatcggaagaagacaggcgaaggggaccgcggagcagcgtaggcggagccccgggggcacggccgaggctgcgcttcaggagtgtccgccaggcgccttcccgggcggttggcgaaacccgaggaggcccacagctctggcctggggcgccgtcgttccaggggcctctgcgcctctctctggcgtctgtctggaccctcagagccccgggatcaaggcgcccatcctcttgatggcggggcgcacctttcgcgtgggtcgggcgctgcagaccaagcacgccgagtgcgtcaaggaagtgcccggaaaccaaagacaacgcacccgggaccaagaggaggccgctgcgcgcaacctcccaaacactgcagcgaagtcggaaccacgtccgcgtgggtgactcgggctggggagccgggaggcggcgccaaggacccttcagcccttgtccgtcctccctgatatgtcctcgacgcggtctgaggcctccccagcggaggcgacgccccggcgccaggtgccctgggtgggggaacccggagggggcaccacgaccagtggagaaggggcggaggccgggaaagctgcgtggaaaagaggaagggttaagactgaaatcattctacagagaccacgttaatgggtttaaatgcgaacattctagctaagtagaaaaaaatttaaaagcagagtgcaagctggaccaaagtgagaccccgattgggcgtagataaacctgcaaccaaaacagccccaggcagagattcagccgctggggagcacaaacccctaatgtttcttggtagtcactttttgaaacattttattatggaagttttcaaatataaaacaaaatcgagggaggcttcaagtgaattcccgtgtacccacccctatcccacagttcttaaaccgtgaccaatctagttccctctattggcctccttttatttgtactaacttatttttgttgccttattataaagcaaacacagacaca

SEQ ID NO: 33395 - DNA, 1044 bp, Homo sapiens
catcatcaggcctggtgctctggatggctgaggttttaatgtgactggatgtcccttggagtggctcctaggctgtgcttctgtggttgggtggcaaggggttgctttattcggtggtggctagaggatgttttagcaggtaaatcgggcccccaggagcccctgagtgccaagtcctgctgcagggcatgtgtttatggtggggaggtgggggggtggagggtggagggtggggggcattgatttcctgccaatatcagaagtttcagaggcttcttgtgtatccacaaacacccaccccattgagaaggcctagaaaacctggccctccccaagcctttactgaccacttgtgaatgatcccagggtgtgtctgacccacagctcctcctggagggagagaaaagtctctcctaggtatttggttatcaacctcaaccacttgctgagccttcctcaagaccagggacctcggcagagatttctgggttgtcaggcagaaccgagcattcgagggtaataactctttggagtccctgaaatccctgatggatgcaccaggtaaaagcacccagggttgaaatcagatgaggaaggttattgtcagcctggggctcctgtagaggtgcatccgcgttgcagggattttccttcttgctgaggagaaacctgggtttctcagctttgccacagtcacaacatttggggtgagaccattcgtggtgctggtggtggggccatcccgtgtattgtgggatggttagcagcatctctggtctccatcctctaggtgccattgtaccctcccagctatggctaccccaggtgtctccagacggtttcaaatgccatggagcaagggagtggtacgtgagcaaaaccaccccagttgagagccattggtctacacttgtggaaatgtttgagggtgagagtgtcgagcttgggtccctgctgtaccctttatgagcaacgcggtcttggaaaattaacactactccaggggcctcagttttctcatctataaaatggagataaatgaga

SEQ ID NO: 33396 - DNA, 1089 bp, Homo sapiens
aaaattggctattaatatcttctactcttgcagatgtagtgaggattaaataagatgtcaggttaaaagtgcatcatcgacactcaatagaaattaggttttaccattcattattattcttggcagatgctgcagataacgtggagagcatacgaaagacacatgtttgaaccaatagtgacatacgggtgctaagttctgcagtaggggaagggcagagagccatggagtgggcctggcccaatcctggagcctcagaaaaaatttcctcattgaattgctgttttagctgagacttgtgggatgggtagtagttggagatcccagacaggatgtgaccgagttaaccatggaaaaatgtggtcctggcatccatggcagagttgaatgatccagtccttctctctcctctggttggaagtccaccagatctgggaatgtcaagttgggggaggggctggcaatgatcatgaccttcgcctgtcctcacatgtcctttgtgtatctgcaaagcctctgttcagtctcctcttctggaaagtgggatcggaaaccacatctgcttctttcccaggactgctaggaagacaagattagatggcaggtgagagctctttgaaaatgaaaacattctgctatttgaatgcaaagtgttcttctttgcctgtgatgtttcctaatctgtgaactcatactggacctcgaagctgtctattaaaaaaaaatgacaaagtggctgggcatggtggttcatgcctgtagtcctagcactttgagaggctgaggggggcagatcacttgagaccaggagttcgataccagcctggccaatatgtgaaaccccatctctactaaaaatacaaaaattagcaaggtgtggtggcatctgcctgtagtcccagctactcgggaggctgaggcacaagaatcatttgaactcaggaggcagaggttgcagtgagctgagatggctccactgcactccagcctgggtgacagagcgaggctctgtctgaaaacagaaaaaaaaaaaaaaaaaaaaaaaaaaagcaaagttaacacttcctccatctctcccctaggggaggc

SEQ ID NO: 33397 - DNA, 1039 bp, Homo sapiens
agatagttgtagataatgtggcattatttctgagggctctgttctgttccattggtctatatctctgttttggtaccagtaccgtgcttttttggttactgtaaccttgtagtatagtttgaagtcaggtagcgtgatgcctccagctttgttcttttggcttaggattgacttggtaatgccagctcttttttggttccatatgaactttaaagtagtttttttccaattctgtgaagaaagtcattggtagcttgatggggatggcattgaatctataaattaccttcggcactatggtcattttcatgatattgattcttcctacccatgagcatagaatgttcttccatttgtttgtatcctcttttatttcattgagtagtggtttgtagttctccttgaagaggtccttcacatcccttgtaagttggattcctaggtattttattctctttgaagcaattgtgaatgggagttcactcatgatttggctctctgtttgttattggtgtatacgaatgcttgtgatgtttgcacattgacttttatcctgagactgctgaattttgctatttttagtacagacggggtttgctgaatgcagcccccagtcacgtactcccttcttggtcaatcgatcaccactctctcatgatcacgaccctctcacacggacccccttagagttgtgagcccttaaaagggacaggaattgctcacttggagagctgggttgttagagacgtgtgccaccactcccagcgaatttttgtatttttagtagagacggggtttccccatgttggttggccagcatagtctcgatctcttgacctcgtgatctgcccaccttggcctcccaaagtgttgggattacaggtgtgagccactccacccagcccacagaaggcttttcatacttgcttagcagcctcctgcatcctacgctagcacctggcactcacaacctgtgggctgctctcatccatgatcatctctccccaggcctgctgttcctcgagaaaggaagttgtaa

SEQ ID NO: 33398 - DNA, 1059 bp, Homo sapiens
tggccggctggatcttgatatgtgtttctcagttggaaagactttggtccatagggaaatgtcttctcaattcttttaatttcattaaggtggttatttttcttcttgtggcctctggaatgtgacacagaactcaagggacaggaaggagatgagttggaggctgggtcaggggtccctgccagggatgctggtgactcacgtgacggtgttgatgtgtggagtccggtgcctggtttggggaatgttcgtgggatatgttccacagcactgacggatctatcaggtactggaggtgaatggtcaagtctgatctcagggctgacagtgtcaggcaaggacaggaagttgacattggactcattggctgaggttgctggggacccagggggcaatgtgtgccaggacagatgggtctggggctaggaaggcaggtttgggctggagactcggtcttgggaggcatcccattagacagtggttgaggctgtcaaaatgactgtgattgcctgggatgagagtggagacagacaggatgggggttttgctctaagcctggggaacccacctcccaggttcaagcaattctcctgcctcagcctcccaagtagctgggaatgcaggtgcgtgccaccatgccctactaactttcgtatttttagtagagatgaggtttggccaggctggtctcaaactcctgacctcaagtgatcggcccaccttggcctcccaaagtgctgggattacaggcataagccaccataccatgcctgaccatttttaaatattaatttttatgaaatattttcaaacacattttactgtacattggaaaagtcaatcatgatttcaaaactttatcaaaatccaatcagaagtcaattaaccatttaattgtggataggtaaggagactattttgaccaaatatgttagaacaattaccacttatagaaataatctatgttttaatgttttagttgaattaaagaatcttttatattctgtgcaggtgcagtggctcacacctgtaatcccagcactttgggaggccgaggcc

SEQ ID NO: 33399 - DNA, 1052 bp, Homo sapiens
ctcgtgatccactggccttggcctcccaaagtgctgggattacaggtgtgagccactgtatgagcccagcctcattgtgctttgtactaaccccctttccctgtcctcttccagcttgtcttcttctatcacagtagtttcttcatgaagaggccatgtgctatattccatgagatatttcacactcaaagaagacttcttttatactcttttgataatttgtctgggaatcactctcttgatttataagggagtttgtagtaaatacagtaaaagggaaacacacaacgtattttgagacatcagagaagggagaaaccaattctattaatatttggggttagcagggaaggcttagttaagaggtaacatttgaactaagccttgagataagggaaggatttgaccatgcagtaatggcgagagagtagaagcaagacattatggttagtgttatgtaacaatttgactgggttgtggggtgcccagatatttggctacacattattctgggtgtgtctctgtggtattctggatgaggataacatttaattgctagactgaataaagcagattttcctccccagtgtgggtgagcctcatccaatccactgaaggcctgaacaaaacaaaaaggtagagtcacagagaatttgctctttttacctgattatatttgagctgggacatcaatcttctcctgagtgtagatgtggactcgagttggaactatatcattgactgtcctgggtccccagcttgctggctgcagactccaggactccttagcctccataaccatgtgagccatcccttacaactaatcaatctgtctctctctatgtgtatagctctacctctatctctctgctctttctctggagaacctagagtaatacacaaggttatattagagaagaggatgacccaaggaaaagcatgcaggcagaaaaatgcaaagagggtttgggaagactggggtcctgatggggagtttggatttcactgtgtgtagcatggagaatccttgaaaatattcaagaggtgaaaat

SEQ ID NO: 33400 - DNA, 1056 bp, Homo sapiens
tagcttgttcaaaacttattcttcctattggaaactttgtaccctttgaccagtgtctcctatcccctacctttcctccaccccagcccctgataaccactgtcctactctctatttctgtgagttcaacttctttagattccacatataagtaaaatcatgcagtatttgtctttctgtgcctggcttatttcacttaacacaaatgtctttcaagttcatctatgttgttgaaaatgacaggatttcttccttttctgaggtttaatagtattccgttgtgtgtatatagtacattttctttatcctttcatccactgatggacacttaggttgattctatatcttgggtattgtgaatagagctgcagtgaacataggaatgtagggatcccttcgacatattgacttcgattttttttggtctatacccagaagttgggttgctggattatatgctttgaaatctatagcacagcagcatgactatagtcaataataatgtgtctttcaaaataactaagtgggtacatttcaaatgtctcatcataaaaattgtcagtaaattaggggatggacgtgttaattagtttgatctaatcattccatattgtatacacatatcaaaacatcacataaatgtgtacaattatgatttgtcaattaaaataatgttagttaaaaaaataagtaacttgttcaaagccgcagttgggattgatggagctgggacatgcaccaaggctgttgctttcaggcccgcagagtccttggtccatgaatgttgaagccctacctgagatttctactgagatcagtgtagggattcaatgtctcagaatcatcccatcctccagggcccacaagtccatgaccgctgcctctacccctgaccctactgacctgaaatatggcccctgctttcttttccaggagcatacaacacttacaccaagcattgatgggatttgttgacttcatttgagatgtggggccgtggagagggtcccatgatccttgcttggtgttggccaactcattgacttctctcctttg

SEQ ID NO: 33401 - DNA, 1476 bp, Homo sapiens
aagaaaagaaatgtgtatggcttcagtgaagtgtaatttggcaaaatcagatagtgcactgaacactgggactcacacctataatctcagtgctttgggaggccaaggggtgaggatcacttcacccaggagtttgagaccagactgggcaatatgatgagaccccatctctacaaaaaatacaaaaattagccaggcatagtggtgaacatctttagtcccagctactctggaggctgaggtgggagaactgtttgagcctgggaggttgaggctgcagtgagctgtgatcacaccactgcactctagcctgggtgacagtgcaagatcctttctcaaaaaaaaattttttttaatgcatgaactttcttatttggcgattccacttgtaggactttgtcctgctgacatatttgcttggtggtaagggatgtacatgcaaagctattcattgcctacaaacaacaaactgttgtaacataaagtatttttcgttcactcattgtggaaacaacatgttcctgtgtgcctcttatttataaccaaatagaccatgtattgaactggggaatatttactctgcttcaacattaaaaccgctttttggccacacgtgatggctcatgcctataatcccagcactttgggagaccaaggcaggaggactgcttgagcctaggagttcaagcccagcctgggcaacatagcaagatcccgtctctacaagaaattaaaataaaaagttagccaggtttggtggtgcacacccatggttccagctactcaggaggctgaggtgggagaattgcttgagcccaggaggtcaaggctgcagtgggttatgactgtgccactgcactccaacctgggcaatgcagtgagaccctgcccccacctccaaaccaagaaataggtttgttgacctcagcactattgacatttggggcaggatcattctctgttgcatggggctgttctgggcactgtgggatgttactagctttcctgcgctctactgaccagatggatgccattggcacccctgttcccatcgtgacaaccagaagtatctccagacactgccaagtacctgctgggggtgcaaattcaccctcaactaagaaccagtgcctggagataactatataccatgttgaacccagtacctggcttcagaaaatgtccagcagattccacaatcatcagctccttttcaattctctaaacagtgatagcaagtcaggcaggttccttccttaaaggtgagaaatcagaggctgaggtcacacaggtggggagaggcagggcaggattccatctcagccctggatggttcaaggaactgggtggcccatccctgcctctgccaccccccaccgccctcctccagcctcagccctcatgtgtctttagttctaattaagtcctcattacaaacccctatgaatttcacccacccccaagcttccaggcaac

SEQ ID NO: 33402 - DNA, 1045 bp, Homo sapiens
atgtcatgagaacagcaggagaaagacccaccccatgatttagttacctcccactaggtccctcccacaacatgtggtgattatgggaactacaattagagatttgggtggggacacagccacaccatatctgagctgggcatcttcttccttgaatgcacattggcctctgaggcacttcctggttaacctcattccacagctgagaaaacccaggcttggcacaggcaagggatctgacccaatgtctcccatcttattagaggaaggaccaagactggacccacaactgtactcctgttttgtgtcaccatgctgcccccaagatcagatctcaaaccaagcagacatggggggctcagaaagtccccagcctagaactttcctgtcacccaatgacactaaaggctaagctttcttcttattattctggattcacgctagaatgaccttggggtgtgtttcacacgtgccgatgtctggagtttcacccccagctaactgactatgaatctctgggttggggcctgggcactgatattcatgcagagcttctgagatgatcctgttgtatcgccaaggttgacacctgcagaaaccttgcacactttttcattcatttagttattaaacatgtaatatttattattatttttccagacacagaagcgttgcaagaatagtacaaagacatcatttatacccttcgctgagattccccagtgctaccattttaccccatttgctttattattttctaagtggcagatgagttatcttttacccctaaatattcctgtgtattccttaataacacggactttgtcttatataaccaaggcaatatcaaaatcaggaaactaaccctgctacaataaggttttctaatgtagggacctcattcagattttgccagttaacccaatgatgtacattggagcaaacgataatcccagatcatgcattattttcagttgctgtgtctctgtaggtcccttttagcttggaacagctcctcggtttttctttatctttcatggtattg

SEQ ID NO: 33403 - DNA, 1116 bp, Homo sapiens
ctgatctcgtacggcatcctcgcccacttgttaccgcgccgcgctcgccgagagcctccggggccggcccgcgctgcgaattacacctcgccgaggccgagcccggggactggagccggaaggcggcaccgggcgtgccgggagtggagtgggcggtccgaggccggggctcagaggccagctcgcgcctgccctgcgcgctgtggttgcggacgccccgaacccggaagcgcggtcccgcgcgcggctcgcccccagctttgaccatatatagtcaagcgctcggctcggcggctgcggtcccggcgagcctgcgcggacctggcgctcccctcccccgccggccccggccccgcctccgccttgctcgccccgccccggaagtgacgtatagcacgccccgcgggcccttgaaaaggcggcgcagacaagcagccgcgtcagaatgcttctgggagtcggggggtgggtgcctttctgttgctagcttgtaggagaagctgggctgtaggaagtttatttgcgggggggtcttaaagacgctgaaagtactggcgggctttggtgggggtctggaaaaacctctctgtacctgtgaccgcgttgcgtggcgggcgctccccggcctctcctttttgaccggtcccgggcgttgcccagccgccagtcctcctgctcgggttttgtaagcaggagagggatgctttttacgtcttcttaaagtacggttaagtgcccttgcttgaagtagttgctggcaacaagaacgtaggggttactctttgttgggcctgaactcgtgctttttctctcaaaagttgagcttttgaaaggcaaaaaaggcgtgggggatgggggagctgtcggtcttaaggaagttaaaggttatttcctaaacaaaacaagtctcactcctaaaaccagggtagtggctcagttgtggcgggagagcaggggctgtaaagtgtccaagtttctagtctcatctttcagtaggatgggtacaagctttccccttggggctctgggggctgggagggttgtaaaagtgggagaaagcaaagtatttggcggggtgcgggcgggtagctgaatgttgttgtaagtggaagagga

SEQ ID NO: 33404 - DNA, 1026 bp, Homo sapiens
cagaggactggtaacaaagcctttaacctgctagcataaaccttatgcaaaaggggttagcccggttaattctgccaaggcaagaaatgagttatctgcaaccctccagtgaactcgtttactgaatcccttcttggggggccctatgtgttgtaaatacctttctttccagttgagcagcccattggaaagtgggttttgcaaataagcaaataactaacacctgcatgctgcagcagctttaaatccctgcaagtcatggaagcttgggcataacttttcagtttgaggttactgaaggatgtacttctaaacagctaatcaacggcataactttagtaacacagtacaaggaatatatcctacttgggttgtctacccttgtttcttaaccatagcttcaggcaacgaaagctatctgatcatcaagatcccggtgaagggggtggtaactgggtggagttgagcctccacactggaggacctaaggccgtgtcttgcactgcttcgaagctcctgtagctgcaaaagaactctggggacagttaaacaattcccctgtcccattcttcttaaactcccataagtgatagaacacagtcgcttctgtctacctgctgcctgagacttggtgtgttgctgtgaggcctggtgacagccccggcctgtcctttcccgggacccttcctggaacgtttacttaccctcatacttgcaagcacttcgtgtgagctagatgctgggtttgtgggcccttgcccttcatcttacatcagggaagggaacttgggttggaactttgccgagttgaaaagcaagtgatgcaaccaggagttaaacaggttgggtctacagagtctaaactgtcctttacacgtgaaagggctgaaatggatagatcagatatggaagttttaattgtgcccctaaataaccaacttttccagtgaaggtagaatcttagcatgctctcacccaagttcaaggatagcgtcagtcgctctccagttgaaagctttgtctttg

SEQ ID NO: 33405 - DNA, 1050 bp, Homo sapiens
aaaaaacagtatatagttgcataccaaacccaatttgtttatctgataaagcatttcttaaatagtggtttgtaaaccagatgaacttcagggacattcatagtcatcaaactgttacatgcccactgaaaatggaaaagaatggactcttgtattacagcttaagtaatggatgccttctttttgtttcctattctgtgttcagtgctttaattgttcttgaaatgttttccacttgtctattttaattcttgtgagtactagaatagctttggccttttaaaacatttgtttattttttttctgagaatggctaacacactttattgaggttcgaaattaataaagaaaataaaagaaatgtatcttcattcattctgtatgttagtgttttaattacccttagaatatatggataaaaaatactattctttgtcttggagaaggtaagagtctagttagatgaataagggttatctatgtagaacaactagagaatgagaagagagcttatgagattgagtactacgttatgcagtagagtagcacgtcatctgctactgagtatggtgtgataacattgtgtaacaggaaagtatgatcaatatctacttaaaattaaggacaatattagcactacattgctttattttaaagtaaaaattagagaactaaacacaagcattgtaagtacaataaaagctgatctttctagttaagcagaataatacatgttcaagcatctgctaaatcattaaatataagaatataggggttttctataatcttatttttctttggaagagtacctcattttcaagaggagaagtttctaattgaccacttctttaaaaataaaacagggtttttaatgtatcccagcaaaaaaaattaatatctcttcaaaaagttctcttgtgattaagtttgaattccctttgtcatactgcttctaatattgtacactgacctccttagttatttttcagtgtttataatcttttcttaggttatcttttttcaagatttggattactttgttcttttctg

SEQ ID NO: 33406 - DNA, 1049 bp, Homo sapiens
caattatgaaccaaattataaaacttggaagaaacaaataaattcatgaacatatacaacttaccaagactgaatcatgaagaaatatacctgaacagaacaataacaagtaatgagattgaagctgtaatgaaaagtctcctaccaaagaaaagcctaggacctgatggtttcactgctaaattccaccaaatgtttaaataaggactaacatcaattctgctcaaactattccaaaaaaaattaaagaagagggaactctgttaaagtcattttatgggccagcattatcctgataccaaaaccaaaggcataacaacaataaaactacaggcctatattctaggataaacatagctctaaaaatcctcaacaaaatattgccaaacaaaattcaataatatattaaaaaaataatgcaacatggtcaagtgggactcattccagggatacaaggatggttcaacacaggcaaatcaataagtgtgatatatcacatttacagaatcaaggacaagaaccacttgatcatttcaacagatggtgaaaaagaattcaatggaattcaacatccctcatgataaaaactcaatgaattgggtatagaaggaacatatttcaacacaataaaggtcataaatgacaaacccacagctaacatcatactgaacagtgaaaagttgaaaagttttcctctaagatcaggaacaagacaaggatgcccactttctccaactctattcaacatagtactgaaagttctagctagagcaatgaggcaaaagaaataaataaagggcatccagatttgaaaggaggaagtcaagttgttctcatctgcaggtgacatgatcataaatttagaaaaccctaaagaccccatcaagaaactgttagaactaataaataagtttagtaaagttgcaggaaacaaaatcaacatcgaaaatttagtagtgtttctataaaccaataataaactagcttaaaaaaatcaagaagcaatcccatatacaatagctacaaaaatttataagatacctagggat

SEQ ID NO: 33407 - DNA, 1030 bp, Homo sapiens
agatatcctgtgttcatggattggaagaattaatattgttaatatatccatattacccaaagcaatctacagattcaatgcactatcaaaataccaagacattcttcacagaaatagaaaaaaaaaatcttaaaattcatatggaaataagaaaagatcccaaatagccaatgtaaccttgagtaaaaagaacaaagaactggaagtatcacactacctgtcttcaaaatatactactgtagtaactaaaacagcatggctgtggtctaaaaacccacatagaccaatggaagaggatagcaaacccagaaataagtccatgcatttacagccaactgatttttgactaaggcaccaagaacacacattgggaaaaaggacagtctggtcaataaatggtgctggaaaaatgacatccacaggcagaaaaataaaactagagcccccatcactcaccatatacaaaaatcaactctgaaaggattaatgaattaaatgtaagaactgaaactatgaaactattaaaagacaatacaagggaagtacttcatgaaatttggaggggattttttttagtaagacctcaaaagcacaggcaacaaaagcaaaaacagacaaatgagattacatcaatctaaaaagcttctgcacagcaaaggaaacaatcaatagagtcaagagacaacctacacagaataggagatagtatttgcaagctgtgtctaacaaggggttaaaatctagaatacgtaaggaactcaaacaactcaatagcagaaaaccccaaatagtttgatttaaaaattagcaaaagagctgaattggtatttctcaaaagaagacaaatgtccaacaaacaaatgaaaaaatgttcaacatcactaatcatcagagaaatgcaaatcaaaaccatgagacaccacctcactccagttaaaatggctcttttcagaaagacaaaaaatgacaaatgctggcaagggtctgaagaaagaggaactcttatacacagttggtaggaatgtaaatt

SEQ ID NO: 33408 - DNA, 1053 bp, Homo sapiens
tgtaaaatcatacccattccattatgtattgattgtcaagaaggaagtaggcttttattgctatttttatgtcagtttccatttactgtctcaccacatttattgggttattgcctttgcctttgactcaacaggagctggaagggtaggaatcccaaattctgttgcctaaggcagccagttgtcagaatggactttcctcattttctattatgaggcctgaggaaagacattcagttccaaaggctgtgcctatccttttaaatagaagagagagggcccggcacggtggctcacgcctgtaatcccagcagtttgggaggccgaagggggcgaatcacgaggtcaggagttccagaccagcctggccaacatagtgaaaccccgtgtctactaaagatacaaatattagccgggcgtaatggcgggcgcctgtattcccagctactcgggaggctgaggcaggagaatggcttgaatccgggaggcggaggttgcagtgaaccgaaccgagatcgcgtcgctggactccagcccgggcgacagagtgagactccgtcccaaaaaaaaaaaaaaaaaaaaaaaaaaaaaaaaaaaaaaaaaaaagaaaagaagaagaggaagcagccgtgccaaaaaaaaaaaaaaaaagaagaggaagcagccgtgccgaggctaggtactgcctaaagaagcgggggaacaaattggaaatgtgggaatgcgaatgtgggcaagttgaggaacttgtagcttctcgtcggttgaatcttttcactgaagctgctttattatatctgacatgtgaaactacacaatttcaaacaaacccatattgaagtcaacatacaaaaaagcatttaaaaaacaaccattagtaaaaataattttttcagttaacgctattcttcccttgtataggtgttgataatcatataatcaaatagcttattgcatatggagagttgttttctttgagttaattcaacgtattgcaacttagttagaatccaggaaaatagtattttcaaatgtgtatttggaatcttcaaa

SEQ ID NO: 33409 - DNA, 1026 bp, Homo sapiens
cagggagaggatgggaagtctaaggcacagagggaggtgtaatgtagctgtgatgtgatggtggggttaggctgcaaatacaaatattacaaggggccttgcaagctaggcacagggcagagggaatgtgtgaagagtagatgattagatttgcacttcaggaagatctctttccttgctggcatgtggaatagtttgggggagtcaagagaatcactatgaccagtgaagagactgtagcccagaagtgttaatggccttaacagcaggagttacagtggaaatggggtggagagaatgcattgagagataattaggtgccagaaaaggcagcaagtgatatggtgtacaggtgggggaaaagtgcgtaaggaagagagaggagatttcggggaaaatgtacagaattttgacttgaggatgacggtgctattctcagagataggaaatgcaagagaagcagtttagggtataggtagggaatggaaagtgagtccagtgtggaaattgtggaatttgaagtacccagagggagcgcaggacattttgacatcattttgagctcttgtatgttttgaccctgctgttttttttgttcttgaatataaacattgccgtcaagatgatatcaacactgatgaattttgtggtaaagatttattccagggttaacttcgttaagctagtttaatttattgacctatttcctatattgcaaatttaatcttttccaatttgttccctcctgtattgttttactagcactgtttccatcaggacaaaatctttcttgtgtacattttacaatgaatacttgatttatcaacctctttatcatcatctttttcaaatttttacagatacaacttttccatgataaatgtcgttttagctctactatttttaccatgtcaaattttggacaactactctttttgatttttcattaatttgtgagcaataataactttttaccattttctgtttttgctattttcagttgtattttacctttttttttgtaac

SEQ ID NO: 33410 - DNA, 1098 bp, Homo sapiens
agggagctcccggtcctgcaggtaagttaatccttgttgcgatactgtgtactagatgggcaaagtgaagaaccagtttagcctaggtaaggagaaactggtagattaccctaattttttttttggtagaatctaaacaatctcatgagttcagttgaacatgtgaaatacactcttcttttcctcacataattgtttcccctgccagtctacacagctcgcaagggtaagtctgttttatgagttggataggttccgggactgcgatttatcttaaagaaaactcatttgcttatgtagcagccaagatcagctactaaatttccaggacattgaaaaaagtgcattctcttcaaatccctttatatttttacctagcatccccttgcaccctgaccccgttctgaactttttgtttgtttgttgattggttggttggttttgccttcaggacaaagtgcaggacaattttgtgtctgttcttgagtcaagtatatttgtttgatctctgtggaacttagttctgagcatatgaatgaaataaaggtgaactgagaggtcataatctgtatctttctctgagaagttctctaaggctctgcctttgcttgttttgctgtttcttgattccttggctgtgccgctgtctctgggttccagcactgacaccccatgtgggtagggtcctgtggaggacagcacgggtctgagagagagaaagcctggggaaagctggagatgccctgttcttgctttcctgcaccaggcctctataccccttgaggtcaaagcatgtctaattacgttgagaacaagtcagagatattggacataagtgtcttcctaaaaaataaaatgtgcagtaaatactacattaaaattatccgtaaaccactttaatattaactttgaactctgcattatggcaggctgttgggaaaataaaatgttccccagcactctctttctctctctgacttcgtgtctaccagttcctgatcttgtcctttgcaaggaatgggtgggactccacaggttcctgactgcatagctttttcaaatccagtgggtctttctctgtttccctccaagttccct

SEQ ID NO: 33411 - DNA, 1023 bp, Homo sapiens
attttggattaaagtggctccgagtgttcagagacaaaaaaccctctctgcaatgaaaccattaatcttggctcatttgtccataaaatatcttctcataagagaaattcatgcagtgctaagcttctcactacatgcaattttgggtttcactcattcgtcagagcattgattccttccgttgatacgtctgaattaggaaaggctattataaatgttcccaggactttagaaaaaagctttaatgacactgccacttttgtcttggctttacaaatgaggtctctccaaccttgcttcattagttttgcaaaatagagaagttctgtataccctaaccactcactagggtggtgcatgtgctgttagtgttgaaaactgtagcttctatgttaataaatcacgaattgttgccccaaatctaaaagatcttaaaagaagagatacaggtttttcatcacagaggtgatgctacacctactgatttgtttagttgactaaatcgtggctcctgggaatctctgctctgggagatttttcagtccttggcgattattctctttaaagtcgttgtatttaccttcctagtgcatggtgtcctatcaggggttttaaatgctttccagcagctactcacatatcaaatgattgccatcaggatcagataacttgaggagctcaaccacctgaccagtgatggctacagaggtgctgataacagtgacaccaccacccttccttccagtgcaactatggacgatgagaatgtctctatgactctgtcccagtgtctacgtcaactccctcaatggcgataaccaagacgaatgctataccgtttaattacactgtcagtttgctgagaggataaagaggataaccaaaaaggggcagttgtaaaaacaaactaaaatggagactagacctgaaaaatccctcagcagacaaagtgagttaggccttgaaaataaccttaacgttttttaaattgcaaacataagcaaaacttaacttgggccatta

SEQ ID NO: 33412 - DNA, 1030 bp, Homo sapiens
catgtttcaccaaggtaacctttgatctgttttcttatctgttaaagtctacttggtgattcagttcatagcttgctagttggctgaatgctagaattgttgctggcaaggaatgctgttacagggggccagtagacagtggaagtaagagagacaggacaaaatgccaggagaaaaaggtcaagtcaaggtggagtacaaaaggcaaatgccaggcaggaaaatgggacgggcttggaaaagaatgcttagtaaagtccaccttccttgttttcactttttgtaacctaattactccaacatctttgctgctgacttttacccctgctttctcctaaattactctcccaaaggtcaccaaaggaccacgtggtcatcacatttgatgaccttctctccatttttaccctccttaacctctctgtgtttgatattgtcaaccactgtccctttcatgagtccctgtttccatggcgatggtgacattgtactcttccagctcttaaatcctcctgactgttctttccctgagctccataatgactccccttccacttctctagtcttcttttttttttttttttgttttgagacggagtctcacactctcacccaggctggagtgcagtggcgcattcttggctcactgcaagctccgcctcctgggttcacgccattctcctgcctcagcttcccaagtagctgggactacaggcacccgccaccacacctggctaattttttgtatttttagtagagacggggtttcaccgtgttagccaggatggtctcgatctcctgaccttgtgatccgcccgcctcagcctcccaaagtgctgggattacaggcgtgaggcaccgcgcccggccttctccagtcttctaattgtggggtctgcctacagaactgttcttttcttacttctcttttttctgcattttctatttcttggatatttaattcactcctatggcttcaatgatgatttctatgacagaggttttgaaatatgacagatacagacataac

SEQ ID NO: 33413 - DNA, 1033 bp, Homo sapiens
tggtaaagccatctcaaatttatatctctaaccctgacattcctcctaactccatgatcacatccttccttcaaaacatctccacttgaatgtccaagaggtttattaaatctaacaggggctaagcaaagcccctgctgtctttgcccaccatactgcatcttggtaagggcaccaccatttacccagctgttctaagtacaaactctggaatcatcctttttcttctactctacatcaaatctgataaaaaaaaaatcctacaagcgttgcctgatcatagatctggaatctggccatttttcatctcctccagcagtgctacatcagttcaagccaccattgtcccttccctgggctcccatggtgccttcttactggtatctgtttactcttgctctctataaatgattcctccaaacaaaagccagaggtacttaccttggcttacaagaccattgaggattaggcctttggctatctttctgggctcatgacctatcacctcctccttgttgactctgctgcctacacaggcccccttgttactttctgaacacaccagatggacactcatttcagggcttttttcatgctactctctctgccccagatacttctctcctagaacttcacatggctcactgcctggctttcttctggtctctgcccaatagtcacttctggaaagaggccttctctgaccataatatctaaaaaagcacccccacagactctatcctcttaccctgatttgttttttcctttgccatatgatgttttatatttctttatatatctattgatactctctttcattagtacattggctccctgagaatagggtcttcgtctaccatgttctttgctgcaatcctagcatctggcacttttcctggcatatagcaaaagctcaacaaatacttgatgaatgaataattccagttattcaagactgtgagtcatatttgactcctcacttgcattccctcctgtgtgcagtcaccgagccctttagagtcttatgtttatt

SEQ ID NO: 33414 - DNA, 1041 bp, Homo sapiens
acccatctcatcttcctcttctcttcaatatttctccttcctccaatctgataaatgaagcaaatatcataggctgccaagggaattgagatatttttgtgtgtgagtgtgtgtgtgtgtgtgtgtgtgtgtataatttaagtaaaccaaatgtataggaaaaatctgagtttgcattaaaaacaaaacaaagcaaacaactggggacttaacctttactttacaaaaggattcttttaaaaacggtctttaaatcccaaagtgcccctggtgcggtgaaattactatttaatctctaaaatttatatttttttcaggaagtttaatagaatcaaatgatccaaaaatccatatacacacacacatgtgcatgcaattaaaatatggtcatcttcttgtctgatgtgctggatcagtgcctgacatgtcaaatgcactcagagatgatttcttcaatggtggtgatggggcattctggcaggtgatcgcccctcagagccacatgtgtaagtgaggcaagtgccgtctttccttggcgtcctataccttcttggatgcaccctcccctttcccatttttagggatttttagggatgcacccttccctatttcccagccagagcccagagaggggaaacaaggacaggctgtctctttggctgctggtctactcgcacttccactatatccccttgggaccagaagtgaggatgggtttctcattcttgtcttttcctctctcccaggactccttctggtatccacagtctagaggaggcagggaccgggcatctgacacccctacataacattctcttttttcttaattcagctccatcattaagttttaataatgggaagagtggattacatgtgtttcagttttttgatatatgaaatttgggctgactaagtacttaatctgaaatgacattgttttaaactggaagagtgttgcaaatttagatttttttctactatccattgggtgtagacaggtattaggtggaatagttatttttttctgcacatctgagtcca

SEQ ID NO: 33415 - DNA, 1133 bp, Homo sapiens
gttttgaattgttagcctcttaactaaccagaaccgtatgtgtttttcctgcatttgctctgacttagtccatgactttcatctgcaggatgtgtcagaactaaggaatgaattacagcggaaagatgcactagtccagaagcacttgacaaagctgaggcattggcagcaggtgctggaggacatcaacgtgcagcacaaaaagcccgccgacatccctcagggctccttggcctacctggagcaggcatctgccaacatccctgcacctctgaagccaacgtgagcaaagggcagaggcagttggcctatgagtgggctgatgcgtgaggttggccacacattccttcctgtggacttgacattttggaagaactctttgccagataatgagttcattttagttttatgctcccattgaaaaattttccactatttttataagctgttaatttcttgagtactttataacatgtctgtagcttggataaaccaagtaagtattttttttttgtctttagcaaagtttagactgtgaatatgatgacacagattcttttttatggtggctttgcttgttttaaatttttgcatgacttttcatctttttatgtgtgtttcctgtagtttgatccgaaggaaaagagtatagtagcctgagaatcaggagatgggagttttagtcgtaggccttatgataattaccccgcggtggtgtgtagaaaagtatgtaaatttgctctgttttaagactttgaactacctcaagaagaggaatctaatacaatatttgtaatgtttccagagctctcagaatgaggatttttttgtaaataggtcagaagacgatggaactgtcctgggttagtatagtaatcttacagtaggatccttaggttgatgctgacttctgtttggggtatgtttatattttatgtggtgtttactttttttttttgacatagaaggatatagtgggagcagtgatacgctaacattcattacattctgcagtaatgaatctgtttaatgggtcagtcactgttttcagtagcatgacagtggggtcataggtgagctgtgaggggctaaatcttgctctgattgtctctttctgttttgagttttgtttg

SEQ ID NO: 33416 - DNA, 1011 bp, Homo sapiens
gtgccctgcctttgggagggtattttgctctcgttagttttgtgggcagcctcagattccctgttgagttgctgttaagaaatggagatttctggctctcattgggtaaggttttctgagttttatatcttattagatcacatccctttacccagaacaaatgcttcactgtcttctgattggcagtactcctgtggctttgtgccttgactcattttgttgtcttcagccttgaaggccccttcccacatggactgacatccactcatgtgcctgatccctgaagcctcccagcacccattcagttgcatccccagggcacaggactttgatctcttctgttgccctcgctaggttctccctggtgggttagtgctttgtatctgtctctctgcccctcactaattctacacccatgagaattagacattattctccttaaatatataaggaccatataatctgtatctttttggtgtgtgtatatggtatctggcacatggatctctgattaccagcctgacatcaacaaatcccctcagttacaacgtataggttaaacaaagcttttaaaagctcatgtggtatgacctcaaggttgctaacctggtcactcatggtaattagaaactctgattggcagctttgtatttcttgactaaaaacctaaataaactgattaggttttaggcgttctttcaaagaggttcttgagaagattgagaactatcctatttggtgcttagtgaaaagattttgaattactgtacgtaccagttgttgccatttctttattaaattcagaagtttttttgccaaataacaatttttcaatcttctctgtttgtagacatcttactgggtgatgaataatcctctaagaaaccctctgagctgctaactttttcagggagaaaatcacaagccatcttctcaagttcccctagaaacctgtggaatgccctctgccaagcactgctctggtactggggagtggagtattatgtcttg

SEQ ID NO: 33417 - DNA, 1047 bp, Homo sapiens
atgagggcttcaccctcatgagtaggataagtacccttacaaaagaggctcagggaggcgctcttgcctcttccaccatgtaaggacacgtagcaggcacccatttctgaagaatgggccctccccagactccatatctgctggtgccttgatcttggacttagcctctaggactgtgagtgacatatttctattgtttataaattatccagtataagtaagatattttgttagagcagcctgaacgaactaagacactctaagcgggaaactcacaaaaaatatttggtagtgaaaaacagtatggtgtgttaatgtatggtgacaagtgtttgtttgcatttaaaaatgcattggagcctcgttttgattaggcagtaaatttacctttaatacgtaagtttgacagttatatgtaatcagcttttttttttttaagatggtgtgattgaggttaatgtgaactgaactttctatttctaagctgtcttcatctaattttacctttctgtggaaaatcaatacaagtcaaccatttttattgcccagttattcaaagttttattcaaagagcaaagatttgacaatgcatagaattaacattggtttgtgggccaccttctgggccagcaccaaagactgaaaaaatattttgccccctaaaagttgttattgagtcttgtcaaatcacattgctctgtcagaaggtaagacaaatcagtgtggactgagagcaaggtcagcaccgtgaacagccattgcggttcctttaacccactgggaattcatgcagtgaagaagcaacacaccatgaggcaaatggctcaaacccaaagaccagaggttcaggggatatatatatatatttttttaatctgtagagatgggatctcactatcttgcccaggctggtctcgaactcttgggctcatgctgtcctacctcagacttccaagtagctgggttttctttgggctaattatttttttgtagagatggaggtctcgctgtgttgcccaggctggtctcaaattcctggcctcaagc

SEQ ID NO: 33418 - DNA, 1067 bp, Homo sapiens
ctgaaccttttccatttttatttgtaagtgaccattacagtgacttttgcagtatcatggtacttctttttttttacctttaatatgcttagttggctgggcgctatggctcacacctgtaatctcagcacttttggaggccgaggcaggcggatcacgaggtcaagagattgagaccatcctggccaacatggtgaaacaaaaattagctgggcgtggtggcgcatgcctgtagtcccagctactcgggaggctgaggcaggagaatcgcttgaatctggtaggtggaggttgcagtgaaccaagatcgtgccactgcactccagcctggtgacagagcgagactctgtctcaaaaaatatatatatacatgcttagttgtgcctcttaacctctactatttctattgtaaatactgactttgttaattaaaacagacaaaatacaagagatggaagctagagggagcctttgttcacctatgtttcaaatgactcaatagatgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggtacataaaggattcattctttgaaatgtagtactgattaacttgtgcaattaatttgttttttttcctccccatagcttaagattatattaatacctttaatcttaactctcttttgttttcttttagtctgatgaatatccttttatccttcctttttcccctcctggtgtaagaactcataactttatcatagactatctactttagctatgcttttccccccttcagtttcttactttgatttttgaattagcctaccatgagaaaatccagcaacatgcacccctagtatatgtttgcttatttggttcttttttgttctaagtttcttcattcctttttgtgtggatacattaatgactctaatta

SEQ ID NO: 33419 - DNA, 1055 bp, Homo sapiens
caacaattttaggaacaactgaatggtactctgcttagcatggagaagtgggttgagtagaaaggaagagaagccacgcagaattctgttttagcacttgtcatttcatgctattcagaacagtttaaagtttaagcacgaacatgtcttactcaacaaaaagggaatgcacttgggtgggtgggggtgaggggggagcgtagcaattgaatttcaggtccttgaaaaaatatacatccttatgagggatgaacaaaaagtttccagaaaatagtttactgggtgctgacttgtaaaattctatcattgaaacagtttgaatacagatttcaaacatgatgttgtagagtcaaaggtgatatagagcttacttctatgaagagcattcaaaccgcagcaaagcctggttttacttgaagtgattggaaccagggcaagtttagatcttgacctgaaatgccagaaaaggagatcgtgactcctgaaggaaaagtgctgcagaaatctgaacaaaaatgtcagggcctgaatactatttccattcttgcccctgttagtagttttcactttacaatcacagcggggttccctgagctgcaaatgaagaattaagttttaatacaaacagaattgttggaaggtaaatgcctatgaatgcaagtctttgaagtgcagttgttttgatggcactaatttttttctgtgccttaggaagtttcgccaccatgctacctaaggacagtgttctgaatttttataaaatttcttcctgaatagcatgagaaaattgggcatttaacctcctgaagggaactttttttttggggggggtgcctaacaattatagtaaaatagcagaatacctgtgaaattaatatacaatccttacagaaacaaaaatggaaaggactctcccatacacaaaacaaacgaaaacttttttgtgataatgtaaccacttcattttcttgtcatatgccagcaagaatgaaccttgtaaatgtgttgagtcatgttaaaaatatccttttaaaggttatcctcttctccttcct

SEQ ID NO: 33420 - DNA, 1050 bp, Homo sapiens
ctagtgtaattatgaaaagcaagggtacaagttcacattttctcacatgatacagatgccaagtagctcacctgaaacaaatattctagcagatgggaaaatgtgcacaaacctatatgcacaacatcctttataatgctcatttaaaaacatatttttttcacaagaagaacaagtgacagaacaaaggatatggaatttttgacaaataatggggaaaaatgataggacaaggaaagtatttgatagttgatatatatatgatcgttttataaatatgtgtaaaacaatatataagtattctataaatatatatttatagaatatatgttttgacatttatataatatataattattatacatagtatatatttatatgtaatataatatataattaatttatatataatatttatatataatttatatttatatattatatatatatatatagcaagccatagttgcccctactgtctaatgcagtagaggcatactatatgcagaactcataaaaaaacaaatttaggatttacttcctctgtataggttgttccgagatacgaattaatgtttcaatttcttttcttagttattgtatactttattcatacttaacactatgttttcccaggtatatcactaataaaaaagtttactggtttaatacatagtttatacactgaagtttgatttttcgcattgtttgcttagattaaagctagttggatatactggacattgtgttgcttttctttgagctttggaataaataatcgccctttgactagtggttgaaaataagatgccaggggaagaagcacacatgcttttcatggactctaaatgcaatataaaagaaaaggagggtatactgtatatgaattatgattcgacacacttggttgctgctagcggccaaatatgcttttcctttgctgtctgctccaatttctctttggacgggttgagagagcactacatgttcaggtcaagatgtttgctcagaaatagtagtacagttgcagctgtgtttgttggagtagga

SEQ ID NO: 33421 - DNA, 2767 bp, Homo sapiens
aacattgaagtgtttcagtagacataacacaatcaaaatgatccatttttcacctaagcaaaatataccttaatttaataaaatgttttataaaacgaactccctagttcttggatgtcagtttagtctcataggtttcttggagtcaaccatgaaagcaggatacaacagaggagcccatgtacaaatttctcttgaattaatttctgccagctctgattaaagtgtggactactagagatgtcaggtgccatcgtttcctgcttcattttactcttggcctgtttggcccctgccacaataaatccgactgtgattgtgcaggaattgcaggttacagttgctacggttactgttgttcagccagaccgacatcattactcatctagcgcgctgccatgatagctaccgctgatttctgttgctgagactgccaaagagcttcatgtgctaagggtgaaagttccgtcgaaggtggcgtctgtgttctaatttggtgtaaggaaacactatctgaattatatactgatactttgctaaggggaacagattgactctgtatcgagagagaaaacttagaaaagtgttcactttcagtgattaaaacaccaagtccttcattactaaggtaactttttaattacttattgggcccaagggactatgtttttgccacttaaaaaatagaggcatacaaggagtattgcatttaaaaaaattaccactatttaaccaaaactttattttcaaatagataggcaacagacttgatatatggacatctgaacacaactcaaaatagccattaccacttgtcatgaaagaaagaaaagtgcaaagccctgagcaggacctacttctacttttattttttaaatcaacgtgtaatcctgtgatttaaacgtcctaaatccaatgaagattaagatcatatttgagattttgccagatctagtgttgatggtttttacttcaaaggaattactaatagacttgttgctaaagaaagctaacagttgtccggtttctgctgttaccaacacacagagtggaccttctgagtgtgaaatccacagcatagctcatagcataagaaaatcaaatgcaagaatgcaagaaagtttctgtgtttttttttttttcactcagctgtacttatttaaacgactgctttcacaagtgcaaatgtttctaactccaccaacaagtacttatggactgccaacttgaatttgtagaatactatgatcaatgctcagaagggaaactaacaaaatatgtggctctatataatatgtggtatttgtgggcctcagctgttgctaacgtctgacctatactgcgtgaattaatgcctagagagttcattgagagtgatcaaatatgtgaatttcagtctatcatattcatgtaaaaaatatatcgtatacacataatcaggtaatattttaaagtttttaaataatgaaattgccactacaatctcaaggttacaattttggggactgaaatttacataaacattatttctaggaataagggttggtagggttttagttatatttaggtaattttaatgtatttgctttatgttttaagacactgaaatcaatttactttctatcttaagggaggttgtgtaaaatgatagtgtttaaatgcctactcagatacttgcagttctgttaactttggaagtcagtagacaaccgtattgttgaggtttcttatctgtaaaatgggaaggatcatacaatttactttctggggatagcacagtaaaatttagattccatattcaaaggaacattgtaaattttcaagtatgatagaaactataattatattattgtcatcctttcattgcaagcaagatggaaatgatagtcactcagatgtccttgcaacttgccctcagtcagcaaagttcctgatactattgcacagccctcttgcatttatccttactgtagtaacacgtaaatatgtgtagtcacattaattatcttaccacagcaaattgacataaaatgtgcatttgtaccatgttatttctctttacttggctgcagaaggtacattagggccaggatattcttaatgagatctcttcatgctctcccagttgatgattcatatagttttaaaattcatctataaaataaattacagatagaaacaaaaagactgtgactcaggaactatttgttagtgcatatatttagattgctgttttaatgatgtgtttttctgaatgacaaatgaaggaaaaatacaaatgttagaaaatgctgagtaaactccttaaactataggtaaagtattctgaaagttgttcagaagatttacatatgttgctaaggaacactttcactactaataaaaattttattttttaaaataatataagattactctgttagctttgtaatatgtacatatgatttgatctatggaacattgtcatctttatataaattgcataggtgattttaagtgtatttttagactactaattatgtcaaaatccagtaaaaattgcaaatcttttagcactttaaatctaaataatgttacattatgagacaagtttgaaccagaagtcgttttgttttgttcttttttccacaattccagtacttctcaaagtagcatagatctatatggtgtatatccactcattacatgttacctataactgagttgattataatcactgaattttttctggagggttaaccttaaaatattttataaattttgatat

SEQ ID NO: 33422 - DNA, 1029 bp, Homo sapiens
ttatttattactatactaattttatattatatttcaaagaagtgatacctccagtgtgcactccagtggttcaagagaaaagtgttctgtggtcaaatgtgttgggaaataatgaaagtcatatcacctgtggtggctacagtgtacacttgtgtgttaatcttaaaggcatactacaataaataaatctgtttaaccttttaaaatttgtttttcaaagttatttaactatagaggcctctcttctttcttaactattcctgtttgttcttgttaatccagagagcaaaaccagtttttagcttttccaatgaatagttactttttattacttctgattgagattttattaaagaccatttaggacatatagggttgacatatattattttttttgtgccagcgttgtcacgtgtaagacttttaatagtgcattggcttataaatctgttcttttcaatccatctttgaaggtgaactcggcattctgttgtagccttgagaaatagaagaacttagaatattttctaacaatttcattaacttagcaccactatttgctttaggtatttgtttatatgtgtgtgttgcctgtgtgcctgtgtgcgcgcgcgcacacacacacacacacacacacaaagtcattcaactactattttaaggactttaacattttatagcttaactgtctctctcttccctgcctcagccaattgaagcaccagaagtcctttgtggaacacctgctgtgcacagcattctttagcaacacaatgaggggtgcatcatctaagctggtgtgaacttgcaggagtctttctcactctatagagagggtgttggagccaaaagcttttattttatgtacaatttggagatgattggtggactttgaagtcattgcaaaactaatttgttcagtatttttgccaagaccaatctttccagtattagaagacaaaataacttagatatgagggtttagacacaggaaaaaaaacaaatggaagaaatgattataaatctcca

SEQ ID NO: 33423 - DNA, 1162 bp, Homo sapiens
gaaactaccttagaaacttaggtgaagagacaggtgtcagatatattatgtgacttgcccaagattgcctggcccgtggagagagagccttcactgtggctcagggatgtgggcttcctgtgtgaaggtcctcccaagactctgtgctgcctggtctttacctggtccacggacaccaatccttttttacttttttttttttctaccatttcatggtgtttgcatttgtcaatatttaaagacacctacctgaaattcacagaactgtatatgatgcttctcatttttgtttgtttgttttttgtctttagaaagtacccacatattgtctgggtgtggtggctcatgcctgtaatcccagcagtttgggaggctgaggcaggtggatcacttgaggctaggagtttgagactagcctggccaacatgacgaaaccctgtctctactaaaattgcaaaaattagctgggcatggtggcatgtgcctgtaatcccagctacatcatgagtctgacgcacaagaattgcttgaacccaagagacagaggttgcactgagccaagatcacaccactgcactccatcctggatgacagagtgagactctgtctcaaaaaaaaaaaaaagaaagcacccacataataaaaatgttgtgctgggcactatataaagccaggtaaatatacaaaggtctcagcctccactgtgtatcatgtttcatacacggaagattatatcctgaaatcactggagtaaatgttgaagtatcagagtatcagtttctcccccataaattctccggttacacttagaaagttttttgtttagttgtgttttgtgtttagttttggctctaagaggaaggaaaggaaattcacattttgtttgtctgacacttttacgagaagttatatatggccttttaatttacacatgtaaaattaatttgtaaaagcagctatgatgtaatttatggatgaaaaagctgaagattgactagccttgttaatgaaaggtagatagccatggttggaattcatgtcttctgaggttcataaaacaggccatcttttaaattgagaagtgacatcataatagcaacatgggcaacctgaaaggcagtcaaagaaaaacaaggagggtattaaaaggtctgaatggtat

SEQ ID NO: 33424 - DNA, 1026 bp, Homo sapiens
agaaaatgtctgggagtcagaagtatgttcagacaagttttctatcatgtgttgtctaccagccttttacatactgtagatattctagaaagactaacaagctagacaaattaatttctccttttgttatgcttatgagaataaactgattaaacagttcctattctatctgtgtaaacagagacatattagttaacttactgcttattttattttcccacatacttacagtaatttcaaatgttgaaaaatgaggagagcagaatatggcattaagcaaagagaatgaaataaaaaataaagcaatgatctgaactagaaaaaaaagttttaaaaatgtaatttttcagttacacaaaagttaccatggcattacctttccttttgtgtctgttggtgatttaatttagtagttttagaaaatgtgtctattgctgtatttaaaaattctaattacagcaattggtaaagaagtttccaagtacaaggggtatttgtagagaacctgtaggactgacaagtgattgacaggtaaacaaccccactgtggccttatattccattctgtgatgttggactatagatactacataagcctcaggaagtaaccaccttccaatttttattaaatgcttggcgtcatggatgtaaacagtattgtgccttagttgactaaatgtggcactttcttttacactgccgcaccaccctgactcagtgtgatggaatatctgtgaaaagaacaaatgggaacttttctttaatgcgtttaactgaatgtatcccccgaaaagaaaagcaagtgcagatttcatcaaataaattgaaaccatctaaaagtgaatgaaagaggatagcatttctaacttcaaatgttctgtttatgacttactagtgccagtgtgaaattgccctttcttctctgctaatgcaaaggctgacaggtcagcatgcacacacacattatgttatgcgcaatcggaagctcttgagcttgtccttgaacatgctttacagttaatatat

SEQ ID NO: 33425 - DNA, 1054 bp, Homo sapiens
ctttgttttcctgaattttaaaatgtggaagcaagtcttctttttgtaaccatttcatatttttaagatgttctaatgattgcctcagagtctagaggaaaaatattctgagggttttccccccttccacttgaatgctaagaacttggatgttttgaatgagctattcgccagcagatgaaaagtcattccagataaatgagaaaccaagtacagtaaaatctgtgttttctaaccagcaaaatctggaaaatcgtaattttttgattccccaggcaaaaatgtcaatctaataaataggctaactgaaatagggtagggtgactgtggtgaaatttaagttgttaagagatgcaatatgtattcttattgctaattttaaaaaaaatctcatgggtttttgtgagcaaaaatgatatatttgtgtaaatcatggcattttccttccttttctagaccatgaggaaaaacaaataggaggtaaaaagaggagatcaacacatgaattaactctgagttatctgtaacggataccctgtcttcataatgtatctcataaaagttttaataccagtgtatttcaaaggtttgcaagttatttagtacttggaacatgttttcccatagaaacaatgttgtaaatattggttcagttcccaggccagtgcacacagcctatttaatccatatgtatctaagagacagtaccaatgtttgcttgagtactggatcctaaaggcatatgtgcagaaaagagcatagtaatcggtatcttctgttagttttttttttttttttcctttttgagacagaatttccctcttgctgcccgggctggagtgcaatggcgtaatctcggctcactgcaacctccacctcccggattcaagccattctcctgcctcagcctcctgagtagctgggattacaggcatgtgccaccatgcccggctaatttttgtatttttagtagagacggggtttctccttgttggtcaggctggtcttgaactcccgacctcaggtgatctgcctgccttggcctcccaaaatg

SEQ ID NO: 33426 - DNA, 1549 bp, Homo sapiens
cagacttttaaaaaacattatttctaatatatttatatatcaacaaggatcaaaacaaattttgttactggaactttatcacaaaccatgtttttagtgaagaaatagctattatactttcttgtacagttcgttcaaaggaggacatgtgttttgtcaacgaggaaagaaatcaatgctatttgtgatattatatacctcatttgaatattttatctatttcaataaattgaaaatgagttcctactttcttttccatatgctgattttcatgatttctttttctatagagaaaaatatagctgagcagatttttaaatgcagcattggcagtgttacaggtctttaattttgttggcattgttcattttgcctttttttgttttttttttttagttttgtgatgtgaggtgatgtgatggtcaaaaatgtggactttttaaggcccgacagggggagccaattccatattctattgagatttcctggcattattgcagttgtccatttgtcacggccaaaatactttctttagccttggctgtccatagggctccgtaacagatactctttgctaaaaataatacagtattttatattaattacctttcagtcattaatattgaaattattaatctattgagataatgcctaggaaactgaaatagggtcattattttaaaatgtatgatatcatcattcaaggtaaagttaatcttataaatataaccttttcacaataaagatcaatgtagaatatatggaacattttaatgctcataaaaattctttagtataatattttatggttagattaataaacatgggaccatctcttctcagatttttaagcaaatcaaatttataaaataattaaaatcacatgactctattatatgacttttttaaaaccacataccttactttaaaaaaagtaaagatcctaaactaagttcaaggtctaccacaatgaatcatttaggatggtattgaattcccataattgtttggttctgtgttttgttctcagtaaagaaagtggaatggttttatttatttgaattatatagggtatatcttatcaaaagacattctaagattacaaaaacattcaatgtgatacatttatcttgacaaggaacatggaattatatgtgcaagaacattcatttgttttcatagtttagaatatataaaattttataatttctgtgcatttatcactttgtaagccttaattccctagttagctacgtatctatatatcctaagatataatatatgatgagtgcattttagttgtctcgcacatgtagacacgtgcagacatgcacacacacacacacacaaatatagacatcctctttgtttttatttcctgtatattcactaacatgataatggacatatattatgtgataaattatattgtgtgttaaataactaccatagattacctattttaaatttcaagagcaataaatctctgttgctaaaatcaagcactaggcttttatggaactcttcctattttttaaaaaacttaact

SEQ ID NO: 33427 - DNA, 1072 bp, Homo sapiens
agcttaggactgaggaagaatattccagctagatggaatggcaaaaataaagacatagaactacaaaggtgagtaggtggtaagttcaagggaaatgataggagatgaaccttggaaggctggtctatgccacactacatgaggtgataactgagtttgaatcacacctgctaggctgggaacagcatggaaaatatttaagcaatgttgagacatgttgaaatctgtaaaatagaaacataattaccattttgagggtgggtttgagggcctagaggcttatgtgattttctcctgcagagttttagctatgatagcagaggaggtgttttctgcagtatctcttgtgtcacaaaaagttcctaccagtgtatattattgtaaactactcaatacacatttgttcattggatgaatgatgctacttatccccctactcttaattaaaagctcaactagataacttttttaaaagaaaagaaaacgaaagaaaggaaggaaaaaataaggtaagagagaactaaaaattggactataaggcagtggaaataggtaatacagagtgtatttgcagaactcaaagatacatggttgtgaaggaaggagaggagttgtaatagactattactttgactccagtgaaacacacctctcaattttcatgcccttgtgtagtgcctttccttgaatctgagcttggccatgtgacaagcgttggccaatgagacattagcaagtgagatgcaagcagaggcttgacaaatgcttacatgttagagatggtcttcttgcttggaatacttgtggttagagtgcaccatcttggaacagctgccttgctgttaggaagcccgagaagtgatacaaagagatgcacatgaaggaaaatggagatgcagagcttacattcccatctgtgctcccagccagtcccagcgctcaggccattttgtaacttccaaccatcccctcacccccaccataccatacaaaacgcaaaaactgcccactcacaccacagaattttaagagagcgtgattggtggttgttgttttaagttgctacacttta

SEQ ID NO: 33428 - DNA, 1051 bp, Homo sapiens
aacatggtgaaaccccatatctactaaaaatacaaaaaaattagcgggtttgttggcgcgcatctgtagtcccagctacttgggaggctgaggcagggaaatggcttgaacctgggagatggaggttgcagtgagctgagattgtgccattgcatttcagcctggcgatagagtgagactttgtctcaaaaaaaaaaaaaaaaaaaaaagaaagaaaagaaaacatattttagagtagggcttttaattgatattttagtccttctttaaatggcaaatataaaatagattttcttgctcttattattttatcctaaagtgattttcatggaattttgtctataagaaattgaaataaattttatgctgtataattatgtcagaatttgacacaataaagatatttttcagttctatgattgggttaactgtttctaggcttgagggagaattttgcttgtaaaccgtattaatttggtagatcgcattctactgtagtcttgtcacatttgttgactttctgtaaaaagtggctgtattagtctgtttctgcattgctataaagaaatacctgagacttggtaatttataaaagaaaagaggtttaattggctcagagttctgcaagctgtaacagaagtatggcactaacatctgatggcttttggtgaggcctcaggaagcttacagtcataacagaaggcaaagctggagcaggcacatcacgtggtaagagcaggaggaagagagagggaggcagatgccgtatgtttttaaacagccagctctcatgagaagtcagagccagaatccactcatcaccaaggggatggtgccaagccattcatgagggacccacccctgtcatcaagtcagctcccactaggtcccacctcccacactggaggtcacatttcaatgtgagatttggaggcagccaacatccagaccacatgagtggctttctgattactttctgccttctttttttcttttttagtatatccactttactgtttgtatgtgttaaagcggtggtccccaacctttt

SEQ ID NO: 33429 - DNA, 1064 bp, Homo sapiens
caggggctacaccatttctaagtcttaagtaaaaataggagtatatgagtaaagaaggagccataaaattcaagctggtgtgtaggaccccagtgactagcttctgacccagtggccaagagacctaaacacataaaggtcacttcctgactctagagctcaatgaggctgcagaaatgagatgcctttctgagagaatccaggagaagtactgtgtaatactggttcactgcattggaaccatgcgggaaaattcataaagcatgaaatgcgtgggagcaaatgcctctttgtgttcctagttagtgccactttacgttagaccttaccgcctcatgcccagattttttctattagtcactttcattttgcattctctctccctacaaattatctgccagaatcatttttattcaaatctgattcctaaactcatgtttaaactttatcagtggcttgatccatctgaagggacagtggttctcaagtgtggctttgggaccggtagtgtgaacatcatctgggaattgttagaaatgcagactctctggcccagaccagatctgctaaataagaatctggaggggtggggtcctccagttaattctgaggcactaacaactcgttgaaagccagtgctttagctaagatagttataaacatagctgggctttcagcatcctactcagtacaggccagccagattccagacttgtatttcctgctttcctctatcaccagaacctccatttcatatgtgaacctccaaatctcagacaggtttcagtcaatttaagaagtgtattttgccaaagttaactacatgcacccatgacacaacttcaggagattctgatgacatgtgcccaaggtggttggagcacagcttggctttagacattttagggagacatgagacatcagtcaacacatgtaagatgaacattgattcggtccagaaacgcaggacaacttgaagtagaagagggacaactcgaagtggggaggggtcatcaaggtcataggtagataagagacaaatggttgtcttgaggcccccaaat

SEQ ID NO: 33430 - DNA, 1104 bp, Homo sapiens
tttaaattgaattgaaatcaatttattgaatgaatcatattcaaaatactttataagaaattttatcattaaggcaaatacacatggatatcagtctaaatctgatcttttttttttcccctgagattttccacaagggaagtggaggaagaaaacagtagaatataacatatacaataccggcctccagccacagtgctacttcccttaaccgtctaaggaaaataaatatatattatgttccagttcagttatctgtagcctgtagttagagatagaaaacatatcagattgggcagagtctaagattggctggcataggaaaaaacagaaacttgtataagctaaatcaagttatgtcactcgaactaccataaaatagtttgtttctgatttttcctctttaattatccccatgtgccttgcacagtatattgcatatagaatgtgttcagtttgtacttacaaaattatttgatgtatacctaaaacaatattttaaatttggaagttcataacatgatcctgaaggcactttggacaatttttgattaatgacaactaaaacttttcaaggcagaccactaaacacttaaaagcggggaagaaacaataagattgtgaacacttgcggggtaaaatcaaaaagcaagtcaagagcataggggtggcgaaacagagcttgctgaagggtaaggctagccagtcatcacagcacgagcaaaccagactgaggactgaatcatgtgacacttgagatccttgcgatagagtctttggagcctgggcatgacacaaccagcttgctatgttgacaaccccagtgcattgagacaatgtattggtgaggtgctgatgttgtattggtgaggtgctgatgttgtattggtgaggtgctgatgttgtattggtgaggtgctgatgttgtattggtgaggtgctgctcaccccgaccaggccatttccctgctctctttgccattggtgttaaagcagaggaagtgattatagagatatccttttaaaattcttccttaaagtaacggaatgatgtaaccaaagggcagaaacctgcaagtcccaaatcattcctgaaaatggaat

SEQ ID NO: 33431 - DNA, 1015 bp, Homo sapiens
atctcactgctgtattccagcctgcatgataaagtgagacactctcaaaaaaaaaaaaaaaaaaaaaagaaagacattgtaatgattaaatatttagaaaaaaatcacatacactgtacattctgtatggattacaattatttctagtattgaaaaggtaataaccaactctttaacatgataatataactgaacctgatttaatttgtttttttctttggataagggagtggaggattacaatttctcagtggtctacttggtcacatatatttgttaaaagccattgtatgactgaaacaatcttagtgccggggtgtacacagtaattgaacacactccctgctttccagatactcagaatttaatttcaagaaaggcacagcaacaagaatttcaggagcaaaagggtatggtactaataacgcttgggctgtttggaggaatcttcagaggaaatggttaaagagactcttagcaaatgaatttctatgtgattttcatgtggactctagggcaaaggacattcccagaagggatggcaacaagcacaagtttgaagtgtatgaaatggcattactctttctaggtagcacaagggattagatgtggctgaagcatagattgttttgaagacattaacaagatctaagtttctaatctaaagacaggccatgttgtgatcatgaaatggcctgtagactctcctatggtcttggatttctatcctgaagaccccaagtcattgaaagaaagggaaagcagtgtgatttaaaaaaaaaagaaaaaaatctaattgagtttcagaaacaccattctggtttttaccacattgtatatcatcgtatgtctttgtagtatggtacctgacacattgtcaaattaatctaaggatcattctaattgcctttaagtatagtaatttgttcatagttcattactaatcccctccatctataatctgaatacctttcccatcaatcttgccttctccaaaactttcttttctccttta

SEQ ID NO: 33432 - DNA, 1039 bp, Homo sapiens
ggagtatctgtatcttgttcattcattaaatatttattaaaaaccttgtagtgctacttctcttctggatgtttaggacatattaataaacaaaatgatccatgatacctgccctcatagagtttaatttatggccagaagagatagacaaaaacagtaacataataaatattttttataataaatatatattttttgagatggagtctcgctctgtcccccgggctggagtgcagcggcgagatctcagtccactgcgagctccgccttccaggttcatgccattctcctgcctcagcctcctgagtagctgggactacaggtgcccgccactagacccggctaattttttgtattttttggtagagatggggtttcattctattagccaggatggtcttgatctcctgacctcgtgatcggcctgcctcggcctcccagagtgctgggattacaggcgtgagccaccgtgcccggccaataaattttgtaatatattagaacacgttaagttctatgggaagaaaaaagaaagacggaatgaggagggtagggatggttggtttcaatttcaaatagatagctagataagccttactaagaaggtaagatgaacaaatacagagagatacagatgcctggggatggactaaaaagacagccagtgtagggccttcaaaacaagttgccactagtaccccaaatgctgaggaccttgcactttgtaggagtatttgaaagtatattgaaataaagagcaaggggtcactggccttctgctcagacgcatagactttagcaaaggagagctgaaggaattgtgttccccttcagtacccatggagaatgtgtcctctgttgtgtaagaaagaattggatgagatattatactgagtcaatgtttgtaccataacaccttatttttccttagacagacagtaaagcaaccactaagggtgcttaggcagccccacttactgttttgtttactgtaacttttagtgttcaccaaacacatcttcaagggcattttaaatag

SEQ ID NO: 33433 - DNA, 1107 bp, Homo sapiens
aaaatagatatcttatagttatttgatttgattctgccattcatcgactatcgcactttttttttttttttttttttttttgcacaaatacacgttctaatgtcggtccatgtgctggagatacaggcataagcaacagcagggttgactagctgtggatagtggtacatgattagaagcctaaatgtgtaagtcaggaaactaataaatcctgcctgccttgcctgccttttcttccttcattttctttcttttctttctttttttctttcattctttcttttttccattatttttgatgcattatacttgtacatattttgagatacatctgaaattttgttacatgcatagaatgtacaataatcaattcagggtgtttagggtatccatcaccctgaagagagggtgttcctctcttctagctattttaaaagtacagtacactgttgttagctactaacacttatactcttctatcaaaggttaggatttattccatctatctaattgtatgtttgtacccattaaccagcctctctcttcatcccccaatccactcatacacccttcccagtctctgatatctatcattccactctccattacttcgtggggtcaacatttttagctcccacatataaatgagaacatgtagtattttctttatccctggcttatttcacttgacgtaatgatctccatttttattttattttatccatgttgctgcaaatgacatgatttcattttttatggccaaatagtattccattgtgtatgtatacgcaatttatcctttcataaccctgtattgctgataatcacttagatcttcataaaacttttttttttcttgagattaagtctcactctgtcacccaggctggagggcaccgacagcatcacggctcacagcaccctcaacctcctgggcttaagcagtctttccatttcagcctcctgagtagctagggctacaggcatgtgccactgtgctaagctaatttttatatttatttttttgtagagacaagatctcactatgttgctcaggctggtctgaaactcctaggctcaagctaccctccctctccagcctcccaa

SEQ ID NO: 33434 - DNA, 1025 bp, Homo sapiens
cccacctcggcctcccaaagtgctgggattacaggcgtgagcacccacgtctggcctgaaatacttatttctatgtgactcttcttgatcccctttctcctatcttcatggagccagtttcctgaaaagaagtaccttgaagcaagatatctgtagactaattctgcatttgcccttgtaatccaaagtttctcaacctaggcactatttatttttgttgttgttgttgttttggagacagagtctttctctgccacccaggctagagtgcagcggtatgaccatggctactgcagcctcgaacttgctgattcaagcaattctcccatctcggcctcccaagtagctggaacgacaagcacgcaccactatgccctgctaaattttaaaatatttttgtagagatgggagcctccctctcttgtccaggctggtctccaattcctgggctcaagctatccgcctgcctcgtgctcccaaagtgttgagattacaggcatgagccatcactccgggccactcttgatattttggaccaaataattcttgtatatgagaagctgtcctgtatagataccagtagcatccctcaattgtaacaataaaaaatgtctccagaaattgccaaatatcctctgaggggcaaaataacacctggttatgaaccactgttaaaatctgaagttattgaggtatgaaagactgttaataaattacgctgtaacagatatagtgttggatgatgtattagggttctctagaggggcagtactaatagcatatatggatatatgaaagggagtttattaaggagaagtgactcacacagtcacaaggtaaagtcccatgataggctgtctgcaagtcgagaagcaaggaagccagtggtggatcagtccaagtcccaaaacctcaaaagtcaggaagctgacaatgcagccttcagtctgtggccaaaggcctgagagcccctgactatccactggtgtaggtacaagagtcttaaagctgaagaacttggagtc

SEQ ID NO: 33435 - DNA, 1752 bp, Homo sapiens
tgggcagtcctgggcagctctgaagtgggacagtatgaaaggaaggccctgggctttgtccctatgagtacctattgtgtcacataaacaatagtgtgttaatggggtgctgaaaaagtctcctgcttaagcaactcagtttgtttatgattatgaatgtcagcagaggtctataaatgacaatgcagtttgtgttttgatgattgtctctctgatgggggtgttgatagcttttcttagttcttgtctcagcatttattcttgattggcatatgacagtcatattcttgggttctgttggtgtttttaaatcatgcacatgcttgaatttctcttacagagcgagaatgacattatatctgctgcttgttaaatagattctcagtttatgctggcaaagtgtcagtgctgtatgtctctatgtatgcaatttttcttttgtacagtcatttttctcttagcattctaaagattgattgaactcttgtgttatagcagtacttaatgtgtcacttactgaacttaaaatcatcactgtaactcaatgcataacgctattcatcatccattgaacctgtcactcctgctgattgtgcagaataaaagcctcttctcacctttttttttattataacagatatagtttgtgcattttttcttcatgttttaactgatattttgtcatcagttctctgatgtttatcaagagttaactttttttccaacccagattaatacaggttagagagtagaggagtttgttaatacgtaacaactactaatcactaaggctagatttattacatataaatatgtcaaattagataaacgctacttaaaattttggctgttggaaaaatattaacttgtaccttcaaatttattagggctcaaggcatattaaactttatagcagactttggatgttttatcttttaagaaatatttgaggccggatgtagtggctcacgcctgtaatcccagcactttgggaggccgaggcaggcagatcacgaggtcaggagattgagatcaccctggctcaacatggtgaaatcccatctctactgaaaatacaaaaattagctgggcatggtggcatgcacctatagtcccagctactcgggaggctgaggtgggagaatcgcttgaacctgggaggcagaggttgccatgagccgagagtgcgtcactgcaatccagcctgaaaactgagtgagactccatctaaaaataatgataataataatttgacttagtgaacaaatttgcagtaaaacagaaaaaataatatagattacacacctttataaaatctgttgtataatcatctagagatgcaatttgaatgcagcagtataacggagaagcatcagatgaattctcagagtatatcaatcttgcctttgttctagattagagcctggtttttagctagaggtgctgtagtaggaaaaacaggtttgtattgattcagattgtgtgtgcattcatagcagatgtggaatgacatatttctgccagataattatcacttagcaaagggtaaaacattagaacatcatgaaagttaaagttttaacttcacaggaaaaaaaggagctttactttaaagcatgatgaaaattatagaatttatgcataactcagttattttgttctgaactttaagaagaaactttcagaagacatccctaaaaaagcaagtataatgaccatagtatgaaacttaattgtgatataataaagctt

SEQ ID NO: 33436 - DNA, 1036 bp, Homo sapiens
agaggtaagtcgtttgtcattttggctagatcttcccctaggaacttctaaatggtttcatgacctcatttcatcctagacaaatgcaagagggctttaatatgagaagagcctcaggaatccaacttgtagatataagcctctcttttaacaggttacttagtaaattagttttctttgtactgtgattcattaagaacaataactttgatttcattttatactttacaggaagcatagaatgactcaatagtagaaaaatacaataacatttttaaaaattatgtaaattaaataaaatggtatacgttaaaattgtgaaaattgtgtaaattacataaaaaatatatgtgattaaattaaaaccaggatttgtggggtggctgaattagatttcttaataaaatttatgaaaaactgtgcatggtacatactattctttcagaagcaataacagttgtaagagattattttttaaaaaatagataccatttattgagagcttactaggtgtcagccagtgctgtatccacattacatgtatgaattcatttaatttttaaagtcaacctgtgacttaccctgtgagctcactatgtgagccatcacccttgttttgcaaacaaacaaattgagggggagaaatgaatccatattcttattttatatcagccatatctctcaacaaacgctaatcagagctgattaacaaattataatcagcatgttcaatatttgatatttcatttaccttgcaggacatcctttgttttacagaattttttaaaaaccttagtagaatttttcttttttaactattattaaggctccttaggtgagtggttttcaaacgatatcctaaaggtctccagaaatttcttagagaatctcatatcttcttcaaccagattcacttgaggtatagtcatttcatatattaggttttattagagcttttccctccttctcttgctctgcctcgcatccatccatccacccgtccacccatctacccatccatcaatgaacttaattt

SEQ ID NO: 33437 - DNA, 1995 bp, Homo sapiens
gaggagagaatgggctttgaggatggttgcctctttttcactgctgcacctcctcattatctctccaggaagcaggttgattctggccggcaaagctccctgaggtgggatccattcagtccattcttacaggggtaatagggcttggggctcatttcagtcagccttcgttggaagagagaggtccctttcctttccttttgaagattgattagtttccaaagaaagacagataacaccactctcattctcactttctctcttttttctgttcttgaaaactcaatagttgtgtacaataagaagtcttgctagacaaattgtgcctatgctttatgttctgtaaacatgattcttgaagctgagaaacttttaatggaaccctttagctaagctgaaattacttacataatccaactctgtattagttttcctggtttttgaaatagtgtcacaaaatagcaaaaaaaaaaaaaaagaaaaaaaagaaagaaaaaagagaaagaatgggaagtagagaatttctaacacagtcatctaacagactgactcagatgtaacaagaaagtataataataataaaatttaaaaaaaaagattaacagaaaacaaaacaaaacaaaaaaaagagaaagttctcagtagccctctggaaagagaaatttctaagcacaacttttttttgttaaagataattgaaaataattatatgtgtgtttggtaaaccacaacgatctttctatattgttaacacctaaagtaggtgaagaggttaatgaggaggtttcccagcaacaaatttaattgtagtcatgtaaaaattacataaactcaacataaaatttgaacacctgtgcaggaatctgaaaaaatttcattctaagtaattcttataatttggactctcagtctagtggtgagaatttgaaaaagtaaagaatgctcatgataaagtttgacaggtgctctgaaagcagtaaatatgaggaattaaggcaacctctacttttgacatcgtttgctctgaggaagtattgtatatcctgactttaattttttcaggaccctgtgcacttacaggatgacagaaatgatatttcttctctcctgaaaccctggggttgatatttacatatcacactcagacatacaaaaaatactattctgctttatttatcaataacaagaccctgtcctcaatgatggagacagaaaacaactttgctaagttaagctatttcagccactacttctggtttttattgctttatttcagaggaattcaattgcagttgactaaatcctcagtcaatttaaagttcatatttcatgtgaggaatgtttttctctaagtgagtccacattcctttctctttctttcccaagatggtccagggaacagggctgaattcccatgttctcatgatgagagaggaagttccttctggtttgtgtgctgtctctgtcctcattgatgtcctctgggatatagttgcctggtatcttgtgttcttgcccaccgaggtctggccattacagggttgtaatgctcatacatgctgttgaggcagaggttccttttcctctggtttttgagatttccatagcaggggtcggtaaactacagcatacaaggaaaacccagctgctgtgggctaaatccagccatttagcttgttggctaaggctgtcagttttcgttctacaacagcagttgtgagtacttgcaacaaagactgtatgtcctgcaaagtctaaaatatttactctcaggccccttacggaaaacgtttgccagcccctgatctctctgagtccttggattgtccactctttgtttgtccttcctcttggcatgtttcatcttttccagagcacacaggaaccactgggtctcctgcacagaaactcagggcagacagagtcactgtctagggacctccccatccctctcctatgtcactgctttggcatcatgctgtatataaaaaggta

SEQ ID NO: 33438 - DNA, 1025 bp, Homo sapiens
gctgtcatctgtgagagacagtgtgtgtagtggctaaaccaatacaatttaaactgcctaagtgtgaatcttggctcagccacttttggattgtgagtcattagcatcacttccctgtgcctcattttccccatttgtgtgaaagtgggttttagaataatgcctacttgatgaaggtacagggaaaattatatgcgatgatacatgcagggtgtctggaggaatgaacaccagatatgaagagagtccttgtatgtgtttgctaggattgctatatcaaagtactatgaagtgcatggcttaataatagaaatttattgagttactttttcctagcctgcttattatttgtgtgaagagaaggacttcttaatgaatacatgaagcaaaattgttctttaatcttttgctttcagttttacccttactgctttttgtgtttggactttttatctagattgtcatttctgttctttggcatttaaatggcctgctttaagcagtccagacctttctttgttgtctgagactcaatagtttcctgctgaccatctatctgataagttgagtcttttgctaattgtgatctcatagcctactccttcaactttcttcttatcccttctcccaatttttccaatctgtattctttttcctcttctctccttctcttccctttctccttctttccttcctttcccttccctttgtccctatttactgctttgtcacttattttcctgtttcttctgcagcagtaaacaggaaatgcagcttcagtttgctgctacatgttgttataataatactctgaagaaattaatgcatggtttcttcgctgtgacaatataaacttattaaaggcttacgttcactcgatacattgatcatttttctgataactctaaaaaccacaaatgtcaataagtcacagagttgaaacctgtcaacatcactacagttgttagatttgttgtttagccttttttattattgctttttttttcttccttatagctcattga

SEQ ID NO: 33439 - DNA, 1028 bp, Homo sapiens
attaaataggataacagatactacaaagcacttcctaagcctgaaagtgctgtgttgtataaatgatttagtagttcactgcttctcaaagctgattatctactagtttgttctgcataagaaactgaaggctgcttccctggagtttcttccagggaatgctgcgttgttttcatggggtaaaccacacacatcttccttttcttctacaattttgcaaggcagttataaattgtcataatcttctctgtcaagatgagcatttcaggtgtatatacctgttttatacataatatagttttaaatatcttgcagttgccaataatatcctctgattattcctgttttaattttttaaattgagactatttttagagcagtttacatttacagaaaaatagaacagtaagtgcagagagctcccatatacccactgtcctcccacacacggcttcaagtttgttttttaatcacatgtggttgtcggaattgtacacattatcccagatgtgatctagaactaactttctgtgatgctaagtagagggagaagtcaaagatgatacccatggtgtgcagtgccattgggatgtcagtcatttactcatttcagtctccaggaaaaagtacagacgagtgagtagagaatgatttcagtttttatatattatgtttgaggcatctgtgagatacccatgaagtcaggtacatgaggtacctagtgtgagattgtggctctcaggaaagaaagctcttaacagatgaagtgatggtggagttattagtgcaaagacagctgagatccctgaaaagtggggttgagcaagagaacaaagaggacccaagagagggcatagaaaaaactgaaggaacaacagaagatggagatgtttcaagaaaaatcagagttgtatttgtttggtttggttctctgcagaggcaaaatgaggaaaagggtctttgcatttgatttggccttactggcttcagtggtcttagcagagcattaacatcacagactgaagctg

SEQ ID NO: 33440 - DNA, 1033 bp, Homo sapiens
aacaggtatcctaaaggtaactgagcagataaaaggaaaagacaggaagttggtcctggaagtatgggcagcatgaatacgtaccatgctagagtcatatagctgggaagacatggaacccaaatttgaaccaaagactcaaaaggctcctaagtcttactcttcccccaacactatttttcagttgttttcagtgcacctaagaaaattaagtggcagtcatttattaagccagaataaaaaacaaagttgatttatctgcatgaaacttgaattacatcaactagcttaatttttttgttggagtaaaaacaaagctatggaaacagatgaattcatcgcttatttaaaaaaccagctcttgaaaatttcatgtttgttatatttattgttgtagtactttgtaagttgtctatattcagttatttaactgagtatattacctattcagcctaaagaaataaaaggaatatagtattattgtgataagggagaaaatttatttatctaggtacaaggaataacatgggatgttaattttaacatgtgcattacccaactaatatagcttttgtttcctttatcacatttttccatacttcctaccctacacaatttgcctcgagtatttaaatgtggaaaaataacggggtaataaggtaacatattttttcaattaaagcgtggtaaaggattttgaattttttaataaagaattttacttttttagtattaaacaacaaaatattgagatacctaagaaggtaatataagttgaagtactttataagctttaaatagtgtatagctgtaagatgatactgctattaaaaaaataagtaatactatttatataaaattctcaaatttctcgagatatatctaaattattttcattataatagtgcatttaataatcatatcaaattacatttatatccaaagcttgttggttaaacaaatacatgtttaaaatagttgagcttgtgaaaatgaagtttggctctatttaatcttttgggatccagatgca

SEQ ID NO: 33441 - DNA, 1033 bp, Homo sapiens
cagcacatctactagcaacaccttttttaaaaatttttttgttttgttaaatatggaaatatccaagcttctccctcaatgttttggaggatagtatttttctgaatgtagaatccttgcatgacatcttccctcccacccttgaagaatttcaaatatgttatttcattgccttttgacctccatggtttcggatgagaagtaaactattaatattcttgaagatcccttgtgaatgatggtccgcttttttcttactgctttcaagagcctctccttgcctttgtctttcagcagattgtctatgatgggtctgtgtgtggacttcattgatttcatcttacttggagtttgttgagcttcttggatgtatagatttatatttttcatcaaattttggaagttttcagccagtatttatttaaatatttttattctattttttcctctcctctacttactgaattccctttatgcatatttttgctcagtaatggtgttcagcagatctcaaagattaatgaattttgactgaatatttatataagtgtgcagtggaagaaggaaatattttgtttcagataataaaaagtctttatactggctgtgcgcggtggcccgcgcctgtaatcccagcactttgggaggccgaggcgggcggatcacgaggtcaggagacagagaccatcctggctaacacggtgaaaccccgtctctactaaaaatacaaaaaattagctgggcgtggtggcgggcgcctgtagtcccagctactcaggaggctgaggcaggagaattgtgtgaagccaggaggcggagcttgcagtaagcccagatcgcaccactgcgctccagcctgggtgacagagggagactccgtctcaaaaaaaaaaaaaaaaaaaaaaaggctttataaatatttagaatgctgggaggtacagcttggagaagtgaatatttaatgttaaaatgtgtcgttattataattatagcagatataattttgatcacttaactaattttttcaatatta

SEQ ID NO: 33442 - DNA, 1099 bp, Homo sapiens
tgatattcaggtgtaactgtcttgtgggttttactgtagttgtggtaggtttcctaataagtgaaattccttgtctccaggcttaggggtcacacaaacctatgttaaaatcctgtcaaaagcagtaacttgggaagcttcatcaactgtaaacagagaacattttgaccgtatcacagtattcattttagaattagtagtaatgcagcagtggatagcccagtgcagtatcggtgcaataaatccttgctattgccactgtcatttttataactttcttttaaaaacatagtgcttgcttttaaattccatttttaagataaaaattctttaaagttttcttggcctgccagtttcacaattctccacctctacctcccactgcattgcaacaccatttaattgtcagatccacctattccaggaagctttctcaaatacttcagggctacagatctctgcatgtgctgcccaatgcctttttctctgttacatactttgcgacttaattgcattctgtctagaaaccctaacccatactttctttgtatttataataatatcagaccttttatttgtatacataataagtgtcttctcaatatctcatgcatcaaatggagccgcaatggggtgattcagctgagccctagctgcactgatcagtcctgtcctgctaacaatcatgtcagtttctgccattcccctcacccctctcctggccattaattcagagaggtctgcacccaaccctgttattaaattatctgctattaaaatgataaattggtttctacttcagtaattgaatgtgcttgcagactattctttccagtcttgtttttatattaatgtgttaccttaaatggagatgtttcttacatgagcatcatattttcaagaattcattattttatgaatttggatccatttaaaaagaatcttaagtgatctttaaaaatcaaatgaattttccacaaatacaaactctgtagggatgctcattaaagaagacgtttaaaaggatatatagagggtcagaaaactgaacgagaattaggcctgtctcctctttgttagacattgtcatttctgcttc

SEQ ID NO: 33443 - DNA, 1032 bp, Homo sapiens
gggaatgacatagccccagctgttgggaaggggaaggctgcagagcctaggagcaggtaaagtctggagcaaacacctctgccgtttttattcatctacacactctttgaggcttttttttttttgtctttgaagtggaaaattataagcgattagaaaacatggaattggcgaagacagaatagtagaaacactactaaatggtttttaggaggcattgtaaacagattcaaattttcttgaatgcaaagttttcctcctcatttcttattactttcttatttttgtgtcttctatctctctttgctttctctttgttctgtagccttctctgaacactgtttctgtcatcgaggcttttaaatatatattgttaaatattattaacttgatgtaattaagcaaaggaaggaagtcagtctaaatcaatggcaaactggagaaataagcaattttttaggaaatgaaggattaatactcttagggatatactgaaactattgaaagcagtaacacactacatcactaaggaagtggaaggctgccttaactcctacataagcacattttggaaatttattgtttgaaataatttgttgtgctacagacctttactgtttaaatagactagtatttattttttttacgaattgcttagcaaaaaaacattgaggatattgagatataaatgcaattcttcgttgcttaaaacttggtgctaataaggtcaagaccacacactaaatctccgtatctgccggttctctctctctctgttgcgtggccacaaatgtatgaacaagaaactcagatcataagcagcagtgggggagaggatgtggatgagtctgtccaatatgccttctcatattggaaaatggctctgttttcatctgatatgcacctgtggttagtagcttcgtatttctttgtgagcatcagttatcctagaattttaaagataattttaataccatcattgttgctttaataatttattttatttgctatttcaactctactatgtggtaa

SEQ ID NO: 33444 - DNA, 1056 bp, Homo sapiens
taatgccactctacggaaatgtaattgggcatattttccaactgtaactatcccgtgtttatttcttaaccaatatcctaaatagacatgcatgcacaaggtacataaagtagaatgtaaatagtcaaacatgctatgaatgaagccataaatttgtagtaaatgttgaataaaacaaaatgtacagtaatatgttaaattatgaaattatttatcaacttgtctatagagtagtgcattctctatgtcatctctaccaggtagctgtcctgcataagcatagtacaagacgttttctctatgttaatatataaaatgatcaatcaattttgtatctaaaaattctaacttttctttttaattctacagcactctcaacaataacaacattactagactttctgtggcaagtttcaaccatatgcctaaacttaggactttgtaagtagtcacaatatatgtaaaagtcatattaatcaattaaagcttccccttaaatagcatgttcagtaagcaaaggacaggaccactggtttacaaggtagacaaggaaaacccaactttggaaaagactagatatgatatttgtgggaatgagctattattctagaaactggaaagatttcttttaactgatatgcattatggaaactttggagttaaaaaaaaacaacatttactttgagctattgtggaggtcacatttcattaagaaatggaagactccttgattggctgtcagaaatgataaatgggaaatctttatgattttattactgtactgcaagcagacctaataaagctaaactggttcttcaacattccttataacgtgaaattatagcatcaccctctagtacttctataattaagattgtgtcagcatttatatttaaaaatatctttctgggttacagatggacattaagatatttttggtctaataaagtattgactacagctgtttcttttctcttgaagaaaaagtaatccttaaagcccagagtagcctttaaaatctttaaagcccagggtggactttaagttatagaatat

SEQ ID NO: 33445 - DNA, 1078 bp, Homo sapiens
agtgaagaaaggataacataaagtcaaatgtaaagattttttatatagtgcatgttttagcctatttgaagcagtgtctacctccattaaaagttaaattcttatgacaaactattgcacacgtattttgtatgcagctgctgaatgcatttctatgtcctcaccaaatataagtcatgtggataaaacaaggtcacataagatgtaaaatggaatgcttttaccatcttgaaaagtaagcactagggaaaattgttacctcaatattcattgacaaaaccccttttaaccacccagcccattatattattatgttataggccaattctaaattgtaactaaataaattatcttggatttttggttgaaataataggaacaacttcttagaataggcctacatagtatgcgaaaaagttgtttttaaagcgctcatttttaaccaatttatttaattatgataataaagtaacttatctaatgtaccttatatgagaataattttagttcacaggactcactgccattagtttaaagtatctaccatgtgcttaataatgtgcttagagctttgcagtataagacatgaacctctgcaggaattctagactctgtgaagatttgacactgaataacatataaacataataatatcattctcatcaaaattttaattgatagaacattactttacctctagaagacatcttttagtattttttggctgaaccttgaaagaagaataagttataacttgggaagagacagatgacattactgaaaaagaaacattggcagcaaagaacagaggtggcagtaagcattgtttgagagattgtagttgaacctaattagaataacaggataatgttgaggcatcgtgaaatataatgccctaaagaatacatctccatttgattttaaaactacagattactgaagatgttgacacttgatgggaagatattagatgtgataaagtaaagagtagaacgaaatactaaattttctcataagggaactatatagtcatctatgcaggcacaaacatttattaagtgactatttactacctaaa

SEQ ID NO: 33446 - DNA, 1082 bp, Homo sapiens
gtctagaatgctaaaaattcattaaatttccctgttctgcatacttacttggatttccactctttaaatatttctgagattttttttttttctattctcggctgaccaactcagcatttaataggtaccctattatggagctatattaatttaatcatcttacagatgtcttagacatctttctctacagtcatattccctctctaatgaagcctgtagacatttaactcaaatctttcaaagactgagaactttgttgtttaaaaaaaacttgggaaaaaaaaaaacaggctcaaaaaacttagaaattttgtaaaaaccttcaattgtgaagtggctaaaatggcttcaatcatacatttgcttgactctcaagcccatggtcctaacttgatcaagctataaaagaggtaggcatagcttggtcttgttggaatgtcattaaaggaaaaattttcaaaatcatgaagagagaatgactaatactccgacaaaaaggacaagagaaattttaagaaacttacctatgaagagaacgtagacaaggcattaagatacaggattgtttgcaaaactaagagctgttttatattactttatatctgtaactattacaatgtcatctttcctattctccgttaaatgttctcttatttccccgaatcttctccacacagcacttaccacagtttaacttgttatttgaaaatgaaaaactctcctattaaactgcagactgggtaaaggtagaccatgactttccctcaccatttctgccccaatacttagcataccatgggtggggaagacagtgttgggagcaggggaaggagatcttggacacacaatctagagagcttgcaggcctccattctttatactaaaacaaaacaaaacaaaacaaaaaacgggcgtgctggatcacgcctgtaatctcagcacttttagaggccgaggcgggcagatcacgaggtcaagagatcaacaccatcctggccaaaatggtgaaaccctgtctctactaaaaatacaaaaaattagccaggcgtggcagtgcgtgcctgtagtcccagctacttggg

SEQ ID NO: 33447 - DNA, 1030 bp, Homo sapiens
gtctctactgaaaatacaaaaattagtcagtcagacatggtggtgcatgcctgtaatcccagctactcggagagttgaggcacgagaatctcttgaacccgggagacgaatgttgtagtgagccaagattgcaccactgcactccagcctgggcaaccaagtgagtctctgtctcaaaaaaataaataaataaaaatttcaagttattagatcaccaaatttcatctcttagagataagtggacttgatttacctaatgttttttaaggcctctcctactaagaaatcctatacttttttttattaacattatcatttatttttattacgtattatataaaattataatgttatactaatatattgttacatagtataatatgcaatatattaacaaaacaaaaaacattcatgtcgttttcagggattttaaaatttctttcaatgtgacatcaacaagatttctataatatttagtaacaatttcttaagaattcagcatactagtatttttagcattgtctgtaaacagtttttattgttttctgcttattacttggaaacttccttctatagtaacaaaacgttttaagtgtagtatcattgtagcatactgctaagcatatgacctttaggacactaggtggctgtgttcaaatcctggctctagtacttactagttagaggctgagctagttactaaattccctgggtattagttcttccatctctaaaatgaggataaagttacttccctgctggctttgttacggagtaaacatcaagaaataatatgtatggccatggcaaattcatctcttgatagaaagcaatttgtatgtttctggatctcaattatcccagagaatctttctttatgccaaaggtcctcaatatatgatttttctcttttcccattcttttcattagccctttgtaaactattttaattcacttactctaatttccttatttccttaactagctcccaaattccacaggggtctacagtggaagactttaacactgt

SEQ ID NO: 33448 - DNA, 1028 bp, Homo sapiens
cccggagcacattccccagtacactgcagagttgtaagttcatcccccaacaaaattctggttgggatggagggaatgaaagcattaaagcataagaatgtttgtcttgccatttttattattaataattgcattaattttaattaatatgcattacattggcataactctattttgtacaagaatatattagaggctaccttcattcatctttctagccaaccatacgattaagtacagaaactaatttatctctcaaaattcagtaagcacttcatactaataacaatggtatttatttgatgcttatttattgggtattatttattcccaatttgttttctaagtacttagtttttaacgtatttaattcttatagcaactaaataaagtagtttgagagcctccattttcaatctctgtaaactatcaatagattcaaggagtctgtcttacctaatttactacttcattgacttacgggcagaaggattcagtggttatcaagtattaaagtagaaaggatagctttttctgaacaatgcaagaaaagctgaaaaggcagaatatgatggtatttacacttaacagccttaacataggaccttgcacatactaagtgctaaggtgtttgttggagcacttacagattctatgcccatgcatggtttgcctttactgactttatttataagaagaggacctttaatgttagtgttctaacaattcagggaaaaaactagcaaaacctcatcattctctaaacatcttagccatgtttatatatagcaccatctggtatttgtcatttactgctttgcaaagttcgttgtctgtttgtttgtatataatccttccatctttaactagattatagctccttgatgacagggattgtgtgttattgtttatctctcactgtgcctatactcatgcctgtacttaattaatttttagcaatttgaataactaaaaataaagtaatgcctttcaaagagttgacagaaacccactatcttgtagttata

SEQ ID NO: 33449 - DNA, 1050 bp, Homo sapiens
cagtgaattatttttcatagtgatatgatcaataatgtagcttaattccaaattttagaattattataacttgatagtgctgcatataaaagaaatgttatagatttttgccagtgttctcacattggagtattttcagtataagtattataaaaggagaattgatagagttattgccaacaaacttgctcaaaaggatcagctgggcacagtggctcacgtctgtaattccagcactttgggaggttgaggcgggcggattacttgatcaaggtcaggcgttcgagaccagcctggccaacatggcgaatccctgtgtttactaaaaatacaaaaaaaaattaaccaggcatggtgacaggtgcctgtagtcccagctactcgggagggtgaggcaggagaattgcttgaactggggaggcggaggtggcagtgatccaagatcgcatcactgcactccagcctgtatgacagagcgagactccatctcaaggaaaaaaaaaaaaagaatcatttgaaatgacagtagatatattaggatgaccagatcaaaaataaaagctgtttactagagggggtctactatgatattagcaaaatattgaagaaataggttgagctgatccaagagaatattttttgtagacagcttaaaaataaagagtatttgtaggcctatagacagaattcaagaaaagtaaataaataaataaataaaatttaaaagtaaaaaaagccacacacctccaaacaatgtatttcaggtctcttatatgtcagtatctaaaaagcagcatttgaaattattaattatctaactgataagatttctcagtaacggtggcatgcaaatctactaatctaacttaaaaggaggggaataaagatagagaaaaaagttcatagctcaagtcagtgaagaaataatttgagagaagcatccatccatcaggaaagtacttaatcctctttttgcataaaatgtgacattttacatcgagtggctaatttgcacatattaaagatggcatgtttataaataatgagatt

SEQ ID NO: 33450 - DNA, 1030 bp, Homo sapiens
caatggtaaaatataaggtatctttcacatttatttgttcctataccccttttctcatggagcatcttacaagactaatggcccatggaatgcactttgggaaatgctttatatttcatttacttacagtctaggatattctgtacaggaaacttttttttttacctctgtgacccctaggagaaaattttaccacatgggataaataactatctggtatatggaagaaactagcataatctcttcccttaagaagagatgctgcttttggaggcttgaatcaaagtcctttagatcctaaagggtatgggaccaattatccttgacattttcataactgatatttaaccacaaattatatggccaggatatacacatctcgaccttcttctgcactgcccacgctcccttggctgcctcatgctacagttgcagaatggaattcattagagaatatgctgccagaataatgatgcttccatgccccattcattccattcctttgtctctaaactgtcatattctggatatgcttgttctgaatacaattgagtcactttgcctgtttattttttatctatgtggaactatggatcaataatgatttaaacccaaatgtaatttatgcagatgtgtatcagttatttgtgcagatgcacacacatattccaaatgagcaggtttgacaaacttttgacagtgtgcaacataggtaatgaggttcaagggcatgtcatttcaatttttaaggatcttattttcaaatcacatgcaattctttaaaccctaagtttgatcctgaatagaacacttagaggaaaaaggcacaaacttagcacatgtgcttagaacacggctcttagatttgaactgctgttaagtgcttaggtcctctctcactaccaatcacattggttaatcaactggaaggactattttatatgtatatgtgtgtaattaaatatttaattcttatagtaatgttttttatttcagaagatcacatagggatattccgaaaccctcctct

SEQ ID NO: 33451 - DNA, 1025 bp, Homo sapiens
gatgctggacattgctattgaacaagacagtctctaccctcaaggaatgtttctattgggagaaacagacaaaaccacgatacgtgaacaatgtagacattaggaaaagtattgcgttctattaaaaaaaacaaagaataatttgtgtttgtggggggcttaggggagatccctaagatagggaaaatccaccttagggaagggacggctgacgcaccaaagttgggcaggagtaggcagcgggaagcattctaggttgtatttaggaaataagtatgttgtgttagggagacaacacacaaaaaataacaatatattgtgtgttaacactatcagttaataagatgctttaataagccttaactgctttatttttggaagtatttggccatttttggatttctgaataaaacaaattgacatatgtatgctttcagaattcttagttacaaccgtctgagatgtattcctcctcgcacctttgatggattaaagtctcttcgattactgtaagcatcttgtgttcaacagaatatctcttttctcagagatctgagtttggggttgtctttttaaggatgtaactgctttgttgattcttggtgcttgaagatacatgcattaggatttattataaattaggaaatagaaaaatcatttcttacagtatcattgtccaacagctttgctttggacaatataacttcctttttagtaatactgattgttgttatagtcatttatttgattatatgtaacattaagacatatggtttatagagtttcaattaactttgaaagaaactttcaaaattgagaaactttcaaaattaatttctttagaaattacatagtatatgaaaacatttttactgtgaaatgtcctttaaaatatgtgaaataaaacatgatccttgatcctactctcctgcctcagaatttacagtttgatgtgctctctggtcctttttcagatgcatttttttctattctaatagatgtaggcccatggctatatagctttt

SEQ ID NO: 33452 - DNA, 1072 bp, Homo sapiens
cgaatgcaatgggaatggagaaatacaaaaatataaatataaaggtatcccatgccctcaagtagtgtacttttaagaaactaaatcatattttttatctattaggttgcttattttgatatcttcccttgctgagttaattcaaagagaataaaattagtacatttattcaaatctttcttgagtttgactgattacatttaacactagaattctggtccagttattcagattgccatcctaaatttctccttcattattatcaatattaataattatttcttataaaaaacagtttgttacaagttacagtaggaataaaaatgggctgcagtatcagctccagtaccctcgccacctctttcgtacatctatgatatccagaatggactcagatttttatctatttcaaagagagaagaagctaatctagttacattagcagaaggtagcaacagtagcaagagttacgtgtgccagcaacaccatgtactgctatctaaaattattttgttgtagacatgcccaatttgaatttaaaaagctaactttggggaaaattaaagagagatactcaacatccatttagtgtaaaacaaattaatatttttaacagtgatttgagttggaaaatttcagaaatcttaatctggggacaaaatgacccacttttttgataagcaggcttccacctttttgataagcaggctttgaggactaaataagcctagatgagacatcccattgcccagatttcttggtagatagaaagcaattaatagtccagccaaggtgggcacagtagctcatgcctataatcctggcactttgggaggccgaggcaggtggatcacgaggtcaggagtttgagaccagccttgccaatatggtgaaaccttgtctctactgaaaatacaaaaaaaaaaatcagctgggcgtggtggtgcgtgcctgtaatcccagctactcaggaggctgaggcaggagattactcaaacccaggaggcggaggttacactgagctgagattgcaccactgcactttagcctgggtgacagaacaagactccgt

SEQ ID NO: 33453 - DNA, 1030 bp, Homo sapiens
ggattacaggcatgagccaccatgcctggccaaaaatcaaatcatttttgacgttgtcaacctatcttactaaggtcaggtgtatagctatgtaatggtcacaaagaagtaccatatacaatctcagtaatgattattgctattttgctactcttggagaggtaaggaatacttgacattgatgtagttttttatgttcaagttggcatgcttaatcttaaagctgttgattagagatttaacaatctggttagctaacagtttcttggaactttgtccttgttcactcctttacattatcaagtctgtggagtaattccttttagacaagggtcaactctcagttttatttttttagagatgaaattctctgtctctgttctttccctagctcaagactttctctgctggtagattaagaactgattaggagcagagtccattacattcatccttgtagctccagcctctagcacaacatcacgtagtaaatccttatggactgtgacttagattggatgaattgggttggattgtatcagagtaaataaagaataaaacatttccctttattataattttaaaacagtttcttatttaggcataaagtgaaaagtacataaaatgacatttattatgtatctcaaatggtccttctttactatcagtttttacaaactgtcttggatagatactactataaacagcctatatctccatcagatagatttggttagaaactgaaagtgatttcatcatagtaggctgataaaatatgatgaatgcatttcatcaaggtatccaacttagagtaatactatttgaaatcacaagcctttaaataaaacctgtttaaaaatagttcatcatgcatatgttgctaaaaatcttttgtatcccagaaaacttatagaagcaatatatgagacttactgtgcaattagttctttttaagagacagataaaaactaatatcatacaccagattgatgtaataactagatgaatacatttattaatttgcatcacg

SEQ ID NO: 33454 - DNA, 1785 bp, Homo sapiens
tattgtaaaattaaaaatgttaatctttttttaaatatgtttaatatttccagtaaattttacaacatagcacttttataatctcaatgatcaaatggattaggccaaactgaaaatatagggcactgtaagcaaacaaaatggggaaaaagaaaggaaggaagagggaggagagtgggtgggagggagtgaccctgctacaattaccctgttcttatttgggctgtggatgttcactatcaaggagataaaatcactatttctctggtagatcacagtgatagaacatggaacatactgcagaacagttcgattttctaggtatccattaatgtgggggctctatgagcctattctaaataagtattttaaagatggtgccattgtgtctagataaaatgcattgtttacttattttggctcagttgggtttgaaaccattacctgcttgttccaacagatgtgactgcacaccagggtacgtaggtgaacactgcgacatcgattttgacgactgccaagacaacaagtgtaaaaacggagcccactgcacagatgcagtgaacggctatacgtgcatatgccccgaaggttacaggtaaaagcagaaatgaataagacctagtgttcaataagacctagcacaacagggtgactatagtcagtaatagtgtaatcgtacattttaaaataactaaaagagtataactggattgtttgtaacacaaggataaatacttgaggggatggataccccatttaacatgatgtgattattatgcattacatgcctgtatcaaaatacctcatttaccccataaatatatacacttactaggtacccacaaaaattaaaataaaaaaattttaagacaaaaaacgtagaacttacagaagcaaagagtagaatgagggttaccaaagaggaggacagagggatggtgtttggggagatgttggtcaaagggtacaaaatgtcatttagacaggatgagtaagtttggaatatctgttgtacagcacagtgatgattttgtttaatagttaagaatacttgaaaactggaaaaacaaggaagtgcacatatataatatacagttatgttatacagctctcaattcagattggcaattaagtaaaatcgtattaactaatttttttttctccttattcttcagtggcttgttctgtgagttttctccacccatggtcctccctcgtaccagcccctgtgataattttgattgtcagaatggagctcagtgtatcgtcagaataaatgagccaatatgtcagtgtttgcctggctatcagggagaaaagtgtgaaaaattggttagtgtgaattttataaacaaagagtcttatcttcagattccttcagccaaggttcggcctcagacgaacataacacttcaggtaagagatctctctctatggagagatgatcggatcttaaaattcagcttcagagaataaacatttgtggtagcttctgaatgattgatagtatgtcttaaatagacagttaaaaacagaaaatgctccttgtgtggacagcgttagtaatttttctcttcaacatttgtattttcaagacaaaatgaaaaacaaatatttttattcattacttgataagcagacagtaaaaaaaaaaatatgtctctttgttttgtgctcagacaaaaacatttgattcatttgcttttatggctctgcagttcagcctctgcatgggggaggcttttcttaggaaatctgcagctaggaagggtgcaggcgaga

SEQ ID NO: 33455 - DNA, 1993 bp, Homo sapiens
tacttaggaagctgaggcagcaggatcacttgagtccaggaggctgaggctgcagtgagccgtaattatgtcaccgtactccagcctggctgacagagcgagactctgtctcaaaaaaaaaaaaggaatctaaaatcatgaactttactgtacttacctgttaagaggtcaagatgaggcttcatttaattccagggagatataaatggaattaatctcaatgataagtcttgtggaagttctggtgtgatcagattagacatttaaagcttttagggagagaaaagtatagtcagtctatctcactcataatctcactcataattgggaaaataaaatccaaactcagtttttaaatccatataatttatatgcattcttcaaactcttattgtaagatcattacttttattaacaattcagtgttttttagtaaatgaatcaagttttgctatcatacaaggtaatttactatagaactttattcccaggctatttgggacagaaatcatgtattaaaagcttgttagtggtgaaaacacacgccatttgtctaggaataggtattcctcaggtttttgattgtaaaagtagtgcataataattaagagcacatacacttgagctggacaacctggcttcagaactgtttagccactaactagatgtgtcaccttggatgtcctcagtgctcacctcttgttgtgaagcttacatgaggtaatacttgtaaagttcttagtacctggcccttagtatgtgatatataatcctttgctcttcctatttgcacttctcttaaaaggaagaaaaatcacctaaggtcacactaaccaaagatgacatgtctaatgagagctaggacaagctgagcaagatttatctctcagcattatccttgacgatactgccactgaaacttccaactatgttttatgaaatgaattttcagaggtcttgtcttaaacatgcttgaagtgtaatgattatctatagatatcatctaggagtattgctaaaaacaattgatatatgttattcctaatacatctctcttgtatttacttaccacatattttcagaaataaataatacatggatgatattttaaattagcttacaattagcaagagtttaagacatgtactccaaaaaagagtaaaaaggaacagaggagggaataaaggagcaataagcaaagtgagttgatgatgaaactacctacctccaagttcccatctgacacactgcattagggtgtttaaaactgtaaagtgtgttaacttaaaccacacaattgtactgcatcaaacaccatcattgatgatgacatgactgaattgactaagaccaatatgtgaccaagaatccattccttggtaatatatgggtcttttctttgcaattttaaagagaaatggggggcctcattattaagatttattaaggttgatgttgataggacatccatataaaactacttggaaagctgtgtataacctcaaagtaaaaaggaattcacttctactctctccatgtctgtctttattttaatgttttactttaaaacttttagtaacttgaacaagatgtgcccccaaagaagttgttatatttctgccagcctttaacattatcttacaatcaatatttaaaataaagctaaattctttactaaaaaagattcagaaatggtattgaattatttgtatcatgatgatcgtggttgggtgggggaccgatatgatagtgatggtgatactaatatctaacattaatttttgctatgctgggtatctttcagtcattttacatagtcctcaaattaaccatggaaggcagaaatatttattagcatttactgaagagaaaactgaaatatattagtaataaagtaacttatctaaaacaaacacttaataaatgcaggaccacgattcgaatccaggattatctgactacagagtctatatgcttaaccattagccaatgt

SEQ ID NO: 33456 - DNA, 1028 bp, Homo sapiens
ctggccaggcgtggtggctcatacctgtaatcccagcactttgggaggctgaggcgggtggatcacctgaggtcgggagttggagaccagcctgaccaatatggagaaacctggtctctactaaaattacaaaataagccaggcgtggtggtgcatgcctgtaatcccagcttctcgggaggctgaagcaggagaatcgcttgaacccaggaggcgggggttgcagtgagccaaggctgcgttcatggcactccagcctgggcgacaagagtgaaactccgtctcaaaaaaaaaaaaaaaaaattcatgtatctacttctgtttgtcaatgaagacctagcacgtgaaaagattgactcagaataattcctgattttatgatagcctattgaaactcaaatatacgtatgatgtctaaacattttcatttacaaattactctagtcaaagctgggctttttctaattgttagctttggaacaaaaaggaacagatttactaattgtttctctgtgctgtggaactttgccaatctgtatttattcttgacatgtgcacatatgtgtgttgtgcctatatcaaaatgagctattaaaaatagttttggaagaagttcatttttaaccactgaaaaaaggaccataaatatgtggtcattaaagtccttatgatggatggatatggttaaattagaaaaacttaccccagggcaaggaattttctgtcaccagtcctttcctggaaatggtaagtttcatccttttgaccctgctctagaaagcaacccacagcgagatggacatagactaaaggcctgtactcacagaacttcacagccaagagacttcattcaatacctgtcagagtgtaaccatggactacccaaatcacctgagctgcatgtagatatttagatttctgcacctctcctgttcctacaggatcagaacctcagaaggaggggagagaggagcctgtaaagctgcctttgagcatgcactgctgttggttcttatgtatgacaaact

SEQ ID NO: 33457 - DNA, 1061 bp, Homo sapiens
ttttgcaaattaatatgtccttgaccttttttgcccttttgtgggggtgaggtggggataaaaagactgtcatatcaagaactgtgacttttctttccctcaaacaataaaactcctttattatcttaatgctcccatgttaacatgtttgctgctaaattacaatgtagaattgataatggtttatagtgaactgtgctcttccctcattaaaatcccagggtgccctgtaaagatgcagatgtttcttcctgaaaacttctttttttacaaagaaaattagatgtacatgtataattcagtgtgctttgtctttctccagattaatatcggttacactgctgatgtttgtaaattaaacagatatttacttcattaacagcttggtggtgttcttagaaattgcacaataggccactccttaagaattttttaatcaaaatgatacagaaagaataaggaagaaaacctatacctttttgttgccaaaaaattggtttgagattcacacatcgttatttctggggactgatattggaatggccacataagagagatggatataaaaacatactatttgcctgaaaaaagatattcaattatttttttcaaaaaaattgtaagatgaagtctatctaagatgaaatgtttttgtttttgttcttctttgtttctccctccccaatagaaccaggtagaaaacaataaaagacagccactcttaggccagggttggtaacatgaaggtgtactatccaggacagagaaacaacattgtctgggaggaataatcctcatcaaccatgataagattttgtctttgtttccctgtaaacaaacaaacaaacaaaaaaccatgcacacacacacacacatacacactcggtctctctcacagacacagacatccaactatttattcattcttgtttaaaatgtctaaattgtaattatagagacaattgtatagctattgtaaattatttattcccattgattacttcttttttccaaggggtttaaatcattcattaaacaaagaaacatctgtgacgatgacg

SEQ ID NO: 33458 - DNA, 1035 bp, Homo sapiens
cttttttcctccagttttgcctttttatatcccttagaatttagtgaacactctgttggaaacaccagccttcttcatttgtgctcagataaaactgtggactgtagctgtgttgatgtagagtctggcattttctacaaagagcaggcttcttgtacgggaagagagctatgaatccccaaagcaaaaggcccaccttgcttcttcaacagccacaccaaacttgtcctgctttgctaaaaactacagagagctatgtgttttgtcttaataaaagtgaccctgttcttctgtgtgaatcttaaagatcagtgttacaagttctcaacagttgtctgtgggtggggtgtcagctaaggaagggctatttttagattttagtcaggtaaatatatgaataaggttaccacatagcttctaggacccctttccttctcacttggctcttgttcctctgttacccaagctggaacatttggactgtggatttcactatgacagtctgtatctgtgatggttaatactgaacttgattggattgaagggtacaaagtattgattctgggtgtgtctctgaggatgttgccaaaggagattaacatttgagtcagtgggctgggaaaggcagacccacccttaaactgggtgggcaccatctaatcagctgccagcatggctataatataaagcaggcagaaaaacgtgaaaagactagactggcctagccttccagcctacatctttctcctgtgctggatgcttcctgcccttgaacattggactccaagttcttcagttttgggactcagactggctctccttgctcctcagcttgcagacggcatatggtgtgaccttgtgatcctgtgagttaatacttaatatactcatatatatatatacatatatatatatatcctattagtatatatattagtgtatatatatatcctatcatatatatatgtatgtatatattttattagttctttccctctagagaatccagactaatacagtatcttctcttttaca

SEQ ID NO: 33459 - DNA, 1043 bp, Homo sapiens
gtcctttatctgtgattctgacacatttacagaattaggcaactgttactcagggccagataactacatacttgaagacatctttagaggatgtactaaaggtaaaaagggacattttaagtaattagaggaagtaatgaacctcaaatcagcctttctgtatgctacatatattttagttaatgcttcagtcagatggaaaatttgttttttgcttctagatgtcctgtgttgaaggttatttttaaaattctaggttttgttgactatcttctgattgtagatgtttaatcttatccttttctctacttgcttgcccttttttctaacctatcttttctttccttttctcctctcttccctgatgtccatacatcccccaactaaccaaccttacaggtccattcggatgatgaagtgtttgaaagaggattgaatgctctagttcagctaagtgtcgttgttggtccttctctaaacgaccatctgaagcatctgcttacaagcgtaagtactgcaaagattagataatgattgactgtatgtatcatgcaccatccatatctcttcatgatttaacaatttcaaatcttcaactcaaaaccttaaaaatctccctctacacactgctttgaatgtgtcccagagattctggtatgttgtgtctttgttctcgttggtttcaaagaacatctttatttctgccttcatttcattatgtacccagtagtcattcaggaacaggttgttcagtttccatgtagctgagcggttttgagtgagtttcttaatcctgagttctagtttgattgcactgtggtctgagagacaagtttgttatgatttctgttcttttacatttgctgaggagagctttacttccaactatgtggtcaattttgggataggtgtggtgtggtgctgaaaaaaatgtatattctgttgatttggggtggagagttctgtagatgtctattaggtctgcttggtgcagaggtgagttcaattcctgggtatccttgttaactttctgtctcgttgat

SEQ ID NO: 33460 - DNA, 1050 bp, Homo sapiens
accttctagatgtgacagagcttgcgcaatttgctgaaactttcagagcttgctttttgtctcatctgtaaaatgagattaatgaggatttataggattcttgtaaaaactgaatgaaaacaaaacttgtgaaacatgagaactgtttagtgttgtatcttggatttagtgaatgttcaataaatgcagttatcagcattgtaaattcaaaaccaaagctattaaattaataggatgctaaatactgttttgtttcagtaaaaattattttcctttgctctcttttgaatcatcgtggtgcatggcaaacatcaggaaattttctcctaacttcatgccctcttgacttctgttttaattcctacctgaaaaaatgtttcaacgtgttgtctgggagcatcttctttgaggacaggatatgtacatttacccatcatatcgtatattgctttcattatatcaagcatttcctgaaaaataaaaggcactcacgtgaggctgcacacatgtatgaagaaaccagtctaagaagctctgacagatttttcctactcaattttaaatttttgactttttgtttgttggattctttgttagacgactgttggttgtcccaaaggaaaaggcaacaaacagctttctgccttaagagcagaagaatcagaatttaagaatgaattctgatctcttggtttcaaaaggaagcaaatttccatgtatctaccatagtcaggaaaagaatatgctggcttaatgtttggatttctatagactttaagtagactatgtttatttaattgcattatatatcttatgtgttgatcatcagtttccatctattgagaatcaaatatacggcacatcgtatattgagaaaaaacaccatttagaattagtgaaattaattggtaagtcttaaggttcattagggtttttgttgtatttttcctactgtggctttaacttaagtcacatgtgaagactagtcaaaaaattttgaccctgggaaacacctttaaattttgttattaactttttctctaaaacagt

SEQ ID NO: 33461 - DNA, 1012 bp, Homo sapiens
accttaaatgtaaatgggctaaacgcaccaattaaaagacacaaactggcaaataggattgtcaagatccatcagtgtgctgtattcaggagacccatctcgcctgcagagacaaacataggctcaaaataaagggatggaggaagatctaccaagcaaatggaaaacaaaaaaaaagcaggggttgcaatcctagtctctgataaaacagacattaaaccaacaaagatcaaaacagacaaagaaggctattacataatggtaaagggatcaattcaacaagaagagctaactatcctaaatatatatgcaccaatacaggagcacccagattcataaaacaagtccttagagatctacaaagagacttagactcccacacaataataatgggaggctttaacaccccactgtcagcattacacagatcaatgagacagaaagttaacaaggatatccaggacttgaactcagctctgcagcaagcggacctaatagacatctacagaactctccaccccaaatcaacagaatatagattcttctcagcactacgtcacacttattccaaaattgaccacatagttggaagtaaagcactcctcagcaaatgtaaaagaacagaaattataacaaactgtctctcagactacaatgcaatcaaattaaaactcaagattgaaactcactcaaaactgcacaactacttggaaactgaacaacctgctcctgaatgaccactgggtagataatgaaatgaaggcagaaataaagatgttctttgaaaccaatgagaacaaagacacaacgtaccagaatctctgggacacatttaaagcagtgtgtagagggaaatttatagcactcaaagcccacaagagaaagcaggaaagatctaaaatcaacaccctaacatcacaattaaaagaagtagagaagcaagagcaaacacattcaaaagctagcagaaggcaagaaataactaagagcagagcagaactgaaggagacag

SEQ ID NO: 33462 - DNA, 1048 bp, Homo sapiens
ataaataatgtaaatgacgtgttaatgggtgcagcacaccaacatggcacatgtatacatatgtaacaaacctgcacattttgcacatgtaccctagaacttaaagaataataataataaaaatataaaataaaaataaagatagcacgtttaagtcaagtgtggacttgtgttgtttgcctccctagccctagtaggtcccaaatttccatttggtgctccatgatgttctgtggaagttcacttcatctctgagtctagtgatagagccatgacctgggcgaagtcaggaagcacattttatccctttggccggacaactggatttgtggttgccatttgactaaacctagtccaggtctaagaatgactccccagactcagactcttgctaggaatggtaggacagagatgtgcttctttccttgctcaacaggagcaatgaatcatggagccaaggagctttggcctcttcttgcagccctacagggtcccacccttaggttgtagccagccccatctctggcctttttgttgctgtgaaccaatgaaattaccatttttttttgtcacttggtgtatccttttctagtatttgtgaacaaaagtatcctgattcacatggtgacatctaattcacatcttcttgaatactgtatatcctgaaacaatttacattaaaagatagctatggtcttagagcacctctctctttttatcctgtgggatgatatcagtaaagagttactcaaaacaggaatgatatcttttcgtgcaaaagaaaaatgagaaacttaatgtggcttataagacttttgctccgtgcttttctgagttgtaattgaagtctcaagtaggaagtgacaaacttaacaacaactctcaatgagtactttgcacaattactttacttgtaaatgtgaaaggaggttatatctgttccctaaagtacaaaaaatgataaaggggtggagaggtctgtaccgaattctggtttccattctcttattatcaaggcaaaaggagaaagacatagagatttgacttt

SEQ ID NO: 33463 - DNA, 1029 bp, Homo sapiens
atgttgggtttattctcctaatgtttaaatcaatatactacaatttatgatctgctatttaccatttgaatcatatgaattacgtgtgtgtgtgtatgtgtgtgtgtgtatatatatatatatatatatatgaaatacatatataagctatgtaaatatctaggacattttattttactaggtgtttatacacagtagttcatgaaggaaattaaatactttctagctgggcgtggtggcacgggcctgtaatcccagctactcaggaggctgagacaggagaatcacttgaacctgggaggcagaggttgcagtgagctgagattgtgccactgcactccagcctttatgacagagcgagactctttcaaaaaaaaaaaaaaaaatacgttctctacagatcacttaaagtttgtaatttaaaaagagatttcctcgtagaattgtcaggctggtgaatgtagtctttttctacatttaatttcttgcctgtgtgccccacttactgagacttccataacaggacttttgactttatcatctttgtatttccaaggtctaccacagcaactggcccataaggaggtgtcagtaactgttagttaactcatttgccttccaggacttttcacatgtaattgaagaagtggactctccttgtatgagccgatataaagcattagaaaataaactgaatgtggcttgcaatttgtacatcttttgaaagataatttttggcaattacatgagagaaagggagtgtccttgggctttctttcccctgagcaaaaataatcatcaccaaactcacattttccccctaaaaagactaaactctaaatagtcaaatgatatgaaaataatccagagcttacctcgaaactcacagctccattgtggtctgtatcaaatgcattgaacagaaaatgtgcatatgttgtagagtctgaaatggtaaaaagggagtatcattaagtcagtgtttccatatcctacataagacttggatagcagtccaagcttcctttg

SEQ ID NO: 33464 - DNA, 1050 bp, Homo sapiens
accagttgtgaatcttagcaaccagtaggtggcgtccccatgcagtattaatactcaatgctcatccagtagcagccccttccaaattgaggaagtaagacccctctggagcacttcaaaatagtaatttataagtaagataaaatgatcattgaaaactcctggaattgcatcccaatggcttttataaatgtatttttgataacggagtgaattgtgctacccctcccccacaaaaatatggtcacccctaatctctagagcctatgaatgtgactctatttgaaaaaagagtctttgtggatgtaattaagtatcacaagatgagatcattctggattacctaggtcattacctaaatccaatggcgtatccttatgagagcagaagaggagaaggtcatgtgaagacaaagatagagagtggcagccacataccaaaagatgtctgcagccaccaaataagtaaaactgtttcaaaatcaaggcagttcgcttaataaaatcatgatgtttcagtcaggcatactgactcacacctgtaatcccagcactttgggaagccaaggcaggcagatcccaggccaggagttcaagaccagcctggccaacatggtgaaaccccatctctgtttaaaaaaaagaaaagtaaaaacattttaaaaaaataataagataaacatgatgttttaaactcaagtacttaaccaaagtattcaacctacaacattataggtctttgatgtgtatattactttgaacatgaatgtttgtatcatttgtgagacagaattatattggagatgtgtattttgatttccccaaagataacaaaccttgtctcttttctaagatcataccactcccatacatcattcaagaacaatgaggcattcaattatccatcacaacttttccaagcgcagtattagaagcaacccagggaccatggagagataaatgtgcattacagtcatctctgaataagccattcttgtcttatttattatgaccttgcataggcactcattcaaatacattcagcaaacac

SEQ ID NO: 33465 - DNA, 1681 bp, Homo sapiens
gtagtgtcaatctttacgattccccattctagtgtgtagtggtatctcattggagttttaattggtatttttctgatgaataataaaattgagcacgttttcatatgcttataaaaagttttaatcaaagtatttgtcaaatgaaataccaaaatgcggttattggaaaaatcatttgcaaacagagaaacttgaaatttatcctttcataagcacagtgagtactgaacaaattaaacaataagccctcaaatagtatacaatattaatgttgaaattctgtaattgcattttagaatatttcaacttgcaggataagtcatttgctgaagcacctatttttaattagataaatttatgttctgtactggaataaaacgaaattgtggaagcccataattatgtggaatcataaatagagacaatttatattatgaagttgttcttatgaaatatttgttgaagaaagctactctgaatgaaaacaaaaaagacagcatctgtgaaaatattgaggctgaaatatttatgcatttcaatgcacaaaaacatagaatgatgaatatccttgtattagtttgctagggctgttataacaaaatatcatagactgggtgacttaaaacaacagtagtttatttctcacaaatctggaggctgggaagtccaaggtatcagcaggtttggcttcttctgaggcctctctcggcttgcagacggccaccttcttgctgtgtcctcacgtggcctttcctctgggtaggttaatccctggcatctctttgtgtatccaaatttcccttagaggacaccagtcagattggattaggggctaccctcataaactcatcttaacttaagcacctctataaagcccctatctccaaatagggccacattctgaagtactgtaggttaggacttcaccatatgaatttgaaagggcaggatacaattcagcccatagcaatcctccatttagcagaccaggttctgacattcctttaacttccatataatgcaggaggagacatgaccacaaacgtctggtgagagataaaagtcaggcagaaagtagcgccctctgccctgcaatcaggaaccaccctgtgttatgtgctttgctgcatgtcactgttgatctgtcaggctccaaagtctacctattgaggccaataatatctacctgaccctctcacattggcatcttttaaaaaatagttttatttctactgtttataaaatacatgctcattgcaaaatagaaataaaatgctagtgaataatacaaaagaaaaaaaggatcgcctccaaaacacacccagtgatagccactgttaccatgctggatatatgtccatcagaatgttttctctatacaaacaacttgtatgcttttaatataaaaaatagaaatcacaatatatactctttttcagcttttaaaattgcatatatttcagatgtacaatgtgatgttttgatacacatgtgaacatggtccagcatatgaacatatctatgccctaacgtagtcagctttcgttttctacttaacatcatggacatctctcctttcaataaatagatactttaagaactattaaaggccgggcatggtggctcacacctgtaatcccagcactttggaaggccaaggcaggagaatcgtttgaacctg

SEQ ID NO: 33466 - DNA, 1054 bp, Homo sapiens
gggatgtggataaagttattgtataatgtatggaatatattgatacttttttttcatgcttataaacttttgtgtgtgccttgcaaacaaaaactgatggtgttttattggggatatcacagttcagtttttttgataacgtagtctgttattgagtcagttctgtagaggtcaacaatagttcttaagagagagctggtttattgagacacataagttgctggaatgctctgaggctggttacctgtatttacagcatgacggagtgtgtggttggttcagatttctcataaagaccacagttaaatcagaaaaaaaattctgcatagtatagagtgacagtgagtagttttttggcactttgactttggttttttggtgccttacaacaggtttatccaaggttggagaacagcctcaaactccagtgttctctataaatgtgctataaatatattttttagggggtaggaggtacgaagttcacatttgctaagatggatttctatatgcttaattttagcatgaaagatgtgaaactctatttggcaaactattatccaaataaagttatgtcaaaaaatgaatttcttaggttcatttcatgaactaattttattcagctcttgattacatttcctgtgtgtagagcatgtttcacacttggtaactgactctcatttaaagagaatgaatggccagatgaatgtccttttgagcatttttcaagtgcatgcatttctgattggttttgtttgccttattcaatggagagaataattctttgtggccaatttcattttaagagggcaatgttgagtgatttttcataatttaaaatatgaataattatgctctcaaattatgtatttgatggaaacttagaactgaaatcttggcttttctttctctattcctctgcacactgctgcccagaatgttttggacaggtgtgctgtgctgagtttcatgtaaatcaaatttcctttttctaatttttaaaaatgactgttgtatctttgtgaaggaatgacaacaatagggattatgttaa

SEQ ID NO: 33467 - DNA, 1026 bp, Homo sapiens
ctgaggggactgtacttgaaagctacttgcaagtcagttgagtggagatactgttatatggtatctcttaataacttcacttatagcaaaaaccattaaatgtccctgttaatgtttactttgcaattactaaaaaagcttaaattaacctttgggaaaatgtgttaatagcatggtttcatggaccagatgcgctttgtcgtttgtgaactttcattttttatttacttacagtgcatgttcaaatatgtctgcctgatactcaaaaacatatgcatgtttaactgctaatttgtagctgttattaaactgaactcatggcattggacaaaccagataggaaaacaatgttttcttcgtctttgtgtgcccagtgcttagcaccatcctggcttctgtttgttaaattgaatttaacattttagatagttttcatgggtaatgagtttcttttaggacattaaatttagccttttaatttaaccatttgaaatgtgtagtcttctgatagtgatggtgtttgaatttgcaattttaaaaacctgcttatcaaagaacccaaagataaaatctcataggagcaaagagaggcttcagaatgtcactgaggaatgctgcggtggcaagatgacttggtaaagtttccagtattaagagagagactgagtctaatgcattctcctccaaataggatgaagtgcctctctctagtcctaatttagaaatgaatttttatttgttccagactgcccttgaagtatgcagagcatttttacaggaagataaaggcgaaggaatcattatggtgacggatcctccgtttggtggcttggttgaacctctggctattacattcaagaagttaattgctatgtggaaagaaggtcaaagccaaggtgtataatttattactgcaaaataaatacatatctatatatctacttcctgtcaaatattagctgagctcagtgaatcagagcagtgatagaatatacatgtcttgagttctctttttaaaaacaggct

SEQ ID NO: 33468 - DNA, 1062 bp, Homo sapiens
atgattttaaaagaaaatgacttatggtactattttcaggtgattttgtagtaaaatctatttttgtatgctagcctctaatagataacatattcatagaattttcaaagttagaaagaaacaggtaacgtaggctgacttcccaacataataatcctctccactaaattcatgaccagccgtcatccagcttcacttgaatgcttccagtgagcagaggactacagccttagaaagcaatgcaatttatttaatagctctaatcgttagaaaattttctcatatggagataaaatatgctccccattaacttccaaccattggtcctagttctattctctgaagcaataaaggataagtccaattgctattccatatgacacaccttcagttatagaatagctatcagatcctcccagtcatctcttttctggataaacatccccaatttgttaagctataaattctgttcattcccattatttttcaaagaaatgaactagttttatcaacgtctctcctgaaatgtagtgactgaacacagggcttcaaatgtgatctaacctgaaagtttccttgttgtgatactgtacttccaaataggccaactgtgagtccgtgccagcttttacacagttatgctggactgcaaactcaccatactgacagccagaaacccttaggggcttttccacagtgtcccttgggtctcctcatcctgtgctacagtgtacttagtttttcccactgctgaagcttacccttaaactagacagggctggagaacgagcctaggaatctccccttaaaggcctctctttcccttgtcctcaatttcttacatttttgtgattcacttattaaatagctagcttacaagccagttttgttgtaagttcttttgtattcttgtttattatagaaacaattcagtacataacttatttgaatgtcaggcttacctgtactgacctcataaaaaacctcatggtattcttgtggataatctaaagcagtggttctcaaactttagtgtgccaggagggcttgttaaaacacaga

SEQ ID NO: 33469 - DNA, 1084 bp, Homo sapiens
aggttgtatgtgtctctctccgttctgtttggctgtgtgggtgcaggcatggttgggtttaaccaggattgtcgttttgcaagtatgacaaagcaaggcaaagatgaaagagagttgaagttacgtgcaagaggagtgattgtgtttctgaactttgggttctaacctgatgaaggagggaagtgaaggcatgtgtggggagagggacagtgaacaggtggtagaatcaatagactgtatcctggtgaggtcaaagaattggagttgagtgttgtagagatgacctggaaagaggggtggtggatggaaagtgggaagtttaaaatggagattttggtggccctgcagttgttggtaatgaccaggccggaggtgtgaccctgggagtggctgagtgcagtagaagatgtgatcactggaggagaggtaattgagagctgaaaagccaggacatcatagctcttgaaatcaccaaaaatgatgatgagtgtgttgttagaaggcatgagcaagccaggtatccagatctttaaggaatgaggggaatggcctaggggtctgtagaggactgcaattaagacggatagcgagtggtatggtctgattgcatgtgattcaaagttaggagatttacaagaagagaagaaatggcatcaagcatcaaggaagacacctacttcatctcctagcccaaaagcagcagtacaggggctgtgggatacaaaatggccaccacctagcaaggctgcagggaagcattgtcctcaggtgagaggcacatttcagagaaaagtacgaagatattaatttcatgatgacacctgaccatgagctgcagaaagcacagaggaagggtttcagaagtaaggtatggcaggagtggtttcagaaaagagagggtcaaatccaggggatgttgtaaccaggagtgaagggtgctgtgagctgtgagataaggcagggtcatggtggcttagctgagtgtggaaatggggaggggtcttggaggagcatgtgcagtggtgaggccttttcttccttactgtcaatggttgtatagaagctgcaacggggcagtcataga

SEQ ID NO: 33470 - DNA, 1038 bp, Homo sapiens
aaaaagtgttttggtggtctattaatgaccatattaatttgttgctattccagtttgactttgtaccaagtgtttgcttaggactctgtccctgataataacaaaggttaatatttattgattgtttaatatgtgccatatgctgaatgcttcagaacagttgatttgaatcttcacagcatcataataggcagatactgttattatccccattttataggtaagtacatggacacacaaatacttcagaacttgcttgatgtcacaggatgggaaagtgatgctagacaatctggctgcataatctgtgctcttaactagcacattgcatcttgtgtaaaatgatcacttaatattgggaaaatgctttattgcgtgctgtctgcattgtagattaaggaagctaactgggctcccatagagtatttagatcatagccttgccaagaaatcgaaaattttcatcttaaatatcccagccacttaagtatgtgtgaactctcaaacaaaagtagaacaaaaaagatgcaagatgcaatgtgtgtgatgtcttccaacattctctttgtattcagagcatcagagaactcttggtttactgttcactatggtaatggttgttcatatttgctcatcttcttaaggttatgtgaaactatgatcaccaggattgcatttggattataataaaatgattcactactactgtgaagttggtaacagatcatttttaatgacaaatttattaagatacaattcatataccattgatagatattttcccaatatttatcagtagcctttaattccttatacttcctttaagtttttacatatatttgtgatttaaacatttctttgtaatactgtttcaaaataggttatattacatttattctatctacacaggaggggttgataacccagagagagtgatttgtgtatggttatgtgtaggttaggagatcctaaggctatgtgctgtttccaaaccgttctgctcaaagagggcacaattctgacatagtctttctgatac

SEQ ID NO: 33471 - DNA, 1515 bp, Homo sapiens
taaataaataataaaaataaaacagtgattgaaagtaaattctagatttctttgagacacttgatcataagcacatattatttagatagcaagttggtttaaatattttttaccatttcaatttttcttttttgctaatagtatataaatttgtcactaacatgtatgtgtgaagcatgggaagaaatactaatgcagatggattctcgtctcaccaagtttgtgcaggtaaagcagctgaagtttcccatggagagagttaaagaatgcatgatgtatgtctttaccttgaggtacatgagaaaaatcagtttgattcataaaaggctaagatcataatttctttcaaatggcttcgtctgacttcaaactgcttcctcagatttgccaaaagggctcttttcccattgatacaacttaagtggggacaggattgtgaagtggagctggtggggctttggcaataagggcaggtgttagaacagctgattggctatcttctagtcactgatgttcagatgatcactttatggatttgatggaagtctaaggcaaggaaagggagtcatgctcctataattttgaataaatatgcttataatttaagaaatacatatatcacaatttttttttcacttttttccaggaaaagaacacaaccacatcagtgcaagatgagttcatgcacttgctattatgggggaaagcaaggtaataaactcagattaggtgctcctgtttttgcttcttttttaacagtaattatttatttgaaaagtagtttatagtcatagtatgtgatttttttaattgatacataatattttaattgatacataatgtgttacatacttacggggtatatgtgatgttacatgcgtagaattttttgtggggctatttctttattttgtttcttgtttgtgcttcgaaatttaaaagttgtaagtgatgcattcagatttccaatagagaagtgactaaaaatactttgtttttcattgtagtgctgaacttcagactctcttgatgaatcagttaacagtaaaggtgcagttaatgtatctatgtattcaaatggctatgaacacattcttaattttttttttcgagtggcatataatatcctgattgtatgctaaatatattttccttttttaattagggcttgaaaaagcttggccagtctatagagtcatcatactccagtatacaaaaattggtcataagtcatttacagaggtatgaaggtgacgtagaattttttggtattgtatccacacatacctggcgttggccttctttccgccgccttttcttcatctggcattctctttttaagccttttctagctaaaattgttgcatggcatttgagaagaatcttcctatacccaagattgaaagagtcaataataattctgctttatgaagtaattttccaacatcttttcaccaggctagactctatctgggtttttttcttaatcagctaagcatgaagtatattttgaaa

SEQ ID NO: 33472 - DNA, 1043 bp, Homo sapiens
cggagtctttattataccatttgagtgaattgaaaggaatggcttcatggaagcaaaaatatgaacctcttggactagatgctgcaggaatcgaaggtagtgatttaatttctcagtgaaatacattaaacacagtttacttatttgacaaatgacgtttatttattttttccctttagaagctataactgctgtgggttcttttatactcaaggcaaatgaacttcttcagtaagtattgggagtacctggaatcactgacctaagaatatgtcacttttgacctaaataagaacctagtaagctgttatgattctcttaaaatcagtttttaaatttttatcacaattatgcctttatatggttccgaaaagccagcagcacagagaatttataaagtaaagctgtattttcctgtcctggtcatccttacctcaggtcttctcgccagagggaatcattttaactctttaactacttctatttttagttcttctatgggttacctccatatttctaaattgtatgactatgccacatttcttttgtcaatttttagaagttattctctttgttttgtttttcttagactgttaggcttgcttgttttcttgcattgtctgttttttctgcatccttccgtcctttcccttctgaagggtggtgtagtacctctggagtcccctgttccagatgccttccttagcctcccacccctctgcttcagcctgcagctgtggtccagttctcctgcacggctaccacccgggcattttcttcattactctcctgggttagacccagaactgccaggattgcctttgtttcttggcttatttaatcattttgctggaaaacatcctctagtaactttctcaaaaagcagacatagaaggtaaactttatctccttttgtgttttttctcctaccctcacacttaattgacagctggctttaggattccctgagggttattggttttcacatagaacttcaaaagcagagttccataggattctgtgctttttgttgctgatggaag

SEQ ID NO: 33473 - DNA, 1049 bp, Homo sapiens
gctgcatcagtcttccgtcacttttgacatttctgaaatttaatttcttttctattgttctttttgtttttgtgagtttctaacacatgtacccctctccatccacagccattttaatggtattttagaaggtagaggctgtagatgtgtgtgctcagaagacaaaaaaaacacgaagagaaatggcattgcttttcctgtatttcgaagtattttttggttcaccgtatttgcagagagcagatataaaatactacgctttctatgatcacttctcagtatgaatgaaaggtagtttaacttattgttctttcaggtaagtagaattattacaggttccagatggagaaactgaggcattgagcattttgatgttggtctggtggcctggggtagggttgaacatattgactgcacaaaggaactttttttctttctcttatcattgctgcaagagggttttgattatattgcttagtaacataagagatgtttcagtcttttattccaagcgttttactttgtactgaaaggttaatgatactgacctacctcttcattggtattatgaaacttaatgcttggaaagggctttgagatttgggaatgaaaagcacaggtttttgcctagaataattatcgtatacatgtgagcttaaagagattgtttaaaaagtgataacccatgtctgtattcagaaacagttttatcaaaatgaagatgacttccatttataacacttaattttgggggtacatttgtgtaaagccaagggaaattcaacttttgagatctcaattgttaggataaaaaatcagcttccaaaaataatggtccattgatatcagaggtaatgacagcacaaatttgtaataatggttttctgttgaagttgatgttttttcttcttactgaccaatgagtattttcttttaaaatgagaataatgctgaaaactgttttttctgatttcttttatttgcaaagttagaaaaggagttcatgctttactgagtcataagaaagactattacacagtttgtggcaa

SEQ ID NO: 33474 - DNA, 1035 bp, Homo sapiens
tgattcttgcagctcactcttcttcacccctgctgaaactgttgataggttaggtagttttgagcctgaaaaaatggacagcattaaaattagcctcatgagctagatgagaaagggttcctccactttctacaactcgtttgctaagtcgatcttttgcactgtgggtgactggccttgcaaaccaggaaagtttcacaatagttgtttttctgacatcactgttagctttattttgggagtaaaatatgtcagttgttggaagggatcctaaggtataattttctgagggctgaagaactaaattgggataaattcaggtcactgcaagaagcaggagcctacactgaagcagacagcactgtttgcctgcagcccttaactaagggtgacacatcttatctggggtccagttctcatttccaaaggagggacctcagcacatgtggtcttagcacaaggcctgaaataataaacaaccttaggccataaagagttctgtagctattggattaactgattggaagatgagttcacatgtttaattacattctcggaaccccaggcgttcatattttcacagtcgcataatctatatttctttgaaagaactttgccagttttcccatggcttttagtagatagtaaaaatgtcacatttataattatgtaccatttcttttattgagcagctttcttttatcttgatttttctttttgttccttttgttgatagatgactcagaaagatatcacatttgttgctgaatttcttactgaacatttcaatgaggtaagaagttgatatttctgtaatgcagtttaaaaaaaaattacagtaaacctggataatgacaagacataattaaatttaacccaatttaattgaagtctatagcaattacttttttaaaactgttgaactaattatgtttataaacatagtcaataaaccagacttttgtttgtgtgtcttataatctataaaagaaaataataactgccactcacagctctcttgaaaaggaaggtttt

SEQ ID NO: 33475 - DNA, 1021 bp, Homo sapiens
tatttcatcatatatttgatggttcccaaatcattccttgcttcttatagccagcagaaacctacagttggattttggtgagtctaagtttgtagtaagtgagattgtttttagtgagctgtcagcgggggttgatgaaaggcagaagaccatggtcgtttttaatgaggttgtgtgaaaatccaatgaagtggtcagtgaaaattctacctcgagataaactgtgcagactggctctaacagtagattattttcttctaattataagtttgctatagcttcttttatttttgtttctgtttttgtttgaaaccagaaagtcctttgctgtttccttattatcctcgaaaatcattgcattttgtgaaaaggcggatggagaatattattgatcagtgtttgcaaaagccagcagtaagtttgaaagaaatgcatgtctttgtgtaggagcaatagtgtctacagtatgtggctcacttatgtaaatgatcttaatttttagaatgaactatgaaaatgttgatagtcaactgtttttgattaacaaaagtaacaatttcatatggttcaacctaatactccaacttaagtttcttacacacgtgtgtgtgtgtgtgtgtgtgtataaagattactgaaggtgttggcatcttgagtattttatttgttcccagaagaaattcattgtaaacagtcttagttacagagctgatgtgtctctgcttactactgaaggatgtgaatgaatggttgttatgagaccagagggaggtggtcttaaacctgccatgtgcttagcaccaaggtccttttcagctcagaattttctctttttccttactgttacaattgtcattaacgtttcttatgtacaaggtttggtgatgtaggcgatttttttaccacattcgaacagtgatggtcagtcactttctgtagagtatctgtgtgcatattaacgctctaattatattttaaaatcttattttatataggatgtaattggaaaatcgatgaatca

SEQ ID NO: 33476 - DNA, 1971 bp, Homo sapiens
aattacaagaagtaacgttgcttctttggaaccttcatcaaatacatgatatataaggtccttttgtgcaaatatttttactgtgatttatagcttgtattgattatgatcatgtggtggccttagctatttagttcttgttctgataaagcttactaagtagttaataataatactagattttaatctcacgaaattgccactgttgttatgtggagatctttttatacaaaatgaaggctgaatttattgattttgttgtaaattgatgggaatataactttcctataaaaccattctttgattcagacttctgatttctaattctttatatatgataagccattaatttaaaaatgcttttatggccttttcttttttagttaagctcaaatcttcgtcatgtgagagtatttgaaatggacatagatgatgaatgggagctcgatgagtcttcagatgaagaggaggaggccagtaataagcctgtaaaaataaaggaagaagtgttgtcggagtcagaggcagagaaccaacaagctggtgctgccgctttagctccagagatagtcattaaagtggaaaaacttgaccctgagctagactcctaatctagcttgccattattgtgtgtgtaattatggccaaaaggacataggagatggactaagatgtcttggaccacctttgtgtaacaaagaaataaacagtaaattttattttttcatattctgcttcatcttctcttagtgatatagtcactatgatagactttattttttctgagctttctctttaatgctatgtgcagaactagtgtttaaagaaaacagggccaggcatggtggctcatgctggtaatctcagcactttgggagtctgaggtgggtggctcacctgaagtcaggagttcaagaccagcctggccaacatggcaaaaccccgtctctactaaaaatacaaaaatgagctgggcgtggtgcatgcccctataattccagccacttgggaggctgaggcatgagaatcgcttaaacctgggagccagaggtttcagtgggctgagattgcgccattgcactccatccagcctgcgtgatggagtgagactctgtctcaaaaaagaaagagagaaggtgaacaaattgaatatgaagaaaaagtctaatcttttctgtcagaagggtaggtatcaggaattgttcctgtatcattgaaatagtcgctcatcactggaaattttaatgcatttagtattttaaaactatagacaacattcctatttttccatctccccttctagttcattttgggtctccagaatgattttaaaattatgttttcagaatatattatactgatttactgaaatgctaagccaaaggatggatcctgtcttttatggtttaaataacataaacactgcttgatacctacatggttatcttttctcattctgtccctgcatttgagctctgagttatttgaatcagcagtgcttagatgtgcccttttgccttttcagacttggttaaggacatatagtagctgtctgtttggttgactccttgagagtgtgagaaatatgggtcaactaaatgttatctggcattagtgcagataagctactgttgatttcctaatgctcattcattcctaaagtacaatagtattcttgtgtgactttcaaagaaattaatttaatatatgaattccactatcacttcatcgataatcactttttaaagcttaaatatctttaggcaggaggatatactataaccaggtgaatgggtaactgcagggttgctgtgtcatttgtctatttaataggtagctgtctctctaggtactccagggtacctctgtgaatggaagccactgttgggtgacatagcatttaggactgtgatcaggaggctgactatactgatctgtagccttgcatatgataggccttaaactctatta

SEQ ID NO: 33477 - DNA, 1054 bp, Homo sapiens
aactgcctcattagagaggcctcctcatcctacagacgaggtattagcctccttgcccaggccctctttctctcattctcccactttgcttttctgcctagcacgcgtctctccctgcaattatatgatgtgattatttgtttgcttattaaatcatctctctcctcactagagggtaagcactgtcagggcaaagagttctttgcctgacttgctgccatcgggccagcacttagagtagcccctgttggtgttcagtgtggaaatctaggagggggaacacccttgcaaaggtgccctctggaatggtgagtggagtccagtgttgagaggtggcaagaccaagacagactcagccacctgcctgccgtcctacctttccattgattcttcccagaattccacatggagataatgagttctcatttcatgtttagaaagagttggaggaggcagaggagaactgcatgcgtgtgggcatgggcgggggggacctctgatatagaaaaatgaaagatgattttgttttttctgatcaggaccaaagaccaagctattagatatttccttaagtgcttttttagtgtggatttggagaaataacttggagggatgattgctctctgcccccacttgtacagttcttaaaatgctggagttggtttttgctattgaaaaaggcaggcagcagcccccagaaacctcctgagggtgcagatgaggcaggggccccagcagacccccagctgatggacacagtgtctccccttttgggcgtggcctgctaacaatgacctttctggaaagcctttgattctggcaagtgtcctcaggcttcctggtacctgtgactgagaagagtcacctggtgagaaaaacaatgttttctctggtccagtgacagcactcaaaacctctccaggggtgagggagaagtatgcaaaatgttcctggggtgggctgggtgtcagatgactcctaaaacaaacggaaacagacactcaatggaaccacagtggactctccaacattccagaaaagtggggcgaggacc

SEQ ID NO: 33478 - DNA, 1028 bp, Homo sapiens
gattaaagcgtctccaattttcatcgccgtctttttagtgccgtgggttgttttgcttggaaacagtagccttggaaaaagatctggtctcttggtggttcttgcgccccccggcccccgcccccctcctggttcctgacggcgtaggccaagggcagctgtctgtcgaagctttgcaatctaggctgcctgaggatgattggagggtatcgtaggacggttagaaggaggctcaagatgtatatatgtgtttttctgttagtgtttgagaatagtttcagatagccacaatggatattcatttggcgtgtgagtaggagttgagtgaatttccatgttaaaaacttgtgagtgttggggcggagaatttcagcattttctagaaatctggatttagaatttatcagtaacttctgcctcataaggaaaaggagaggcattccgcttgggaattttatataaatgttttattttttcttaatcattagatagtttacagttatgtgctttttgctgccctgtagatgcgtgacaacccttctgtcccatcattggggttgaaatgaggacagcaccgaagagtgcagtttctggtcgatgaatactgcttctaagatctttgtggaagatattaatcaaatgcagttaaaaagtatacgtataatatgtatattatatatatatatacacacacacacgtaatagcctgtagtgagattattttaaagacacttcctagtgttaaagaacccttgaagtgtttcgagttcttattgttttggtaatgctaaaagcttggggttgtgtgaatgggggtggggggtgtggtgtgatgtattctaatgacttgagttattctgggtgctaggaataagagttattatatttaccaggattactatgctgaaggtattcttcaagagtttgttttttttctactggttgatctctacttttagaaggtatgttacccataaaatcatttggagtgtcatttcatttacaaactgaagttctacaatagtgaa

SEQ ID NO: 33479 - DNA, 1039 bp, Homo sapiens
gccaccatgcctggcctcaaaagttacttaagtatattgtgtaaagtgagccactatagtcttataccaggaaataatcactgttaacaattgggagtacctttgacccttgaacaacacagatttgaactgagtgggtccacttatatgtggatttttttcctccaaacttggatggaaaatacagtattcatgggatgcaagaatagtgtatatggagagctgactgccggtcttgagtatgtgtggattttgatgtatgggaggatcctgcaagcaatcccctgcggataccaaggaacaacgatatatttcttaatttaaagaaatggaaacgctgacattcgattctattttaaaaatttcagtagttttgcaaacataatattaaaggtgccagggagctaacactttgttgaatatctactcagtcctcaactacaatgtgagggaagtggtatctctatctattagattactttaaatgaatttccaggaaataaacttatttttaaagttacacttgattagactagtctttgggctcaaagtttctctgaagtagcgtaatgtatctttaggtaaaaattttgtatttcatttttaaaaagttttttaaattaaaaaaaattttttttttgagatggacgtctcactctgttacccaggcagacttggaaattttgggctcaagcattcttcctgcctcatcctcctgagtacctgagattacaggcatgcatcattgtgcctggcttaattttatttatttcttgggataggatcttactgtgtcacccaggctggaatacagtggcaaaatcacagctcactgtagcctcgacctcccaggctcaagtgatcctcctgcctcagcctgccaagtagctgggactacaggcttgcactaccatgcctgcctaatttttatttttattgtagagacagggtctccaacacctgggctcaagcgatccttctgccttggcctcccaaagtgctggaattatagttgtgagccactgtacatggctcggac

SEQ ID NO: 33480 - DNA, 2012 bp, Homo sapiens
aaaatatacctagaagataaatttctcaaaataatcctagaaatgacttttaaagcagaagagaaaaaaggaagggtggaatagcaacaatggaaacaaatgaggaatcctgctccccaccccacctcaaagcccactgtatatgtggggttatggtcagtatttctggtgttagagtgtatatttgcaaatctctgaactgtttatatgtatgaatctcatcataatagattcacattcttcttaaaggcaatgcttaacatgtttcctgatcataagatgttcatattgaagattttaaaaaaatacaggttgaatgtgctgcttaaaatgagctgctgctttatttttaaacatttaaaaaattttgttaaatttagtctcgttcttcctacaaaagagcttaaactttgacagtaacagctgttcttttgtgtgggacatgttttcatgaggatttttgtgcacattaaaaataaccatttttgtgaatcgtagttattattcatagtcactttataagagatataaaggttttccagtgagttacttctgattcataaccaaattatagcagagcagatgtagactaccagtggaataattagccaaaaaatattagggggctagagatctctttgtgtaacatttaactttaatttcttggacagcttatatgaataattaaagtgttgaggcagttaaaatttattttcctctcttgggatttcccagttgtcatagatagctgtagtcactagggaagtagaaatattatttccagcaaacagatggctttcctcgtattggtccccaaaagcgcctactgaggtttgtgtttctgttggatgatttcctaatcacaccaactcagtatacttttgaaagatcacacctggtaacagaatatgatgtaaatattaatatgacttagtgaacttgagagcatccaaaattgtaagtttatatagttcctacatccctggggagagtagtctgtccaatgagaggaatcgcctggtagctagtactttacttttcttatcacaagtcccctttctgcctcagttgtactctcagggattcccaagctgctacttctgctttttaactctcattaactctgtcatctacgtgctattttcatttctgcttagtcagatgactaccccatcccgtactttgaggcattggtaggtttttgttagaattaaggataggattctattatgtatggggaagattttcagagaatacagtgatgctggggcttaaaatgacaaaatcacatcttttctaagctctataatgaagcttttttggagatttcacttgttactaatctttctctttttaaaatgtctgtttttcttctcccattggaaattaaaacacacacacacacacaaacacaaattgggaatctacatgtatatttatgctagtgaaatttcaaaaatagtcaagtattagtgaagtggccacattgttggagtaaatacttgggggttcatcatctcactcccaaaaaatttaggacatggacatgcacgaggagttcaggagtggaggtttaataggcaaaagaaagagaaagagaaaggaaaacagctttctctctagtgagagagaggggacttccagagaggaaaagactggcgactgcggatgtactggattttatagtcagattggaggaggggatatctgatttacatagggctcacagattggttgggtcaggtatgacgtttacagcggggaaggctggctgcctaatcttattatgcaagtaaactttccccttggcaggtgccatcttatctactccttactgtacacatggctgacaaagagaagggaagatggagccgctatcttgaacatgattggcacaactgctgacatctatgtctgtagctcgattttacagtctgctctttgtgagaaaggaaaatgatttggggctgcttttcattaaaaggaaaaccttactgaggacttccataccc

SEQ ID NO: 33481 - DNA, 1101 bp, Homo sapiens
aaaaaaaaaaaaatgggtgtgggggtgcatgtctgtagtcccagccacacaggaggatcccttgagccccaggagttcagggctgcagtgggctatgatctgtgctactgcactccagcctgggcaacagagcaagaccccatctcttaaaacatcaaaaccctaacccctctcctgccaacaaaaaagcctcattaacagataagaactttgaacaccttgagttatataaaacgtaagtgaagacagtctggcccttgatagtttgtgccccactggggactgcaggtacactcacacaaactgtaaggaagaacaccatagctcatgtaacaggcatttcccaaggagcattgaggtacacaagaagaggggatggttaattcagactggggattccagtgaaagcttcaggaagggatttcttcttccacctctcagttttaaactttttaactatgttagaggaagatgaattctggaaatttgggggcaagagattttgttaaggaatacctgagtactgactgtcctctgaccctcctgccaattcaggatgtggttcttgttagagatgaatttgttcaaaaaccacgagtgcccatgttggtaaacattcctttaactggaagaaaacagaacatcaatagaaaggtaagcctgagtagagtcccagtaagaatgtggctattttctcacctctgctagagctggacctgcagagtgtgtcactggcagctgtgagtacttttagctagggagcttgtggcctaggtaagcctgccaagacaggctgcacatgcacttgggctctgtgtagctactgccattcagcttaagttttgtatcagtagctaagtagagtcagagctagatcaggccaaatagactgggagtgagaaagtaggagagtgaatctgtttagcttcttcctgtctgtttgtaacccatttgaaatgttgcacaaatttcgtttccttccccagagataaccactgttacaaatttgaatatattctcccagacaaattctttgtgtacttaaaaatacataaaagtgtataaatacagtttgggttttctttatctttacttttaaaa

SEQ ID NO: 33482 - DNA, 1068 bp, Homo sapiens
tactataaggccagaaaaagaaatgaaagacgtcttgatgggaaagaaagaagtgaaactgtctttatttgcagatatcatgatcatatgtatagaaaattctgcggaatcttgctactagaactgataagtgagtttagcaaggtagtaggatacatgattaacatacacaactaaattgtatttctgtatactgatgagcaatgggaaattggaatttgaaagcaatacaatttacacagtagtataaaaatatatatcaggaaaagtctgacaaaaggtgcaaaaactctacactgaagactaccaaacattactgggagaacttgaagtcctaattaaatgttcttcaggtagaagacctaatattgttgaaatgggctgggtgtgatggttcacacctataatcccagtacattgaaaggccaaggtgtgaggatcacttaaggctaggagtttgaaaccagcttgggcaaccaagtgagaccttgtctctacaaataataaaaaaaattagctgggcatgttggcacgtgcctgtggtcccagctacattgggaagctgaggcaggaggattgcctgagcccaggaggttaaggctgctgtaatccatgtttgtgcctctgcactccagcctagatgacagagcgagaccctgtctcaaataaatatatatatggttaaaatgtcagttcttctcaaattgatcctgtggattcaacacaatcacagtcaaaatctcagcaggcttttttgtaacagttgacaagctgtttctaaaatttatatagaaatgcaaataaccttgaaaaaaagaaaaaagaacttacactgcctggtttcaaagcttactataaagctatggtaatttaaagtattgtattggcataaagatagctaagtagaccattgtgacagaatagtggccagaaatagttcttcagatacgtggtcagttactttccagtcaaggtgcgaaggcaatttagctagatttttttttaaatggtagtctttctaacagttgattgtagaacaattggatatccattcctccttcaacccac

SEQ ID NO: 33483 - DNA, 1050 bp, Homo sapiens
tgttgttattgttgttgttttgtattggttatattttagtccactcagtccactaatatcacttagtttttattacggaaaaatttcaaacactctcaagtagacagagttgcaccatacagtgaaacctcttatgttcattctctaacgtcaacagtgatcttaacattcaaccaatcttatcttcatctatacctgtactccagccccactttcttctgcccttattttagtttgatgcatatccaatcagtgttcaaatttaaaatggtctaaaatattttaaaaatcagattgcttgaatcaaaattcagatctaccacttagtacagtttatattgtgatatgtccttgagtataatctatggacaccccctcaactcttgcaatttatttaagtaagttgaaacatttagtcactagagatttccacgtactagattttgctgatttcatttatttggtatagtttaatgtattttctgtaaattggtagagtcaaaaagaaatagagcgtgggcctagttggaaagacagatttcattcagtactattgcaataggggaaaatagaaccaagttccatttcagaatacaacaaagacacttggggatgaagcagagtgagagggtcaatggatggaaactttctaaaaggagacatcaaaggtagaaggtttctttctgacctgacttaggattcctgctaaaggcaggccaaggtgatcatagatccagagtgggagatagtttaggaggattcttactatatataactgagctaaacagactgatgacggggctcaaggacaaatactagttgattgctcagagcagcctgcttaaaagtatggtcaaggagagaatctttagtgtagaatggtgatcagatttaagtttgttgtcctttggttcttgttttctttctgaaaagcaagacctgcttcaaaggtggtggtgtgctctcttgcactaggaggtatattatgtcttgtattcaggctatttgcatttcagattacacagttttatgtaactgctttaactttgt

SEQ ID NO: 33484 - DNA, 1044 bp, Homo sapiens
gttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaacttt

SEQ ID NO: 33485 - DNA, 1049 bp, Homo sapiens
gctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacatgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttg

SEQ ID NO: 33486 - DNA, 1034 bp, Homo sapiens
aaaaactgtctaaatatgtagtattgtataatatactgcctttcttataggaagatgatgctactgactcttagtcacactctcttggccagtcccccttgtgatgcttttctgagactgctggatgggggtaagagaagtagtatgtggctgaggagcagtttttctttgtgaaatttactggccagtacagatcacttaccttcttttattggactcattagcaccatgttctaactaagccattgagactagatataacataatagttaaataataatttaaatgcagttaccccccaaattcaacatgtttaatgaaattatactgttatggtcatttatttagcttttaaataagttattgattcttgtttttagttgtattgctagacttcaaaaaatgaaatgaaaccagtttcaaaattaccttttccagaggccagttggagaacagaaagaacttcttaataaatggaatgaaatgggaactgatgaaccaggtatgtgaacaattttttctgaatgtagtagtggaaaaataattgccttcttaactgtggatccaaaataacataattaacaattcttttgggaagattgcaattttccttctcattaattttctatcatctggaaaaccagaattagactgacctactcaaactcccagacaccacatgcaactaataaatacagacatcaggagcagctttttgtttgtttgtgtttttagagacaggttcttgctctgttacctgtgctggagtacagtagcatgatcacagctcactttaacctcaagctcctgggctcagagggtcctttcacctcagcctcctgagtagctaagactacaggcacacaccaccatgcctggctaatttttttattttttgtagagatggggttttgctatgttgccctggctctctctgttgaactcctggcctcaagtaatcctcccatcctcccaccagagcctcccaaagtgctgggattacaggtgtgagccactgcgcctggccttattta

SEQ ID NO: 33487 - DNA, 1066 bp, Homo sapiens
cctccgctggtgaaacccaggcaaacagcatctggagtggacctccagcaaactccaacagacctgcagctgagggacctgactgttagaaggaaaactaacaaacagaaaggaatagcatcaacatcaacaaaaaggacatccacaccaaaaccccatctgtaggtcaccatcatcaaagaccaaaggtagataaaaccacaaacatggggagaaaccagagcagaaaagctgaaaattctaaaaaccagagtgccccttctcctccaaaggatcgcagctccttgccagcagtggaacaaagcaggacggagaatgactttgacgagctgacagaagtaggcttcagaaagtcggtaataacacacgtctctgagctaaagaaggatgttcgaacccatcacaaggaagctaaaaaccttgaaaaaagattagacgaatggctaactagaataaacagcatagagaagaccttgaatgacctgatggagctgaaaaccatggcacgagaactatgtgatgcatgtacaagcttcagtagccgattcgatcaactggaagaaagggtatcagtgattgaagatcaaatgaatgaaatgaagtgaaaagagaagtttacagaaaaaaagagtaaaaagaaaccaacaatgcctccaagaaatatgggactatgtgaaaagaccaaatctacatttgattggtatacctgaaagtgacaaggagaatggaaccaagctggaaaacactcttcaggatattatccaggagaacttccctaactagcaaggcaggccaacattcaaattcaggaaatacagaaaacaccacaaagacactcctcgagaagagcaaccccaaggcacataactgtcagattcaccaaggttgaaatgaaggaaaacatgttaagggcagccagagagaaaggttgggttacccacaaagggaagcccatcagactaacagcagatctctcagcaaaaaccctacaagccagaagagactgggggccaatattcaacattcttaaagaaaagaattttcaacccagaatttcatatccagc

SEQ ID NO: 33488 - DNA, 1083 bp, Homo sapiens
taccagctgctatagttagtccttcattcctagaggaggatctctgggtggtgtgtcatacatctgccacacactgctgccatcttagtgaaagccactgtcaatagtctcctaacaagtctcctggaatgcttttgcacatatatccgcatgctaagtttctcaactcctttcaatctttgattagatatcaccttctcaaggaagcctacactgaacagcctctttaaagtgtcacccactctttctctgttcccctttatcttgtttccatagcacttgctacctaatacactatataatgtaattatctatcatatttgctatttgttacacacattctgctccatcataattaaactccataaaagaggtgttttgtttgtttccttttatgtattccaaacacaaggaacagtgcctggtgcatagtaggggcagaagaagagaattagtgaactgactaaaaaataatctgaggaagtcatccagaatggaacaggggggataaaagtaagtaaaaggcatggcaggttgaatacgtgtaggtaaatcttacagcttacaggagtcaggtagaagtaaataaagaaaatgtgggagaggcatcgttcaattaaaaatgcccaaagcaattgaccagacaggtggtccagtttttggaatttaaataactaaaggcgtacatatttagtcataagtaaattcactctagtgttgtttgtagttggggaaaagtggaaataattaaatgttcaacaacagtacaggttaaataaattattgttctttcatacagtggaatattctgcaacataaaaatgtgtaagaaatatttatcttacaatagtgaaaagaaactacatataatcctgtttggtttgaaaaaattatatgtatgagtatgttaaaaagcagtctgaaaggatatacctcaaattattaagactgatgggattatggctgtttccccttttgtttatcatctgtatttctttatttttaaaattaatcttttttttttaaacagagatgaggtttcaccatgttgatcaggctggttttgaactcctgggctcaagt

SEQ ID NO: 33489 - DNA, 1028 bp, Homo sapiens
agtgatatcaatccttatttttctgtggctactgtcaagatttttgttttcagttctcaccactttgattatgatatatctaggcatagatttctttggatttatcctcttgggtgtttgctaagcttgaatttataagtttatgtcttttgccaaatttggcagttttgacccattattactttaaatatttttttctgcaccatactcattcttcttttcttctggcaatccagtggcacaaatgttcaaacttttgatataaaagaaaaaaagaagatgaagaaaaataaggtttgttattttctcacaggtccttgcaggtctattttttttttttttttttccatagagataggttcttgctttgttgctcaggctggtctcaaactcctggcttcaagtattccttcctgtctcagcctccgaaagcactgggattacagccatcaccacacacagcccttcactttttcttaatcctttttctgtattgtgtagattggacattttctactgatctatagtcaaattctctggctctttcctccatcattctcattttactattggatcccatctagtgagatgtttttgtgtggtttttcggttattgtatttttcagttctataatttccatctggttcttcatacaaaacatattgaactgtacactaataagggtaatttctgctatactgtagtttccccttatctgtgggagatatattccaagacccccagtgggtgcctgaaactgtggatagtactgagccctgtatatacaccatgatgtttttccctatatatgaataactatgataaagttcaatttataattaggcacagcaagagatttacaataactaataataaaatagaacaattataacaatatgcaagcatcactactcttactctttggggccattattaagttaaaaaaaaaagggtcacttgaacacaggcgctgtgataccaggacagtcaacctgataaccaatgtggcttctaagtgactaacatg

SEQ ID NO: 33490 - DNA, 1025 bp, Homo sapiens
acttctatgagtataaaatatattttgggccaaaaaacagacaggtctcaacaattttacaaggattcaagccatataaagtatgtgctgtgattgcaatgagtaatattagaaattgataacaaaaatatctggaaaaatcttgaactattgaggatactaacagattgctaaataacccataggtcaaggaataaatcaaaagggaagcttgaaagtattttgaactgaatgaaaatggaaataaaacaacaaaatttttgaaattcagtcaaagcagtatttactaggaaatttgtactataaataccaatattattatagaaaaggggaagatctcacatcagtgatcttggtttctattaaaaaactaaaagacatacaaatggtcaacagacatatgaaaagacactcaatatcactaatcatcagggaaatgcagattaaaaccacaatgagatgtcaccttctacttgtcaaggtgtctattataaaaaaaaaaaagattactgttcacaacgatgttgagaaattggaacacttgtacactgttagtgggaatgtaaaatggtgcagctgcttggaaaacagtatggaggttcctcaaaaagttaaaatagaactaccatacaatccagcaatctcacttctggatatttatccaaaagaattgaaatcaggatctcaaggagatttgaacacatgttcactgcaacattattcctaatagtcaagatatggaaacaacctaaatgagtgaataaagaaaggtggtatatacatacaatggaatattattcagccttaaaaaagaagaaaatcctgccatctatgacatgagaaaaccttgatgacattatactatgtgaaataagccagtcacagaaagacaaatactgcatgattccacttatatatggtatctaaatagtcaaattcagaagcagagtggctgttgccaggggatgggggagggtgaaatgaagagtcgtttttcaatagtataaagcttcagttatgcaaga

SEQ ID NO: 33491 - DNA, 1050 bp, Homo sapiens
ggcagatgctttgacagctatggggttaaagggtagatggaaactgtccagaaccgccagtcagaactccccagctctggccctgactctggctttccttaggcgtgtagtccccaggaggcttatgaagtgctctgagccttgatttccccttctattaaatgggcttgtcagaggaccaacaggctgtgagtttgaacacaagggatgcccattctgatcaccacccttaggtagacttaaagtatgtcattgaagaacatgaatttcagcctcttaggctccagcttcaactgccttagaaggaggcaacatgacctgtgaactctagcttggcctaaaggaggctcttctggtagccttgctagaactccgttactggagcagagccaaaaagaaagtactgagacaactttggctgtttcatagaatgttggagctggtagttttgtgttgaaaggttatcaaaaggagaccattttgtcatttccaaatcatctttggactagcctgtgcttgaatggtaaaatacttgatgaaatgacatttttaaaacttctaagacactgctccccaaatctatgcacgtccaagtatagtgcagtaaagtaaagcggttgagagtgtgggctcgggagcacccccatcttcaaatcctgcttttgccacttattagctgtgtgaccttgaacaaattacttgaccactccgtgcatcagtttcttcattggtaaatagggataataaaagtacctaccttctaagactgtaaggaaaccctgataaattaacaaatacaaaggacttagcacagtgcctggatgttgtaagtgctgtgtttaacgttagcccttacactagggcttggtcattggtaggcactgagtacatgttagattttactggactgttttagatggtggaggctgtgatgcaggagaatggaaagaactcaggaagggagattaggacaaatccatttagtttatattccttagtcactgtatttacaacttttatcaaaccaattatctttcttaagagctatgg

SEQ ID NO: 33492 - DNA, 1827 bp, Homo sapiens
ggcagaacatttactttcatattctctgtaaaaccaaatcagtgagaaggatgcaaggagaactaggacagtatatgaactttttccttcttaaagctttttctgtgtaggagcatattcatataactgagaagattgtttgaaattttagcttaaggctaatatattatttcaatatatactcattgaacacttacagatattgttgtaggtattggagcaatgaagaaaacgatgagcttaatttcactgaggataagacagttaacaagtagacaaatatttatcaggagatgataaatgcaatgaaggaaaataaaataggtgagaaggtagagaatgttagggaaagtatatgtgtgtttgctgttatttaaggtggtcagggaaatcttcatagttgacatttgacaagagagaagggagagacagagggatgagacccttcaggtggagagaatggcatgtgcatgggccctgatggataccattgttggatttttggagaaacttccaggagaccacagggctggtgtagagtaagcaatggagagagtaatagatagatcagagaggttgtctgggctagaatgtacagtcttgtagacatcatctacaagatgtgaggacattgtcattgtatgtcatgtactctgagatggggagctactgcagggtttttgagaagtgtgacatgatttgatttatgtttggaaatgatcacttcagctctttcactgaaatgacactctagaaggtctagtcttagagcagggagaccaattagtaggcttttgtccggggagagaaagtgctagagctcccttgttagctatggaggtggtaataggtggtataggtggagctatatgtggatgctaaatacagtgaaagcccttctgttctgttgtcctgaaaatcaagttcattgttatatgaactttattgtgaagtaaagacataaaagcttatgcctttataggatataatttaaagagctaggaaattggaacaacccgtagtgttcaactgctgaatgttacaagatacaataagcaccaaaccaaataattaaacttttttttttttttttttttttttgcctcttgccttgtccgtgatccctttaaaacttagaatttatttgagctttttttctttactgttttgtttgatgttgctttcattttctacttgggttaagatgtatcttgctaataatctaagatcacaccgtgctgttacagaattacagactttgattgaactcaaggaagtggacaaagcctaaagctcaaactgtctgctaattacaggaacttctccggtgtatcccttatagactgtcattcattagctcctcagatactttgggtggttgggaacttattgctcctgaacaacttttccattagtaggcagttctggtttgtgagaagttctttgttgcattaaactaaaatctttcagtactttctttgggttctagatgtatcctttgaagcaaagagtggctattttttctcttaatgttttaaaagaccctgtattagggttctgtacagaaatagaaccagaaggaatgaatgtatatgttcattattacaaattaataatataattttatatagtgcatatctgtaattatattaccaattatttagttgcacttaaaatactcaaagatgtaacttaaaataattaattgttttatacatgtatctacatatctacatagatagacataggtaaaacatagagacttatttcaaggaattggctgaggtaattgaaaagatccaaatccaaatccaaaatccataggat

SEQ ID NO: 33493 - DNA, 1057 bp, Homo sapiens
tacctacctacctcaatccatgaaggctttttatttcccacttgtgacttcaatgtactttgttcaatttttaaacagttaaacattagaatgttaaaagtatagattttttgatacttttaaagaaaatcaatatgatctaaattgaaaacttaattgttttttaaagtctgctatagatgttaaattaagttacttatggttttattatcctttgtgaaaggataataagtgacagaagtaattaatgactataaaatattttcaactttaggctgggagcggtggttcatgcctgtaatctcagcactttgggaggctgaggcgggcggatcacgaggtcaggagatcgagaccatcctggccaacatggtgaaaccccatctctactaaaaatacaaaaaattacccaggcgtggtggcacgtgcctgtagtcccagctacttgggaggctgaggcaggagaattgcttgaacccgggaggcggaggttgcagagagccgagatcgaaccactgcactccagcctgggtgacagaatgagactctgtctcaaaaaaaaaaatttttttttcaactttataaatttctaaatcatagtaagtcataacagaaagtaaccttagaaaaccaaaactttttcaatgtagctactaaattattaacatacaggagtctttctacagctaagtttgcactgaagaggtttttgaaacatgtaacaaattattaaatcacacatggatgagctccaacagtgatcatcaataatatgtaaagtgttaaatgtgttgctcaaatatttaaatttgtatactagaaatattttcatttaatatatatatatatgtgtgtgtgtttttcaaataaacaggatagcagtgcacgaaccttcatttatgatctcccagttgaaaatcagtgaccggagtcacagacaaaaacttcagctcaaggcattggatgtggttttgtttggacctctaacacgttagtattctctctcactcagaggatgatgtaaaagaatatcctgatcatctctgtgttatttaag

SEQ ID NO: 33494 - DNA, 1011 bp, Homo sapiens
tttaggctgtttttgtgacatcatgtttttacttactgttgttttattccaaagatacaaaaatcatgtaaataattattacattttaaacagttatttattgtttgcaaaagctgtttattactcaattttttctgtgttcattcccctgtaaacaacaatgtgatttaaactaagggttgggatttagatcaaatgaaacattcatgagtaatagcagagaaaacagttaaatagttgccactattggaaggtcagactttccacaggtttgagtcattatttggcaatcaatctgaacattgttcagcttcaatttatgctaaaaatatgtaagtagtttttatgttaaatgtgtttcctttgagctcttttaggggaaatacatttatggaaatattaagaaaaatctatgattaaagagagtaacttgaatgaattttgttgagattctctgtataattccttggaagtgaaaattgtatagaaattttagctttaaaatcttctgagaagaagggcttgcggacttacattttgtggtgttatgcaggtctgcatgaacctgagcttaaattttatctccctgagagattagcagggacgccacacagcttacccaactgacttattaaacacagtattgtcccaagccattgcagttagttatgtaggcagatgttgctcgggatttgtttgcagtgagttagtgctcttccccttactttaatgtgtctttttgaactgtcacctagtgttgcattgtgaattttgtttttaattttggaatcttaaaatatatttttctacgtaattctttgttttcacactaactgacagctgttctatttctttatcagaagtttgtgtatagtactcttgttggtttattctggcacactataaagtttattcaaataagttgggtttgttcagatcaaacattcctttgctcttcagtgtccttagttagctttggggaaaattaatctgcggggtggtgctcgacac

SEQ ID NO: 33495 - DNA, 1022 bp, Homo sapiens
atctctcttaatcccctacatgaattcacccatttgtgttcccattctaggttgtctatatattggtgtctcaacatatctgtgcatttttttcaggttctttttttcattcttatgaagccctttcatccctacattcagcatgaagcattcatcaagtaatctcttgtgagtaaccccttctccttactcagtagtactttcttatacattcatggcaccttgccatatgctacctagtaccattttttaaattttgtgcctgatccatgtcaatatgtaggttcttgatattaataataaattctcatttaataagtttctagcagatgataagaactcaacaaatagtatatatctgctactattgctaaagataatatgtacattatttcatttaatccaaggagaattaaattatttcccatttataaatgagaaaacagaatgtcagaaagactaaacaacctgcccaagattacacaactgatggccccgggggttaatattcctgtacttccacatatgtaggaagagtgccttatgcttttttgaatactcactagctagcatagtaattcacgtatagtcaatactcaatacatgattgatgataaaaatgtaaacaggtatttatttcaatgaaaaagaaagtttcactttgttcaatatcccatttccccatctgaatatttaagaaaacaatataatgtcctagaaaaatgaatgaccagttgtacaagcatacccaggaatttctcatttggtaatttattccaaggaactaatactgagaaaaaatattgtaggggaaaaaaacgtttattttaccactatttaattttaaaatttggaaatatcccattcaatagagtagtttgtaagtataaatatgtcatttacataatgaaggaaataatgtgaaaaactggataattctgatgtctgtactacagagaaaaaatattttttaaaaatttagtaaaaaaataacaaaacctaaagccttccaagtctatcac

SEQ ID NO: 33496 - DNA, 1083 bp, Homo sapiens
ccgagcctggtttgctcacctttgaactgcaaagggatcaagttcagcttgagttccctgcattgggaaggagagagagcgtgcaagagagcgagtgggagagggggaaaggggaaaggagaggagggaggagagagaggagggaggagagagaaagggagggagggaggggagggatcgagagagagcggggagagagaggctgcaatctcctccctgaatcgcgcacagcgctgcagatcccactgctccgacatgcgggccgaatgcaggtgagaaaaggcacggactctgcggctgcgaacccaaacttgggcaccgcacggtgcgcactgctcagccttcgcccccgtgggcgaaaggctgctgcggtttcaggcggctgcttcgtgactaatgaccttgcgcagagttgttaagaaaaaagagaaacccgcgctctccggggtgagaagggactgactctgggcgtctctgaagatggctcgggcttctctttggcgcgccggggggaccctgacactgaccgctctgtgacgcgagtagtctcccctgcaccgtgcccgaagcgacgtgccgggggatttttcattctcgatctgttgactggctcccccgctgcatgagcagagtcggagttgagactggcttgttgctggccccagcgcctggtgcaggaagcgactcacgtttgtctgggtggccggagccggagcagagcctgggtttggagtgagtgcctggaacgtgaattggactcaactcgagtagcagcaaagaccagcgggctggcaggcgggggaggctgcaggctcattccccacctcttcccagccccactgcccgtctgccggagcggttctggccccttccgacagagcggggactagagccggggattctccgcccgctgaggggatgactctgggttgggggagcgccgaacccgcggcgcgcagtgtcccgtgaactgtgagtactgcgactgaacggcggcaggcgagcgggcgattagcacccattgcatgaattatgaaacaataactttcggaagaagcaggaggaaaaaaagaagcatctatc

SEQ ID NO: 33497 - DNA, 1050 bp, Homo sapiens
aaaaaactggaaaattgaacaaaaaagtcattaaataattttcaccgtgttccatttgttataactgaagttacacaagaaccacattttgaaggggaaaacaagattgtctttcatttgtcttttaaaaaaacaaccatatacactatatgatttattatgaaagaaattttgcaaaatataagcaaccttactttctgtaactatttttttcccaccacagaacaccacgagtaagcaggcagtttatgtttgagctgtgacaatttcaaatgtgaacactagattaggtcttcttagttctgggaaggtcacaccctaaaacttatttctattgggagctaacatttccttgataaaataagttacctaagtgttctaaacaggaaataagtgctatttgatctatttattttcaccagatggaaatattcctccacatttcttgtttttaatttgtgtttcttattttgaacgaattcataattttgccctagctacataaaaatgaccatatttgaaccagttctagatctgacaaatgactgttgttaaattaggattatagggaaactcagaagttgtacttcattgtcaacaaaacaaaataagactgtaaacataagcccttgcattctgggactctatccaaacgcattcagcaatttggctgtgcccaccttcagaaaagccataatttgattctaggatctgggtaccataatgcagtcagaggatcttagcattcaataggcactcgtgggggctgggggttagaagttggtcagttctgtttccttggcacctaaaatctattctcctcctggagctctttgctgctcacagaaaagaaaagtacacaattttatacataaatgtgatttttaaattttgttttgcaagaagactctcagattaatcattccagaaaatattttgtaactttaagattttaacaaatctgaaattttctttaatgattgcagacaccgggaatcataaataaataggaaattatcctcggttattaactgtgaatgcctttttatt

SEQ ID NO: 33498 - DNA, 1041 bp, Homo sapiens
accactggtgtataaagtgtttattacagaaaaaaattcttgaagtctgtcatttaaattccgcagaatcctctgtttattcaaatcagcagatgttcattgagtgcctgctaatgtgctaggcacaacagaagccggggtattgcagtgaacaagaaagagtgacccttggccctcatagagtttatgtgccagatatatttaaagtatgcaatacttttcatagagtaattagatatttattaagggcttactctgcatcagggactgttctacgtacaatatacagtttatgacaagaaatagaagatttctgctcttatgttctagggatatatagtatagaactcagaggccgtcattctcctgttgtttattaccaaatgtaatgaagacatacctaactgatagtatttcttaatctatagattggagtaattcatatgctttttacaagttataatacataccttatgactgtgtgtgcaatttagttggcttaaaaattgatttagatttaagtgtaaatttgttggactgaattctaacagctttgactccttctttattcttttgttttatagaatttaacttgaatggaatcttttatttgtctaagtctatttctgtctagtaagggagttgaaattgatcatgtcttgactttgtgggccatcagagaaccatgacattccagggtattgattttgtggtgttaaagggtgacagatctactgttaaagtgccgagagagaattgggtttcagattgtacaccataagcagtcttggcttttgctgagacatgactagctttttaaagtaatggaaggaattgtaagtcttaggtaatttttagtgcataattttgaaaagattaatttcagcaagcattatgtaatcatgcatagaggggaataagttccatctatgataaatattgtatatctaaatatatacaacttggagtgtgtgtgtgagtgtgtgtgtgtatattcagaaagtatactctatactaagggtattgagtaatgtttcaaga

SEQ ID NO: 33499 - DNA, 1054 bp, Homo sapiens
aaggtgaaatgcctttggaaaagataaccctgatccttcaatattctctatatgctattgtgtgaaactcagcaaaattcagcagatacaagttctccagtttctggtctgctataattcaaatataattcaaatcttatagctctgtgagctgtaattttttcaggcatagacaagtgaaaggaaactgtgaaagccaaaatcaaatctctgtcacaaaccgatgatgaaagtttccaaaaaggttgaagaataatttttgaaaatcactttatccacagtcataagggtatatacaagttcctccgactactagtagcataagaatcatgaaacctaagaattataaattgtcatattatcataaaaagataacactgattatgataaccatttcacaaatagttgttactttgcaaatatttaatgtgtctattatatttgatgaggattttatttcaaaagtttttcattaaatagcaaatgtgctgtgtttattaagtgataagatttcagtgtatgaacagaaacaaaaattcttgcttaattgaactggacaacatttaatatctgaaaagtcagtggctttcattggaaatagttaactaagagtattttggagaagataaaatgagcaaccattgagaatgttcagttttgcttgtttgaaactactttttgaaagaaatatattaattaataatcgtgactggaaaatgttgctctcagaaatggccctctggtcttggagtacatagtatcatgtgtgaaaatataagaaagttatattttgacttcatatcatagtttagcaactgaacatcagaaaaaaacaaagccaatttcagatttgcattagatgacaaatctcaataatttttacagattttatggaagggctggctactctatttttatggatgttaatatcaccataataacctatcttaagctgctttttttgaagttctaatgaagagttaaaattagggtgattcaaaatgaacgtcttagcctatatggttcgatgttaggggaaaaattaacatttcca

SEQ ID NO: 33500 - DNA, 1028 bp, Homo sapiens
tttttccgtctttgtattttttttctttagtgaagattcagattggttctctctatgcacatcctggaagtggaaagaactgtggatcttattttctgtggcagaacagtgatttacagggaaaatagttcaactgagaaccactaaatgcagaaagtctagcatccaagactataccctcagatcaggggccaacgtttcttagaaatcaactcatccacatgttgaaaaatctaactaatttatggactatagggagaaaagcatctccctactttcttcctaccttccttccttccatccttctttttttaaggtatttactttgaagtattacattagtaggcagagactgagtaaaatcaagtaacaatagagcactagtatgaaagggcatcctgaatttataatattgtttctccaattaataattattaaatatacagtatatatctatgttatatgtagtatatataataatcacaattgctatatataataattgctatgtattatgtagtatactctctctatatatatgtgtgtacataaccaattaataattactaagtattttggacctgaattatcattattcattagtagagataatatagccaaaaggaatgagaaggggacttgtagtcaagctgacttaagttcagtcctcaaatttcttgggcctaatttcttcatatgtaaaacagaagtaacgatagtttttatatagctattgtgtgtaagctgcaaaatatgctaaatacctggaatagtgtctggctcatggaaataataagtggcagcaagtatgatttcgtattatgcaagttgaataataattattggcatcctaggcccatccttatgggggtcacggtaatttttattttttgccatagaacctgtgatgagagaaatgtaacacttaccccaggtcacccaataagtcactctatgtcattaggacttaagggttttcagcttcactgtctgatttcagtccattaggccacaaagtcatcaaaaca

SEQ ID NO: 33501 - DNA, 1079 bp, Homo sapiens
gtgccttgtctccctgccttgctctgtcggatgtccttattctttccacttcttttctcatttggacttggcaggaatgccttagctcagtgccagtgtggtaaccttaaactcgcttacttaagtggctgatctcatcgcttcctttatgtggtttgtgggatttttcccctctttgccttattacgtcccttgaccaccttgcagcttcatctatctcatacttccgttattgtattatcctttaaaaataaaacaataaatatttaaaacataaagcatttttatgatagttgtgggggtagatatttttatagaaacaataatgagaaaaaaaatggatttctccaagctttataaagccccaactacgcagagggcaaattctcaagttacaggattctacttgtcctatttctgaggagcagaacaaaattttttttgcagatattttaagagatggcaaaacagggaagcaaaccaaagtcattacaaaagcctcccagtgtagacccagccatctgcatatagttcacagaactcttctgtttatttatgagtcgtggaatgtgtaaagccaacttctagctgtaaaaggacgtacagttgctctcatataatttctttggccctttttttttttctgcaaaaccaagagtttgctttctcatattcaaggaaacactgccatgcataaggacccagtttttgggaattccgattcttttgcaaaagcattttaaatgacaactaaaaaatacacttaaaacgtaagactatggaatttaaataaatgcaactgatcttgatatatatatctcgaagcactgcacctgcctaaaaatactttttcatagttctaatgtactctgtaaaagaaacagaattaaattgaagaaagaaaccttcatttttcagtataatttggttcttttcaagataataaccttagattaagacagtcacaaagaaagacaatgaaaaaaagtcacttattttaccttaagacttcacaatttgcttcctagtaatatatttttccggaggtttttataggggaaatgatttctcaaatttca

SEQ ID NO: 33502 - DNA, 1032 bp, Homo sapiens
aaagttattcaaataagattgcaaacagaggtgtacatatatgcaaccaactaaaaatatgaatttattgactttcaaaattcacatttttactgtcaaaaagaaatatagatttactttctgaaacctaattgtgaaattgtacactgaacccttcaaataattttggaagcttttttcttttttttttaatcttcaaatgactctactttgtcaggcatttcggttatgagagaacagtggtagtggtggtgactcaacgtggaggttgaaatagagatgtaattaaatacattctgaaattagaaaacaaggttaacgatgatatttgaatgaaatcttttcaaacccactgtcaaaacacaacttcttttccactcttgtttgaatctcatggcaaccttgctaccttttacagtgacttctcttctggggtgtgttttctgaatgcctttcatttaataggcatattttagaaacctaatttctctgtctgcgtcacatcagcaatgctgtagaaacctaaccattttagactgtctggatgctgttcttatcaagtcattaacattattattgagggtgacatagagaagttaactcccctcactcggagcatcttatttgttaaagaccacagccctttaacctttataaaggatgtggtttcagcaagttaacttttaatgtggagctgttttccattataatttcaatttatgtctgtctgcagaacttcctgcaaatcttacaagactttttgtgtaagtaaagctcgtctgggttgtgcataggtgtgttctgaggatcttagttcttggaatgttagaattggagcccagactcctcattttagggatgagagaattgaaactcaggttgtcctgccaaggagcatcaatacaacaaggtctattatgagtatcctgacagttcattaagtgtgttttcctctacctcatactgaccttttgcaccagttctatcttggttaaaactgtattttgagaccctgaaaacaggtaatttata

SEQ ID NO: 33503 - DNA, 1077 bp, Homo sapiens
tagtagttttatttatttatttatttatttatttatttttttttgagatgaaatctggctctgtctcccaggctggagtgcagtggcctgatctcggctcactgcaagctctgcctcttgggttcacgacattatcctgcctcagcctcccgagtagctgggactacaggcgtccgccacctcgccccactaattttttgtatttttagtagagacggggtttcaccgtgttagccaggatggtgtcaatctcctgatctcatgatccgcctgcctcggcctcccaaagtgctgggattacaggcgtgagccaccgcacccggcccagtagttttatttatttggggacttactgaattttatttttcatatcgttgcatatgaggagcacaaatggactttttttttttttttaacctccctgagggcagaaatagtagcagcagatgtacagtttcagagctttggacaacagaagtagaagtactagaagtactggcacgtaatagatggaaatgaaattgttctacatccatttccactcattcaggcaattcatgtacaaactaaaaagtcctttcccttttccacattttacaggtgaactacttaggttttgttggtttgttttttgtatgctgttcttaattttggtgaatagagaggtgctttctattccattgactaagattttcttttagagaaagtaagcaatattcagagttattgctgtaagttttgcttgagtgcttacgctttaattcatattttatgccatgctttttcacacaaagcacttatggcatgctctagaatccataagaaatgaatatatgttaattagcttgcattcagttattttacattcagcagctctttatttctgttggtttatattctaatacgatttgcaattctagtgtagtatatttagtacacggtctttaaggtatagtaatttacattttaatcatacattaatttataaagaataataaaatgtgataaatgttttcttctatgtaaatttatgtttacatcctgactcacaactgggagataaagcaatttggatca

SEQ ID NO: 33504 - DNA, 1032 bp, Homo sapiens
tgctccaatttttcttaatctgaacaccagtatttcatttgccattgctaaaatgtgtggactgttatgaaaatttaacatagtgttttttttatatgagtcattcagctggcttctaacatttattttaaaactttgatttttgtgtttttgtgtgcaggatttttttatttcttctaaaggattttccaattctaagtctgtcctacagttaagacaaaggttataaatggtgaaccactgttatctagaaggggccactctgtcatctacaaaaaatagtcgaatgaagtgagccagccctaaaattcagagtcaatttctggtccaggtacactaaacggtcttccagtgagcataagcctcttacaaagagtgaggtaatcaagactattataatgcccaacctatattaatgtaattatccactacaacacaaacaaattatctctaaaactcagttacacttcagagatcttattttgctcataaaatcactgacctcacccacatcgcccacaccctaagcttcatatcatctaacatgacatataaaaatttaggcacaatcacgcctagtccatctcaactgtaccccaccccactctaccacacggagtgtcagactcactggacagcataaactcacatacatttgcaaataaactattttaaaactttagccctcaccacctttcttgccattgtgtttggttctttctagtttaaacagttccattcttatgactgtttcttgaacacttcctagatgaggaataaatattcgatgttactaagagacgtgaagaaatgataaataccttttccaacctttcaaaaggtaacatgatgaggaaataagacatacagtcacaaattcccaaaaaatgtggaaataggattaaattcttaataagtttgcctttaaatggccaagtgtgtaatagagacaaaaatcacatttacaaaagatttctgatatagagatagattatgaaaagacctctagattgaacagattttagataggtg

SEQ ID NO: 33505 - DNA, 1061 bp, Homo sapiens
cacacacgaaaaaaacaaaataaagccaaagtccctcaaatctttattggtgaatttactatgtgaaatagtacttctgtaaaattgagcaagtgaaatttccgagtttaacttccttttcataaagtgtagttaagcgtatgtggcctccagattgcaggatttcttgaatttcaaatggtttatcttgtaaaagtgctggacgaaaacaaactgctcggcagatgttagttgttttatctgttgttgaggttatgaggaactgagtgttgcttgggctatttataatgggaaggttgggaagctggaagcgacactcctttgcatttatttgctgtgagcctttccccagtcacagagtttaacactgaaagtgatgtggaaggaaggaaatgggcatgagtggaggtgccacaggggcagtggtagctgtctgctggtgaacacataaggaatcttgcttcactattgtgtcatcaacccttcttcaaaaagggatcaacagatcagctggaaagggagaaaccaggttggaaataggtttcatgtgtgaaaaaaaagataaaattgggaagtaatgatttgccaatgtgttccctctgttctgttaggtttatcggcatgatacgatttcaaaaccatataacactttttctccctgtgcttgttaacattattttgttgagaatcggatgaaagattttaaccgttttgcaagtagaagtggaaacaggttgagtttatatgtttttgtaaaatacgtgaaacatagcaacatgaggcagtataggtccagtgtggtcactattagccatgtacagctatttacatatgaactaattaaagtcaatttaaattaaaaattcagttccgttttatagcccacttctatcaccggagaaagctcatttggatggtgctgatacagagtagtggttaacaggtcaagttagataaattcctgggttgcagcccaacttcatcacttactagcactgtgactttggacaagttcatctcgagcctgactacttcatctgcaaaatggagacgataataat

SEQ ID NO: 33506 - DNA, 1050 bp, Homo sapiens
caacatgctgatgtgggacccatagaatgaaaatcacagaaaaggctggggtatatatgaattgtctgaattgtttttaataaataataaagtacaatttcatcaactctcaactttaaggtaattacctatctaatcactaccatagttcaaaactgtaaacacatttatttatttaaaattaatgtttggggctatactaaaggaaattgacaaattacatatggaaaaactgtaatatattttctttttttaatacagcattcctataccataattattttttaaggtctacttttctaataatactgtcacttaaatcaacaaaaacaaatgattatttttagtgtagcattcttgccttttagttaaatattttaattatataagcatttgctaaaaaattacataccctatattttattcaggcatcaaatgaattaggaaaattttagtcagcaccaaatcttcttagaaacagtatagtttgaaaaacctcaataatttcttttgaaagttttgacaataagtggatttaaagctggcaaacatagtttcttgcaagaaaaaagctacatccatctctcgggtttgatttccttttggccatgtggaaaatacaaaagaaataaaaatcggtcagtacaccgaaacaaaccaacaaacaacaaaacaaaaagacaaacttcctttcaaggttatataaataatattcgttttatttttctaatttatttgtcatgttggtttattattgctgaatttatcctctgactactaaatatagaagatgtctcaattttcattacaaactgcccccttctagaaaagcaaaacagcaacactcacagaatacttgtctaaacttaaggtttgatgcttttagagagtcttgttatttactaggcattgggtacaaggtactcaatacattttgtaccaatgaggcataaaaatctacattttatttggtaaatgtatttgatatataacttcagataagatctctctatagaagaaaaaaattaacacttgcattaatcttgccag

SEQ ID NO: 33507 - DNA, 1030 bp, Homo sapiens
tagattgtttgttcactctgataatagtttctttactctgataatagtttcttttgctgtgtagaagttctttagttaatattttcaagaggttaaaggaggatgaggctgagcagttactgagtttacaaaggagatcactgtaagccttcaaggcaattgctttgtcatggtaaaggcataggctaaagtgtaagggacttaaaattaaatgggagctgagaaaatggagctggctggaagtagtttacctttctctaaggatatctaatgatgagagaaaggagagaagatggcagcttctggtgtaacttatgcctaaaagtggcaatctcttagggacaacttctgtttatttaaatacataaataggtcagtaagtaagtaaataatagtggtgcctaccattaagaaacaatgaggagagggttcattcagtataacagatgccacattttagggggctggaaagaaattagcaggttatgcagaaagccagacattctcaagattaacaaagtggactctgggatttttatacaaactgtgcagagaaaagtcaaaaggtatacacatgtctgtgggcacacattttaatactataactgtggctttttttcatttatatagtgtaaattttatatcccatatttctttaagcataaatatcctatgacaacaaggtattatggctttctcccttttcatttttttaagtgtaattatcagcaagaagaatgcattcaacagacacagaatattgatttcatttttcattgattgacatttctgtgttttcttatgctaggaggctaacaactttcaattttatgtattttatctagatttttaaaatataataatgatttaatatatgtgggataatacattactaccacatttgtgcactagagttattctaaagtactaagcagtgaaacagacaaaaatgtgagtgttgttagtaatataatttggtgttttaacaaacaataacaagaatctctaaattaattaattggttatttta

SEQ ID NO: 33508 - DNA, 1048 bp, Homo sapiens
ctttccatcaaaaagcttattcagatagtcagaagataacataactttaatacatgcaggtatataatacatcttctttctaatgccgacaaatttttctatgacatttatgtggttctcctatatttaattcttagggactgaatccacaaaatattttacaaaaagatttgcaagggttgagcatgctatcatacatgcttttttaatctggggcctgacagattgttaggatttaataaataatggtaattattattattattatcattctaaaacaatccaaatgggaaatgtattattttcctccatttcacatttgagaaaactcatcccccaagttaagtaacttgtaaaagagatagcagttattaagtagcaatgctgtcagtcaaagcaagggataattgattttaaataatggtcttgtcttctttataataagggaatgcatattcaaattaatgtattcagtatttaaattttctgcctcattctatagagtataatggtctctaagattgaatgaacaggtgttagatattgacatgagcatttctagatgttatctcttgtatgtattacagcatctcaatgagggtcagtttttataaatgtccccattttatagatggagaaactgagacaggcttagaaacttgctcaaaataagtagctggtagtaactggagaagacagtcaacccaattcgatctgaaaactatatgacttttaagcttgatagtggactggcacaaagttgtataaagtgttgaaaggcaagaagatttaaatgtttacagtatatcaaaaatgaaaaagcaggtaaaaagaccaaacattatattttgagccacataataagtatcagcactgttttcaaaacagaaagctagaatgctgtttttaaaaatttagattgccaacagaagaaaatcagatgaagttttacttattgttttctattatttcattgcaacagaattgtatgtttaatataaaaaatttggaaacaacacgcaggagaaaaaagtcacctttactccta

SEQ ID NO: 33509 - DNA, 1045 bp, Homo sapiens
ccttaaatagtcttttcttcttagtaacatcagcattttaatacagcattattataaattttagttccttaataactggtgtgttaactctggaatactccaaactgtttctttttcaaaaatcataaaacgtttaatgtttcaccttttcttttttttttttttttttttgccctcttttaagaactcctaaaatgtttgtggcccaacagcttcttggtggcagacattgctgatatgctgctatgaccataaattattttggctcaagagtgtgattaataatttactcttgcagtagtccttcagattttattttattaatgtaagaacacacttagaatcatctcctgattcatgcgtagctatatccgtattctgcgcagaatgttaggaaatggatagtgctgaatatttagggccctacctttcaatagaatcactgcacacatcagcatgtctatatgtctcctgtatgacagatctttaagaacataggaattcgaaagatatatttttttactcaatgcttctaaaaagatatataaaatgcatttgcctgttcaactgtctctatagtgtatctccaggcatataatttttcatcttatcaagtgacttttaccaatttgacagaatcaaacaattaaggtaaaccatagcttcagttttgaaaaataatgctctactttagaaggaatgtatatggcccttttattccaaaattcttgtgttgatattttggtagaagtttctagataattagttctagttttgctatacataatatctgtttgttttgccataataatgtttgcaaaacattattagttcttctaatatgactattataagatattcaaaaacaattctcaagcattgtattaaaaccactggtatcattgatgcaattgtaagacccttaacattcctgattaattacattatttcatttcactgaaaattattcccaaactttacgtttcttttaacatgtagaatataaactcatgaatagagaccatgcctctagatattattttaa

SEQ ID NO: 33510 - DNA, 1054 bp, Homo sapiens
gttctgttccattggtctatatatctgttttggtaccagtaccatgctgatttggttactgttatttacctagtagtcattaaggaccaggttgttcagtttccatgtagttgtgcagttttttgtgagtttcttaatcctgagtcctaatttgaaactggaccccttccttacagcttgtataaaaattagctcaaatgtattaaaggcttaaatgtaaaacacaaaaccgtaaaaaccctagaaagaaatctaggcaataccattcaagacataggcatgggcagagattttatgactaaatcaccaaagcaattgtaacaaaagcaaaaattgacaaatgagatctaattaagagcttctgcacagcaaaagaaactatcgtcaggacaaataaacaacctacagaatgggagaaaatttttgcaagctatccatctgacaaaggtctaatattcagaacctacaaggaactcatacaaatttacataaaaaatccctatcaaaaagtgggcaaagaacatgaacagacacttctcaaaagaaggcattcataaggccaacaaacctatgaagaaaagctcaacatcactgatcattagagaaatgcaaattaaaatcacaatgagatatcatctcacagcagtcagaatggcaattattaagaagtcgagaaacaatagatgctggcgaggctgtgtagaaataggaatgcttttacattgttggtgggaatctaaattaattgaaccactgtggaagacagtgcggcaattcctcaaggatctagaaccagaaataccattagacccagatatcccattactgggtatatacctaaaggaatataaatcattctattataaagatacatgcacctgtatgtttattgcagcactattcatgacagcaaagacatggaatcaatacaaatgcccatcaatgatagactggataaagacaatgtggtacatatacaccatgaacactatgtagctatagaaaggacaaaggtcatgtccttttcaggggcatggatgaagttggaaaccat

SEQ ID NO: 33511 - DNA, 1005 bp, Homo sapiens
gctgcagggtattctgttgagtaaagataccatatttaagagctaccttattgttatttatttttcaagttttcactattatgaaatcttcttgcatactactaattttatccttagggtcacaagtagaattgctgagtcagagattatgcatagtttccactgttaatacagattctcaaatttgctttcaacatctcctaccagtagtaaatgactagcagatttccctacatcctacactgacatcaagtatacattttaacaactcatttttatctgggtgcagtggctcatgcctataattccagcaccttgggaggccaaggtgggtggatcacgaggtcaggagttcaagaccagcctggccaagatggtgaaaccccatctctactaaaaacacaaaaatttgctgggtgtggtggcacgtgcctgtaatcccagctactcaggaggctgagacaggagaatcgcttgaacctgggaggcggaggtagcagtgagccaagatcatgccactatactccagcctgggtgacagagcaagactccatctcaaaaaaaaaaaagaaaaaactcatttctagttagataagcaaaaacatgtatgttttgtttagcatacctttgattgttaatcaagttgaacatattttcacatataaggctttccctttcatatactacttgttcaggtccacacggttctttttttaagttggtctcttgaataattccaacccatttcacattaaagccaatgttaagagtgaaatttttatttttcaagcagattttacttcatttatttttattttaagtttttaaaattatttttaatttttgtgggtacatggtatatatatttatggggtatgtgaaatattttgatacaggcttgcaatgcataataatcatatccaggtaaatgggatacacattgcctcaagcatttatcctttgtgttataaacaaacaagtgatattctttaattatttttaaat

SEQ ID NO: 33512 - DNA, 1030 bp, Homo sapiens
acctaagcgctgatgaatgatggatagagatactgtgatatactattcagccttaaaaaaagtaggaaatcggccgggcgcggtggctcacgcctgtaatcccagcactttgggaggccaaggctggtggatcacgaggtcaggagatcgagaccatcctggctaacacggtgaaaccccatctctactaaaaatataaaaaattagccgggcgtggtggcaggtgcctgtagtcccagctactcaggaggctgaggcaggagaatggcgtgaacccgggaggcggagcttgcagtgagccgagatcacgccactgcactccagcctgggcaacagagcgagactccgtctcaaaaaaaaagaacaacaaaaaaagaaggaaatcctgccatttgtgacaacatggatgaacctggaggacattatcctaagtgaaataagccagacacagaaagtcaaatactgcgtgatctcaaatgtggaatctaaaaaaagtcaaactcatagaagcagagcgtagaacggtggttaccagaagctgggccatgaagggattgggaagatgttgttcaaagggtacacactttcacttataagatgaacaagttctgggggtctaatgtagcacatggcaactatggttaacaatactgtattgtatacttgaaatttgctaacagagtagctctcaaatgttatcacacaaaatggtaactagatacagtgatcagtgtgtgttaactgacttgattgtggtaatcatttcacaatgtatttgtataaaactcatcacattatatatcttacatttatacaatttgtcagttatacctcaataaagctgcaaagaaatatcatttctaggttgtgcccatcacaacctgtaggagttaagatttcagcctgagtttcagtttcaattccaataccactactttctatgtaatactgaacaagttttctaacatctctaaactttaatttcttcctctataatgggaataaaatcaaattattttttcaaaatcat

SEQ ID NO: 33513 - DNA, 1026 bp, Homo sapiens
aacaccacattccaataaaaaatatctttagaccagattcttcacgaaagacatgaaggttttcatgcttcaaggtttttgacttttttttttttttttgaaaggagtcttgctgtgtcacccaggctggagtgcagtggcgtgatctcagctcactgcaacctccgcctcctgggttcaagtgattctcctgcctcagcctcccaagtagctgggactacaggcgtgctctaccacggccggctaaattttgtgtttttagtagaggcgaggtttcaccatcttggccaggctggtcttgaactcccgaccttgtgatccacccgccttggcctcccaaagtgctgggattacaggtgtgagccacggcgcccgaccagtttttgacatttctaagccaaaagttccatttgatgaggtcttagatgcaggggcaatgtgtcccttttcagatttcagatgtttagaaaaagatgtgtcatatttgggccaactgaaaaactcttgatatgtaggtttttatgaagctgtgcagaatgtaggaaatacattttagaaccaacaaagaggcatttaattttgagtgtgcctgtctcctttgagatgagcaacagctatttttctcttcaaaagacaatgcgtgtatttatcagcacattttatataatcagcaaatctaaacctctgaattaggtaagccctataggtttgttgccagaattagtgaatttatacatgcaaagtgcttagaacagtgcctggtacacagtgagcactcaatattatttattgctattattatgtttatttattttatacttttagagtataattttgatgttaggtttggattgctgaggccaagcaaaatttagatagaccaacccagctaatccactagaaagatatttgagggttattcccatctaaagatctatgggatctttggatatcatctgtgagaaacaacagaagtttgtagataagacagatatagattcaaatgccaccttcacaatttattag

SEQ ID NO: 33514 - DNA, 1045 bp, Homo sapiens
tgagatgtttttagactttttgaaattttaaaatatcagagaaaatagtaatttcctagtgttttttaaaattgtgctgtgtaggccaggcgcagtggttcacgcctgtaatcccagcactttgggaggctgaggtgagtggattacctgaggtcaggagttcgagaccaacatggtgaaacaccatatctactaaaaatacaaaaattagccgggtgtggtggtgcatgcctgtaatcccagctactcaggaggctgaggcacgagaatcacttgaaccctggagacagaggttgcagtgagctgagattgtgccattgtactccagcctgggcaacaagagtaaaattccatctcaaaaagataataaaaagtaaaataaattgtgctgtataaatcttgaggtgcatttctgaggatggtgcgtcttctggatacaactgaacatctcgttctctccctttggcagggcatcagacacgtggaccactttgggtttatctgtcgggagtcttccggaggtggcggctttcattttgtctgttacgtgtttcagtgcacaaatgaggctctggtgagagaggacaagcaattcttaccttggaaccttctttacaaggaattttagctccactgatttttctgtccttagggaaaaccagatggtcattgacatatcattatttgtctttagttatttacttatgactatttagtaagcagctaatacacatctgaagcttaattggctgtgcattttatattttttatttctgaagaacttgtttagtgtcaccttctggtctagcattttacaatgtcattttagacatctgatcaaaggagtttgccttttttctcagtagtttgtatttttagtttttactgtatcagtctgttctcacactgctaataaagacatacctgacactgggtaatttataaaggaaagaggtttaatggactcatagttccacatggccagcgaggcctcacaatcatggcggaaggtgaaggaggagcaaaggcacatcttacatggcag

SEQ ID NO: 33515 - DNA, 1046 bp, Homo sapiens
ttataaggtatatacaactgtgcagccagtgccaagattaagaaatggagcatttctggccaggcgcggtggctcatgcctgtaattccagcactttgggaggccaaggcgggcggatcacccgaggtcaggagttcaagactagcctggccaacatggcgaaaccctgtctctatggcaaatacaaaaattagccaggcatggtggtgcgcacctgtagtctcagctactcgggaggctaaggcatgagaatcgcttgaacttgggaagcagaggttgcagtgagccaggattgtgccactgcactccagcctgggggatagagcgagatgctgtctcccccaaaaaaagaaagaaatggggcatttccattgcctcatagtcctgttttgtgtctgcctccaggtaaccatcatcctgacttctgacatcatagtttaattttgaacaagcaagtaatttttgatggcacagtgatgttacccaattcgattccccattattttcctaagacttatctctctgactaatgaatgttcataaagttaaatcacctttaagaaataatgatttggcccagagcagtggctcacgcctgtaatcccagcactttgggaggcagaggtgggtggatcacgaggtcaggagatcaagaccatcctggctaacacggtgaaaccctgtctctactaaaaatacaaaaaaattagctgggtgtgatggcgggtgcctgtagtcccaactatttgggaggctgaggcaggagaatggcgtgaacctgggaggtggagcttgcagtgagcccagattgtgccactgcactccagctccagcctgggtgaaagagcaagactccatctcaaaaaaaaaaaaaaaaagaaagaaagaattaatgatttgctactatcgaggatggtgaagttgcatgggagattttagggaggtgacacctcactaattgtatttcagaattacattaaggaaagatttgtttcttgattgtgtataacaccatcgacgtttatttctctgctttagtgacttct

SEQ ID NO: 33516 - DNA, 1131 bp, Homo sapiens
aggtaaatgatagttccccttctcaaaggaatttctaaggtagtagccattcttttgatgcatattctcattctcatagagagtccaattatggataattggacaaagctgaatgtcgcttttatgagaatccattctttctcttttatgctttgaaaaatgtgtagcattcattagtgaattaggatttcattattcaaagaagacataaggtcttcgaacagcagatgactgaataaaataatacctaacagcagtagaatgaggggaggacatattcaaggaacattttatgcccattagattggcagaaatttttaaaaagtgacaataccgtataaaggtgaactttcctatactgatactgggaacatgaatttgtaccattcagggaagagaaacttgataatatctggtgtagtctgaaggggcacagtccctgtgacccagtgaggacattcctcattatttcccttgccaaacatttcacatgagtctataaggagctctatataagagaggtcactgcagcctcctttgtaagagcaagaaaaaaaagcaaataagtgtttaacaataggaacatagataaattaggttatgcagtgaatatttgcactctgactaaagtgagtgaatcaaaaaaaatttgtcaacaggaataaatctcaaaaataatattgaaagaagaaagctaatttacagaaggatgtgtacagtatgacaccattcatttagtttcaactacatatcttttatggacacatacatataaaagcagaaaacatgaattgataggataaacaccaaatatttctgcatatggccaggtgtggggaagtagtggtgattaagcttcaaagatgtctgcagtggttcccattaaaagtagaaagtaggctgggcacagtggctcacgcctgtaatcccagcactttgggaggccaaggcaggtggatcatttaaggccaggagttcgagaacagcctggtcaacatggcgaaaccccatctctacaaaaaaaatacaaaaattagccagatgtggtggcgcacacttgtagtcccagctactcgggaggctgaggcatgagaatcacttgagcccaggaggtagaggttgcagtaagcc

SEQ ID NO: 33517 - DNA, 1050 bp, Homo sapiens
tctttgttaaaagttttgattatggaaataataaacttggccgggtgtagtggcttacacctgtaatcccagcactttgggaggctgaggcaggcagatcacttgaggtcaggagttcgagaccagcctagccaacatggtgaaaccccgtctctactaaaagtataaaactaagccaggagtggtggtgcatgcctgtaatcccagctactctggaggctgaggcagaagaatcccttgaacccaggaggcagaggttgcagtgagccgagatcgttccactgcactccagcctgggtgacagagtgggactccatctcaaaataaaaatacatataaataataaactttaaaaatagaacacagatgtgtagaaagctgtcccacccaccgccactcccaagaagctcctgttaacagtttcgggtgtgtggttccagacgttttctttgcatgtcctttatcttcttgttttatatcctgtgactatcactaaaagcatcatcatttaaaagctattatcagaagctaccaaattggaaacaaagtgcttgtagacatgtgaaatagtgagtttgattctattctttgtgatatttgaattttgcacggactttttttttaatgtccagggatgcattatttagttaggaatttcaaaaataggtattctaatcctatcattccttctttgtttattaacttaaatacttctgtaatgagaacatcccttcatcaacatttggattactttgaggtacatttctgggcaaataaacatacccttgtaattattttttagtaaaagcaaatcaggttctgttagtgccagtgtgtttttttttttttttttttttgagaccagagtttcgcttttgttgcccaagctgagtgcagtggtgctatttgggctcactgcaacctccgcctgctgggttcaagcgattatactgcctcagcctcccgaatagctgggattgcaggtgtgcgccaccacacctggctaatttgttgtatgtttagtagaaacggggtttcaccacgtcggca

SEQ ID NO: 33518 - DNA, 1033 bp, Homo sapiens
tgaattattccttgaaatcatggccgggcgtggtggctcacgcctgtaatcccagcactttgggagaccgaggcgggaggatcacctgaggtcgggagtttgagaccagcctgaccaacatgaagaaaccccgtctctactaaaaataccaaattagccgggcgtggtggcacatgcctgtaatcccagctactcgggaggctgaggcaggagagtcgcttgaacccgggagatgtaggttacagtgagccgagatagcagagatcgcaccattgcactccagcctgggcaacaagagcgaaagtccgtctcaaaaaaaaaaaaaaaatcactcattgcttgacaggcatttcataggcaaacttttctcaacgccaccaggtatgagtgagctaaatactgtcctagcagctgtggatcctttaaatgggatctgcgcttccttaagacccgtgcccggtgtccccctaagatatgatcagcatagaacttaggccacaggtgaatcctctcatgacagaagtaagtttacaaaaattcctcagcccttttgtgtgtaaaaatatattaagaataggatgatttgcttaaaaaccaatgacaacagccatatggagctgtaactatatgagatgactgagggaagccagcgagagaaagacttggcagtgaggacggaatctcgtttacttggaagagtctggctgggtaggaattacgttcattgtccttttcagcaccttagcgctaagccagcccctcatgggagccaggccactggctgcttttaggccgccagggactagtgaggagtctggggtttctgcaggtacaacaccagtgccatgaaggtgagacatggtgacagaggaaggtgtctgacttcagagcagggagtggtttcaacttgaggattctggttgagtgaatattgaataacaaggcaatgctcccactctgtcttgctcttttcttccacgggcttggaaaatattcacaagggggaaaacttggcccgaggtgtgtatctgaa

SEQ ID NO: 33519 - DNA, 1041 bp, Homo sapiens
accttcccaggtgttttcaaaggaattattttattcctccacaacaagcctgtgggagtcggagcaaaaggcaaagtgattacctgagacattagataactcgccaatattcaccctgctaacaactgaggggccttgggcttgatctcctgcttccgaatcagggcttttcctgccatcttgtcatatccaacccattgcatctgctcatgcactcaagtgaaaggaaaaaatgactaggcaaaatggacacatcttagaggtggaattaactctttttttatgttgagggatgtttctggcaaggtaactagcaacgtggcctgcacttatagttgttcctgcatgggtgatgaaagagatgctataaaactaaataaaaccaactgcctccaagggagggatccgttgactggacaagtgttattccaaagtctgggttattatgagttgcaacgtaaaacattacataagaagatttgaaggcaatattctgtgctctgaatgctgctcaaaagaaaatacttttattttaagtaatattcttttgatgatctcaagctcagtggcttttaatgattaatgagtaatatgcttattttaatgctgacctaagaatacattctgcttctcaaaaaaacgcaacagattagccacagctgggacatgtactctttaagtaatgttctcacagatgtgattaagtaacgtcttggagtatgcccagtagcagcccacgtaggaaaccagctagccaggaaagaatcacttgaaactaggcacccagtaccactgcagtgaggcagccccaataatatttgccttaagaaacgcttcctttccagaggcagacttaaaagtacagctttgaaatccatttgctcgattgtggtgtggcaactttaggattatttataaaggcactcaaaggtacatcaaattctatttgttacagatttacaaaaagatttctttgttctaaatatacaaaactatatttagaacaaaaagcataaggatcagatttccctattgagttgt

SEQ ID NO: 33520 - DNA, 1031 bp, Homo sapiens
ctatcaatggtgatttcaatcgcaatattttaaattgatgagaatgatttgtaaacatgaagttactattacgtaaattctgtttgttatagagtttcttcagttgttacccaagtgtcatcctagagaagtcagaagaatcagaatccatcgtattttagagttatgtgaatctacatcataaatgggcattaacattctaaattgcttggtttggagaatgtgttagcagcatagctatattcaactagggagatgctaaatacacagaagtttcaagagccttggaacagaattacaggggaactatatatgtatatgtatattttattaaacacccatctgcactatcagtattgcactaatgtggaatttgaaagactattttgctgatactgtatatatgcgcatcattcctgattagattgttgtaaagacaatctgaaagatctaaggttttaaaataatttggtttgaaaatatacagttgtcttgaaggaattgctgtcatacatgaagttgctccgagctgtctttattctcttcttggtcaaggttaacaattgctaaatgatcgcaaattcacctaaacaatacatttacaaagccatctttacatgcattaaacgagggctacaacaatattgttttacaaatactagcacttttttttctgttatgtacttagtgttagagggtcaaaataatctttctgcttagcatctcttaaaccatacctgcaaatatagcaggattattacatttacagtactttaatacttgtataaactatgcagaaatttttaataaagtgtaatatattttataagctaataagactgaatgggtaaaggtttttagcatgcattagtatacttgcagatactgaaacattttggtaatctttcttactaaagatgtgaatgtttaatgtaccttctctgtttctactctgtagtccaatgggaattcagtaatgacattttgtcatgtcaaactgtgaacataaatttgtactgtacagtcctcat

SEQ ID NO: 33521 - DNA, 1023 bp, Homo sapiens
attcctcacatttgttgaaagatcaaaaaaaactacaggttcaagaaggtcagcaaactcccaaaagattaaacccaaagaaatctctacccagatatatcataatcaaactgctgaaaactagacaaataaaaaaatgaggggtcaggcataacctgcatgaagcacggtattgaatttttgcatccacaactagatagatactaaatactagaattgtaagtggttttatttgtattaaaacatttaatattttatttttgccaaaaaataaataaaacttcttagcttctccctctgcccaatcctgttcccctcattttcatgcaagacttatttattgcagatgtttccccccctttaaaccacctgcatgcaaatctctgtctcagaatgtatttccagggaacctgacctagacatgtgccaactggcacagaggtagaaagaaacggccccctgcctcctctttcagatgttggtatagtgagacaagcaaatggttagcttgctgatagatactattattaaatgtacaaacgtgtcaataaatttataatttattttaaatatctttgatttcaaattgtagatatttaaatacataatggtattttcccttgtattcttgccccaggtcccacaaatatttagagtaagtctgcccttccttcttgatttctattatattttctagtttctggtatagaggaacattattggttttataatatcatcttgtatctggcaaacaggctgagctgtctaattaattctattactttgcctgatgatgctattggtttgctgttattgtttttaacacctgtaataactacagtaataactatttaattttcccccaaccccctccatcttcatttcttttatgcttttctcatttctcatggtattggctaaattatgcaacaccatattaagcattagtagctaccatctggcatccttgtcttacagtgatcttcatggaagtgtgtctaaaatggctccaataagcatgat

SEQ ID NO: 33522 - DNA, 1056 bp, Homo sapiens
actgacagcatttcaaggaccttggaaaggggagaaattcctaataatagagcaccacggaattacctggatggaagtgcaaacactggccacagagtcgggcccgtggctctggatgtattgtgttgggtcagaagctcagagggaacaaaggagtggggacagtacctgtgagtttgttttaagaagggcaggaaagccgataggttggctgaaagggcctggaagagaggatatcactttcacccaggtcttatttaaaccattctacgtaggtgcaaatttagtctctttttaaagattaccaggaaaggggattctactgtctctcttagtagcttatccttttattagaagtcaattttatgcctagtctttgattattgttcatttttttctattttatttgcctcttgttgcatactcataagaaatcattttgcactgatgaaaacaactctttccctgttgctccagagcagagtgaattgtacaaaacaaattcttgaatctaaagttcattacaaggtggttgtttggattgaacacaggctgcccctgaggaatggcaggttctgcaggaaaatagccaagtgcaaaagcctatttgaccccatgtacatctacacctgataaattctcatcagccctttaaaaaagtttctgaccagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggcgcctgtagtcccagctactcgggaggctgaggcaggagaatggcgtgaacccgggaagcggagcttgcagtgagccgagattgcaccactgcagtccgcagtccggcctgggcgacagagcgagactccgtctcaaaaaaaaaaaaaaaaaaaaaaagtttctgaccaggtgcagtggctcacacctgtaatcccagcactttgggaggccgaggggaccggatcacctga

SEQ ID NO: 33523 - DNA, 1076 bp, Homo sapiens
acataagataattgggtgtctcagcacatgccaactgtaatggatcaggcaagaatttagcagtggttttccatcatttttttaatgatattacagttttcttccttgtgcacagcaaatatgtgcttaacactgacaaaaatctaaggagtggatagcaagggaaccttgtgttttaccagtcatcaagctgaaggaatgttttcaaaagtaacgattttgttatatcatagtagtatcagctgtaataacttttacaggtgagcttaaaataaaggctatataatattaatttagctgagttttaaaatgtcccttgctttactaccaggtatcagtactgataggtagttgtggaataaaacgattcttttgatgttactgtgggccagtactttgtaagaaacagcagcagcaattgggagggagctaagtagggagaaatctgtgaggcacttgtacttggtgaataaatgtcattttggcatttaactgcagttacgatgaacttaatttaagtttcttcttatttaagaaatcatgtgttccttaagtattctgttccccctccccgctgccttttgtgccttacttgcttttagtttggtcagatattatcggcaaagaatttgtctgttctgctactctctactagacatctaaccttgtccaagtcaactatactctcaatctacttcctcatttgcacaactactctacctgcctcacaaggtatttttgagtagtgaatgagaatacttcttgctttgaaagcaagaagcactgtggtgtattcgaaagtatatggtttttagggtccatcctggaccctgccactcaccagatataggtattaagtcaggttaattaatctcacttcagtatcttcatctataaggagtggtgggctgggggcaggaatgacccctgttggacagagtttttctgacaacaaaatgccccagtcagtgtaaagtattttatatattattgtgctcatttgggcacttaagagatagtagctgctgctataaatcctgaccgttactcaatacttagatgtgccacttacttaa

SEQ ID NO: 33524 - DNA, 1084 bp, Homo sapiens
aacaaaattagaaaaaataaaacattcatttaccaacataagtaaattcacatataaaactcttaacatgttatctactactggagaaattataatgtgaatataaaatttttatacatgtgtaatcttggaaaaattatacacacattggttgctataattccttacaacaaaggtagtttgcatggctaatgattactgaaataaaattaagctattctttagtatgcatacagaaatatcttggtgggctattcattatgaaataaaaagattatccttttttgactgagagattgctatgtgcattcttcaagaattttaaattgacgtttttcatttataggagatataaaaataaaatggcatttttaaaaatctaaaataaatgaagttgtttaaaaaatgctactcaagaagactcatcaaagtaagacgggtgtggacagtttacatcttcagtgaccaaactattccaaaaataaaatttcaaaaataaaatgtactgtgagaaaatgtttttgatttttagatatgaggggaaatatgtcaaaggaatttaatattttggatggtttgaaatttcaatcttcttattgcaaataagaaaaaaacattcaagattttagaaaagtcctttgtgtgtatattctttttctctatttttttctagattaaatagatctaatttttacatcttccttcaacaccctggctgagtctttgacctttgtcataaagatacatttatttgccctcagctttttgattaagtgagcagtcagacttctctaagtagttgttcacctactgtaaacaaatcaaagcctgtcactgttaatgtcacactgacattcatcaattttttttttttttttttgagacagagtctcgctctgttacccaggctggagtgcagtggcgtgatctcggcttactgcaacctctgcctcccgttcaagccattctcctgcctcagcctcccaagtatctgggactacagacatgtgccaccactcccggctaatttttgtatttttagtagagatgctgtttcaccatgttggccaggctggtcttgaac

SEQ ID NO: 33525 - DNA, 1025 bp, Homo sapiens
tggtgatgaattaaaatttccatactaaaacctttaaaatggttatcataattaagtttttgaatggccctttaaaatgttaatataaaaattaaatgaattacatagtgtcaaatttttgcatttaaaatttgagagttggccaggtgcagtggcttatgcctgtaaatcccagcacttcgggaagccaaggcaggacggatgatcgcttgagcccaggagttcgatgctgcagtgagccattggttacaccactgcactccagcctgggcaatagaacaagaccgtgtctcaaaaaaaaaaaaaaattgagagttatacaggtatatagtagacataagttactaacgtatcattttaaaattctgaaaataagccattagtttttattttagtagatgtctcaaggagctaataattttttccccatttagtccttcttttctttttgggatgtcttaaaccatgtaggtctgtaatgcatgtaatgagctcttatatggaaccactactgttaacatcaattattttataaaataaggttaatgtagttccatggctaatggaatttctttttatcattaaggccgccttgaattaaaagaagataatattgagtgcctgttatctacagcttgccttcttcagctttcacaggttgtagaagcatgctgtaagtttttaatgaaacagcttcatccatccaactgtcttggaattcgttcttttgctgatgcccaaggttgtacagatttgcataaagtggctcacaattatactatggtatgtattttttgaaggtgagaaagtcgatcctccatatgcatatttcttattgttgcaggcttatctgcatgttactgttttcccatggctctgccacgtgtcttgcgattgagcttcattgcctagtgtgtcatattttcattgagttataatgggaaagcaccaagtaatacttctcgtgggtatctgaatcaagccctaagttactgcagtcactgggaagcagaacagtggcctag

SEQ ID NO: 33526 - DNA, 1028 bp, Homo sapiens
actgggtcaaaggaatcttaagaattctttgtaccactctcacaagttattattaatattaaaaataggccaggattatgcctgtaatccctgcactttgggaggccaaggcgggtggatcacttgaggtcgggaggttgagaccagcctggccaacatggcgaaaccccatctctactaaaaaataccaaaaaaaattagccaggcatggtggcaggtgcctgtaatcccagctactcaggtggctgaggcaggagaaccacttgaacccgggaggtggaggttgcagtgagctgaaatcataccactgtaccccagcctgggcaacagagcaagagtctgtctcaaaaaaataataatagctaaaaataatagcaataaacactatgcacagtgcctacagggtgtcagtattatgctagaagctttctgtgtgttatccctcaatatgcattgatctcccctttctttgaactcctagtactagcaggcttcaatctcctgacaatctctctgacttctggctacctctctgatgtcagctcattctattaatacttcttccctcactgatgcttttatttcaaccccattggccttttcattcatctaacaggccaaacattttatccatatccaggatattgctttagctgatgctctcactggcatgctctgcccccggatattgaagtacctagcagaaattattcactcaaatctctcaaatgtcagcttaccaaggagcccttccatgaccattcaatagcaacccccgactaccactttctaacctgaataacatataacatagcgctatttatttgtagatgcttaagttttagatataggcctgatgactgcatggtacagaaataaataacttaagataactgattagggttacagtataaatatttcaacattggaaaagattttccattgttcagataatctgcaaatacttattaagtatcatctgtgtacctggaactggtgctagcttttgtagtcattactagcactct

SEQ ID NO: 33527 - DNA, 1050 bp, Homo sapiens
gccacctcacccagctaatttttgtatttttagtagagacgggttcaccataatggccaggctggtctcgaactcctgatcttgtgatctgtccacctcggcctcccaaagtgctggggttacaggcgtgagtcaccatgcccagcctaaaattaattttttaactaagcattttattatatgcttctattattacaactaatttttccacatactttaaattattttttctcttccaagtaacatcatgattttacgacctttcacaaactcaacttgtatcaaataagtatgtaatttttaatcctcaaattctcctaatttagccagaggaaacctctttaaacttactcttttgtccttttatcactgccctcaacattcttggaagcagtgctgctttctgaaaaccataccatggtctgtcagcggtgctgaaagtttagctgcatcagaatcccctggagggcttatgaaaacacaggtagctgggtgccactttcagagttgctcggtcagtatgtctgggctgggatctgagaactggcatttctcacaagttcccagatgatgctgctggttctgatttcaaattttgagaaccactgttcttgactcattgtgatttcttttctcaatatatggaaagaggtactctccaagaagttctgcttccccttagtagggaattgtataacacttcaacctcatgaatcgtagaatgcatgtcagaactggtggtgggcaaaagtgttttctacctgcttttgagctactcttaatggtgacggagctggaaaagatatatcatttttaaagtcatgaattcccaatgatttttaccatttaatatgttattgggtgccacttttttaaagtatgaggtttcaccatccattaatatttttgtaatcacatttagagctaaaactatcattaatagacaaattaataaatatctcatcataggtcatctcatgaattttgaggttccatcataactgaagtctacattcattatacttttgtattttgagtctaactgaccct

SEQ ID NO: 33528 - DNA, 1034 bp, Homo sapiens
gatctgaggcaaaatgagcagaaggattcacgcaaaggcgagcaggtgcaggcacggacctccaagagtcccttcccagtggagcacacaggacgcaagttccgtaactcctccacgactgacttgtacaacatggtgaaacgtagagtgccaagaagctcattagagactcagcagccaggagttttattggggtgtggtcacataggtgccccctgcgtggcatgtgcccagttttccaggctcccagagagcaggtgttcggcataaaccacgttgtttgtacaaagattttaggcacggtgagccactcatcagttctggaaacggtgggaaccgtctccaaatctatgttccagatgcgagccgagggttagctgttcaagcctttccaaggatgacagtctcaggcctgcacacacaagtacttttctgaacaaactgggacaaaagaaataacatttgcccaagatcacattgtcagctaataatagcctgactctgtgttcacaagcacggtaggacgttgcctctgaaaaggcctcactattccaaaagacatgtcatgataacattcttaagtgattaaatactgtcacattacatgacagggatcagcaaactttttctgtaaaggaccagatgttaaatattttagacttcgtgagacatgtggcctctgtcacaactgctcaactctgccatcttctcatgaataatacgtaaacgaatgggcatgactgtgtttcaatagagctttatgtttggacacaaatgttaaccacatacacttttaacatgtcacaaaaatatttttcttttgatgttttttcaaccatttaaaaatgtaaaaatcatccttagctcatggaccatacaaaaagtcagagggctagatttggtccatgggtcataattggccaacccacattctctaagtgtatttttgttgttgttacatcaaagtctaccatgcgggcaaggtatgggataggacaggcactctcatgactgctggtggggatggaaattgg

SEQ ID NO: 33529 - DNA, 1087 bp, Homo sapiens
tgttgcccatgctggtctcagactcttaacaatcctctcacctcagcttccagagtagctgggattacaggagcaagccactgcaccctgctttgtttttaaatttaaattttgcgtcctttcctgatcccatcccctttcccctgaacactattcttattgctgagtttattatttccctttttagttttatcacatatatttatgttccttgactatcatttagttttgaatgtttcaaatttcttataaacagaaccaaactgtatgcattctttgcaacttgctttattctctcaacattatgtccttaagggtcatctgtctatttcatttaaattgtaacatttctattctagttgatgggtgacacatgtacaagaggttgcagattttgttctgttaagactgcaagaaatcctcctccactggatgccagtgagccctacaatactgcaaaggcaattgcagaatggggtctggattatgttgtcctgacatctgtggatcgagatggttagtgtgtcatcatggcctctaccagaaactggctctaaatgatgacatcatcctgagcagtggattcttttgtttctagatatgcctgatgggggagctgaacacattgcaaagaccgtatcatatttaaaggaaaggtacttatttttgcatttgtgtaatttaaggacctttttggacccatatgagttaagtttaagttcattaccttgaaacagggattattcactttttgaggagtttcatagttttctgataattcactggaaattatgtacacatttctttggaaaaagcatatttgtatgtacagatacatatttgcagagaattttaggggctcagtgacatgaacttacccatagacctttagcccatagaatccctccctcatattagagcattagtctaaactttgaataattttctttaaaaagtataaacctggtcttcttagtaatgatttttttttttttttgagatggagtctcgctcttttgcccaggctagagtgcatggcaccatctcactgcaacctctgcctcccagttcaagcatttatcctgcc

SEQ ID NO: 33530 - DNA, 1027 bp, Homo sapiens
tttcattgtccatataattatcagcatttttgtcaaagccatttaacaagcctctagggagttctaaactttcctgcattttcctgtcttcttctgagccctccagactgttccaacatctggctgttaacccagttccaaagttgcttccatatttttggatatctttttagcagtgcctcactctactggtaccaatttactgtgttagttctttttcatgctgctgataaagacatacccaagactaggaaatttacaaaagaaagaggtttattggacttacagttccacatggctggggaagcctcataatcatggtggaaggtgaaagtcatgtctcacatggcagcagacaagagaagagagaacttgtgcagggaaactctcatttttaaaaccatcagatctcatgagacttattcactatcacaagaacagcacgggaaagacctgcccccatgattcaattatcatctgccgggtccctctcacaacatgtaggaattatgggacctacaagatgagatttgggtggggacacagagccagtcatagtaaggtattgtttgggtaaaacataagcctttctttcctttcttttttttttttttacagggtctcactttgtcacccaggctggaatgcattggcatgaacacgtctcactgcagcctcaacctcccaggctgaagtgaccctccaactctgctttcacagtagctgtgatatggtttggctgtgtccccacccacatctcatcttaaaacccagtgggaggtaattgaatcatgggggcaagtctttcctgtgctgttcttgtgatagtgaataagtctcatgagatctgatggtttttaaaagagttctggctgggcatggtggtgggcacctgtaatccaaactactagggaggctgaggcagagtgaattgcttgaacctgggagaaggaggttgcagtgagccgagattgcaccgctgcactccagcctgggcaaaattgaagactctgtctccaaaaaaaaa

SEQ ID NO: 33531 - DNA, 1033 bp, Homo sapiens
aggggaaaggtggtaactggatcccaagagcagtgctgctcgaaggcccacacttttgagggtattcggggttattgcctgtcaggccttcactgttcttttcttggggaaggagcagtgagtccttaggtattgattaaaaaggaaggacattcagagttagtccttcttagttgggtgttaggagtcaaagggagacataatagaatactgtcttatttggtggcaggggtaagggaattttcacctgagttagcaagttaattccaaataagataattatctcttttccacttaacccccaaattcctaggcctcatctttattgacatctcaatcttttgagtgggcaaaggcaaggtgtttggtgtattaaagacatgtaaatatttttagttaggaaacaaataatggaatgtatgagtagcttatttcaaaatattgtttacaagttacagatcagagagactgtcttaagacagtgcctctgtgactcgtgttgtgccacgaaacttcattatgatgtccctcatagttaacttgattcttacttttgaaaagcagacctattaaaaatgtgaaatttcaccagattaatacattgtttcatctccttattgagatttatcacgacttaacagattttcaaaaaagttgcctcccgttgctcttaagtcctgcagaatttagatacatttgtactacgtttatttatgtaagatattcacagtgctctagtaatttgactcaaaattatgcaagtattagtacagtttctcataccaagatcaacaagaatgccagattgtcttccccacatgaattaaacaaaaagtaatacagaaaatgattattttcaagattcacataccattattgaatatatcattgctatttgtgtttttcttttacagttagtactttaatagtgtcaataataatttgtgaaattcagcattctaagtatgtgatgagtatacatggagaaaaaattatttaaaattcaaaaatgacaacagacttattgaaagta

SEQ ID NO: 33532 - DNA, 2207 bp, Homo sapiens
gccaggcgtggtggctcacgcctgtaatcccagcactttgggaggcctaggcaggtggatcacgaggtcaggagatcgagaccatcctggccaacatgatgaaaccccgtctctactaaaaatacaaaaattagccgggcatggtggtgagtgcctgtagtcccagctacttgggaggctgaggcaggagaattgcttgaaccggggaggtggaggttgcagtgagcgagatggcaccactgcactgcagcctggcgacagagcgagactccatctcaaaaaaaaaaaaaaaaaaagaatactttgagacttaactgtatcagatgtgtaagataatttatctaaagaataaatggacacagacagtaaagacaaaaaatatatactggctttgaatgttttatttttaaaacttttaagtttgtttcccgtttttagtgtttttcttttaaaatttctcgcttttgattttaataaaaaggtaaaattttctaccaaaaatgaatgtaacgagaatttgaacagttgtttctaagactagaggcaggcgtggtggctcacatcggtaattgcagcacttggggaggctgaggcaggagaatcgtttgagtctgggaggtcgaggctgcagtgagcggtgattgtgccactgcactccagcctgggtgacagagcaacacactgtctccaaatagtaaaaaagtggtttttaaagtttttatttttattttattttttcaaaagtgtgtttgaaagttatgtaagttacagttttatgtaatatttaaatagtatttcttatggtttctggaatgggttgagcaaggaaagcctatagattgggttaaaaaaaatcaaagtctgtgcaggtaatatgtttggggtgaattccttgtatacagtgttacaaagactttgagctctgtccattgggcgtaggtttagacacatctgggctccctagcttcttccctttttatttatttatttttgaaacagagtctcactgtcaccaaagctagaatgcagtggcgtgatcacagttcactgcagccttgaactccccaggcttagatgatcctcctacctcagccttccaagtagcagggactaaaggcgtctgccaccatgcccagctaatttatgtaattttttgtagagacggggtttcaccatgttgcccaggctggtctcgaactcctggactgaagtgatcctccggccttggccacctgaagtgctgggattacagacgtgagccaccatgcttggcctgtcaccccttcttaaagactatacacctttttttttttttttttttttagacggagtctccctctgtcgcccaggctggagtgcaatgcgccatctcggctcaccgcaacctccgcctcccgggttcaagcaattctcctgtctcagcctcctgagtagctgggattacaggcatgtgccagcatgcatggctaatgtttttttttgtttttttttgtttttgtttttgtatttttagtagagacgggtttttaccgtattggccaggctggtctcgagctcctgaccttgtgatctgccgcctcggcctcccaaagtgctgggattgcaggcatgagccactgcacctgggtttttttttttttttttttgggagacagagtcttgctctgttgtccaggctggagtatggtggcacgatctcaactcaccacagcctctgcctcccgggttcaagcgactctcgtgcctcagcctcctgagtagctggtattacaggcgcaccccaccacgcccagctaatattttgtattgttagtagagacagggttttaccatgttggccaggctggtctcgaacccctgacctcaagtgatccaactgccttggcctcccaaagtgctgggattacaggcgtgagccaccgtgcccagccaagactatatactcttatttcccgtgaatacattattgacagttattgaaaatattgactatagccccaaaaggcttaactggttagagatacagggcagacaaaggatagataaaaatggtgggggcaaagagtaaatgctatgggattctaaagggtatctgcatgagagagattcctttttgttgttgttttgttttgtttttgtgacagagtctcggctctatcacccagcctggagtgcagtggctccatctcagctcactgcaacctccg

SEQ ID NO: 33533 - DNA, 1637 bp, Homo sapiens
cattgtattggccaggctggtcttaaactcgcggcctcagatgatctgcctgcctgggcctcccaaagtgcttggcttaaatggtgagccaccatgcctggcatgcctggactttttttttttttttttcccagatggaatctcactgtgtcaccctggctggagtccagtagcatgatccaagctcactgcagccaccacctcccaggtcaagcggttctcctgcctcagcctaccaagtagctgggattacaggcgcgccccaccgcccagccaattttttatattgttagtagagacagggttttatgatgttggccaggctggtctcccaaagtgataagattacaagtgtgagccacaatgcccagccaagactatatactcttatttcccagtgaatacattattaacagttaccgaacatgttgaccacagccccaaaaggcttaattggttggagatacaggacaaaggatagataaaaatgggaggggcaaagtgtaaatgctatgggattctgagggtatttgaatgagggaggttcttttttgtttttgttttgttttgagtcagagtctctgtcacccagcctggagtgcagtggctttatctcggctcactgcagcctccgcctcctggcttcaagtgattctcaggcctcagcctccagaatggctggaattacaggcatgcgccaccacacccggctaattttttttgtatttttagtagagactggatttcaccatgttgaccaggctggtctcacactcctgacctcaggtgatctggctgtcttggcctcccaaagtgctgggcttacatgtgtgagccaccccacctggagtttttttgttttgttttgtttgagatggaatctcactctctcacccaggctggagtgcggtgacatgatcttggctcactgcagcttctgcttcccaggtcaggcagttctcctgcttgacccagtagctgggattacaggcgcatgccaccatacccagctaattttcctatttttagtagagatggggtttctagccaggctggtctcgaacttcagacctcaggtgatccgcctgccttggcttctcaaagtgctgggattacaggcatgagccgtcgtgcctggcctgtatgactgtatgagggaggttcttgagctaggtgccttttttttttttttgagatggggtctcactctgtcgcccaggggcacaatcatagctcattgcagccttgacctcctgggttctagcaggccttccacctcagcctcccgagtagctgggactacaggtgtgtgccaccacacctggctaatttttattttttgtagagatggggtctcattgtgttgcccaggttggtcttgaactcctggcttcaagcagtcctcctgcctcagcctcccaaagtgctgggattataggcatgagccacctcacccagccttcttgagctgagttctagaggaaagttaagactgacctcaaatttcaggagacagtcccaaaggaattctggtaatattgcaattttttttttctgagacagttttgctcttgttgcccaggctggagtgcagtggcacaatctcagctcattgcaacctctgcctcccgggttca

SEQ ID NO: 33534 - DNA, 1027 bp, Homo sapiens
acattcagtaaacggatagctgttagatgtcagaattagctatgttttcatattctgtcgtgcttattattcttggattataaaggtattgttcaatggtttagtgattattggatgtaaatatgcctcaagaaaagctcaagatgagggttaaggtacttctaatagtgtttctttgtcacctgtgtgccaataatccatggggctagtggccaagtagtccacccttatctgcagtttgattttctgcagtttcagttacccattgtcaaccatcgtccaaaaataagtgagtatagtacaataaggtattttgagagagcacattcacgtaactttcattacaatatattgttataattactccattgttaatctcttgtgtttaatttatagattaaactttatgatatgtatgtacgtatagggtcggtactatctgtggtttcaagcatccactagggatcttggaacgtgtcccctgtggataagaggggatatattaatacaaaggaatatatgtgggctctgttctccagatgtgatttatttaatctttctttaggagacagttataaatcgttcaaagtttgtgttaaaatgttgccttcctgaatgaaaaagttcatttgggaaactctcaaatgatatagagataatgggattattttgaatttcttgacatggctctgggtttcctgaaactagaccaaagaatctagattctaatcctgtggtgtataatcttggatccctttgcaaatccctttttcagtgggctttgggagccagaaaataggcagtctcattcatctgacatccattttattctcttacataaatctgaaaaggtgggagaactttatttcattgaacatgcttttttaaaatttttttatttttttaaggctagtcaaacgaagcagtggaaatggaaaaggaaaaaagtctgtaactggttatgatcaattaattgtaaacaccactgcaaaaccctttttttctttctcttccctttagttctttg

SEQ ID NO: 33535 - DNA, 1033 bp, Homo sapiens
tttcctgaatgagtttaaggatattcctaagctctagagagctcatccccaaccattgtgaaagtttcatcctgattctgggactaggaagagttgaatatattgataaaggtggcctccaggtaaagttggatttctgttgcatgtaagtgttaataatgtagtcaggtcttgaattaggatgatggaatgtccaagcccaaaactgggaaacaagatagtgggaaggtaattttttttttttttctgtagttttcccttttgaagatctcactggcatctatttagtatatatgacatcatctgtggttcaattctttagtgtaactttacattttttatttattcacatatttactgaatgctacctatgttaataaaatggacatgatccttgctgttatggaataaattatggctcagtaaggcagtgagaaattgaacagctaataagtgtgtttgttgactttaagtaaggggacctatggaagttgggtattctagcctcagggaaagagtttcttgggaataaccggtaactgatacttacaggataaattagaatgaccatgatcaactctgtatacgtatagatagttaataatcattttacaatgaataatggaaaaacattttattgtttttttctatgtatatatgtttttatttattagagactaggtctcagtttgttgcccaggctggagtgcagtggtatgatcatagctcactgtaaccctgaactccagggctcaagtgattctcctgcctcagccttccgagtagctagtactacaggtagacaccactgtgcccagttaattatttttaaattatttgtagagactgagttttgccatgttacccaggctggtcttgaactcctggcctcaagtgattttcctgccttggctttctaaaatgctgagattacaggcctgagcccctgcctggccaacttctgtttttctttttttcttttcctgatggactgtcctacgactgtttttatttttttaaccaaaactgcgtc

SEQ ID NO: 33536 - DNA, 1033 bp, Homo sapiens
gaaaaaaatagttgggtgtggtggcatgtggctgtggtcccagctgcttgggcagccgaggtcggaggattgcttgagcccagtaggtacagtgccatgatcatggctcactgcagcctctgcagtccggcctaggtgacagagtaagaccctgtctccaaaaaaaaccccaaacttctatttttcagttgacttaaaaaaaagtcttatctacgtaacgttcacagattgtatataattgtattcttgggtcttttacaatttatgattgttaaccccttcacatacctttctttttttctcatctcattaatactgaaaatcctgatgtctgtgattcctagtttaggtgtaaaggtttgattagcttcaggttaaacattttggtaagaagatcccaagtgatgttgtatacttcatattgaatcatattagtacatgtgtaatatcagattttcttactgttattgatgcttggtcacttgtttaatcatttgattaaggtgggaactacaagatttctttgtaaaggtacattttatgctctttgcaattagcaagtaaaggatggattacttctttggcatcctggaaataatcttattcccaaaatccttttaccaggtgcactcacacacacccccactctcactcatgctggtacagtttaaccatgccagttaatctagcatgtttatctttggaatttgggaagaaacctgagtacccggagaaaacccacaaagacgtggggagaacatggcaagctccacataagacagcagcccgtgtgggatttttttttcctcataaatgttataaggaaatgatgttatccaaggacctgctgtattctctttttctctcttttttttttttttgagatggagtctccctctgtcacctaagctggagtgcagtggcatgatctcggctcactgcaaccttcgcctcccaggttcaagtgattctcctgcctcagccccccaagtatctgggattacaggcgcgcaccaccacacccggctaattt

SEQ ID NO: 33537 - DNA, 1050 bp, Homo sapiens
ggtctatcatccaggctgcatgtagtggtgcaatctcggctcactgcaacctccacctcccaagttcaagccattcttctgcctcagtctcccgagtagctgggactacaggtgcctgtcagcacacctggctaatttttgtatttttagtagagatggggtttcaccatgttggccaagctagtctcaaactcctgacctcaaatgatccacccgccttggcctcccaaagtgttgggattacagtcgtgagccactgcacccagccaaattaaaggttttatagttaatgttgttagggaaaggggaactatgctgcttacttctatccaagaaacttaattctgaaagtattctcattttacagtaataaaattgagagttaggtgttaagtgttatacctgaatgaataccacaagtaagcgacagaactaggattcagcacacatatgtcttactccaaaggccatgacttttgtaatactgtcatctttcaccattctccatgtcttgcttatagttcctgactcttaaagtaagactttaagttcgcttgtgggagcagggggattggagttttagattgtgaaataactggatgtttgaattaaactgtggtggtataaagaataattgttgcttgatggaaaattgagctgtgaaaaatttttggcttaactttgttttctttttatctttagttctgtgcaaataaagaccctattctaagccctctagaattttttttttttttttttgagacagagtctcactgtgttacccaaactggagtgcaatggcgaaatctcggctcactccaacctccacaccctggattcaaacgattctcgtgcctcaacctcccaagtagcggggactacaggcacacaccaccatgcccggctaatttttccggatttcaccatgttggcctcaaactcttgactcagtgatctgccttggcctcccaaactgttgggattacaggcacgagccaccgcatgcacctgaccagaatgctttttcataatgtaattcatcatgatgat

SEQ ID NO: 33538 - DNA, 1030 bp, Homo sapiens
cactttaggcattcaactttattccctgttttgtctattatttaatcacccttccatcttttccatttctactcattctctgcactgttggtctagaaatcttcctagagttcagttttgatcatgctgcttttctttccctgaataaagtctaaactccatggcttggcacttgaaacctagaacctgaccccagtcttgtttcccactctaatcttctaccacttccacccacaatgtgggtctcattttccatcttagattgtttatttgtaggtgatgcttattcttccacagctttctatcagtttcacttaaatctttgtccctattatttaaaattctagttttctatgaggcccgagtatcactttcttcattaagctgagttcatcaaatgtttctccctctcctctctcagtagcattttatacaatttatatagtggcaacacaaatatagttccaactcatgtattattttggatatgtatctttctctagcttttatgctcctgagtcatataggtcttttacacctatatattatcagtaattcccaatagtatagtgtcccttgggcatatgatagcagtcactcagaatgttctagaatttgttcattcaacctattggttgttccagtttaagaatagatatgataatggaagttccagggtgattttggctcacttagcattatgggctgcctattagtctattgtttatgtacatctattttctgataagtctggtcgatttttttattgtgataaaatatgcatgacataaaatttaccattgtaatcatttttatgtgtgcagttcagtggcagtgtatttaccttgttgtttaacctttaccattatctgtctgtagaactttctcaccttcccaaactgaaacttcgtacccattaagcaataactccccattattccccgctcccagcttctggtaaccactgtttctgtttctccgagtttgattaattcagaaacctcatgtaagtggaatcataaaatgtcat

SEQ ID NO: 33539 - DNA, 1038 bp, Homo sapiens
cagcctggccaacatggtgaaaccctgtcactactaaaaaatagaaaaattagtcgggtgtggtggcgcacacacgtagtcccagctactggggagactgaggcgggagagtcacttcggcccgggagacagaggttgcagtgaaccgagatcgcaccaccgcactccagcccaggcaaccaagtgagactctgtctcaataaaagtaaaaaaataagattaaaacaaaaggcaaaatacacttcacatatcttcagctcacttgactgaaccgtaatccttctgacatcttcaatagtgttttaaaattatattttctaatcttgttgaaaatactaaaccacatggggttttttgtatgtgtttgttttgttttgtttttgagacggagtctcgctctgtcccccaggctggagtgcagtggcacgatctcagctcactgcaagctccatctccctttacgccattctcctgcctcagccatccgagtagttgggactgcagtagctgggactacaggcgcccgccatcacgcctggctaatttttttttttttctttttttttctttttttttttttttttttgagacggcgtctggctctgtcgcccaggctggagtgcagtggcacaatctcggctcactgcaagctccgcttcccaggttcacgccattctcctgcctcagcctcccgagtagctgggactacaggcgcccgccaccgcgcccggctaattttttgtatttttagtagagacggggtttcaccgtgttagccaggatggtctcaatctcctgaccttgtgatccacctgcctcgccctcccaaagtgctgggattacaggcatgagccactgcgcccagccaccattttaaagttataaaatgctgtgaattccttgagttctgacattatggcatatgcttgtttatgaattgaactcaatagtaaatagaggttgattattcaaaattcaaaaatccgagatttgaaatgctccaaaatctgaaactttttgagtgtttacatgtcactc

SEQ ID NO: 33540 - DNA, 1030 bp, Homo sapiens
aaagcaatgtttgatgtgggctcagtggctcacgcctataatcctagtactttgggagcctatgtcgggtggatctcttaagcccaggagttcaagaccagcctgggtaatatggtgaaacccccaacactattagaaataaaagaattggctgggtgtggtggtgtgtgcctatagtcacagctacttttaagatggatcacctgagtctgggaagttgaggttgcagtgagccacagcagtgagaccttctctgggggggaaaaaagggagaaatgtttgttgtacataagccctatattactgtcttacttagcttgcattgtatttgatatttagccttataataacatttttgccgtaatattaagtgcacattcattccatgtgagtcgcttacatctggagatgctttattaagtaggatggatacagtgtcttttagggaagaccggacaaacaaggcagaaatcacagaagtgtaattaatatactatgacaaaggaaactgcaggtgtgtggaatagatcaggaagaagtgatatggaaagtgaaacttgaagagtaggaattagttgggagaagagggcacagaggtatgttattgagaaaacaaatatgtatgaaggcccagaacaggggaaaagtttaatatgactttttgagcaggagagtggagtgtgggatagaggtaaaaattgagatttcaggagtagtctaaggccaggttaagagtgtgggcttggccgggcatgatggctccatgcctctaatcccagcacttagggaggccgaggcgggtggatcacctgaggtcaggagtttgagaccagcctggccaacatggcgaaaccccatcttgccatgttggcgctccaagatcgcgccactgcactccagactccagcctgagcgacagcgcgagactccttctcaaaaaaaaagagagagagagtgggcccacatgaagggaatgagaggtcattaatggtccttaaagcagcatagtgatgcaaatcagatttgtttt

SEQ ID NO: 33541 - DNA, 1032 bp, Homo sapiens
cacctcagccttccaaagtattgggattacagacatgagccaccatgcccaccctaattaacagtatttgtcaaattttaatgtgcatcagaatcacctggaggacctgttaaaacaaccctggagtttctttttgtttttttttttttttcgttttgttttttgttttttattttgtggaaaacaaaagtagaaaaactaaaaccccaaactccagaaaaaatcctaaaaaatgttttttcttaaaaaatactgtatgtctctactcctctccctccctcccaacagcccttcttgtgttcttttctaagtgccttacccccccacccccatgactatccattgttcttgctattgtgcccccacttcccaatatctatccaggatgtgcaccccatgttctcttacctggcgtcttacttttttctccctcaaatttcagcaagcctcatacttgcagtctcatttcgccagcatgcaagaactgtctcccccttccttttctgggactcaataatcttttccccttaccactccctcaccccaggcctattataagcaggagcatgtcctcctgccaaattccctccctgttcccacccacccccccacccttcttatctcgagaaatgtcagaaccttcccctgggcaggcttagccaggaataaaacatttttgtcttccctcgttctataggacccttttccctccctccacatacacatgcgcctctaagagaaggaaatctttctctgggaccccgtattcccctggcctactccaagaaccctgtcccccgctccagcttcttgcactctcaagagcaacaacagtcttctctccaaggaatcatcttccctctctcaggatgtgtgcatctgctcagcctcccactcttacctttctgccccagaccccccacccaccaattctcctgggccaaagagccctttccccacctagcccagggaccccagcctccgggcctccacgcctgcgcggctagcggatgaggacattaatctcggcca

SEQ ID NO: 33542 - DNA, 1054 bp, Homo sapiens
attctgttatttgtctcagagtacttccaattagggttttccatgttttatatatgtgctatttgttcatatttgttgttataagcatggcttgtgttccagctttgctttcctattgagctctaagccttacacgttgaggttggactcaagggtttcttttagctcctaaaatagttcaataatttgacttatttccttgtgatgaataagtggtagaaactagatttatcgttttaatatgtaatagatttaaatatataaattacttttaaaagaaatattaaagtgaattgaatagttagtaatttatactttgctttactaagtaatggtggttccaaagtatttgataaatttacctctttccaatgcatatgggaagtcttttaataaaattactctattgtgagtttataatcatctcaagttatgtaataagttaggactttgcatgtggggtttccataaatcactgtacactaatgcagctgtaagaaaacagaagaatctagttgtattctagcctgggctgtgggtaatacaaaagctggttacatcgtaaaaaattattctaatgtccacatatttttataagctagtaatctgtgttcagttgtataatgtttgctgctttccagtgtttggaacatctcttaatacctcacttaacctaattttagtcttgctagttatatttgttgaatttggagattaaagtagattaatgttacttgtctttattattgtcaacacaaattgtgagtcgaagcttcaggttaagtggtcttttctcgagtgacataggttgtctataatgcaaagtgaatcacattttaaatgtagatttgttttatttggaaaagtaggattgtaggcgattaagagctgaaatatatcaaatattataactgtaatgtcatgtcaatcaatttttccccccatatagtacaaacaaaatcccgaaatgttcaaacagacagctcgactttgggcacatgtgtatgctggagcaccagtttctagtccagaatacaccaaaaaaatagaaaac

SEQ ID NO: 33543 - DNA, 1448 bp, Homo sapiens
caatacaaaataacaaaaatgtaatggaatcagactgaattaaagtaaggctgtatattgaaagtcatattataaaaggtttgctttctttaagtgttatttatcttaaattataatcgttaaatgtttggaagataatttttgaatcataacgtcagcataacttcatttgacttctcaataatcttgatactagaagcaataaaagaaccattattaaatatattgtaatgttaaagatgtgaaggttcttccaaaaatttgtaaggctttcctaattaacagtaaactcttatagctgatattattacatactaaacacaagttgctgttttttccccatatgtttgcttacgcatgtctttatacaatcacctctttttattgctgtagtttattttctaaagatgccaaaggaaacaagatttttctttatttattttaaatacctgaaacctcgtactttatattttgaagtaaggtgggattgtgtgaaaatgtggatggtttttctccagtgttggttagaactactttttttaagtggagggcaacttggtagtattagtagaatttgggtttaaaaatatcagacacatctacccagtttattttttgcctgtattatcagggtatatttaattgtcctgtggttaaacaaaggtgagagagctcagaggtttctaaaggtcaagcattttacatatatacatacatacatgctcttggaggcagctatatcctgctttgatttttatgcacatgagccctatagggttatatactcatctaactacacttcagcatccccagtgcccaagaaattggaaagtacaatatttggtttgagacattcttcataaaagattctttattataaaaatttacctcatttacatttaatgtgatgatcttttttttcctttctggtatatttcccactgtactgtttggtttttgttattctcttgtctgtgggtagatttagttacccaaacatagaaactaaagcaattgcttttttcctctggtcttaaatatgtttggacaaaaagacactaaaaggtcaggcctaggggaaaagtaccctggtggaaattatttttgtaattcttaatatttttgagttggctccgtttgtcagttttaaaagcctcaaaaattatgttaaaaaaaaaatccagtgaaatcccatttagggcaggccgatttgttagaagtcactgatgctccagtaggcttttgttataatcaggcctgtttcctgagtatgtgcctcttttaaaagaagaaataattagctgtatagtatttcagtactgatgaatgaatgaatgaatgaatggcagttagtggacccaaataagtattcagtggtatataaatatttgaggaactaggtactgaattaggtgctctgagttggcaccccgaaatgtttggaatca

SEQ ID NO: 33544 - DNA, 1051 bp, Homo sapiens
tttgcactgctgcaatatagatcaaagatcttgtggcataggggtaggggagtgttagtatctcccttgtcccatttgttctgttactgcttcattggactgatacaccctcatgaacttgcaatcacctaaatggaagtcttgaatgtgtcaccttttgcttggttatttcaaccatgctgctatatataatcaggtgtggcacagtttgtcagtttgattataggtgtgagtggatagaaatcattacactgtgctgttaacgatccttgtctgcttgctgttacctactttttacaggcatcataataaaagctagactatttctttggggggaaagagacttatttaatgtaatttaaaaaacttttccaatagaaaatgaaatattattgaaaataatatctattttttagctttcagcaattgatggtgctttgttgtggtgtctgctggaagtctactgccattatagggaaccttgcttgttagcttctctagatctctattctaaacaatctgttagtgatgataaattctgtaggagggtctattctgagccgttaacttcctgtaaggggaaaatgggtgggttaccagaaataccattgaagcagggtgggctgtggggtggaaggttggggtatttgtcttgagaattaaaaactacgaaacacttttgtacacaactgattttttaaaaaataaacacatttttaaagatgttgaatttttccccccttattgggaattcttaaaaataaatgcatgcatgttttcccctgaaaatggtttatatcttatttctgggtgctcatctgtggacaagcaattaagtcttactctaaataagaaccaggcagatatttctccttcacaaatttcatagtgattgacatataaatgcagtaagttgtatcagatctttgaatttaaaaacattgaaatttagttctaattaaatttactaaaagaacatatttgcttaggttctaatccaaaatttagagtaattaagagttagttaagtaatactttgtattctgtttcc

SEQ ID NO: 33545 - DNA, 1056 bp, Homo sapiens
tttaaactcacttacagcgtggttgaatttttcttttttcttctcgacatgtaaggacagataacctatacataacctttgaaatatggagtgtgccctgctttataaaaacttggcatttttgaattacatgtttcatgttaagagttgatatttgaattaaaaaaggattttggccaggcacagttgcccattcctgtattcccagcactgtgggaggctgaggggagaggattgcttgaagccaggagttggagaccagtgtgggcagcaaagcgagaccctgtctctacaaaacaaaataaaagaagcaacaacaaaaaataagccaggtggaatggtgcatgcatgtggtcccagctttgggaagctgatgcaggagtattgcttgagcccaggagttcaaagctgtagtgttgtaccactgcactccagcctgggtggcagagtgagaccctgtctcttaaaaaaacaaaaaacaaacacaacccccaaaaactctttctttgctttgtagaggtattcttttagtggattaaatatggttttatcttttcaaacatcttagaagcaaactagtttgcttgaagcatggtacattttaaaaactttcattaggaaaatagagatatagaaaagtagtatgatacattgaaaccacaggtacccacctgcttgattcaacaattgttaccattttgccatatttgttttatctacatatataaatttcctgaaccatttaaaagtaaactaagaggggcaaataagtttttttcagttttcccttttaagtatcatatgattgtattataaatgtatgtattttggactttgacatttaaagatttagattgatatttgctcttttaaaagattatataagaagacgtatatcttcagatctcgccaaggaaaaggaggacattctccctatatagccataaaaccattatcatttctagcaaaattaccagtaattccctagtattatactactttttgatttttttttgagacagggtcttgctctgttgcccagactagagtacagca

SEQ ID NO: 33546 - DNA, 1012 bp, Homo sapiens
gggaaagacattgatgatactggtttttggtagcttctctttctgaggaagttgtttgctgatcgtgtttgggaacatgctatgtttgggtcctgtaacttccctatatattacatatagagagattttttttgtttgtttcttttttgatggtcttaaggagctaaatatttggttcttagtatcagttttcttaggcctattatttctagttggtcgatattgaatattatgtagaatatatatgtgtgtgtgtgtgtgtgtatttttgtttttgtttttgagagagtcttgctctgttgcccatgctggagtgcagtggcgtaatctcagctcactgcaacctctgcctcctgggttcaagcaattctcctgagtagttgggactacaggtgtgtaccaccatgcctggctgttttttgtatttttagtggagacagggttttaccatgttgcccaggttgatcttgaactcccaacctcaagtgatctgcctgcctcggcctcccaaagtgctgggattacaggcgtgaaccactgtgtctggccagaatatcttttttttttttttttgagactgagtctcgctctgtcacccaggctagagtgcagtggcgcgatcttggctcactgcaacctctgcctcccggattcaagcgattctcctgcctcagccatctgagtagctggaattacaggcaccggccaccacactcgactaatttttgtatttttagtagaggtggggtttcactatgttgaccaggctagtcttgaacttctgacctcaagtgatccgtccacttcagcctcccaaagtgctaggattataggcgtgagccaccgcactcagccagaatatcttttttgattgttatagagatctgttattttctggatattgttccaccgaggtaaattattcaaacttaattgtccttgtcatatactacatataaaagatttatttataaaatgatatggagtgcagcacatttcctaaaattggaat

SEQ ID NO: 33547 - DNA, 1028 bp, Homo sapiens
caattgtgaagggtactgtttctttaatttcagtgtccatgtgttttttgctagtatgtataaatacagtttcttttatatgtttatcttgtatcttgcacccttgttaaactcactttcttgttggagattttatagattatttgggattttctgtaatacatagataaccatgttatctgcaaatagggacacttttatttcttcttccctaatctatatgcgttttattttctttttttctcttatttcatgagctagaacttccagcattattttgaataaaattggtgagagtagatatcttgcctttttcctgatgttaggaggaaagcgtttagtatttcattacaaatacaatgtcagctgtaggtttttgtaggtgcttttatcaggttgagaatatttttgttcctgtttttctggtagttaccatgaatggtgttgaattttgtcattattttctgcattgattgatacaattctttcacgcattaaaatggtggattatactgatttttgaatatggaactagccttgccttcctggaataaaccccatttcattatagtatacaatcctttttttttttttttttttttttgagacagggtcttactgttacccaggctggagcatagtggtgtgatcatggctcactgaagcctcgaccacctgggcctaagtgatcctttcacctcaccctgcccaccagtacctgggaccacaggtacgtaccactatgcttggctaattttaaatttttttgtagagttgaggtctcactgtgttgcccaggctggtcctgaactcctgggctcaagcgatcctcccaactcagcctcctaaagttctgggattataagtgtgaactactatgccccgccaaaattcaacaatatataaaaacagttatatccactgcactccagcctgggtgatagagcaagaccttgtgtcaaaaaaaaaaaaaaaaaaaaaaaaaattatatatatatatatatatatatatatatatatatatagct

SEQ ID NO: 33548 - DNA, 1025 bp, Homo sapiens
ttgagaccaccctggctaacatggcgttaccccatctctactaaaaatacaaaaattaaccgggcatggtggtgcacacctatagtcccagctacttgagaggctgaggcaggagaattgcttgaacctgggaggcggaggtttcagtgagtcaggatcccactactgcactccagcctgggtgacagagcaagactctgtctcaaaaaaaaaaaaagtgttagcatggttcagcatgcccttataacagcaacaataatatatgttaataggcggaattcattttaaaactgctttgttaagacaaaattcatgtgccatacaaatcatccatttaaattgtataattcagtagtttttagaacttaatattcagggctgtgcattcgttaatacactctatttaatttggctttgctgcaacttttagaacacgctaaattttagaacatttttatcatctcagaaagattctgtacctattagcagtcactcttcatttctttccagtctgtgttttgtccctatagataatttgcctattccagacatttcctacaacatgtggacttttgtgattggcttctttcacttagtataatgttttcaagcttcatccatgttgtagcatgtgtttcattcctttatatggatgagtaagattccactgggtggatatatcacattttattaatctattcatcagttaatagacatttgagttgttttcactttttggctattaagaacagtgctgctataaacaaacacacatgtctatgtctaacctttttaggaactgccatgctgttttccaaagcaatcatacctttttatgtttcctctaataatttatgagggtttcaacttttctacatcctcaccaacacttgttattgtccgtttttttgattattcctattctggtaggtgtgaagtggtatctcactgtggtttcaatttgcttttctctgatggctaatgatgtggaacatctttttgtgtgttttttggccatttgtata

SEQ ID NO: 33549 - DNA, 1030 bp, Homo sapiens
gcctcttacttttaccaatagtgcaccaactgtttctggagtagtagaaccacaaacgttagctgaatgtcaagagcaaatgcctaagagagaccctggaaaagaagtaggcatgtgcacccagactgaaccacaggattttgctcttttatggaaaatagaaaagaataaaattagcatttcagattctatcaaagtattaacaggaagattagatggatttaagccgaaagttttcaatattaacacaaaatcagacgttcaagaagcaattccatatagagtaatgtatgataaaagcacgtttgttgaagaaagtgagcttaccagtgcagatgaatctgaaaatcttaacattctttgtaaactgtttggatccttttcattagaagccctgaaagacttatatgagaggtgcaataaagatattatttgggccacaagccttttgttggattctgaaactaagttatgtgaggatacagagtttgagaatttccaaaaatcgtgtgatggatcacaaattgggcctttttctctggggttgaatttgaaagaaattattagccaaagaggaactttagagaattctaattctcctgtgccagagtttagccatgggattggtattagtaacgctgactcacagtctacttgtgatgcagaaagaggaaactcagagcaggcggaaatgagagctgtcactcctgaaaaccatgaatcgatgacaagtatatttcccagtgctgctgtgggtctaaagaataataatgacatacttcctaacagccaggaagaacttttatatagcagtaagcagtcctttccaggtattctaaaagctactactcctaaagatatgagtgaaacagaaaaaaacctagtagtcacagagactggagacaacatacattctccttcacatttctctgatatttttaactttgtatctagtacttcaaatcttgaattaaatgaagaaatttattttactgattctcttgaaataaagagaaatgaaaattttcca

SEQ ID NO: 33550 - DNA, 1047 bp, Homo sapiens
tcctttggtgctactccagatacatttaagacaagattaattttttagaacatatttattgaaaagtcttgactaatagaaatgaataaagtaaacatatttagactcatggaaaggaataacttagatttactgtgaagctttgtataactgcagtagtcaagaagtgtgaagacagtaacatagcatataacataaatagaaatactctaagatttagtaaatagaagcataagttaggaattaatagtacaagttagttttgtgatgcataaggtggtttagtatgttttctgcaaatatataatgagtaatgattacattttcttccctcccccttcccccacaagggtctctaacagttgaagattgtgtggttcatatagatctgaatctggcgaaagtgattcatgagaaatggaaagaatctgtaatggttggtaggcttctttttataaagagctccttttttgtccattttgaacctttgaatttcagtgaaatctaccacataatattaaggagttctattgaattttggctttgagatggaagagttctattgaattttgactttgagagagaatgaacttgtaccatttaacagattactgtctttttttttctctcttttcagtagtttaagtatttccagacagccaaattatataattagcgatggagctcattgtaattgttgattttttttatatcttttttctattttagagacagtgtctagctctgttgccctggttgagtgcagtggcacaatcatagctcactgcagccttgaactactgggcacatgatcctcctgccttagcctccagagtaggtaggactatacaggtgcctgccaccacacctaggtaatttttttttttttgtagaggcaaggtctcactatgttgcccaggttggttttgaattcctggctttaagtgatcctcctgccttggcctcccaaagtgttgggattataggcatgagccactgtgcctgacctgttttttttttaagaaaataattataaacagtgagttt

SEQ ID NO: 33551 - DNA, 1047 bp, Homo sapiens
tgttatatcacaatgtttaagaatatttattatcatcttaggttagaattaaaatagcatatttttaggaaagttctttttgtctgacagtttagagcagatccaaatatgaaatgtgagtaataatataattcttatacagttattttggagtaaatatatttgtgaaaaactgaaaaaaaaaaattgtgaattccaagatttctgtcaatctgaatttgcagcttgtttgtacactgtagtttctgcccattgaggagaatatgttttgaggacgatgttcacagcatcacacagtgtcacttttatgaggacccatggggaaatttctctcaggtctcagtaccagaaaaagctgtacttctgagcaactggtttgtttttattttatggacactgagaatctttgttttcccctttgctttggccactaagagtctcagaactaaatttgtggcctacttgtagcaattgtacaggattttgtggcatgcatttatatactaatactgctagccttagcttatattttatctttattttctctgacttcatttatttttatcctgtttatgtgtgtgtatgtatatatatgcctctatatcttcatccttttaatgattcaatgtgttggatatgcatgtgtgacagtatgtgtatatatatttacatacagatgcccacacatacatgtatacatgtgattgtgtgtgtgtgtgtatatttataagcaacttcaaatactttgcaaaaaatgagatataaataaatagtgcaagagtactcgtattactaatttcagcctttaatccgtaaagaaagtctgtgattgcttttaaatcatcagtagttttgcaacaagttaaccatgcctttggtcagtgtttctagtattacacatttcatcttgaacatgatttttatgtttttgttttagaaaagggagacccttatgtttgaaaaagattgtgccactaaactaaaggagaagcagctctttaagatatttccagccattaaccaaaattttctggtggacattttcaa

SEQ ID NO: 33552 - DNA, 1047 bp, Homo sapiens
cacagacatgatgctcaaaggaaatactcacagagcattttacatttgtaggttagcgatactcaacaagtaaatataatgcacatgttctaaaatatccccccaaaccccagcaatccaaaacacttctggtcctaagcattttgagtaggggatactcactcaacctgtatatttgtgctaatacatgactcattagaatgattctttgtaaacttaatattttaaaagtacagcacttctgtagtatggaaggtttcagtaataattatattcattcagtagtctcttaccattatctcccagatggaaaaagaggactaatgtggaaaccccagagggtgtccagttggaccagggagatattagacacttaacagtattttcagtctgtccatctctttattccaatgtgagaaatggaagtgtttttttttttacgtttattggctcttcatatttctctacattatttttaatgtgcagtttcttcaattggttagtatttccatactatttgcaactttatggcctttaaatataggacatattatatagcagaaattttgactttaaatcctcttgagtagtatattttgagaagaaaagctatactgctcttctggatggtttccatcctttatttaggtcttttctttttgaattcaagtgttttgtatgcttagaaagtagacatgtataatattgagatcggttatttctgagctggaaattggaaactttggaaactcaggaaattgctctgacaatgttttaactgctctcaatttaagaaaatgacgaaatgtataaaaaagacaaaaataacgtgtgctgttttttccaagtgctttttctaagtgcttttccattgtgcaatgaggtgaagtttggtaatttttcggtgtagtagttaaatattgctcaatttttatttacatgtaaagaaaacagatttaaatgtttatgtggccaaaaggtgtcatttaaaaggtaaaataagtttatgtagaatgtatgttcatggtgcttatttttaaaatgtaa

SEQ ID NO: 33553 - DNA, 1050 bp, Homo sapiens
tcctcctctcgcctccatcttccctatccccagagactgcatctgacttttgttctgtggccctttccaagggttggggcacaggcccctctattagggtagctgacttgagcttgtgcgatcttgtcaattgtagactagaattgcctgggatggatgcctagggacacttgaacctcatttgcagcctcttgcttcataaccaggcttccttctgtgggtttggcagtggtttttggaagaatctaaaacttccatctaggctaggtaagcacggtagccagaaaacatgcagagaaaattgacatgcctggcttctttgttacagatggacgaatgccttttccggtgaaccatggcgccagttcagaggacaccctgctgaaggtcatctttggaatgcatctcttcttaatgtgcctcacaattctttggctaaattttctattctaaagtgctaacactcttccagtatagccagcatcagttgcctgggttaatagcagtctttagggctgcaagatcctcttagtaactctatctaccttattttattgcaagtggttttaaacagggcttcagagacaccctgagtaatctgtttcatgtgttgtctttagtccacagttagaattagcctgaaagctgttgctttgcttcctggtgggattaaggtgaccattgtcctcccatcagattacatcatagctaaagactcacaaaacagcagcctttcataatccctctaagacaacgggatttgggtcagtcttggaggtagtgtactatagattctagttaggtggttaaatttaggagtttttccttcccacatggtctactgttacaagaacaaaataagcagatttaaaatccacctgacaaaaactgttaatatccaggatcactttgtaaccatcctggacagaaaagtgattctgggcaaaggttggtagacgaccctaggcctcttcactaaaaaatgagcctctagagttgaatcaatttgctattataaaggaaaattgcttaattatgatacacaaaata

SEQ ID NO: 33554 - DNA, 1142 bp, Homo sapiens
gaatttcctggttgatttatagcatggtatttaagatgcaaagaactatgttgctttgtttcatgggacccatcacgccgggcacggtggttcacaactgtaatcccagcagtttgggaggctgaggcaagcggatcacttgagctcaggagttcaagaccagcctggtcaacatgatgaaaccctgtctctactgaaaatacaaaaattagccaggggtggtggcgcgtgtctgtaatcccagctattcgggaggctgaggcaggagaatcgcttgaacccaggaggtggaggttgcagtgagctgagattgtgccactgcactccagcctgggtgacacagtgagactcagtctcaagtaaataaataaataaaataaaattaagagacccatcagtgttttgtgtttggttactctccagtaataactttgtaatttccacctagctcctgcattgatcttgcatttttcaatccaatgcattttggttggtctacttatacacttaattcccatagcaagcctcattaatctcattaattccatgccctagtgaactgctgagaagaaaagttgtcattaccatggattctatcacatgaagggatggaatggtggaaaccaccttccgttttctccctctgtctctgttttgctgctgtccaaatatttaacattaaaagagtattataaaaaacaaattgatttcagacatttgagggataacatatttgagatttaatgtatttggggaactgagaagtgtttgatgtgaggtagaggtacaaggaaatgggagtgggttttatatgcataatagtgcatgccagagctaggataggctagaggctagattatgtgtcagttacaaatgacccccaaatctcgttggcttgcaccatagacattttttcttgctcatgctatatatccaatgtggattggtacccagactgacagagacttccttcaccatatctccaactatgaccacccttacagtggggagggaaaggagctttctgttgagacatgattcatgggccaaagcaagtcttacagcaatgcccacctgcaggtggggaggggaagagccatcagactttgtgtctcaacaggaagacccgataccaatgacag

SEQ ID NO: 33555 - DNA, 1031 bp, Homo sapiens
cagaggagggagctcttttagacaatgaaacatagtggggtccttgagtgcaactaaaatttcttttctgattaatcaccgtccccttgattcatctttgcttggtcttgtgtatttccattgcatagtctgacttataatgtggttctgcagttgagtctttcttagaactgggtgatcacaggaagttatcttatttatctttgtagtccattacccctcctctcaccctacaggccttactcagtaacttgtgcatagtagctgttcaataaaagcttgttaaatattaaggtgatagatatcacagttaccctgatttgattatatgaatgtatcaaattatcacctatacccctaaaatatgtgcatgtattatgtatcaatgaaacataaaatcttgttaagggatttgattttcaatgatgataggggttgtgcttttgaagtgatgcaaggctaagaacaaaactgtaattgtttaattcagaaagtagttgtggaatggagtctgaagggagacacgacaatatggcctgcacgaaggaagattttgtgtatagaatgttctagcctgtttagattgccttgacttgtgtcaggggagcagtttgtttcactttgcctatataagattaatgtttctgagatgaaaaaaacacacaaaaaaggagctttttgacgtaatcaagcctctatcaatcacttcttgcttcctaataacttttgtatcttcctttcaggagagcagttgaagtgaattcttctgggaccaaatccagtgtttctgccttgaagaaacataattaactgacattttaaaagccactttatagacctgttctgactctggtctaaggacattacttgatttatagtttatgaaaagtctacttttagaatttgggtatgttttatggtagctcttttagttgattgctttcatttttctttgggaaattatctagaatagctgtagtgatgtcatcagaagcttgacttttacctctgtgtacttagagggctgactg

SEQ ID NO: 33556 - DNA, 1030 bp, Homo sapiens
tttgaaacattgttattttacaaataaggaaactgagaccagaaggcagtgacttgcctggagtcaggcagcaactttgttccagagttgggactggagtgagtctttgttcctcgggtcccacttgggtgctttttctagatccagatttcctgacagtactgcaaacctactgtgtgctagtggctgacacaaagctctctgcacaattccaatcctggcatctctacttctgaagatgccattccttttcctcagagggaatgggcttctccgcctccctctccaataggtgtggcaatcagctgtcttccagttccctttcactgcatcagcatttcagccgcagcagcctgcttgtggacagagcaggggttggcagtggtgacgactgttttgggaaaggaaatgtaagggcatttcggctgctgtgctggggctgacgaggagcacacaggagagatgcccctcccatctcccagagtgggttggctggagttcattgcggagcatgaggacgtgtgggggtaagtaaaattcattataaaagaaatacatgcttaggggtatccatgatggaaagaaggaagctatttagactttaatacttggtttaaaaaaaagtgactttttattcacttattagtatggcgaaaataatatgaaaattactttcctgtggattcatcttgtcctttgataactgttagcacctgttgcttttaattaagcttttttttttttttaattccctaaggaaagcattgttttttattttccggtatgtggtacaagacacataactccattagtttagtcaaaataaaaaggatttttgagaattttgagaatgagaagcaacttggctgcatttttaagatgtggtccagcagcacatggtgttgtgggggagatgtggctgcattcatggtggggctgcttcacctgagcccctgtcacattctgctcctgactccacagccccctttgctttttaaaaacttccatttcttaaaatgaggaggaaaag

SEQ ID NO: 33557 - DNA, 1045 bp, Homo sapiens
gtggccattctgtgctttaaccagtagtcttacagcgaagctctgacctgaggcattctgcttatagcactaacaaaactttgctttccaaggggttaaagaaatactttcaaaacatgtggcctcacttccacttaattgctgtagggactctctggtttcaacaggagcctttgaatctgaagtttaagccttgcttttgttctatcagccctcttttccttcagtgatatgttttgcattagcgttgcagtggagtagacactagcctgtattgattttggtttgcatgcttatgctaaggcagaggtgttaattttgaggaagaatgaatcctggtttggacctgtgcacttgaggaaaggaggaaattataatttccaccatctgtaacagtggccctgctccgaacattttgtggcaaagaaatgtttagtaggtagctctgggcggacaagagggattcaagaatcaataacatttaggcaaaggttaaagacagaaggatgaatggcaccgcccaacaaaaatagactgatgagagttattggccatggggtgtgacttggagaaactgtcgtttaaggattgggggagaaaaagggactcaggaagaggactgagaaaaagaaacagagaaacagtggaaagtggagcattctagcatccatttgaaggagagtgcagaaataggaggtaatgaactgtgtcaaatgcaggtagagatttagcacattgcaagaactgaaaagtgtcccttggattagcaagtaaggaatgattgttgaccgtaagaggatttgtaccagatggtgagaattgaagtcagattgtgagggggatcaaacaggaggagagaaataaagactgtgattatgatcaactcttgtgggcaggagagctgagaaagaagaggagagaatgtgtggctcagggagccacacagtccttggaggactgttcgttagggtagaaatgttttttgtcttgtttataggacaaggagaagactggtgagaaaaagatgaagacagagacagagaag

SEQ ID NO: 33558 - DNA, 1058 bp, Homo sapiens
gcatttgagtaggtgccgtttttcttataactgagaccaactgcaaattccttttagatggcaaatgtcaataaacatttcttgagaaactggttttctccatctagaagtagttgtaagattgctagatttaatgatttttaaaagtcattaaagatatttagataaagataaagatgcatttacagatttcgagaaagcatacatcagggaaaataaaaaattaacctggcctatctatccagttacctgggtcaaaacctcatttttttttaatttgaaaagtttagtacaaaaaaaagtttaagacatggagagcctgattctccatatagattccctgtcttccagtggcagtagatatttggaggtataaaagtgaaaagagaaacccatgcacagcatatgtggcacctgggtctggcaccgcagtgccagagcataaatagactgattttccaggcttgtgtccagataagttgtccaagacgagagccaggaaatcgctcagagtcacagaaccgttgctcgggaaaggacgttggacatcacttgttccaacccatagaggttaaatgatcagtccgagctcaccagcaactccatgtgagaaacaggcccagcacccagaccctcagtctcaggagggtgcttgccctcctgcttcacatgtctagtacatcttccaatgtcgttctctgggccagtccaccaccaagattctagttaaaatgagcagccagatgccaggtaggctttgggctagaccatgtctctctcaagccaggaaactgccacctcccacctgaggccccagggctgagtctggcacccgggcagtttggatcgcattctcagttaaggggaagccagctcctggctgagtcccatgcaacctttctgtgctctcattcattcacgtccagggatctgtttttatttacttgttttcattcttgagaaagtgttaccagttggagaagggaagggctctcctctgttgagctgtaaccaaagaaaaatacaggtcagaaaacacatttttccatcaaggcggg

SEQ ID NO: 33559 - DNA, 1027 bp, Homo sapiens
taaccaagaacaataattagtataggctgtttagatttactgatgagccagtgtaatttttttggtggaggggagtgtttgtttctttttatatatataaaataagtcacttttcatttgcatattttatgaagctttacaacttgatttcatcaattagtaattacggaattatttaacattttctgatttatttagtattttaaaaaatttcaaaagtaatacagataagaatacatttataaaaaaattaaacaacattttactctttaccaatcatgtacattcttttatatccttttttaaggataacttggatttagacatgatagatttcactatgaccatttgatgaatgaagatacacatattctccagttgaattgcttttaagttttgagagtatacacatgaattgaaatgtatatttatcacgcttgtatttgtttatttcagtggtcaaggaagtttgctccaaccttttatatactatagatttcttacccttcgatattcgtctcgaagaaacccatattgtcggtaagctgatgattattttaggcatgttttatttgttgagagtattgtgaatatatagtattcgcaattcttaagagttacttagctaatgtgttagactttagaagcaagcagtgtttttgtaaatttaagttctaggccttagaatgtactggggttggtgaggaagtggttgtatttgttcttagaaactgagactgcagttatctacgccacctctaaagcactgctaaaacttagcaaattttaaaatgtataagacatagattccactctcaactttcctagttgaagaaacaaaacacgtgtcaattagataaacaatggttaggatacagaattcacaagccaatagataatgaatgccatatgtttgctttattatatcagtactgcagtccacagaagggagagatcattgggccagaagatagatgagcccaggaaggtttcacaaaattgagattgtgggaggagtaaagctttt

SEQ ID NO: 33560 - DNA, 1087 bp, Homo sapiens
agtgaatcaagataacacaaatatgtgctggtaaacatcttcaaagctgtcttataagcacccattttaaccaaaccagtggaaaggtaatggaaaatatttcagcttgtaaatattgataaacaggctataaaactacattttcagtactacactttttttaattaaaggttttgagaccatctctattcacaatttgtaccattttcacctacgatatttattctcaagttggtggtttcagttgtttttggatctctagtgcagattgtctatagctgtgctgtccagtacagcacagcaaccacatttgacctttaaataaaattcataaaacttagaacttggttccttttgagcacagttcaggtgggtactcaaaagccatgtgttgctgatggcaactgtgggtcagcacacatatgcaaaaattttgtcattactcaaagttctgttgtcagtgctattaaggaactctctgactggtccttcagcacagatatgcaaaaattttatcattgttcaaagttctgttgtccgtgctgttaaggaactctgacttggtctgtgccagcgatgcagccagtaataaaagaactatgtgactttagtgaaagcgattgacttcattagtcctcatgtcttctagctttattcatttgactgattggttaaaacagtgattgtatgttgatgaacttatgtggaattaaaatatcttctttcagaggtactcactgctgaataaattagacagctatgtaagtcagtgtgatgatgaaggtgctctgaaagcatagagaacagacagagacaaataagaattcactgaggaggtgggaacataagccaagtcttttaaagaatgagcctgagttctgacacatgggtgcctgaaaagtgcttagcatacttgagctcaggaagtatatagagaattgataaatatctgtgtccacaaaggtagatggtagaaaggactagatcatgaaagggtttggattttattttgaggtaaggagagcctttgaagattgtaacatagagaggctgggaacccccatgatgaaatctgatttagaaatat

SEQ ID NO: 33561 - DNA, 1011 bp, Homo sapiens
tcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggataaatatttggggtcacctagccattgaaagcagaaagcagtagtgacacagctttcccttcaaagagccattgagaaacatttctcaaacaggaaatccttcttttactaatgtggacatatagattattcgtattatagtttgtagaactacctagttcagaatcttgactgccagttttcttggtttcttaggcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgtattattcaactttgatttgggttgtaaaatgtgttaaatcctgttcattgaactcccatcaactcttataaaattcatgctgatcttcattaccgttgcatgattggaaatgtttaaaacattgtacagttttagtatagagaaatgtaatggtttttgtgaccagtttctgtctgcatgtaa

SEQ ID NO: 33562 - DNA, 1135 bp, Homo sapiens
cccgacctgattatggaatttttgagtagcttttacaggaagcttcccaagcaggttgtggatcctggctccttgtgatctcttgtttttctagatttttattctcttgttagagttccttggaccttatcattatttctagtttctaccaacacatcttcccgttttctacagccttctttattagagtggtttgggccgagtgaatctttttccttatttttcttattatttcttattctgatcttaaagatctcatttcctttccctgttttgcccctcccatgagttcccaaacctttcttctaaagaaatcttatttttcaccgtaagcagcattctattgttcccataataatttcattgagttttttctctattcatccaaataatacaatatattcttattttaataaaacatacattctgtttgttatcaataaacagtataattcagaaatctagacccatagtcagagtttatggcttacaaatcgaagtaaaagttgagatcacatggacaaggtttatccctgtgtagttccttctcttagctctgaaggcaggtcaatacagaattttgggtgtctgatttcacacattcttagagcatatgaatttcagcacagtgcatttttctactttattactagtttttatgtagccagctcagatcctttctggaagtaggcaggacatgaattacaaggaaacaaaacaaacaagtttctggaaagagacccagatatgctttcggttttaatctttccactttctaaacaagaacttctagagaaaaataagtaaatctaattcagaagttttgatagaggaaaatgttctggtctgtcaaagccaccagttacagtgcttctctgcaaaattttggaggtattaaaaaaagtttttgtttttttacagccacgctccagaacagcatcagtgttttttaagggaccaggaaaagtggtgatggttgcaatttgcatgtaagtactgaaaaataagctttgtgaaatagaatatattcttttaaatatgtatatccttaaatatgtaaatttattacatggtagctagctatagagtttgaggtttattttgttttaggaggaaattgaataagtctttatta

SEQ ID NO: 33563 - DNA, 1127 bp, Homo sapiens
gcacccaggtggagataagtcaacagggttctttccaccagtaatacagggatagtgattatagcttttctcattggagggatgtatgtgtgaaaagtgcttaacatagtacctgctctaagatatgtacttaagaagtattattgttaatatatattggtctgaagctcaggagagaaatctgagttagaggtttgatagtttttagtatatagatgataactaaagccataaaagtaaagatcacctgaggaatgtatgtatatatagtatcaggaataaaaagtcctcaggaaaaattccttgaagaatgttaacattaagaaaaaggtggaggctttgggagacctcgtgatccgaggtcaggagattgagaccatcctggctaacacggtgaaaccccgtctctactaaaaatacaaaaattagctgggcgtagtggtgggcgcctgtagtcccagctacttgagaggctgaggcaggagaatggtgtgaacccgggaggtggagcttgcagtgagccaagattgcgccactgcactccagtctgggcgacagagccagactctgtctcaaaaaaaaaaaaaaagaaaaagaaaaaggtggaggaaaaagtgcctgcagaggagattgaggaggagtaaggagaaaagtagaaagaaaaccaggagtgtattagtccattttcacgctgctgataaagacatacccaagactgggcaatttacaaaagaaagaggtttaattggacttacagttcccgtggctagggaagcctcacaatcatggtggaaggcaaggaggagcaagttatgtcttacatggatggcagcaggcaaatagagcttgtgcagggtaactcccatttttaaaaaccatcacatctcatgagctcattcactatcacaagaacaacatgggaaagacccaccctcatgcttcagtcatctcccactgcgtccctcccaaaacatgtgggaattataggagctacaagatgagattttgtgggagacacagagccaaaccatatcaaggagtgtcaagaaagccaagggaagaagcgtttgttttttttttgtgagacggaatctcactctgtcgccaggctggagtgcagtggtgca

SEQ ID NO: 33564 - DNA, 1053 bp, Homo sapiens
taaaaaattttttgtagagatggggtcttactttgttgcccagactggtcttgaactcctgtcctcaagccatcctcccacctcagcctcccaaaatgttggcattataggtgtgagccattgtgcttagcctaattttactttcaacagaatctagtgtagagatatacagctgattgagtatgcttttggcttaaatttttgtccaaacctatgctaaattgttttctctttctcttctagcaatggattaaactgcttctttaaatttcttgcctggatttataccggttcagcaagtatgttctcagaagctatacactcattatctgatacttgtaatcaggtgaggactaaagctttttttataagtcaattttaaagtaatagttgtaggctttaatctaaaagttgatctattttaaaactgaatgattccagtagttggcttgtgggataaaataaaagtttacttttcagcaatgaagtgcatagaaatttaatcatagtattttaaagcagattgttatgctttaagaacctctgacaatggaatgtgaagtataacattgtcagtcactgagcagaaatctggtctctgaatatgaattctcaatgactgtaatagtcaatgaatttaaacttttggaataaagatgtaaaatcatatgtaattggttaaaatgctttcacattagattcataatttgaattactttccttggctttgcaaatggagaaaaatttttgtattaatacaattaaaagaccttctaaaccccctgtggcccaaattgtgaaaactagaaacccaaaacttttctaagaatataataaaaatttctgtgtgtgcatcctattacattttaaagagtgtggtatattaagaggataccttttcaatatttacttatttttagtcctgttatgtaaaaactgatttgggagaacttcaatgagagacacaggtaaaataagaatatttaagacaaggataaaaataacgtgaagataaggagcaaggagagcaatattaattaaaaattaagcctg

SEQ ID NO: 33565 - DNA, 1022 bp, Homo sapiens
aaacaagaaatttggagaacttcaagacattataaacttatatagaaattaggacagtgagttactggcataaggattgacaaatcaatggaacaaaattgaggatccaacaacagagccacatttacatggcccgtgcctttcggcaaaggtatcaaagcaattgagtgaggaaatgaaactttttaaaacaaataatgttggaaaaattggatccatatggggagaaaaaggaccttgactcctacttcacacactgtatacaagtttgaaatggatcatagtccaaatataaaagttaaaactatgaagattctagaagaaaacctaggagaatatcttttagacctggtaggcaaagatttcataaataggacacagaaacaatatcataaaataagatttacaaattcaacttcatcaaaattaaaaacttttgctcattgaaagacatccttaaggaaataaatacgcatagattgggagaaaatagtcacaaagcattctgacaagggactggtatccaggattaagaaattccacgattcagtaataaaatgagaaccagttttttccccccaaggataaagatttgggcaggtacttcacaaataaggaaacatgaatggtggccagtggacacctgaaaatgtgctaacaccgttaatgatcaggaaatgtatattaataccacaagacatctctgcatatccactataatggctacaagtaaaaacctgacagccaaatgttggtgaagatgtggagcagccagatctcccagtcattgctggtgtattactaaaatggtacaaccactctggaaaatatttggcagcctcctataaacatatacttatcctgtgacccaccaattccacttctaagtatttacccaagggaagtgggaatgaatggtcccaaaagatttgtataagaatgttggctgggcgcggtggctcacgtctgtaatccgagcactttgggaggccaaggcaggcagatcatctgaggtcaggaat

SEQ ID NO: 33566 - DNA, 1060 bp, Homo sapiens
attttgtttttgtttgttttggcgataagtcattgaaataactaaatatcagaaatctcctgcaatttatgtacctgcagtttgttcaagatttggtcatttcttccactgtagtatctaaaatgcagaacttcccactgtgtcaaagtaaattcaaggtataatttgaaaatggagttcaagttatttttatgctttgtagcacggcatggagatcttgttttctccatatttgataataataaagcacatattttgatcttagaggtctgttttatttggtccaaggaaacatatattctagatttagactcataggctgcccaatctaaaattttgatgataacttctattagatacacacttattttaatcctcctgttgtgatttggaaatgtattttgttaatatttcagaattatttatttgtaaaatgagtatactttttagaatgtattattttgaatcatagccattatttgatacagagatttttttctattgcttctattaacataaccatctaacacttttgaattccacaaacatcattttaagactagcttcagtaatataatttgataaatcttaagaccaaaaaaagtgcacttttatttctgtaaaggagtctacctctattctttagaaatgcctttctttacttgaaagcaatactactgttttcccataaataacatatttgaatgttttgtaactgtcaagctagtatagagaatagctctctagtgtgttaattacccatcattacagtgttttaccatcttaagaaaaatttttttttcatggccagttttatgtacaaaagatttaaaaacagaaggtacaaattttaaattttaggttgtgaagatttcttctcaaggtatttttatagtctactttagtgctgcccaacagaattttctgcaatgatggaaatattttatatctgtccagtatggtagtagctaactacatgtagctattgagcacttgaaatgtggccagtgcaactgaagaactagattttaaactatatttagttttaatttatttaaat

SEQ ID NO: 33567 - DNA, 1029 bp, Homo sapiens
ctttttatctagaatgatactagctatatatcatccttggttggatgagaagagagtcacccatattattttctgtagggcttaattctcttacagaacattagtaggaagaagatacggaaaaaggtttctttcagcttttgattccactgttattttgtctatctggtgtaggaaaagtgctatggatatatctaaaagaaatggactcttcattatgtcatttttttgtattggtgtctctaatctaaatgtgctcagaaacttcacatatgtaatgacaggtacaagtaagagatcttaattatgtcacatagtactcttatgaaagcaagttgtagcatcctcattttgtggtatattaaaactattaggagttgttaaaggaagtaattaaagaaattaggaataaatttcaagtgccttgatttactcgttctggttctttgctctctataaagttcactgaaataatataaactgttaatttactgatttttttatgtgcttcatttaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaaggtcagccttattccagtaatcctgttaaggcttacaaaaacatattaaaaaacagaaatgcctggtttgtaaatacttccagaggaagttttggattcctcgtcttcagaacgttttagtctgtaacttttcagaattataatcctggaagtaagaaagaatacacttaggaaactccttctaagtttccttttaaattttctatacttctaatttttagagtaaggaagagtcaagttgatataatgagaatggaagtttgcaaagtagttgtcttcttagtggaaatacttaatatggaacctgtagagttgccttatattcgcattgcaattacaaattgaat

SEQ ID NO: 33568 - DNA, 1576 bp, Homo sapiens
accttcagatttaataactcactaggactcttagaactcaccgaatcatgttatacccatcatggtttggtttattacagggaaaggatactgcttgaaatcagccaagggcagaagaagtgcatagggcagggtccaggaaagttccaaacatgaagtttcagttgtcttttctctgtaatgcatagtattactctcctggcaatgaagtgtgacagtagcatgacgtgttgccaaccgggaagctcatctgagacttgatgaccagagattttattgaggctccatagttgactgcataagtagctgaccttttgtctctagcccttctagaggtagagcagatactgtgtggccaaaggcccccatcatatatcacattctaaagttaatgcccccagataaacaaagacactcttaggcaggacatgtcaagggcctagaaattccctcccggttatggagaacaaaagccaaacctccctttgggtaagattaattctctactatacactgttatattaaaatctgttggtctatttttatactctgaatgaatcttttacccatgcatgattctataacattatgaattagtattttggaaaatactggttcacagaagtacttagatctttcagatgttgatacatttctaaatatgggtacactctcaggctgatggggtggatatgtttttcaacttaaatttccacttaaaagcttgcattttatcattagcaacaaatactgttgttttccttgaaataagactcattttgttcattttttaggagatgcctgccaaatacccaaatttgaataaaccgagtttgttaatctttcaaataaaaatgtactctagattaaaaagcagtttattcagctcacaacttaagcaatcaaagaagtacttttacgtactttccattttgtcacagtatttttaaaagtgaactcaagggtttaggtttaataaaatggatatatttgctatttcatgaaagacttttttaaatgaaactggctttttttttaatgtcaagtgtgggacagtagagacaatgactactggtattgtttgatgccatttgtgttgaattgtgcaaaggtgcaagcagttttacccaccattgtttttatgccatcaggaaatgtcagcatagtaaaaaaagcaaagaatgtcttacagttactgtgaaaatagttgtgaccttagagtccccctaaaaaggtctcaggaccccagcagtccttgaaccgcactttgcaaacaactaatctgtataaaatgtgagacaatggttatttttgtgcaaggtagcacaagattgaataaactttgctctttattctacttgtttttattttgctggcaaggaaaataatggactaaatatttgctttacattttagtagatacaagaaatcagaagccagatttaagaataatcaccaaattggtccttgtcacctacatttactcttacaacaatcagaccttattgtttttgtttagctaactttgtactttaactagaggctattaaatcattaataatgtttttgaattatg

SEQ ID NO: 33569 - DNA, 1054 bp, Homo sapiens
gttttcaccacacaaaaatgtgtatttccagtgcttcgcaatgcttggcatgtactagatccttaatgcacttttgtattaacaaacacatgaacaaacttaggaatgtgatactacttattgtactgtttatagtatgtctatttacctattgatcttactttttttcttatgcaactatttctctcattagtatgctatagtgaaatagtttgcaaatgttttcattggctctaatgaccaaaaggaataaaaagaaacaagattttattttgctacaaataatgtggtggtgatttttctttccagaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaaactactacttacatctaacagacacactacaagttgaatcaatttgaaaatcatgtttttatgcttccatagggaacattttggttatttaaattgttcataatgtcccatatttcacctgttcagtgtatactgtactttgcaatcatctttccttttttcacattggtaaaaataagtggcatccataggatcatgatttttaatttgttgcctctgaagatttcactccatcaagatctgccaatcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtcatagtagttgccattttgtaaaatttcttttttcttctttgcttttttccccttatt

SEQ ID NO: 33570 - DNA, 1114 bp, Homo sapiens
gctgtgtcgcccaggctggggtgcagtggcgcgatctcggctcagtgcaagctccgcctcccgggttcacgccattctcctgcctcagcctcccaagtacctaggactacaggcgcccgccaccatgcccagctgattttttttgtatttttagtagagacggggtttcaccgtgttagccaggatggtctcgatctcctgacctcgtgatctgccagcctccgcctcccaaagtgctgggattacaggcatgagccaccatgcctgtacatgcctacatgtacacatttaatccccacaaagagccagtgaaatgtggtctgtaattcacatttttgcagatgaggaaacagatacagtagttaatattagtgtctgagactactcatccaataaaaggcagagtcaggatttgaactcacaaggaagcattctgctaaacagaaaagcccaagagaagtaacactgtataaaattagaaaggaaatattcattatattgttatacagtaacctaatttatattcagtagtcagaacaattagctaaatctaactcagactgcttgggacagggggatgacggttggggtagggcgtggatcaatgagttgtttttttttgcggggcggggggcggtgtttgggtttttttggtttgtttgttttcttttgagacggagtctcgctctgtcgcccaggctggagtgcagtggcgcgatctcggctcactgcaacctccgcctcctgggttcaagccattctcctgcctcagcctcccgagtagctgagactacaggtgtgtgccaccacacccagctaatttttgtatttttagtagaaacagcgtttcaccatgttggccaggatgatctcgatctcttgacttgatgatccaccccctcggcctcccaaagtgttgggattataggagtgagccaccgtgcccggccctcattaaggtttttatggacgctgaggtcttgtctgtttcgttaggctattttttatttatttatttatttatttttttttttttgagatggagtctggctgtcttccaggctggattgcaatggcgcgatcttggctcactgcaacctttgcctcccaggtt

SEQ ID NO: 33571 - DNA, 1057 bp, Homo sapiens
tggaacaaatctcgtaaagataatgtttagccaaagaagccagacgcaaaagagtacattctgtgattctatttacataacatcccaaaacaggcaaaactcatcaatggtgtgagaagtcaggaaaatgattgcccacggggtcaggagtgacacaggaaggaacagggagagctagaggtgctggacagctgaatgtgatcaatttctttttctttctttcttttttttttttttgagacggagtcttgctctgttgcccaggctggagtgcagtggcacaatcccggctcactgcaacctctgcctcctgagttcaagcaattctcctgtctcagcctcccgagcagctgggattacaggtgcccaccaccatgcccggctaagttttgtatttttagtagagatggagtttcatcatgttggccaggctgatctcaaactcctgacctcaagtgatctgcccatcttggcctcccaaagtgctgggattacaggcatgaaccaccacatcctgccaatttcttgatcgaggtgctgagtacatgagcatgttcagttttttttattattatttatttttgttgttgttttgagacggagtctcgctctgtcgcccaggctggagtgcagtggcacgatctcggctcactgcaagttctgcctcccgggttcacgccattgtcctgcctcagcctcccgagtagctgggtctacaggcacgcaccaccacgcccggctaattttttgtattttttagtagagaaggggtttcaccatgttagccaggatggtttcgatctcctgaactcgtgatccgcccacctcagcctcccaaagtgctgggattacaggcatgagccactatgcccggccgcatgttcagtttttaaaaatctcatcagcctgtacacttttggtgagtatacttttcttatgtatgtcaataaaaagtaaaaacaaaaaaaatcaatttattgtgcccttcgtaccttctgttcctttaattggcatcaagtgtccctggtagatggcaaacattcttcctcctccatcc

SEQ ID NO: 33572 - DNA, 1079 bp, Homo sapiens
ggccccggggccccggtccgcgccgacccttggggctgctccagagtcctgggctaccgacaggctctacagctccgcagaattcaaggtgactgccccctggaatctgatttagccaagttttcaaacgttggagtgccccatgcgatcttggacatgtatagggctttctgggactagctctgaaccctgcttgcaacttggtacagggaggcagagcggagagtgtgagcactgctcaggttcccgaccctccactcctcactagtgtgaccttgggcaagtcactaactttgtaggttttctcattttcaatgtcaaatgttgatttgtttacgcgagccactggtcgaagtgctttgcgtttattcatctatttaattctaaaaagcctactaagcaagttgctagtaaatattaatataacgtccattttcctgcaaattaagtagctatgtggcctgggcaagttactacattgtcactctcctacttcatttgttgaatgcagaactgatcaaacatccagtggctaatttgtgagatttgtgtgatgtgagaagtggacttttttagactaatacctagaatgcaggaagttctcggtctgtctttgtagttttatttcattctacctcagccagagcaaacctgtgtaattttgactctggtgggagagggtgggaggttcaacaactctgataattgtgaatggatacattttagtcagaaaagtgaagtgactgaaggcaagctataagtaggcagaaagacaaaaccttaaattaatcaactttggccctaatatgcctgtgtttttaaaaatggatttatattgcaattcgaagtataaagatggtgcaattctctataccttttgaactgaagggaaagaaaatctacagggcaaacatcagaattagttttttttcggcagactttcagctataattgtgcttttattatctgtctttatggggctattaaaaaacaaagctcacgtgaattttatatttcattgtaatttcatggttttgctgattgtgaaatatgcagttgattggaaaaaaatagagtac

SEQ ID NO: 33573 - DNA, 1102 bp, Homo sapiens
attagtaggtttaatgtttataaatatttttaacagaagtctgtcaattttagtttgcatttgggtactactttctgaattataagtggtcttaaaaagccttgtcgtttggaaacttaaatacattttgaatttaatgagagaacatgatttatttttgaactacataaaaataaaatattccagcttccagcattaaggtaattatgttcaagatggatgttttacataggcagtcaattccacacttaacagaaagtcatcatagactatgaattaagatcaggaaaaaacttatttcataccaggaggcaagaatcaacagcaactagtagctttttggaattacaaatgtgtttcctgcattctaaggaaacactagaatacctatgttttcaatagaggttaggtatcaattggactgcttggaaacaaaaacacaatttttataatgatttcttttgaaaaaatgagttaagaaatttttaagatttttaatattttggaccacaacatagctggagctgtaacaacttcaaagttaaggaccatgtctgttttattctctatttgctttgtattctgtatgatacttaacatggtatctttcatacagtaaatgtataagtgatgcttcctgaagaaagaaaggattttaacagtacttctgaaaataatctgttaatagagtgtattattgtcactttatgaccttcctgctgaaaatctttagaaaccaaatataattttgcaagtccaggcaccaattgttttaaaattaagacaataggagtatacatattcttgtctgtgattgggacaacttgtaagcctaattgaaattttctttagacttcagttttataagtgaaacatttaaatgtctgttttgactaacattacaagctttgaccacattgttaaaagtaatagctgaaactaagtgcttgtgtgtgctaagctaggctctgtttaaacacttattatgtactaggcattgctctaattggtttacatgtattaactcatttaatcctcacaaaagccctgtgaagggagatgcaagctgaagagccaaataggaaatccaaaggtctcattt

SEQ ID NO: 33574 - DNA, 1387 bp, Homo sapiens
gcctcccaaagtgctgattacaggtgtgagccaccatgcccagccatgtcatttcatttaaagtcacaatttccatgaatctcaacaagtgaggacctgctatattttgttgcatgcagtttttctttacggacactaaaaggccccatacttaagattccatctactttaagtttaaaggattttcagaatcaccttaagtgtcaaatttgttagcaggattaattgatatgaattcacttattaaacagtaaactcaaataacatagacatcaaataacagacatctgctctagttaatgataaaatgtttatagattttatcaggtggttagtttgaaactaaatggtttacatctaaattaagggcaggagctgtctttcagacattcaaaacgcatttgtgtaaaatgacaggtgtttggtattaccaggaactcataatgacattttaataattattgtctaaatttcataatcgaagcgattttagagtagttaacttgagatttcacagccagtaaatggctgtatttctccagagctctcagctcccatgtttattcagccaacgaacaaaccagactgcagactgtattagagcaagacaacatcatttagccattgatttttatcttctaccttgaatgaattgaatgaagaaaatgtcttttagggataaacactatcaaggatgaattttatactaaggttatatgaaagaaaaatctcaaaaccactaagccaaagggaagtcaagctgggaactgattgaggcaaacctgcctcccattttattcctaaataagacagccacaaagataaaatttgctcacaagggaattccttatggacaaagaactcaaagtcttcacatgaaacaaatgcataaatgattgctttctctgtttcatgtttcactaagccagattaaggtataactgactattcctctactctcctctcacatgtaaattgtatattcagtgaaaggctaatcagaaactcaaaaaaatgcaaccctttctctcttacctgcctatgcttgaagcccccgcccctcttcaagttgtcctgcctttcaagaccaatgtacaccttacacatactgattgatgtctcatgtctctctaaaatgtgtaaaaccaagctgtgccccaaccaccttgggcacatgtggtgaggacctcctgaggctgtgtcatgggcacaccttaaccctgggaaaataaactttctaaactgacttgagagctgtctcagatattttgagcttacagttattgtgaaatcattttaattataaattaagtggagatttacttaaaatcatgtgtagaagtagcctgtgatatagtcctagatacatacattatcatcttatgta

SEQ ID NO: 33575 - DNA, 1056 bp, Homo sapiens
cagttaatgaaccagagattttatattttggagggtaaagaaatgagttaagttttccaggtattaagaacatgggagggtggggaaaggcacttaatgcggttttgcaggaaatgggattactggattggagagataggttgcttgttagtaaacagatgttccttgtcagaaaggctgcaaaaaggactctaaaatcccagctttgagaaagacccacttttaagggacaagcaaagagtactgggaagtgtttgtgtagtaggagaaattctaaccataagaatgggactctaaaggagggaagggggaagcattccattcactagtcctgcaactgctcaacagcctacttgaaggtcacctgaaacttcatgtccagtaggagaggggacaacaaagataagggtaatatcagctgtatgatttagaagatgcaacattttccagagtatcactttgtagaggatcgtttttctacttaaatagtattcatctgtcatttgctaacaactttgattacggaaagaatacacagagctttaaaatacatgcaaattaaaatatcagtaaatattaaaaattcaactcctttataaaatttttttctttacattggatatatcttttatacatcaaataggactgcttccaaactagaaataattattttgaaaattctattaattgctttttagatattaagtcaaatatttactgtgactttaggtaaaaactgacaactttctacatacgaattttatataaataaataattgctacttaagtcaaacagaaataattcttctgataaaaatgcaccagacttcctgaaacgttaccagaagaaaggttaaatgtcacagattctaaccaatgtctatacaaagtaacttttatggttttgactcaaaatgaactcattctacctttgtcaaactactgaggtggagcctaaatacaaagtaagagaaaaaaattcatgatgatgatgtcatatactaaaaatcaaagctgttctatttaaaaagcaaaaatgaaaagcgagaatgaata

SEQ ID NO: 33576 - DNA, 1046 bp, Homo sapiens
gcagtgattatgtattgtatcatgtgacaaaatatagatgaatttagtaagctaaattctgttttgagttgcgatggttttcttgaaaactatgttatttatgttggtactaatttaattaaattaacattcagaaattacacagccaatttggcaacacttaaattaatgctgctatttaatcagcattgttaatgtgactttaagcattgacaatgtcaccattatttagtatttacttaatatttctgttgtgcagcacacttagaatagttcatttctttaatttagacaattcttattatagacctatagactatcacctatcagaaaacctattaaaacacaaatacttacagttaacctcaaagtgtgtctacaattggattaaatacagactccttgatggcaatagctgttttccactgtctagggtgcttctcttcctcttatcttctttgaaaattgtggaggcataaggaagtaagctcatcaatgacgttgctggaaagaaggaaaacagcatagcccctttgttaccatccgaatgtctggacatatttagagctctcctaataaaagttggatatattcttgtaacaggcatattaagacaaactgtttgttttccttaattagaaacagttctttcttgcttattctatttacttgagaaaatactctcagttaatcatctttaataagcatccttagccacttcctaatgctataataaatattcaaacatatagattgtccagtgttctaagaggcataaaactcaggtatacatggaaaagtgagtagagtggtagatgtaagcccagtaagagaaagtcacacaagtaaaaggaacacttcaggatgactcaaaccaatggaaaagttggaaatattggccttttgtctatactttgaagaacctctttgtttctagaagttacttttgcctttctcttgagccgtaatctcctgcctttaagctgctaataattataaatctgaaagtttgctgctcagaggaagaatgcattaatctcttctgg

SEQ ID NO: 33577 - DNA, 1064 bp, Homo sapiens
ggtgtgagccaccatgcccagcctaaacatcatttttaacagctgtcttatatttccattagaaatagatttaacacaattagatataatgcagtcaacaatttctctatttctcaacatttgtgtagtgactttcctttttcttttttttttttttttttgagacggagtttcactcttgtggcccaggctggagtgcaatggcatgatctcagctcacagaaacctccgcctcccgggttcaagccattctcctgcctcagcctccggagtagctgggattacaggcatgggccaccacgcccggctaattttgtatttttagtagagatggtgtttctccatgttggtcaggctggtcttgaactcctgacctcaggtgatctgcctgcctcagcctcccaaagtgctgggattacaggcgtgagccaccgcgcccggctgtgtagtgactttctaaggctgagttcagtatatttctactgagggccagagaggacatttttagagcatattatcctatgggtctagagaagtaagacaagtaagagcaggttaaagtcccccaaaactatatgaatgtatgccttcattgagcattatgaataaagaaactctttgctacattctacattcagagtcaaaaaaatgctaactctgtcttaaattcttttttttaggttactactgaagttgaaaatatttttttcctatatatttatagtatatggcttctgtgtttgttcaggctttttttccaactgtgctattcatgtgactattaaaccagaaatgaataatttttaatatttatcttataagatattaattaattaattaatttttgagactgagtttcactctactgcccaggctggagtgcagtggtgtgatctcggctcactgtaacctctgcctcctgggttcgagtgattctcatgcctcagcctcctgagtagctgtgattacagttgcccgctaccacaactggctaatttttgtatttttagtagaaacgggtttcaccacattggccaggcttgtctcaaacttctgacctcagg

SEQ ID NO: 33578 - DNA, 1079 bp, Homo sapiens
ctttgttcttccttctgcacctccttcttaaactagatagctaattagttattttaagaaaaaagaaatttaaaaaaaagcctgctttatttgttagtgggctagaatacacaagacatacccacccatgaagagtttatgaattgtaacttattgacattatcataggaatttactaccagttaaagagggagaacggaggaagagaaaaatacttcagataaaggaaaaagttttcttctcacaaaaacacagacacgtgattgttttcacaggttccattaattaactcaggtctggaagacataggacaaaatggagtttctgaagaagtccaggtgaattcagctttggagtcacttatgttcattttttttccttttcttttactattatcctaaaggttatttttcttgttgatatagagatttttgtaaaagattgctacattatttcaggattatatcctacatttcgattgctctcaaatgttttatccctaaagagtgagttttccacagactgtttggaagcaactagaaaaatctttgtgaaaaatctgaacaaattatcataatggctctcttgaaattttgcactttcacccttattaaggaaattataattagttactaacctttaaaaatagatatattctaataggatagaaagttaacttcctggcaaacaaaatactaagatctcaggggctactgcaggaaaatacctttttcgcacattaaaatgtttataaaattttcccctctcatttcaaatgcatggcaggaataacatttttggtggtctttaatgtgatggacagatttactgtcacttattgattttatggaaaataaattggctatcttatttttataacaatcttatttttctcaaaacaaaaatcctaaccaaaaagttgtcattaaaaaaaaaaaaattcaggtagactgaatgtttttctgctctaaccttaaatgttattaggtttggtttttgtttctaagctacttcaagactacctgaggtaataatggtaaactttattattcagaattcgattaaactaacttcagcat

SEQ ID NO: 33579 - DNA, 1074 bp, Homo sapiens
tgggggttcgaggcgtgcgcaagtaacagggttgtagctcgttgtcctttggattgtggaccttctgagtgctggaccctattggggtctgtgggttggggcagcttgagaagggctgttcgcctggggaggagtcggaggtgggaaactgctttgtaggcagggatcctgctttgtgtaagatactggctttcggatggtggccctgggcattctggatgtaggagaggggtctgcttgatgaggtatcaccaggtgtgggggtcaggggcagaccagagtcgtctacgtctatgcagcggttggtgtttgggacccatttctggcggggatggggagaccgtatgaatcagcactcccctttgggtagtggggtaaaccttgctttgtgtgaagagagggcagaggatggtgctgcttttttttttttttttttttttttgttactctgtgtgaagagtcaagggtggaacgagccctggctcttattttctaaaacaagaattgagtctggcgttttgcagagctctgaattgacagttatcacatccatctttcatttccacgtccttctaggggcagagaaaaagagtcctatttaaaaatttaaaccaaagctatattgtcataagccacttcttgatgaaattgtggcccccccaccttaatatcactttcataaataggacatgggaggcttttcctctcgttttattataaagatgtgtgtgggcaattatttgtcttaattcatttttcttaaagttttaacttttagctaaaatgtctctgctctattgaaattaaaacttctaacagtgaaatcgaaatcattcatagactctggtattgcagggctggaactttgcagtgttctgaggtagttaagagctttcctgggttcgcccctggttttgccacttactagcagtatgaccttgagcaagttactctgaggctcactttcttcttgtatttgatggagaaaataatagcacttacctctatagagttatgaaaatttagtaagataattatgtatgcatttagcgctggatctggcacatagtaaac

SEQ ID NO: 33580 - DNA, 1805 bp, Homo sapiens
ggttacgtttacaaaagtgctataatagaagttttggcaaatttattactgcaaatgtttttgcactgatttcttggattgagtataatttaaggaaatagttttagataataggatttgaaggtaagtcaaataggcaaataaaaaagcagaatgtatgaatgtttgtattttgaatatcagaagttgaccatgggcctccaatatgaatgttttttggtgccatggtcaggtatgttagtaatagactggatagattatgtttgatgggaaaggaggtgacttaataggggttattatagaaaggggtttttgtggacttatttgggaaccttaggcttttttttttttttttttgagacttttcaatattttttagtacttccatggctaggggtaggaggcatataaaaacatgaacctgaaaacactgtggtatctaaactagggcaggagatcactataccataataaaagagtagaagattttaagtttatataaattttgttgtttgcctctgtaagctgtttcataatgttttttggaattaagtaggtttacataacttaaaatttttacctaaagatttcatgttgctgtgttgatcaggttaagaaaaccataacttctagctgaatttttaaaatttgcctataggggttacattatttttatcactccaagctaccaaactacctatcctctctgataagataacaggaaagcccaaacttggaactgttatgaactggaattcttggcatctctagctgtcttgttgacttagtaaaggtaaagaagggggaggaggggcagggggtgtgctattctgttttgtttaatcccttacttatttaaattgatccagacttctatattttctgattagtattgtgacgtgggcattatcattacctacctcttctctgtaaatttttaaccagttgagaaatggacacagatataaggtaagatttaaaatattagcttaataattgatgaagctgagatggagaatatcttttggatccaaggccaaaatggattttctgatttcccctcatatcgagacattaaagggaggggtctgcattgactggcaggagcctcttctcttgtggggttgtgaggcacacaggagacaaaggccacctgttcacaggtatatttggcatattaaacgtgtccagtaaagaaacatggaccaacaggtgataaattggcacacaaatcaattcatccatcctggggatgaacctgtacaattgtctagaaagctaatatatcgtaggggtgacaggatcatgggaggaggaaaaagattacttaacaattggaaatatagtcactttgattttaattgcatttagtagtagcaggtgtttgaaaatggaaagtaagaactgtgttgcttggcacagtcactccataaatatttgttgaatgaatatagtcatgctactaaagtcaaaaaaggatggacacgttcttctttgcattttctttttgcaagttttttgtgtttcttcagcctatcccactctgaagaaaacaatccagtctatatttttaagacttcatggaagtggctatttaaactgctttgagaaagattttattcattccctgttgttgggcactgagtgaagtggaggtaaatagggcagagacctcaccaagccagcgggaaaaaatgaagactaattagacaaagtgaatgcagagataacaggatattaattccttcttagttgcctctttccttctaaacaccccattaaaaaatgggcaaaggacatgaaca

SEQ ID NO: 33581 - DNA, 1221 bp, Homo sapiens
aattatctcataaaagagataatttataaagtcgctctcaaaagagggacaacagagggttccggaacgttcccgccagccgccacgagaagaccagagaggtgcatcacaacagcccaaagtcaagcctactcccaacccccttccccgccatccagggaaggggcggggcagggttcttggtccgccgctgtcgcctgcgcagtcgcagtgcggctcgtggccgcagctgcctgaaagggcaaagggacgagtatacgcatgcgtctattcctaggctgctggctctcagacccgcagtgaggtctgacgtcatttcctgccgtaagtatacagtgcctccgggtcgcggtcattttgagcccctgtctggatgacttcttgcggctgttctacccctccccctccccgcggtaccttgcacttttctccctccctgccccctctcgagtccaccctccgggccttctgcccctgatcgcttggttttccttgcagtcgcctgctgctgtcgtcgggaggtgggtgaggtgacgcaaacagccccgttgttgccctccgcgtatcccctcaccacctttgcggccatccacgactttcgcaccttccgccattttcctgcctgtgagggtggacagatcgcgctcgggtctcggcctcctgagtgccggtgactgcgggaggcgacggagtgcttctgggggtgtgagctggggaagttcgtggtcacggatgcgtgtggggttgctgctcagtctgtaacggcaggtgggagacggacactgggtggaggatggagtgcggtaatcagcggttgtaggccgcttaggctttaatccagcgttgttttgtgtaaagaacttaaaatggtattgtcttaagcgccgtgtcagccctgacagtcttcctggtgtttctaggaaggatgccgttatgggaaataagagggtttcattttttctcatacggttgtagggtaaaggtagtttattcagcaggctccatccatccatgaattcagctgaccttttttatttcttttctctaattaaggggttggcatgtagtaggccttcatggcttattgactgaatgaattatggaagggctcagttgctgtcctcattgtgtatgccatttcctgtttccatgcaaattgtttttaaaatgagaataatcatgatcccacgtaaacgttctgtaaaatacggttacttgatc

SEQ ID NO: 33582 - DNA, 1081 bp, Homo sapiens
cctgtaaccaatgaagttgaagacctttccatttgtttatacttcatttcagcatatctttttctgtgaagtatctgtttaagtctgttaaccatttttccattgtattgtcttttttcctattggttttgtgagacttctctgtatactttggaattgagtcttttgtcagatatagatatggtgattattttttccccactctgtttaactgtagttttcagtgttaatagagtccaatttatcaggtttcttctttctaataggtgctttttgttgactctttaagatcttcgtctactctaaggacacaaagatggtctcatgctttcttctgtaaaattttttaaaaaaatctttcatatttaaatttttaagccatctggattattgttcgatgtaggatcaaggtacattttcccctgttaatggatattaattgacccagcactatatttgaaaggactatgctgcagtgttgtctttgtcataaatcaagtgtgcaggtgtggatctgtttctggactcttagttttggtcagtttgcctattcttgtacttaataccagactgtcttaattactacagctttatcatgtagattttgctatctggtggtagtcagttctataatacgattcttcagtgttgccttggccctttgtgttccacatgactcttagaataagcttttcaatttttgtaaaactttgattttaattgggattgcattgtatttataggtgaagttatggagaattgccatctttagaatattgggtctttcaattctcagtaagttttataacttgtcagtgtagagatctttcatatctttcattagatttgttcctgggttttgagcgtttttttttttggtgctataattaattctgtcttctaaaaaatgtttgtttttttgtttgttgttggtataaacagtttttcatacacacacacatatatatttggtctattgaccttacatcaagtgatctttctaaatttacctgttctaatactttgtagagtcttttggattttcgtcatatttctcttgatactgaattcatttggtttt

SEQ ID NO: 33583 - DNA, 1331 bp, Homo sapiens
ccctgtctcaaaaaaataaaaaaaattatatgtatatataattttggaaataagctatatgaaagaagttattttaacacttctttaagatataggcaatgactcatatttcttactacaatatgattttcatttacaggcactattatcaaaagtcaaaatatgactcaagtgtgagtggtcaatcatcttttgtgacatccccagcagcagacaacatagaaatgcttcctcattatgagccaattccattcagttcttctatgaatgaatctgctcccactggtattactgatcatattgtccaaggtagaaacttctcttgaaatgaatttcaacattttatggtccaacgtatgtataaactttatttgatgaccttttctgctggatatcacctgtgtgttctaccatcaatcatcaacctaaactcagcatgtttgttcatttgtttcttcattcattcaacttttcttgaggaccagtaggtgtcaaggactctgctagacgtggaagaagatgaataacacttggttcttgtccctgaaaaactttcagtctgttagaagatatagaaatacaaggatgaattactagtatgtcccagtaattgaaaatactaaggcaagcttagtggaatagtgaagaagaaatgataaatcgtgtctcaggaagtagagctccaggaaaggtataaaaaggttacatttgataggctgggttttaaaggctttcagcttccctgtctgtaatacaagaaagaactgttgtcaagtgagaaaatccatgtgaaaatgctttgtgaagtttgtaaatactagctttgaagatcacacatgtaagtgcaacaacatcaattttgtattaaggcttggatttgaatcatgattgacatttgctagctatgtgaccttgtaatactactactacattataataatgtagtaatattattataactactttatgatcctttcagtttcttgatcagttgaatggagatgatactacctctcttaatgaactgttggaattagaggaaataatcagaggcaatgtctggcaaataatagactcaaaaaacattagtttctttccttcagtctagtcggcagtaaaagatgaggaattagaaacgggaaatacaggtctgtaattctttatctaaaatcctgaaattcaaaaaggtttaagccaagtttttttttgttttttgtttttttttttttttttgagatggagtcttgctctgtcgcccagtctggactgtagtggtgcgatctcggctcactgcaacctccgcccccccagcttcacgccattctgcctca

SEQ ID NO: 33584 - DNA, 1023 bp, Homo sapiens
tccttccttcctcctatttctctcttactccttctgccctctctctttcatatgccttaggtgcatcccacattctgcgtttttttggggaaatcctcgacaggtgcaggaaacttgtgttattgtaactatgtaccgctatctctctttcacggctctccatcagttgtgaacatctattggtttatcccaagtcactaagcacatttttattaggtacacctgtttttccttatacagctgtttctggagtatagggtcgcatactcataaacccagtgtaactcagaaacgcatctaatattccagtaaacccatcataacgttgaaaaatcatgaatcaaaccatcataagtctcggcttgtccgtggatatgggtgtcatcaattccagtgtatacagtaatgctgtacaccattaacaatggcagactgattgggagtgcctactgatagcattataaaagtcagttattagagggatacttctttaacctgactgaagaactgatctaatggctttagtacagtgcatgattatgtgagatgttttgagacagagtagtacatttgtgaatgaaattttatggcttttttcacttagtaggaaccattgtgtgtggaaaagtgagaaaattgctttctgctgtagagtctggcattcattgtagatttaagcttatttttctgtgagcaaatcttattcaataaaatactactctttatactaaaaaacaaatcagtggtgatgtgtggtcattatcctcagcaaactaatccagggaaagaaaaccaaacgccacattctcacttataatgggagctgaaaaatgagatcacatggacacaggaaggggaacaacacacactggggcctttcgggaggcagagcgttaagaaaaacagctcctgcatgctgggcttaatacctaggtgatgggttgacaggtgcagcaaaccaccatggcacacgtttaccttagtaacaaatctgcccatcctgcacgtataccccagcactta

SEQ ID NO: 33585 - DNA, 1042 bp, Homo sapiens
gtaagcactgggttccagcattcccttgcataaatatgagaacacagtggaggtacacgtaacccttgtaacgataatataaactatgtgttggtatttcttggggtgtttgaaaaaataactgtcttgaaatgagtgatggaggtgggttagtggaatttagggtggaaatgtgaaggtgagcaaaggtaatatgtgacgtcttcaattttcgaagaagcttggaaagcaaatgagaatagaagaaaactgtaaaaagtggagaaccataagactttttttgtttgcttgttttattattagctgcaggctgcaattccttctctccttaatactagaaaccttcctctccataagtagactccctaaacgtcacatccttcaccagttccctttactgtttacagggaagggactccagaatctgtaatgtagaaggctaagattaatgcagagatgatagatttttgtatgtaatatataaggtattatgaaactacttgcaacatagtcattagaagaatattgtaatttttctgatgataaaaatattaccaagaagtcctaagatttgtaaaccttttggtgtggttacaaacatactgaacttggatacttgattgtttgatggttcttttcatgatgagtgaaaaattgggcaatgtgtgtggtgttcttgtggagatcatttatatctatctgtcatattttacttaatcgtgtggtgaaatatccaggaaactcttggtaatataaaaatatgtacaaaaatgtgcacttaactctggaattttttcttgcagagggtaaagtgatgaggttgaaaaacatgcaagagctataattgtcttcaaaatggtgtttttaaagaaaatatgaagctagtcatagctttctctttttcttttgttctattatatcccaaagggcaggtgctttttatacacatatagcccacctccctccattccccaaagccctaggctcctacacactttctgctctggtttttaggttcctttttgatttttggcgcttgggg

SEQ ID NO: 33586 - DNA, 1026 bp, Homo sapiens
tttgatgcttacaattactgtgtgatgacagtctcctaggtagcctttaaaaaatcactcttgagaagaaaagttataagaaagaacagaaccaaatgaggcattccctcactcagccattcagcaaacattcaaggggatttttgctgccaggtgctgctgtcacaggcaggactgtgtgggggagaccggggcttcaggagcttccttcagtgagttcattgtggagacagaaggaatggatgcatgggacgatgatgcctgctaggttagatggatgccccgggggctttgagaacatgtggggaatggttagcagttgtcatgtgagttttagcttttgaagttggattatgtgaagaacaggatgtgtatgcatgtgcaggtggcatatggggtcaggtgggagctttccaagcccagcgacaacatggcatggtggggacagagaactgtggcaggagagtgggtgtttggtaggctagagtggaggggaaggtgaggtgcagggctaggcaggagctggtggcaggggtggggtggggtcggtgggaagaactcaaaagaggcaccagggagagtgtatgagtggaaaggaactgagagaaggaaagagaagtcccaggtggggcacagggagggaggaggagcaaaggggaatggggagggactaacacgaattcagtgatgatcttggatttgcttcaactgctttgcctgcattaactcatttaatcctcacagcaaccctcaataagttagggactgttattatctctgtttcacagatgaggacgctgaggtgtagaaaggttaactccccttctcaaggtcacacagcttataagtggtgaattgagattctaactcaagcattctgactccatggtcttggtaaccctctactgccactgaaatcattcttaacattttgtttgtgcttttcattgaaccctgattggaacactgcatgtatattggaattctttttttttcttttgtcactggcctatgaatgatgctgac

SEQ ID NO: 33587 - DNA, 1045 bp, Homo sapiens
gatcattccatatcagcaaatatagatcaactcaaggacagtcaaaaacaatttatttaataattttaaaagcagtatattcgcatagttttgaaagaagtattgaaaaaatataaaacaaaaagtgaagatttctgtcccagtttatcacccctaggttccatcccccactagtagtccacgtttgactttccagaggtaactcttctgtttgttaaccaaattatggtgatgatgatgatgatgatgatgatgatgatgtattttttccttaaatacaagtgtacatttatatttgccacttttccactcagtatatccttgagatcttttcatattaacacatttataaagcatctgctttcttttttaatgactgtaattttctaatccatgggtattttataatacgttccttcagcctcctgttgatttatgtacacttatgcttatatgtttaacttttagccaccactaataatgcaggaatataacttttggaccagttttagtagttctgaacttttgaattagataagtattgttactatagtaattttgcatgtaaatatttaacccaaagtgtggcacttgaaattcagttaaacgaaagtatacttggactcatgcctccacttttgccttggttacagtggatacgtccaatactgggagtacttttcatgggattcttggggtgttgctttgccagccggaaacttctgtggctggtggcaccttctgcctgagtattgcctgtgtctgctgggctccttccacccacttggccaggcaggctgcactcagttctcactactggcctggatcccacacctgccaagtgtgagttagacatggagcagcacacggtgtgtgggtgagcaagcacccgctccaatcactgcacacagccaggcatgctggctgctgcagtggggcaagtagctccaggtgccagcacaggcgccagtacaggcaccagctctgtgcgaggctgcagctggaccagatgtactgcatgtggcttccactgtgggcacctgca

SEQ ID NO: 33588 - DNA, 1711 bp, Homo sapiens
ttatttgcttagtgttctcttgagttgtctaatattgagagattcttccttagactgtgttccgtgcccagtctaacttgtaagacacagaagacagacatgagttgtaggctacattaataaatgtaggcaagacatttcttgccatatctcaccattattttgtagttctggctggtgaggtagaagggagtatatcaaatacctgttctgttcagttcttactgattatttgttaatcagagaaaaacttgtattaagtgcttaccagttctatattaggagtgactgtgtttaaacactgtagttaaaagctgaagcctgcaaatgcaggaaataaaacgtttaaaatatacttaaaatactgattgaatagatgtctggtttgggtaaaagaatataaattatctgctactttaaagaactcagtatctttaaataacttaaaactgccttttcaatttccagcatgtatagaaaatatgattcgactagaataaagactgaagaagaagccttttcaagtaaaaggtgcttggaatggttctatgaatatgcaggtaggtattcatttgtatcatctaagactgatccttatgacaataaggagtaccttagagatgattaaagaatttaaaaatgtgtacatttcaaatttgggtgtgtgtgtgtgtgtgtccctgttagagggagagagggacatagctgtaacaaatcaccagatagcctattttatagccagcagctaagccaaataattcagaacactagaagggaactgaaaagatgaaatgacttgggagaaatactttggattgctgggaaacctatttggaatgctgataatgggtgattatttggtcaaagcacctgtgttaaaataagctttgctgctttgaacccttacttagtgcagtgaaatttctttatattaagtgtttctatttggaaagatcatttggcagaaaatgtttgttttgtcacttaaaatgttttaaatttagtctttctttttgcaatttactataattggttgggtaatataatgttgcgacctggggcttatttgttattgtggctttgtatggtgtaaaaaagaaaaagaaaaaattttcaaacaagctcaagctgaaggctcttttatctttcttctttctcaccttatttcaggctcttttataacttaccaactggctattctagcaacctttaaaccaattttcctgtcatctcctctccagacaacctgccatgtgccactgttgtctaatttttttaaaactaagctgagcagatcatacatacattcctgaacaacctcaaccactcccctctaatcccaaccctatctcctggccaaaagaatccctgctatctgcaggataaaagagagtgaactccccgtgcctttgcctgaaatgattttctccgtttttccatctgacatgctcttacatcttttaaacccttaattaccttagtagccttttctgtacttccacaggatagtgtttataacttgttgtaacttgttttggttcccttttattggtatcaaaatgaggaattccccctgtagcctgatctggctatttttctcctattcccatgcaaccctttttgtgataagagccttgcccctgttggccacagagattggtctaggtggctggcacataacccaggccaggccagtcagacaaatcttcac

SEQ ID NO: 33589 - DNA, 1070 bp, Homo sapiens
aaaagggggccttactgtctttatcaagaacagagtgataacttgatttttttctatgtaaaagaaacatttatgttttttcttatttaattttatagagactattatgtggttctttgctatgtttccaaaaattattttatgtattgaaattattacccaagtaagagtagaacattaagctgttttaaagagcaggaattgaattcagccttaactttagacaaatggtatataccatattccaacgattgaaggacatggtgataagttgatttaaatgattgtacaaagtagagtcctttaaagatactgaaattcgagaatacttttcaacttagacttgatttttttttccaaaaggagttaatggcctttaagtcttacttgttgacagtataatactactacagtggtaatagtatggtgtgcatggtcagatttaatttacataagactgtatttcacaggaactgatgatgttgtaggccctgaaggcatggagaaattttgtgaagacattggtgttgaaccagaaaacgtgagtcaaacttactgagttgggtgaatcagttggttgtttttcatacttaaatctttgttctttagcaaataaataaataattaaaaagtagtggtatgttagtttttatgaagcagtctaagaaataagttctaattctagtttgacttataagcagattctccattcttgtaagtgatatggtgtaactacagttattttttctctcatttaatttcttgtatgtaaaaggtacagtaagccagatgcttacaaaatggtgtggccacatgtgcctacaatgacggatcaactggaggccacattgtacgctgtgtaccttcgtgcccctcagtagttgttttagcctaatgtagagtcaatctaggacttataattattcatcatgattttgagtagattgtaatcatcaagaatttttcatagatcgtttacttccaattgaatttagctcagaagtgattgcttttttttttttgagatggagtctcgcactgtcgccaggctggagtgcaatggtatgatg

SEQ ID NO: 33590 - DNA, 1029 bp, Homo sapiens
tgttgggattacaggcgtaagccaccgtgcctgaccatcattgctgagtagagcagccgatggctgctttttaaagtgtccttgtgatgatgaaggcatgggcatatcaggattttatttcaagccttcagacgaggcaccatcaacattttcaggtccatttttatttgtcttaagaaggtgtgatacccagtttgtatagtactgagttctttacgaaagaatgtccctctacaaaagaatattacctgataccagaccttgcccatgtgttttgagggccctatctcctgggaagtgagaagcaatttcctggaagaggtctgcgtctgcgttctgagtccagggtactccttcaggctgtttgttgggaaccttgcttgccactttgtatgatgcaggtggtggcaggtgggttctcagggtgattgccacttgatccttgcaattcagggtttagtgacaagcctgatccactgtaaaggcatggaggaaccgcttgctttttgtggtatgaaactctgaagttgatgtcctcatcagtgaggtggagataattattcagaataacttttaaggttctttgtagtgtcctcatcagtgaggtggagataattattcagaataacttttaaggttctttgtagttcaaaaatagtccaacttcaagtttaagaacctctgcctaccctcccacccccaccttccaacctttctagattagtcatttgtttggcaaatgtttgaatgacagtgatgtgccaagtgtagtattccaggccctagggaatcaaaaaccatgagtaagataaagtccattaagaggaggggcttataaacaatattcagacaaaagatccagaagtcataaggtcacttgtctttatgccagtaaagtaactaaataagcattgtatttgtgaagtatgtgcacctagtacacaagaaaacccagagagtaatcatttatgtgctctaaaggcagaaagtagtcgatctttaaactattttgtcttctattttggattt

SEQ ID NO: 33591 - DNA, 1050 bp, Homo sapiens
cagggctgacgcgccactatgtagcgggtttcgggcgggccacgcgtgcgggacaggaacccaaccccagccgaccttgagctccaggagttcgtctcttacgtctgcggaagtgcagctgcctcagttcttagcgcaggtatgttcctagccttgagcggggtgggggaaggaatgagtcagcctggagcacgtggccagtgggaccggagggttccccggcgtctgtttgtcgccaaggtccgaatccggctccccttaactggaaggaaacatccatgtaggggctcaccaaacaaaacagctgtgtttctagtgtggtttcagacttagagaagcagagatccacgaggtattgagagcaacgcggaaaatagtagtgaaccctgtaaaaatcaaagaaaaaaaatcacaaagcaccctttcctgtgcccttttaaggttgacccagtgctttaagaggctaacacagaagggtaaagtaagtctccataaaacccagagaagagactggaaagctcctctttggatcctgtctggagtcacaactgaaccagaaaaagtttcgttacaacttgagcgcctttgtgattttctttacagtttatagaacaagcaatacatttcagttttctttggttaaaacgtcattttaaaacttttctttctataggttgacaactacaggcacaagccattgaagctggaatgtcctgttgctggtatttcaattgacttaagccaactatcccttcagttacaataggaaagtgcctctaataaggccaaatatgcgtactaacttgtagcaaccacgtgtccgtgcagtgccacaggagctagagcagtgacaatgctggtggcaacagggcagtgtagcaggtgcttcatgttcaccttttcaaccttttcatttaattgtcacaactcggaggtggattctgttagggacaggctgccccaggaccactccgcccccgctaactcaatgcagctgacccttaccctgaatactctgcagctgcattcctgaaccgttatctaggcgct

SEQ ID NO: 33592 - DNA, 1057 bp, Homo sapiens
gaaatcctttacattttctagatgtatcaaaatttcttctgtgtgaaaccatttttcacctattctgtgtaagaataccttatctatatcaactgacatgaattactaatgcttttttattaaagtgtttgagcaaaaccatcatttgactggaccatgatgtacttgaggctattcgtgggctcacgaatattcaagtaattcaagctttcctttattgaatgctgtagagctgaaacatagcatatgaaggtcaaaactcagtcacttgaaaagattgtatatattgtttacttgttaataccctttgaaacttctcaaactatagaatctcattctcatgatgaaaggatcagactgaaccctatttgccctttattctaaatcctagagatgaacagtttatatataaaaatccatttaaaagtgaaatttagattatttaaagaacaaagtatcgtgagattctgaacataatcaggtcctcacgttttggtgggtgggaagagtgaaagagaacagtgtgtgtgtgtgtgtgtgtgtgtgtgtatatatatatatatatattttttttttttttttttttttttttttttgaggtggagtcttgctctgtctcccaggctagagtgcagtggcatgatctcgattcactgcaagctccgcctcccaggttcacgccattgtcctgcctcagcctctagagtagctgggactacaggcgcccaccaccacgcctggctaattttttgtatttttagtagtgacagggtttcaccgtgttagccaggatggtctcaatctcctgacctcgtgatccgcccgccttggcctcccaaagtgctgggattacaggtgtgagccaccacaccctgcgagaacagtatatttttatttaatgcttaaactgcccacaattcttcattgctttttctttcttaatcgaatccctgtttccaacatctgagctccatcttccactcccaaaagaagtttcattattacaagttaaatatttctgcccaagtatggccagtctcagactacttttgagatg

SEQ ID NO: 33593 - DNA, 1025 bp, Homo sapiens
tgtaccacctccaggtaaaacttttttcatgttttctccatcattgttaataaacatgaaatttcaagcttatagttacaggagagacggtgttgatgcggttagaatatggaataggctatggggatttcaaggtcctattttcagctctgcctttgcttcattccagttttgattaagatatttagttttcttatacctgtcttacccgtttctgtagaaatagagattctgagaaaattcttacctattcaatttgtgaagaaaacagtataggatataaaataaaagttttcttaaaaatgtctttacagaccaatgaattttttatgtaatatagtgactataagagaagagaaagataatttattttgtctttatcattatttccgattttttaattttagtcctgctggcttagtatcgtgagaaaatgtgttctaaaccccacatagcaactagacagacagctggtcaggtggctgttcttagagtggtgattgtttattgttgtaatagtatgatcactaggagtttatatgtggcccagtgttttatttatttatttatttatttatttttacatttttgtcagttatttctttttatagtgtgatatcacacctggtagcaagtgtgtcttcctgagttcagtgttaaaagccaaggtgtgtaaagagaatgagaggtgataatgcttgcaagggtgggtctaaattcaaaatgacttcaataaacagaaagagtgaagtttaggtagcatagtacagtatacatacttagatgtggaatacagacattgattatgtgtgaatgtgtctgaaaaagactcatcagggaaagtcaaaggaatcatttgtgtctttttagtttaaaaaacaatgtggttgtgaggctgtatgaaataggattgtggactttaggactaatgtggtaattgccaaattttgtacttttaagatgtttaatagaggaattatagatcctaacactggatacagtgaagaacatggtaaacatgaaaa

SEQ ID NO: 33594 - DNA, 1089 bp, Homo sapiens
gtagttcccaaatcatttattgaatagtctgtcgttcctgagggatgtacgattgtcgtctctgtcatctattacatatctatgtgtatgaatctggttttgggctttctagatattcagttggttagctgtccctgtgctaataaattccataatatctttaattatgagttttatagtaaatctgatatctagtgcatcaaaatcaattgttgcttttacatatgtattttagactgaacttagcaagttccatgaaaaacttgagattttgattaataacatttgtatagtacttactacataatgctctttgaagcaatttatgttaatttatgtaatcctgacagttttaaagtaggtgtattgttactatctccattttatagatgaggaaatcaaaatattaatttccacatgtcacacagtaagtggcagagtcaggatttgaacctatgttgcctggcttcagagtccttgcttttatttactataccatattgcaattgcactgatgctctagatcagtctgtgtggaattcatacctttacagcattgagtttatcagtgatcaaggactttctctccatttgcagaggtgttgttttcaataaactgctatagttatctccatacacttcttgaatgtctttggttggatttagtccttaggtacctaatgtttttgttgctgttataagtgttatatacatttgaacagtgtgttctgtttatatttgcttgtattcagaaatagttgtttggttggttatttttatagccatttacctttctgaactctcactataatttgtaaagtctatttgggaaatactcttgcagataatgacagttttgctcctttttttttcagatccttgtttgtccctttttttgttttgtttatttgttctggcaagaacctccattataatattatataacagcaaattaaattataacaacattataatgtcgaagtactcaaagtggagttcttgtatgattccttttttctttataaaggaaatgcttctagatttttactgttaggtttttgatagaaccatcaggttaaggaaattctg

SEQ ID NO: 33595 - DNA, 1046 bp, Homo sapiens
actcctagcctcaagttatctgcccgccttggcttcccaaagcgttgggattacaggcgtaagccatcgcgcctggcctcctctcaacactttgaagatgtcccagtgtattctggtttccattttttatattgggaagtttgtggtcaacctaattctgattcctgttcaccttgtataatgaagggtctttatatgttaggtttttaagatttgtttctggatcttcccgatactgtgggtattcattcaccatgtgatatttctcttttctatttataaaatgaatttctattataatctcatgacacatttttggtgggcattttgtttttttaaagtaccataacgtttgtttttaatcgtgttttttctttagttgcctttccccatcttcctggttctgctccttcgtggcctagtcttgtggacaccagcaagcagtgggactattatgccagaagagagaaagaccgagatagagagagagacagagacagagagcgagaccgtgatcgggacagagaaagagaacgcaccagagagagagagagggagcgtgatcacagtcctacaccaagtgttttcaacaggtttgttgggtgtgcaggagtttatactatgtattttataagcacttacaaatttattttcgttatgaggaagtgaatttcagttcacttggaaaagagatgctcagggagtacataggaaagccatcttaaaatgataaaggattagaggcttcccattaccttgaacagtagtccttaaatttgtttgtttacttatctcttaaaagaattttctaccccttcatttatttttatcttgccatctaagtttttcatcttaagcttaaattagttgaccatatagatatttccagtgtattataaatattaatatttaaaaagaaaattatcaccacttctattattattctatttttagagacggtcttgctttgtcatccaggctggctggagttcagtggcatgatcatagctcactgcactcttacattggaagaagatgccatctaa

SEQ ID NO: 33596 - DNA, 1099 bp, Homo sapiens
gtctgaactgaagataatgactcacctggggccacatttgaacattgtaaacttgctgggagcctgcaccaagtcaggtgggctcactgacctggagtgaggattttcactggacacatgtggttgtgaaaactgttcaatcaggcttaaatcctccactctccatccccacacatggcagggaatagaagtcccttgaatggagctgactggtcccttgaattgatggaagctcattggtttttgagcaaaatctgttgccagtccagtcatagccattcatggctctttattaaaaaaaaaaaaaaaaaaaaaaaaaaaaaacttttttggtatcttatttttttctgtgccatatggtctgcaggacaattcatggcttttctgttcttcattttcatacccatctcctaacggcttttgtccccataggccccatttacatcatcacagagtattgcttctatggagatttggtcaactatttgcataagaatagggatagcttcctgagccaccacccagagaagccaaagaaagagctggatatctttggattgaaccctgctgatgaaagcacacggaggtgggtgcaaagagagatgttgctgtctatcattatcttacaggcatcacaaatggaaagacccatgtcctgatagatatcatgtctgcagattcagtgcccaaggtagcaagacttagagtcaaaccaccctgtccagtctttccatggtcatgcagagagatgcatgatgtctaaaggtgttttggactggggtgtcacatgggaaggccttgctgataggtttgaatgagagtgagttagaatgactctgggagctcttctgctatttacatgtgatccacttagacctataaaatgcagctctggccagggatgcttgagttctggaaccttgcaagaactgtctgtggatctccaagctcgaggtccttgctgaacctggacctataaatgacgtcaatgatagtgatccctactgcagaaatctacaagtggctataaagaactctgtaggtaagaaattctgtaagatcagaaagtacaatgaattcacttcataataaattactt

SEQ ID NO: 33597 - DNA, 1063 bp, Homo sapiens
tgggttctttgtagagttgtccatagaaaaaaatgtgacctcttataaacaaaagaaaaataaatatggtagttggagttctttgctttatttcctatgacaagttcagtgatttgtctgtgattttaatagccttttcaagagtaagcatgctgggcaggggtgtatcttgtagttgatgtaaaaactgatccactggcagcttaagggacatatccaagtgacgggaggagaaatagagttctattttctagttctgggtgcccctggactggggctgtctttgaaacaggcctgagaggccttatccatggtattgtgaatgaataatggatacttttattctagattggagatcttaggtacctcctgagttcagttcctcactacagtatttggataagatgatctgttctgtcttccttacgtaattgttagggagccaggatggtacaaattctaacatgctccatcaggagcgaataaagctgactctaaagtttgactgtgcctctccgctttatcagttgtcctttccgaagtaggtagctgcaaagagatataccctggtaagtcaccacttcgcctcagggcatgcttctgtgattgctgagctaatccatgtgctgttctttacattcaggaaggtattttgcaatttccaggtggcaatgaagtatcatgacaattgaataaatgaggaaaactgttgaattggttaaatcactctaacagggctcacaaacattcttcatagggaaagtcatcttctgtatcttggaactatccttaattataacaaatgtaagatgtttgaatacttaagtaatctctgttacagcaatgaaggaaggtggggcatcattgtaggagctagactcaagtgacctacaaagagtagataaaacagtaactagctatggcctgggaccatccatagttcaaccatcatgaggtcatttatttgcagaataaattagtaaggttgggagatgcataatttatcttggaaaacttttttttcaaaattgatcaaggataaaacacaaacctatttcaatga

SEQ ID NO: 33598 - DNA, 1035 bp, Homo sapiens
taataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaattttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttt

SEQ ID NO: 33599 - DNA, 1062 bp, Homo sapiens
ttgaaagattggggaatgaatgtatgttcatagaattaatttacataaaaggtttaaggtattactgagtggttttttttttttttggcttttgtttttgttttcaatcggccagtgaattactagacccatataatttctattgtattattttcactaacagcacttttaagactcatgaaagaaatcgcatgaaacagaatgttttggcttaatggattttgtgaatcaaataatgtttttttctctttgtagttactcctagaaagcttggagccaaatgagtgatttaccccttgcaaatggagaccatttgatgatactcattttgtattaatcttgtgcctggctccttgtttcctccctcatttcatttccctttatttgttttaaagatttatgttattttatgtaactgtatgtatcattcaagatacagataccaaacctgcgacctttctatctcaagcagagagggatttagtgtagaattaggtgcttaatcaggggctggaatggtgggctctaggctggttctccaagaatatcttcttgaaaaacacagctaaactaaccataagggctgctgctgcctctggcatagccaggatatggaaattgggaggccaccactggaatcattgatctcaaaagctcacctcgtagctgtatcccaaaggtgaggaaactactgttgctaagattgctgcctctgccttctcatgcccataaaactaggagctagacaacgtaatacagaaaaacaccatttcctatgcccgtctttcccaacagcagcagctgaagcaggagggaaacgatcgtctccacttcacttcctcctgctacacctcagataagtactgctgacgggtggaatcgaattcacagcaagaatcctagcttcaagagagtccaggaaatatttctcatcaagtactctgcagcactgcaaccaaactagaagaaggctgcaatgaacgctaagagccaatccaactgtaagtatttttgtgagtcgccataaatcctttccggtctaaggtagggtgggcagggata

SEQ ID NO: 33600 - DNA, 1045 bp, Homo sapiens
caggtagaccggtggattttcatcagtcctttactatcattaacggattcctgcttcgaggtggccatgtggaattgcatgatccttggttctcttacttgaatcagctttttagggttcccccttggctccagagcctcaggctcttgcccattatcagtggatacatttgtttcttcagtcaagcctccgactaggctaactgcttcctgctgcgcagagggaagtccctgtttgcttttctgaagccagtggtttgctccgcaggtcctcagaaggtctgtgtttttcccttcttcctagcagccggagaagaaagtggaagatgatgctttgagtgtttccactcctgaaactcagtctctcgactgttctttctcatccagacctggatggcattgagttgttcatcttgcagtttactgtccctctcttttgagaaagccccctggtagcctttccactggtgatttctttcattgaccagagctagtcaagtcagcattctgctttcaggctctccctagcaggatggtagctcagagagagatttccttagaaagtgtttttcttcactgtaaaacataagaaagaagacttaaaactggacttagcaagggaaacacaaaggaatcttaccattcgaaagtagatcacagtaggggagctgaactttgtgcttgaactgtttagagaagaagcaagagaatgtgtctgtgtggaattctcttgccaggggaactgaagctgcccatagctgaggaacgtatctcctttgtccagagagacagggcttttccctctgtattgggaaattacatcaggaaattacatcgggatattgaggaacaggttcccctctttgtacttgggaaattatattaggatattgaggaacggaataagtggataattgtgtttctgctgactaaatgatttgtttaattccctgagcctgtgaaattgtttagtgttggctaacaattctcattcctatagcctacataacagggaaaaatctattgatgcaagcacggtggttcca

SEQ ID NO: 33601 - DNA, 1029 bp, Homo sapiens
agccaagagtggtggcacatgcctgtagtcccagatacttgggagtgggctgagatgggagaatcgcttgagcccaggaggtcaagggtacagtgagccgaggtcatgccactgcactccagcctggcctgggcaacagagcaagaccctgtctcaaaataataataatatataattttacaccaaaagtttcaggaaaaaacgagtttgttggagttagtttatactttcacatatcaccacaaagatctccagttaaataactatcaatatccatttccattcatctccccctcaaatcatagcctaacagaacactttgaaagctcttttatttaatatttttttacatcctttgaagggagtgcttcaaaaatgaaagcatcagaagataaaatatttttatatttatgcatagcaagccttcgtgaacggaagtgacacactctggattgaataatactgtagcctcattcatatgtagttattcaaattggattaatgtctgtgtgagtttatttgaactagcagaaagtatctgaagatattcaggaataaagtttatacttaaaatagcttatgttaaagaaaatacctgtgattaattcagagggaaataaatgcatggtataaaagaaaaccaaaaacttaaaaaataatactatagcctgagcaacacattaaaactgcacacttgtgcagcgtaagattctctggcttattggctgaggtgttaagtttattccttttatgaagatgtcctattacagtcagctaagcactaaagctttgcatttatatgtactttgctatgggggaaagaaccttatgattaataagacacatatcaaatgcatagtcaatcattcccacccccatccctggagctgtaacccaaaactgttaaactaagattcctttgttttttttgtttttttgagatggagtctcactctgtcgcccagactggagtgcagtggtgggatcctggctcactgcaacctccgccttctgggttccagcgattct

SEQ ID NO: 33602 - DNA, 1049 bp, Homo sapiens
tgaccctttcctttcctttcctttcctctcctttctcctttttcctttcctctcctttctcctttttcctttccattcctttcatttctcctttcctttcctttttcctttcctttctcccttcctttcctttttcctttttctttgttgagacagggtctcgctctgtcgcccaggctggagtgcagtggccccgtcttggctcactgcaacctctaattgatcctcccacctcagcctcctgagtggctgggactgcatgcgtgtgctgacacgcccggctaatttttgtttattttttttttttttgagagaggaggtctcactatgttgccgagtctagtctcaaactcctgggctcaagcgcttctccggccttggcctcccaagtgctggtgagctctcacaccggtgcattgttttcgtgtttcatgttttcgttacatgttactttcttaggcttttccaattttctgttgtttttctgtgtaagaccgtaggatagaactttctgagagactgatcttggtttcactaagcaagaacatttgtaagaatcagtgctgtcccagatgtagtaatcgctattgagaaataatgaagttccccttactggaagtactcaggaagaagttgaataactaactgcctatgaggagattctgatatgggagggaatctgggagataaagttactgggaagtgaagattctgggagccgatttaatcctcacaacagcacgttaaacaggtagaggaggtttgtaaggaatagtggtttaatatcacagagctagaagctagtttcagcagaaccagaattagaatctggacttctgtgccttactaagttttattagcattcattgtgtcttactcttttgacttatttaattcactaatggattttaatggtttattggattgtatgctggtgcagttctttgatcttgagcctagctttctctttctccttttttgggaactttattgtgtatgttgtggcatgtttacacacacatcttgctgccttgggttcttgcaagttg

SEQ ID NO: 33603 - DNA, 1049 bp, Homo sapiens
catagctgggactacaggcgcccgccaccatgcccgcctaattttttgtatttttagtagagacgaggttttaccgtgttagccaggaggtctccatctcctgacctggtgatccgcctgcctcggcctcccaaagtgctgggattacaggagtgagccaccacgcctggccttaattatatttttatgtaactttttgatactactcaagtattttttcctctacggtactcactatgctgaaagatttttctttcacatgttttctaaactatgtaatataagtgtcattggctatttttgtccacctgatggaggtaagaaatgatcaaagtacagtttaacagcagtattagcaagagttgagccttgctgaatatgtaagtttcaacggatttgctttgcaactacatgcagtagatgttttaagagggtaggtaggatatttaaatttaacctttttgtgccactgtgtgagagtgggcttctgaaaatggaggggggaagcatctctccttggttagtaggcattcaagtggaagatatgttataaaaacctagttgtatcttataggatgctaaaagcaaggtgactgaacttctaacagggcattctacattgagtatgtgcttttctctataattaggctaaaaaaaggttggtaagtaatatgaacttaaaatcaagattaacccccaatttacaaacccatgataaaaagtgttgttgattacttggatcctatcttttctgcagtttatgtttctagtgacttactcaatagttttttcttactctttccctggacagaatatgtaatataagaaacataagtcctttgagttgagggagatcagatagatttaataaaagtcatttagactttattgcatattctggaagtccaaagaagaatgactctggttgcatagcacttctaataaagccacaaaatcattacctgactcagtgcctgttcttgttatcatatttttactttatgttttggtatttcatttatttattacgtttcagctgtgagagtacc

SEQ ID NO: 33604 - DNA, 1124 bp, Homo sapiens
ggactacaggtgtgcgccaccacgcctggctattttttttttttgtacttttagtagagatggggtttcatcatgtttgccaggcagctcttgaattcctgacctcagatctgtccacctcggcctcccaaagtgctgggatgacaggcgtgagccaccatgcccagccatattagtttcttcagttttataaaccaaacttctaactaggggatttgctgctttttcactttactttagtatgttgttatctggcttcagtccttgccttttccttgaaattctttttttaattttaaagatagggtcttgctctgtcgccctggctggagttcagtggcacaatcatagcttactgcagcctggaactagtgggctcaagtgatcctcccacctcagcctcccaagtagctgggactacaggtgcatgccaccacacctggctaattttatttattttattttttttttttgtggagatgaggtctcactatgttgcccaggctggcctcgaactcttggcctcaagcagtcctcctgcatcggcctcccaaagtgctgggattataggcatgagccaccacaaattccattttttgaaagaatcttgtaagttagcaaattgctaaatccagggatctttttcagttctcatttgacactgttaattctctactgtttaagaatccatctcaggtgtatgaacttggcagaataatgaagcccgtttgacctcagttttcctgtattaaaacttaaaacagctcctaagtttttttgagtatcaaatgcaacaatgtgtctgaaaatatctcgcatctagttagtagcgcaccccaacctgacggtctgtgatgctttagttgctgcctggctcgaaatatctaagatagttttttttcctattttttttcctccctccaccttctttgaataaagacattctctaaggcgcattctttgaactttatctctttgccttatctgttggaaatctcatctacttgcagagctttagctgataaatttgggctgccagcaaccagatagagtacgtcctcacttaatgttattaatagattcttggaaatggtcactttaagtgaaatgacatcaatgatgtc

SEQ ID NO: 33605 - DNA, 2007 bp, Homo sapiens
aaacattttgtgtttgagcttagagctaagtgatcataaatggtgtatatttattcctaaaatttttctgggatttcagatcctgaaattttatacaaacctttaaaaagcattttcaggaggaaaatgtgtcagagccaagttgaaatttgaaatgcccttttttttttttttaatataaggattcttaatattggaagagaaaggaagttgttgttttgagaagggggcttgctccatcacccaggctggagtgcaatggtgccattacagctcactgcaggaagctcgtttttaaaggaccgtcaacgtaggtggaaccaaaataatggagagaaagcaagaagcccttaaaatgatacttgcttaattaattaaactcaattcattgagagccagctgtcaaggcaacaaatactttccattttgttaaatttctccagtatttagctcagaggtctagtcttaatggtaatgcctaaatttttctgatctttactgtggaattttataatctttatgttatgtgttaaggaatgacatgcacactaagaatttatgattttattcttacctgtgactagggcctttgtaataaatctgtttttacgctgtccaaaattactatgttcttgggtttctttttctttatctcttgggtttctagagattcataagcttaaaaaattaaaaataagttattaggattggaagagacctttggaagtggtttatctagcccagggcgtctcagtctgggaactgttgacattttggatatataattcttggttgtggaagggctgtcctgtgcattgtaggatgtttagcagcgtttctggcctctacccactagatgccagtagttcccctttgattgtaactaaaaatgtccgcaagcattgtcagatgtcccctgggagacaaaatcgccctggttgagaaccgcttgtctagcccatttcctgggagtggtggttcccttctctggaactcagacgttgagaagagaagggtatttaccacctcctctagcagtctgttccaactttgggtgcgtctttggagacagaaatctctcctctctgttaagctaaaacctgccatctctaactttttagttctgcctcttaggaccgtatggattggatagattcacttaaaaactttcccaattattggaacatgataccccgtccttcctggtccctcacgggattgttttagagccaagtcagcaaacttcttgtagttgccatgtatttgcaggctaccaatctctgatgcataatcttcctttccttccctccctcctccttgcctcccaccagccttccctccttttctctttcttcttatttcttgtaacttcttaaaaatgtaaaaaacctttttttgctcttataggctgggttttggttcagtaacttgccatccctggttttagagtctgacatctgctaatcttcagagggcagtgcagtgctttagaactgtatatagaactttggggaaggtctgagcagcatagaataacgttggacttgtcattaactccttcatgcgaagagcttactgcttttttgaagctttgtcacatttacagcgtaatgacagccaagacactggtttgtctttttcattaggccactttaccttctttttttttgagacagagtttcactcattgcccattgtgcaatgggcgcagtctcagctcactgcaacctccgcctcccaggttgaagcaattctcccgtctcagcctcccaagtaactgggattataggcttccgccaccatgccactttaccttctaagatatttttagacttcagcgtaggacgatctgtgttaacagctgtattaaacttgtcttagctggaaccaactctctataccctgctgaggtttgtgggtcttactctgtccttcagagtgttaatgaaatttttcttagcttcccgtcgttcaaatgttttttaaacatacctgggtctttcatgc

SEQ ID NO: 33606 - DNA, 1027 bp, Homo sapiens
ctcagcccctcaagtaggctgggaccaaggcgtgtgtcaccccgtcaggctaatttttgtattttttttgtagagacaggatttcgccatgttgaccagtggtctcaagctcctgggctcaagtaatccgcccgactcggtctcccaaagtgctgggattacaggcatgagccaccgtgcctggccagagtaattgtatttattatatgtatggtcgtgtcctctgttccttacatagttgtttttgtttgtttatgagacagggtgtcactatgtttcccaggctggttttgaacttctaggctcaagcaatccttccaccgtggcctcccagagtgctgggattatgccactttgcccagccaaatttttaagttttaattactgaatgagtattactgatatacttgtgtttcaccattaggatttgagttcttgatatagttccaagcatcattttttatataacttacacagatgtctttccttatcagtgggaaagagtggaactgaatgtttgagcctgttgtaacattattttaatataataagaaatttttagatttttttcataaaacgtacttattttaaatagttacaagggagcagagtttaaatcttgctatgtgagacttttgtcatgattcttcactagaagtttgtgatttaaagatttgtgatgaagaaattccactatgcaagtggcatggcttcccagttataaaatctcagctcttgagagggcctcagagctaacttctaccccaggtactgtgccttgcacaacataaggcaagccagcctctgactgaacatgcctggaaaggagttcaatatcttacttaacatctctcaggaagatgtgccatcttcaactggaccattggcttctgagtaagctgtgttaggcctgggctagacctaatggtttattattggtggagagaaagatctggaaatacttgaggttattacatactagattagcttctaatgtgaaccatttttcttttaacagtgataaatt

SEQ ID NO: 33607 - DNA, 1073 bp, Homo sapiens
gtgcctgccaccacacccggctaattttttgtatttttagtagagacagcatttcaccatgtttcagtctcctgacctcgtgatccaccctcctcggcctcccaaagtgctggcattacaggcgtgagccactgcacccagcctatttttctttttttaataagagatggagtcttgctttgtcacccaggatggaatttgtagcatagtagtgtgatcataactcactgtagcttcaaactcaggctcaagtgatcctctcacctcagcctcctgaatagctggaactacatgcatgaaccactgcaccattattttatttttaagagacgggatctcgctgtactgctcaggctagccttgaactcctggcctcaagtgatccttctgccttagcctcctgagtggctggctccactctgcttggctctgatatttttccataaagcctatcattcatttatcatggaggtatgttaattttgccttcttaatttctctcaaattcacctgctctttgcctacagtcatctgccccgatctggggcaacgcagtttcttcccagggctgttgccatagcatcgcagtggatcacccttccttcagtcttgttcccctctggttctttctctccactagactttaaaaaatttttgagatagggtcttgctctgttgcccaggatggagaacaatcatagctcactgcagccacgacctcctgggctcaaatgatcctcccacctcagcctcccgagtagctgggaccacttgtgcttgctaggatgcctggctaatttttaatttttttgtagagacaaggtctcactgtgttgcctaggctagtctcaaactgccaggctcaagcaatcctcttgcttcagcctcccaaagtgttgggattacaggcatgagccactgcacctggcctagcggatttctgaagcattaatctgttctgttactttccagctaaaaaccaacaagtgtctgaggacacagtttaaactccaagatgatagggtcctccctcacctggactcccacctaccctcatgacctccttttgtgaa

SEQ ID NO: 33608 - DNA, 1019 bp, Homo sapiens
ctgtgaagccacagttaggtctagagatggaagaatcgtctctttgctagtcagaagacctgaacattttcttttataactggattttaagatgagttatagttctactgttgcttgccagcactgtctggatttaatacaatcctgtcatttctcaaaacagtgctggagaaaacctgattcttagtgttcacagtcaagcatgttaagtattgttccttgttatgtaaaaggggttgaagtgattctaatttgttttcaaggttagtttaatagattggaagaataattggccgcctcatcggctcccttttcattttgtacagtatcaaggtataggaattttactgtatttgactttttttctctctcttccagtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctctttttt

SEQ ID NO: 33609 - DNA, 1037 bp, Homo sapiens
ccaaatcagagccagttccctaagaagaatatggtgcaaaacaaaacaaaccacacattaaatacatgacaccgaaatcactttgatgagaaaacagaacacacaggtattttaaaatataaataaatacatttagccatttttattcaagaaccccagagaactgctttaaaagcaattgcttctttgaacccctttctaaattctttcataaatacttactagtttgattgtcacttaatgcagcacctcagtgtttgctggtggtggtgatggaatttcacttagttgtctctccataaactatatcctattccactaaataatgtttccctgaggaaacccaggcagcttacaaaatactgttataaacactcacaacaaaacctgcagagtattttatttaagaaaaacaaggaatgtagtgttatgacatagggggaaaaaactatgcaaaacagtcacatggaaagaaagtattttaatttttaaaatccaagtttgcttaatttcttgtgaactgttcaacactgttttaaatatcctgaataactgtgccaacaaaattcatccccagtgtttccacaggagacattaaaattaaagaccaaattatactatttttttcctttaaccaaagtattctttttctcagtcctttttgtgcaaaaatattacaagagcaattcaaatggaaatgctgaaatgacatgccaacatttcagggcacatttaaaacactcagaataattcttgaaattattatattctaaaatgttactagcaatcacttttagattagttctgtacatctactcacacggatgcaattttcctagacctctgaaaaataaacaggctcattggtctcttttggtgtccacacaataggcaagataggtttacaatagtgtttaaatcaaactaggcatctacaatctcttgactccaccacattcaaaacaaaaatcaaagttcatttggctatcttgaaatcactcccataaaccaactacggttcactggacctaaacatt

SEQ ID NO: 33610 - DNA, 1072 bp, Homo sapiens
tcgggaggttggggcaggagaatcgcttcaacccaggaggcggaggttgcagtaatctaaggtcacgccattgcactccagcctgggcaacaggagcaaaactccgtctcaaaaaaaaaaaaagaaaaaaaaaagctgaaaatatttgatactaacatgatttgcacaaaatattttaataatcactctcaatactatactttctaaatactattaaattttgaaatgatattttatcattagagctttatttctgcttcagcaatagtgtgccttccaaccactgatcactccatagcccgctgtgctcagtaacattacctgagttgatgtactctgtaaagtctgttgttgtatcatgtgctgagttgtgccaatgtgtccagtattcattccactttgaatctggttagtaggaacaacttggccttgcatatttataggtgcaagttgctggatattagatgaatttccagaagaaagttgaacggaaccaaaattcaacccaggatttgattgttgcaaaaacatctttaaaaataaagattatgttaaaatgagctttgtagattgaaaagaagaatgagcattaaaaagaaggcaaaatcaagctacaaagtatgtttaaaaagcaagtaacaaggctaagtcactttgaagaattagcaataaataagtagtgaataaaatatgaaactttatattcaatctttcagttatcttgtttccaattgttagaaaaagtgtaactagtgttagtctgtggattgacagctctgtatcacttatcatttataatttataacatcacacagaagtagttttcactccaagtttccctttaccaaagtcatagtctcctagagtggtcctgctggttggtcatataagactaatttgaatcatacatactggtatcttaataaaaatattactgatgattgatttataaattctgtacccaagatgtacctaaaactttatgtaaaatataatttttatattatggattcaaacttactaaaatttggactggtaaaaaaagatgactggagaaacaaggatgttgaca

SEQ ID NO: 33611 - DNA, 1084 bp, Homo sapiens
atagaaacacccggcttcaggtcttcataaacatatctgtcatgttgactactgtaacctagaatagtgtctgccacctaataagcatgagtatttgctgaatgaatgaagagtcacatactgcttttcattatggctaactcctttatgaggtatgcccaatcctgtcttgttttgcctcttactgtacactcagttgcttttagccagagaaggagtatgtggtaaacgttggtccctattattcatttgaccagtttttactattcagttctaattaccttaatagatatttaagtatccactaaacacaaaactatgatgaacatccctcccttctttaagagaattcttgagatagagaagcttatgatttaatgagcccattagacggcaaatgcagtaagtgctgtagaaatttagaggagagatcactttggattaagatcttcattgaatcaacttcatgtaaaccatgaagtgtaattagggtttggatagggcggagatgatattccttacatggaaagtaccaaagtgaagatttgatgtccaaaatgaacagagtgtttggagtggaatgtttttgagaacattaggaaaacgttgagtaaaagcgtgatgtgatacaaactgtcttttaaaattatcttgttgttcagggttgtgggaccttgcaaagagaaccagattttgtagggttaagtaaagttgatatgaacctgggtcagtatatttgcagtgcgaaaagaaaggaataaattacatgtagatggggggaaatcgcagaatgtggtagcagatttcatgttgataagggaatagggaagcaaatatggtagattttgaacctggacatttgcttatagatgtgaaagttaggaaaggggaatcttggaggagctatagctgtcatgttagtgaatttaagcatttgttaaatgcctagtttgtcaagttctaggaatacaaagatgattaagacatggtcctacttttaataggggataaaatacagctagctagaaaatacaattcataaatgccgtatttatgaagtagaggggaagtgttagagaggtag

SEQ ID NO: 33612 - DNA, 1058 bp, Homo sapiens
gtttcgcttcttttttcaatatgctcagaattaggacaccaatgttaatggaagataaggaaactataccacctatcccttatagaagatttgtgcactaactaatatgagccctggaagatcaagccagtagaagatagaagatctatccctgctttatactttggatcatttatttgtgaagatcacaactttcaaagttttattatttcttaggtcttcatggaagttcggggaaattaactggatctacttctagtctaaataagctcagtgttcagagttcagggaatcgcagatctcagtcatcttccctgttggatatgggaaacatgtctgcctctgatctcgatgttgctgacaggaccaaatttgataaggtaaactaaaataacaagtacttcttaaacattaacattagttttctaacagcagtttgtggttgctctaagtgtgttcaaagatttgggttcttctggctctcttaagcattaaccatgtctttccaactgaatcgaatctgggaaaaaaaaaaaaaaaaactagtcaaaggacaagtaaaatgtgaattatcaatgaaatggcataaaagctttattaaaatttgttataaatcataaaatgcttatatctcaaatctaagttgtttgggcacctaaaaagtaagaggaaataaaagcttttgtgatgctggcctttctctgtactaaattaaataagtttttttgtttgtttgtttttgaaatggagtcttgctctgtcacccaggctggaatgcagtggcacagtctcagctcactgcaacctccaccttctgggttcaagcagttcttctgcctccctcccaggtagctgggattacaggtgcctgccaccacacccagctaatttttgtatttttagtggagatggggtttcaccatgctggccaggctggtttcgaactcctgagctcaagtgatctgcccgctttggcctcccaaagtgctgggattacaggcatgagacatcatgcctggccataaataagttttaaaagttgatctttgtgctcctct

SEQ ID NO: 33613 - DNA, 1990 bp, Homo sapiens
ggctacaaacctgtatagcatgttactatactgaatactgtaggtaattgttaacacagtggtgcctatttgtatatctgaacatatctaaacatagaaaaggtattgtgttgtgctacagtgttacaatggccagatctcatgaggcaataggaatttttcagctgcccccattataaatcttacaggactactctccttcctatatgtggtctgtcgttgaccaaaatgtcatcatgtggtgcatgactgtattttaagcctctttagaaatatgtttttagttattagaaagttaatgaaatatttcctggtatttaaattttctgttcttttagcgacttagttcatacaactgagagccttcggcaatcaaaattatctgctgtgaaagctgaaaaagaaagtgccaattttgattttgttttggaaccctataaacttgaaaatgcaagattgagtagagaaaataatgaattatacctagagttaatgaaactgagagaacattcagaccaacacgttaaaggtaagtgaaaatttgataatttttaaaatgcaatgtctttgtcctttttattttagaaggaaaagctaacgtctaattttaaaactattgattagaaaatatagtagtcctacagctggatggtgtgtgcctatagtcccagctactcgggagtttaaggtgggaggattgcttgagcccaggagtttgagaccagcctaggcaacatagtgagaacttgtttcaaaaaaaaagaaaagaaaagaaaatatggtactccttctgctaatagcccctgaaatactatagggtatgttgaagagttcctgagaaggaaaataaatgtgcattatatagctatgataatcactatatgtggattaaatttttagaattaaaaatttaattaaaattttagaattaaaattgccatagggaatattaaatgctggatttgaagaaatgttcttgaaacaacttttgtttttcccttactgaaaataaaagtagtaaataaggtgaaaaccatgtatcatgctgactgttttatagtcagtctttgagctgtcaagtagaataggatgatttcaaaggtactagggaaaagataattatatggttatctttgtatgaattattcttatattcagtagaaaactttatctaatccatggtatgaattcataatcctttagcttcagacccaatttactggatcaaaagctatgatgtacgttaggctaatacagtagctgaaaaatgaagattctcttttgtgcttagtgagttatttgcagttttgttaataatagtagaagaaggaataagtgtcaactaaagcatgcataagaagcaggtggagacttttaaattgatatgactttttgtattttgtgaaatggaaaaacttcattggatttcttgatctttaaaacggtctttgaatctttttcattttaagagttgaaaacttcattgaagaaatgtgcacgtgaaacagctgatctgaaatttctgaataaccaatatgctcataaactcaaactgttggagaaagagagcaaagctaagaatgaaagaattcaacaacttcaagaaaagaatttgcatgctgtagtacaaactccaggtaaatcgattccttctcgagacaaattatacacatttaatcttttaacgatattaacaccattgactaaaataggactttggattggattttcatgcttagactttagtgtttgaaaatatatattgaatagaccgtaaacttcttgatttatttctaatgatccgggtagtaatttatacgtgtgcttagaaatgtatgtagtattagttacttagatactagtctaactttaatgcccagagctttctctaatcaatattttaaattcttttttctattattattatcattattattttagttgtaaaagtaatccatactcattaaagaatttggaaattatgtacttt

SEQ ID NO: 33614 - DNA, 1089 bp, Homo sapiens
attaattgctagatccaaaaggatacttacagtctttgttttcttgacctactctgtggtatttgatattattgataattgctctttgaaacttcttccatgacttcatttttttccagttttcttttttttaagcctcttttttttttttttgctttttttcaactgtccactccctgaaatattactgttttcttggattctgtctttgaccccttctcgtcttatgtatctttttcaagtgtcctcatctgctctcttggtttaaaatactgcctgtatattgatgactccttcatctctctgtggctcaaacttctctgctgaactccagacccatatacccacctttacattgggcatttccacttgggtggagtctttttgtactcatatgccttgtactgaactttttctcttctggtttcgactcctttattctctactttggttggtagcatcaatgtttgcccaagtgcacattctgtattctttctagatctctttctcttgccttcgcataccactcaccaagttctgtcatttctcctggctaagtgcttcttaaacttatttcttctgttctatcctctaccactgttttattttagttattaattgtttcttatgcatttctgcattaggtctccctgcccctgcctctgtttttattcctgtcaatttcatcctttagtccagcataatcgtaattagttttgtcctagttcttcagacatctccaactactagatcccatgcacattacatccagtcataccaagctatttctgctgtctcaaacattccatgtttttgttgctttttggtatgtttggaatgtttggttatttatttaagaaaaccaaagcttgggccaggagtggtggctcacgcctataatcccagcactttgggaggccgaggcaggcggatcacctgaggtcaggagttcaagaccagcctggccaacatggtaaaaccccatctctactaaaaatacaaaaattagccaggcgtggtggcacatacctgtagtcccagctactcaggaggctgaggcaggagaattgctcaaacccgggaggcaga

SEQ ID NO: 33615 - DNA, 1047 bp, Homo sapiens
gagtttctgcttagggaagtcagtcagtaaatgttcagggaactcatgttttactgggtaaactcatgttttactgggtaccatactagacactgaagatgtaatgaaaaagaccaggttcctactgtggccctcatggagcttaaattttagtagtacagatacacattaaatgcacaatcatgtacataaccttataacctcatttataatgtgtttatgaagaaagtacagaaaatattcaaaatactataagagtatatagaaggagatctaaattagattgaaaaatctgaaagaattccttggagaaagtgacatttaagctgacacctaaacagtaataaaaatagattgtcaaatctttgtttattgagccctccttttctagaatctgtacagactgcctctttctggaagattattttgtttttctttgggagaaagtctcactctgtccctcaggctggagtgcagtagtgcgatcatagctcactgtaaccttgaactcctgggctgaagtaatcctcttccctcagcctcccaagtagctaggactacaagtgtgcaccactatgcctggctaattttttaattttttgcagaggcaggtcttgctcttttgcccgggctggtcatgaattcctggcctcaagcagtcctcctgccttggcctcccagagtgctaggattacaaacatgaaccaccacacctggcccagactttttaaatttagatatggttagattacatagcttcttttatagttacattggttaagtcccaaaacactaatctgcttttgtactataaaatatcttgtcctttaaagagttcggataactaatcccatccatcatgcctcggttttgcttatttaaccaagagattaattatttccaagtgcaggtgagaggtacctcacagatatctatcatttaccaaatctacattgtatgtggtattggcataacagatgttacatagtataggccaggtctcttttcagtgtatcatattatcaaattatcccttcttggcacttc

SEQ ID NO: 33616 - DNA, 1029 bp, Homo sapiens
tcttaaatataactggatgtggggcacagagttttattagattctataatttcatttataacattattgaatttcagttttttatgaatatgttgaataactttatcatttttctcttaacccacctttcaatttcctccctttcagaataatggctttcaatgagttcctatgtggatttttaaaagaacagaacagtaatgaaatatttgaagtacttgttgctgaaaatcatgaacatggacacaaattctacctctgtcaacttttatttaaatcagtgaatatgttaaaaagtttggtttaaaagaactatatctatatgtatattttcatatatatgacagaacaagaatatgtattaatagtgcctaatgtatctatatttttattattcatgaattaaattactaaaagtatgtttatactgtgaattaatataatgtattcacattattctttaataatctgtttattaataagccatgatatgtgtatgtaaatattcttacagtacttgtttttagttgtcatgcctatgtttagaccatatcttaatgtattcacaaagaattatcaactttgatgctatgctgtcatgcttaactttttcttcttaaaattattcatagatctactgtctgttgtcaaggggaatatattcaggtctagtcttcttataatagcagaggtcttggtaaaataactaccatatataacgtgttattgccatctagaagaactatgatgagaaagatacatttatatattatgtaaaatgttaactatcatcatatggactctatgtaacacaaattcaaaagcaaactaaaagctatatgcagagttttgtataaaacaatagaacagaaatttgggacatttttctaggaaataaaattcctcggtgtattaatctaaggtttcaaagtataaaagtatatggggtaggccgggtgcagtggctcacgcctgtaatcccagcactttgggaggccgaggcgagtggatttcctaaggtcaggagtt

SEQ ID NO: 33617 - DNA, 1109 bp, Homo sapiens
attccctcaggcatctgtcttcctcagaatgtttagttatttcatatagaacttaagcaaggaaggaagaaaggaaaggaaggaagagaagaaggaaagaagaaaagaagttctgtttggatactgtgctaacaggtcatattgggcttgcttattagatctgcatttctagtattcttgttttttcccttcaaataataattttttttttttgagacagggccatgctctgttgcccaggctggcatgcagtggtgcgatcatggcttaccacagcctcgacctcttgggctcaagtgaccttctgcctcagccgctcaagtagctgggatcataggtgtgaaccactgtgcccagccaaaaaaattttttattgtggtaaaatatatataacaaaaattaccatcgtaaacatttttaagtggacagttcattggcattaagtacattcacagtgtcaagcaggcatcaccactgtccattttcagaactttttcatcatctcaactagaaattctgaacccattaaacagtaactcctcattgtttaccaggggcagcccctggtaacttctgttctattttcagtctctgtgaatttgcctattgtataactgggatctcatgtaagtgggatcgtagaatgtttggccttttgcgtctcatttcaggtcacatgcttttaaggttcatccatgttgtagcatcagattccattgtatgactttttaaaaaaaaatgaaattttctgttgatggatatttgggttgtttctgcctttgggctactctgagtaatgctgctatgaacattggtgtacaggtatctgagttctgctttctatccttttggatatatatgaaggaatggaattgctggatcaaattgtaattttatgcttaacattttgaggacctgctaaagtgttttctgcagcaactgcaccattttaccttcccaacagcaatgcacacacagcatttcaatttctctatatcctcaccaattcttgttgtttcctgccttttgataatagccatcctaatggatgtgaagtggtgtctcagtttggttttgatttgcagttccctgatgactaatgatgttgg

SEQ ID NO: 33618 - DNA, 1027 bp, Homo sapiens
atcatcctggatttatagtgagccctaaatccagtgactagtgtccctgtgaaaggagaagaggacacggagacatagaagggagaaggctgtgtggagacagaggcagggattggagtgatgctgccataagccaaggaatgccaggagccgcgggatgtggaagaggcaaggaagggtcctcccttagagcctttggaggaactgtggccccactgacacctcgatttcggacttttggcctccagaactgtgagagaataagcttgtgttgtttaagccacccagtttgtggtcacgtggcattgcagccctaggacactaatacagatacctgttagacattggcgtgtccatgttgaaatgacaagtgagcttggatttcatggaaaagattgctgttggggttacaaagttgagagtctttagtttagagatggtgtttaaagtagtgagaatggctgaaatcctcagggacagcgtctggagaagagaataagtttatggacccagtcccgggactctcctgtctgcagagattgggccagtgagaaggaagaccagctcatgagctcatcctggcagttatctggtggaaagcactgaatcgttctcccttcctaagtatcaaggagaaaaattaggtatgggtttagagagctcctacttttaaggcactcagttacttttgttctaaactagcctcagatgacttccccccagggaacattatatatcagggaaagaagaaaggatagggaggaccctttgtcctgttaaagaatgagcaatagaagaaggctgccagaatagtcctggagcagcaaagaagctgtctcagtctttctccttccctgctcgaaaaaagagactataccagatcaaaggaggaatgagaatcaattagagagatggactctttcaaatagtcatagcaggccggaactagaaggggcttaattaaatgtgataatgtttctacaagcttaacctacagctctgcatataatgggtgagcaacttctgt

SEQ ID NO: 33619 - DNA, 1049 bp, Homo sapiens
gtctttatagtagaatgatttataattctttgggtatatacccaacaatgggatggctgggtcaaatggtatttctggttctagatccttgaggaatcaccacactgtcttccacaatgattgaactagtttacactcccaccaacagtgtaaaagctttcctatttctccacatcctctccagcatctgttgtttcctgtctttttaatggtcaccattctaactggcgtgaaatagtatctcattgtggtttttgatttgcatttctctaatgaccagtgatgatgagtttttgtcgtgtgtttgttggctgcataaatgtcttcttttgaaaagtgtctattcatataatgggttagcaacttctgtaattattattggttaatagctattttctaatcctaaattttcattgtgcagataaggaaacggagagtccttattcatatcctttgcccactttttgatggggttgtttttttcttgtaaatttgttctaagttccttgtagattctgcgtattagccttttgtcagatggatagattgcaaaaattttctcccattctgtaggttgcttgttcactctgatgatagtttcttttactgtacagaagctctttagttgaattagatcccatttgtcaattttggcttttgttgccattgcttttggtattttagtcatgaagcctttgcccatgcctatgtcctgaatggtattgcccaggttccttctagggtttttatggttttaggtcttaatgtttaaatctttaatccatcttgagttaatttttgtataaggtgtaaggaggggtccagtttcagttttctgcatatggctagccagttttcccaacaccatttattaaatagggaatcctttccccatttcttgtttttgtcaggtttgtcaaagatcaggtggttgtagatgtgtgttgttatttctgagggctctgttctgttccattggtctatatatctgttttggtatatactgtagtcttgtagtatagtttgaagtcaggtagcatgatgcctct

SEQ ID NO: 33620 - DNA, 1116 bp, Homo sapiens
gtggtatgatagagttgcctctagagactactttagattgtaagtcaacataggctgctgtgaagaggtgatatttaagtagaggcctgaatgataataaggaaccaaccatgcagcaatctgggcattccagacagaggggtggaccatgcccagggccaaaagcaggaaggagcttgacatgtttgtggaacaaaaagatgaaatccaaaagatgagtgaggaccagattgtataggagtttggattaggtgctaattgcagtggtaagccacgggaggcctttaagcaaaggagggccataagtttatgttttcaaatttcattctggccactgtggaaggaaggcaagagtagaagcagtgatactaaggtgactgcagaagagattctggtgccttttatgagggggatggtagggtagatggagtgaagtagatagatttgtgtatgttttgggttgatagcctataggcctgccagtggatttgaaatggacgtaaggaaacagaactcaaagatgacttctaggtttctggctcaagcagctgggtaaatgatggtgaactttgaagaaaggatgggatttagagaaaaggagccaagaatttcagttatagagctgggactagatgtggcttatggagaaagtgtttaagatttggcaaaaacaaaaagcttttactcagtgcccccaagaacagaggacatcaaattctgtttagtaaattaaaaaaaaaagtattataaatgtatagttgtttccataagaagggcccatcaggagaaaaagtgcattagaaaggttgggaattgaaggagtagaaaatagaaacaggataaataagtcagagaaagatacacagataaagagctaaaaagaggaaatgcagacaaaagagacagatgtgcagaattagagagagaaggggcaagcacactcacacagactcttcactctcttccattctaacctggagccagagagacactagaggcagttgtgagatcaaaacttttttctttattataattaactatggagtgataacaagacacagaccaaaagcaaataggaccaaatctttatctgaaacaggaaagttgtctttattc

SEQ ID NO: 33621 - DNA, 1059 bp, Homo sapiens
gggcatcttgccctttgttaggctgtaaacacgatgctgtcctcttccctcctactcctttgctgcttttattacttgagggttcactttgcggatttgtttttctgagccctatcacttttcttgatagagtgtctactgttaagttgccgcctacggcattgcttcctgtggggaacctagctagtgtgtgtgcaggaactatttagacaaagtagttttggtcaaggtattataggatttttttttttttttttttttgagacggagtttcggtcttgttgcccaggctggagtgcaatggcacgacctcagctcaccgcaacctccgcctcccgggttcaagcgattctcctgcctcagcctgctgagtagctgggattacaggcatgggccaccacacacagctaattttgtattttttagtagaggcgggatttctctggttggtcaggctggtcttgaactcccaacctcaggtgacccacctgccttgttctcccaaagtgctgcgattacaggcatgagccaccgtgcctggctataggattttatggtctgtgacactaggttcccgactgaattgttccaggtgcttacctgtgaatgggaggaggttttatcaaccattaagagttttaatccatcattagtctgtataaaaagttcttaatgaggagtattacattgactgtatagtttcaccttaaaatttcattttaaaatagtttcatttgcttaaccaaaatattctgaggggcatctaggggccaaaaactactcctcatgaggggataacagtggagagcaagagaaatacatattctgccttccttaatcagatgccttaatatgaaaggtaaactttattttccttttttttaaaaaaaaaaaaaaactggcaggatcaactagttaagaaaggtaaactttacacaggtagtttcacaagtgatgaagataatgaacgtgaagtacagtatttaaggggagctggaaaggactgcactggggtcgtctgcctggcaccccttttctaggaatctcctcttataccca

SEQ ID NO: 33622 - DNA, 1047 bp, Homo sapiens
cctgccaccatgcccagctaatgtttgtatttttagtagagacggggtttcaccatgttatccaggctggtctcgaactcctgacctcaggtgatccacccgcctctgcctcctaaagtgctgggattacaggcatgagccactgcgcccggctgctttatgaatattaaaactgctaaaacaaagcctgtcctctgtatcatttgtttctactcaactgatggacttttatcactaatgacagaggagacgaatgtaatgggttaagataatacacatcagccctaggctaatcacttacgaaccagaagggacctcagagatcacatggcccactctcctcattttgtatatccaaaggctccgtttccccacctacatgcttctgagcgctttcatttgtttgttcagtcacttaggaacacttactggtactatacttactgcatgctaagtgctgggttggatcctgaggacacattctttgatttcaataatcctacaaatctatgagaaggaacagactgacatactgcgaactacatacaagtgagtaagtggggcagtcgagccacaaactacaggagctttgaggacacattgttaattctgcctaaacattttcatctttcattgcaatggatgattaggaagcgcagagtttcactttggttttgttcatggatgtttagaatgtttaagtaggaaaagaagccaggtgcagtggtttctacctatagtcccagctactagggaggctaaggtggagggattgcttgagcccaggagtttactcagcctggacaacacagtaagaccctttgtctaaaatatatataaaataaaataaaaataaagtaggaaaagtatcagaggcagcagttttcttaatgggggaagaatacaagagtatagttttccttctgtgcagtaatttctccatcaagttcttttatacagtggcaattctatgtacatataatcagagaaagtgttccatctatattttacagtggataattttttacttacatcaacaaaatactc

SEQ ID NO: 33623 - DNA, 1040 bp, Homo sapiens
gcttttattttcatatattattttttcttttcatttttttctttgaaacagggtcttactttgtcacccaggctggagtgcggtgttgtgatctcagctcactgcaacctccatctcccaggttcaggcgatcctcctgcctcactcagccccccaaagtagctgggactagaagtgtgtgactccacacccagctaatttttttttgtattttttgtatttgagatggaattttgccatgttgcctaggctggtcttgaactcctgagctcaagtgatctgcccgccttggcctcccaaagtgctaggattctaggcgtgagtcactgcacccggcctattttttcttacttttttttggtttattttgttgtcctttttctagtttccgagagttaaatacatagtttattcatcagcagcttcaaggttgttttaaggaatgttttaaagctattaatattcctctgcatataccgttgacttcatcctatacattttattattatggactatttgttgttaatttctgaacaagctgtcatttcagttttgatttctattttgatccaagaattattcaaaagagtatcttttaatatccagcaattcattagactttgcttaacattttcatttacagttgattagatataaaggcattcgttttattattcttttgttataaacatgatcagctatttaatttattagtaatattgacagtctttttaacttttctttcttgtatttgtctgatatgtatttttgcccggtattttgttttcaagttttctttgccatgtatctcttttttattttattttattttattttatttttattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccgccatgtatctctttaattaatatataagatttttaaaaatctcac

SEQ ID NO: 33624 - DNA, 1032 bp, Homo sapiens
attgaacctttgaatctagcattgccctagcaaatacttagggcattgcaatgggaattgaattttatcaaattgaattcagatatgtaaacagataaccgggtgaagtgtgattagtgatatttgagagagttttgcacagagtgctggggaacacaaagggcagcataaacaactgccacagggagcctgcgggcctcccagaggtgtcattcgagctgtcttgaaagatgagaaggtgcttgccagacactcgaggggggcacacaatctccgcaggtcacatttatgtcaacgtgtttcttaagagaggcccttggatcctctaaatcctgtcgtttctttcatttatgtaactttagaaaaatgaatgcttgatttaccagcagctttggatcaagcctatagactgtacaggcttctcttccagcaaacgatcatcttagtacttctaggggataaagccaaaaaataccccaaaccaaccaaacaaacaaacaacaacaaaaaagctattgaatttattacccctacaatgtccattttaatcttctttttccttattaaaataaataaatttttttttcttctaaattggcccaagtgaagccaagatttcgttcccatgatcctttcatcatttcaacagacgcacactgaatgcctcccacggataaggcactgctccggactctaggctgacaaagaacaaacagcaagacagtttctgctcccacggagaccaaaaattgacaccaaacagaaagctaaagtcagcatggaaaatgtcctccactactgtttactgttaaagcataatctattgtttacatacatgcacacagattaagtgttaagcttcttgaaataaatgactaattctgaactgcagttcagaggtccaaggaacgatgaagaaggctatcctatgactggaagatttaccaggaaaaggaaaaagcatccttagtctaaacttcactgggcacatattttaagaagcctcagaaagttcattccatgcagaaaaac

SEQ ID NO: 33625 - DNA, 1384 bp, Homo sapiens
caccttatttggtttgggattattagtatcattgaattaaaaggaatcttaacaagtttgctgtaatctttatctggcacatgcactctctgtgcagcttacctctccaaggccatcttcactttaaggaatttaactatgaaggaaacccattttaatgttaagcagttctaacatgaagaactgaaatttactccctgtaattctatacaaatggtctttgttctgcctctgggagataatacagaatttcaaattcctcttccacttgaaagccctgaaaagtagttgaagacagcaaccaaaccttctcctcctgccattccccaagtgagatatttgaactaaaaccccagagcgccctcctgttcaaaaactgaatgaaggctctattttcaatagagaaatagattcaaaagaccaaatgaagatcagaacattgtgtggtgggtatttgaagcaaagggaaggaaattaggataaaggggttttctgcagggattcagtcagttgctggttggtctgtagtatatgaaatttcagctaggaaaagatttgaactcttgccacacagtgtaaatagcctcattgctttggatcattcaacctacgaaaccttacctatgaaataaaagctttttctttatcattcttgccaattctaattttataatttaataactttccttacttttaattccaatattcccagttgccctttcatttcttagagtttctggtagcactaatctttcttaaattcaacaggggatttaatgcttttgttttcagttaagttagatgtacgtgccttccacaaaataacaaggtaatgtaatttaaatacattgtcagtgcattcttggcgtagttttgtctcttccaaagtatcctatttcacaattttgattaatgtgaaaaagatttaattgcaaacctggattgtcatctacatcataaattcctctatgctgtgaaagtgagtgtattgctgtaaatttaaaggatcttccagagttcctaagtcacagaatctaagatttttatttcaaggtttcttgattggtagcttcccaatgactgaggtaatttctaaagagagcatcaaattaattttgggttccttttgcaataccgataagtgttccatctatttatttattttatttttttatttattttaagtcagaatcttgctttgttgcccaggctggagtgcagtggcacaatctcggattactgcaacctccatctcctgggttcaagcgattctcatgcctcagcctccccagtagctgggattacagttataggtgcacgccaccatacccggctaatttttgtatttttagtagagacgaggttttgccatattggccaggct

SEQ ID NO: 33626 - DNA, 1025 bp, Homo sapiens
ttagcagtattagaagccatcattatgtcatctaaactgagtctgttttagaaacttttagggattttttgtgcagagatgattactgtagcttcattatgtgcttttggttctccttgggattggcggggggatctctctaagacgaagttatctttatattaaaaacaataaaattggatactactgtgtccagcttggtagacaaatgagcaaatatgtgactaatgattaacagatctaagagagaagagctcttgaaaccaaggatgtagttaccaccccaagttgagaattgattgaagtcacctgtctatccatgagcctgatcattcattaaaagttaaacaacagattgcatctaatttttttttaaaggttaaaatgacagttttacttcccctcttttcattttttccttagggtttctgttcatgcaacataccacaattctttctttttttcatttgagtcttacgagtcagattcaaagagagggcagaggaaatagtgtagggtttggacagtgcgtttcaagtccaggctccattaccaaatggctacatgacctagtgtgtgaaattacttctttgagcctctgtttttttcactgtaaaatgtataaataataatacctacttcaaggccaggcgcggtggctcacacctgtaatcccagcaccttgggagactaaggtgggcagatcacgagatcaggagttcctgaccaacatgatgaaaccctgtctctactaaaaatacaaaaattagccaggcgtggtggtgcacacctgtaatcccagctactcaggaggctgaggcaggagaatctcttgaacccaggcggcggaggttgcagtgagccaagatcacgccactgcactccagcctgtgtgacactttgtctcaaaaaaaaaccaaaaaaacaaaaaaacctacctcaaaattttatgcacagttaaatgagacaacatatataagacacttagcacagtggaggatttccataaatagaagctcccttca

SEQ ID NO: 33627 - DNA, 1033 bp, Homo sapiens
ctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctagatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaactttggtttcatggtctctgaagtcactgactgctatttcagcttgtttacccttacctagcattaagactccatctacttctgtgcagtatatgaaaatttttaaactttcatttagactggtggataggactgaccattacaaattgtcgttatcaattttttttcctttttttttttaagagccaagttctcac

SEQ ID NO: 33628 - DNA, 1049 bp, Homo sapiens
tataattactttaccttagagtcaaatacagtatatgactgaaaataaaatgtttctaatatttaatatatgaccaccttttacctttcaaggaatgtatccatttcatttaggttgctgactttattggcataaaagttcttcattttatttctttattgtccttttaatatctatagaacctctctcattcctgatattggttattcatgtatttttttctttttccctctgattagcctgtccagaggtttatcagttttactgattgttcttaaagatccagctttttgtttgtttcctttctatcctcatctcctactgctcagcatccccctccccctccactccagctatgtaggcctccttcctgtccctcagccacaccaggcaccctttttactggcttcaaacagctcatgccacatgggattcatcatgagagttcagccgctctatgtatgcctcactgatcatacacttaaatgtccagcagtgtcttattgtagaaacatttctaagggcttattctcaacttctgtacttaccaaaccatttgtgaactggcactgctttaaaggaaagttttattttacagatatctaccttcatatttggaaaacacggttgttcatggtatttctagaagtaaagttaactatgttctctaaagggagtagcttttatgataaatcaggtattagcggagagcctttatttgctatttcttcagcgttttttattttcaaaagcggtattctgggagtgaagggggagttcactaatttatacctttggctgtgtaggtatctgcattagttaccatgtatagccatgaagaagatattgatagtgccattgaggtcttcacacaagctatccagtggtatcaaaaccatcaggtaaataaatggagtaaaatgttatgagagcatgtttttacataaaaataaagatggagtagtgaaaaaattcaggcaaacaagtattacacgtcactattttaaaagtggaatactatttagattatcaaatgcatttttttagta

SEQ ID NO: 33629 - DNA, 1050 bp, Homo sapiens
taagcgaatttggtgcccttattgagcttggatcatatgtgctactctaaatcagagtgtgttcccaaaactgaggtgggttggtggatgctaagcagtcacaagtcataaacttgatagttgttttggaatagagtttgtattaagccaccaccttgctccacatcactgtgttaaggaatagagaattagattatgactcctcatgttctcctttcagaatactgtatgtactatataattgatatgacttgttattgtatagaagatttaggaacattttttgcttttgttgaaggtcatcaagaaaagacagtcttccagtgtcaatagatacattggcaaacatatatatctatataaatgtgtgtgtttgtgtatattatgttcctgaactcctgttctatcacagtcttagtaaacacttgccatcgtcagatagtatgtctctaaaagtagatgttgaggctcttgaaaattctgctggtgctacatacattcggaagaagggtggaaaagttactggagatagtcaaccaaaggaacaagggtaatatttttcattgtaacgttctctaatgctgattttaaattagacaaggaataaaaaatacattctcatagaaatttcatgtgaataaagttctagttctctttgttccttttccatttctctcactgtgcccagctctttgtccttatttccttcccttttccctcagcccaaaattaacctctggtattaatttaatctattattccagaagtttttctttgtgtttacacacacagatggtttacaaatattttctttaaattggtttatttattactattttttttttatttgtttgtttgttgagacagagtcttgctctgtctcccaggctggagtacagtggcacagtcttggctcagtgcagcctccgcctcccgggttcaagcaattctgcctcagcctcccgagtagctgggactacaggctaatttttgtgcatttagtagagacagggtttcacccttttgaccaggttcgtcttgaactcctga

SEQ ID NO: 33630 - DNA, 1023 bp, Homo sapiens
tgcaggggctccagcaacaaaaaagaaacagcaacagaaaaagaagaaaggtggaaaaggtggctggtgatgagaatattcttgttgcaggctgtttttaaactagtgtcagtgacactaggaatataataaaggtaacacagcaagaagcacagaactactccctcttcatctccatattttcataatttcttgtgtttcaaatagggaaacatcttcctcaaagtctgcctagtgagatatggcctactggttgcctcatagctttgtacagattatgaggactgaaaataattgggcatttacccatcttggtatctgttgtatcctttatctgtgtgtgctgatttgatcttttttcagtttcacataccttatctaaggtttcccaggatttaaacagaaactacttctatgatttcagctggagtctgaagatacttgtttctgttcaagtcccactttaaattatgtcttaggagactgaaagtggaatcttctgagcattcctaaatatctgcttagaaatatcatgtgataaagagggaccttcttaatacactgatgttcttcactaaatggatggccacaagaaaaataaagtaaatgtcttaaataatttaaccataaattttctgtcatgtgatactggaatatgggatacttttcatgtttatatatatatatatatgtatatatatatacatatatatatatatataaacatgaaatatatatatatggctcctttgtgccccatgtcattttcagattatggtagcatgctgatacagcaccatgaaagaactcaaggaaaatatatcaatgtaagaagttcactcttagacccagtgttctgaggtcacatgggtttggactgtctcaatcagaaagattaatgactgttatcaagaacatgaacattggcttcctccatagagaagaaatcagtatctgagttgcataccaggcagtattaaaatctaacaggtctgtttggcccattgatagatactcaaatgg

SEQ ID NO: 33631 - DNA, 1020 bp, Homo sapiens
atgttccccagtaactgatcctacctcagtcccttctccagtaagtcctgggaaatgaaatcattctttgtgttatttcagcatccccttattacttagaaaaaacactgaaaaagtgaagctcttttggaaaaattgaaatactttttatagtctataaatacaatttataattgaaatttagggaacaggttaccttaatgatgatgtcaccaatctctgttcctttactcatgccagagtcacttaccatgaatgagagaaaaagctgtttggtaagcattaaaattctctgtaaaattgcatctgcccagaattttattctctctatagatcagtattttacaaattaaactaacttttatggggcatatctagatttgcatgaaaatgaacttacttgaaagccaattttacagatgaatgagttctacctttaacgtctttgtgttacagaggggtaataccacatagcagttttgaacttgagttttggaatcagatagaacctgaagttgtctctgtcatggattatttaccaggtatgtgatcttaaacaaatttcctaactccctgtgctgcagtttctttatgtagaaaatgggttcctgcagcattcttgtaaagattagatgataaaatgtatataataaagtatatatttgaaacaaaaatttttatttagaaatttagctgtggctaggcacagtggctcatgcctgtaatcctagcactttgggaggccgaggcagatggatcacgaggtcaggggttcaagaccagcctgaccaacatggtgaaaccccgtctctactaaaaatacaaaaattagcctggtgtggtggtacacacctgtaatcccagctactcaggaggctgaggcaggagaatcacatgaacccaggaggcagaggttgccatgagccgagattgcaccactgcactccagcctggggtgatacagcaagactccatctcaaaaaaaaaaagaaaagaaaagaaaagaaatttagctgtgtt

SEQ ID NO: 33632 - DNA, 1088 bp, Homo sapiens
gaaccttggaaattacctcttccagtcttcttctgtaacagcccaggaaaatgagcataggaagactaactttctgaatgttgcccagctggtgacctgtgctccgctagacccttctcagtggggcagtctgtcattagtctggtaggaaaaatcaggagggcagtagtcataatgcaggcaggagctcattgccattttgaatgggcatagactgtcctagtaggacaccaattctagccaaagttgcccacgggaaccacccaccactgcttgcttcgcttgaaagaaaacaagggctgggagacagctgcctctgattttacttcttgccttaggaaggttccagctaattttgtgtaacatagttgtgccggctcttccatgaaaattttgtctttttctttgtagaatcctcagtccttcagaaatattaatttctaaactgactgttctgcttatactttcccctcttttttggttatttaattcctgttataacactcaagggctgctactggtcttacatttaatttactgcattttattttatgagatttctgtggcttcttgttacaggactttgtatgagattttgtggagaggtcctggttaactttaaagaactccttgggttagttggctgagaatcattggctttggttggctgctgagacttgtgggaggaccatttgaaagcgcctacttctccaaggtacaccaagcaaacctgatttctagaaacgaaggtggaagatctctatagtcaaatgtatctgttatttctctgcaaagctctcagccctttgcttgacaaatgtttgctgttacttcgtttcttctctcgctctgtctctcttaaagaagatataaatcaaactgcctgggtaaccttggccttataaagcttttcaactatttccagtaagaaaacagttgagaagtttctctgaagatagtctaaacaatttcagattaaaagaactaaaaatactttaaagctactcagacgttaatcttagcacaagttttattgttgtggctattcatatctcatcagacattcaaggagtaatttgtcctgtggt

SEQ ID NO: 33633 - DNA, 1062 bp, Homo sapiens
gcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggtaagagaagctttctagtccataagttcagttctcttttctgattgttacttgagtggttagttaagtagtgcttgagaaaaaggactctggttcaaatccaggttccattttgctatctttgtgaccttgcacaagttgtttaacctctttgttcagaaatttctccatggagtaacaatatctaggttgggaggattatgtgaagttacatgtaaagcacagaggaacagccaagagatcttaccgtggtcttactaaagtacatatcctaacttggggtttaccttcagcaagttagactggccgtgcatggtggctcacgcctgtaatcccagcacctcgggaggccgaggcgtaaggactgcctgagcccagaagttctagaccagtctgggaaacgtggaaagacccccgtctcaaaaagaaaacagaaaaaaaaaagtttgtgtatttatttctgtgacagtgaacacatttaagatgcagtgtagtttctgaaagaaattgagggcttatataaaaaggaaaactcagtgatt

SEQ ID NO: 33634 - DNA, 1052 bp, Homo sapiens
ttggacttcattttattgctggtaatgtattgtatgccgccattactttttacttaaaaattttctttgccggctatgcacggttgttcacacctgtaatcctagcgctttgggaaaccatggtgagcggatcatcggaggtcagaagttcaagaccaggctggccaacatggtggtaccccatctctgctaaaatacaaaaattagcctggcatgatggcgggtgcctgtaatcccagctactccggaggctgagacaggagaatcacttgaacccgggagacggtggttgcagtgagccgagattgcgccattgcactccagcctgggcagctgagcgagactcagtctcaaaaaaaaaaaaaaaaaaaatttctttgccattctctcttggtttttgttttgttttgtttttatttttaagggaattaatttaaaaacttaaattgagaggcttgtatttgtgtatttttcactgcggctttaacctcctaggctcaaacgatcctcccacctcagcctctggagtaggtggcactgtaggcttgtgctataacatgtggctaatttaaaaatttttttgtacacagggtctcactaggttgcccagactggtctcaacctccttagctcaagcaatcttcctcacctcatcctcccaaaagtgctaggattacgggtgtgaaccactatgcctggccattcttctaagaatatttttgatacgtatgtgtaaagcttgcagaactctttccccttttgtcttggcttacacctataaattcatttcggaggcataaaacagacaattggtagatttataaagaagagaacctgttactagaattgggaaaaagaatttaaaattgtttgtacagggcaaaagttaatattcaggtaggtactaattagaaaatcttgatgaatatattttaatataagcaagacttcatggcaataaagtaaaaattacgggagaaaaagaacggagcaaataaatcatgccatcaaattttaaacagaaaatttctacatcctccctttccgttcac

SEQ ID NO: 33635 - DNA, 1051 bp, Homo sapiens
aaaagttgtttgaacatggcattgactgggaggccaaagatttaaagaagcggaagattcttctcttaagacatgaggagtaagttgtgtgataatggtatgtgttttgtgtgcatgaatggacattgtaaatgttgaattctaggctccgacaatcattgtcaacagaagatcaagctgcaaatatttatgttttaaaacttaaattataaagctagttaagtctttctaatgactagttttaatgttcatgggtacattttacctaagttaccgtttacattgtatagaaaaagatacatcttaagcacagattggttattaggaattagtttggggaagaggtttttttgtggattctttcatactgcaaagaaaaaccatttgccttttggggaattgagctaacttctaatctagtcttaagactagaatgctaaaaacaaaaacatgaaggaaattaaaaccccttattattaaattgatttgtaaaaacattgttactggaaatttattggacttgaggccttcctccagaaaataaggacttgattgtcaggcctatattaggttctgaaccttaatgccatgtatttgtacttactaaaaattgtttcaatgaaaagtacattagcagtatgaacttctggtccagttggaagtttttccatttgaaaaatgtgatgtttgcatggaactgtttgaaacttttttattttctagtccccctcccccacactggatagaatttagcctagaattttccctttggataaaagaacaaaaattgaacatgttatttgtaaattgatgtttagtaattagtgataaacttgaaatactagcatatattataagccttaatcttaggtagtcttatgaaaatgaatctcttaactatcttttgaacctgtattcacattggttttcaagatattttaagttatattttttcctcttttcagagctgcttcttattctggggctacttttttttttagttgtgtaattcacaaagggctgcatttttttttttttttaataaggctta

SEQ ID NO: 33636 - DNA, 1023 bp, Homo sapiens
gtgagccgagatcgtgccattgcacttcagcccaggcgagagtgtgagactctgtctttaaaaaaaaaaaaaaaaaaagtatcacaggtagaaaagtcacagcatgttgtctgaggtaacagtccagtatgggtagtaacccaaagcatacactgcttgatgggaggtgcgggagaaattggacaattcacacaagattttaaatagtaattacttcccaaccacaagtccccttaatagttttcatatgcatatcccttttcagtagcaggcctggaattagtgaattttgattcatgaagatgttttattttatgtatttatttttttttgaaacagtctctgtcgcccaggctggagtgcagtgtcatgatcctagctcactgcaacctctgctgcccgggttcaagcaactctcctgccccagcctcgcaagtagctgggatcacaggcgcccaccaccgcgcctggccaatttttgtatttctagtagagacggggtttcaccacgttggccaggatggtatcgatctcctgacctcctgatccacccgcctcagcctcccaaagtgctgggattacaggcatgagctaccgtgcccggctgttttttataaaatgagacggagttctgtgttgcccagggtggactcagatgatcctcccacctcagtctccctaaatgctgggattacagatgtgagccaccatgcctggcctgtgtgtttttttttttttcttctcccagacggagtcttgctctgtcgcccagactggagtgccatgtcatgatctcctttcactgcaacctcggcctccaggttcaagcgattctcctgcctcagcctcctgagtaactgggattacaggtgtccgccacaacacccagctaatttttgtattttagtagagatggggtttcaccatgtggcccaggctggtctcgaactcctgagctgaagtattcctccgactttggcctcccaaagtgctgggattacaggtgtgagccaccacgcccag

SEQ ID NO: 33637 - DNA, 1123 bp, Homo sapiens
ttacaaaataaattatttgatttttaagtttaaattgactgtagatactttggctattgagaaatgaattttgatttttttttactttttaatatcaagtgatcttgtgaatgtgatattagttaatatcacaagtaacttcataagatgacttcaggtaaaataaacagagtagagatcataaatatgaaatatttatatagtttaggtgtttaagcaccattctaatgattttgggtaaagtagctatagttcagcttcctggggtaatgaaacttatctatagtttagaagctattcatcttaaattgcctataaaaaaccatggctatgtatattacaggcaatgccatgtttttcttacaatatcaatggctaatccacatggttgtgagaaatttctttcccattatgtgacagtctctactgaaataaattgccccaactgttatttaggtcataccttacacatgtgtgattgtctgctgtgttttctaccataggacctaacttctaattttggtggccatacttgactggatcagggtggggccaatttgttggcctgtcactgatgtgcgaggtgacctgatgaagccaaaatgggaggctgatgattagttggactctgcatattgtcttagaaaattgatgtgaagatgggggagtcagtagttggggagtagaagctaagaaggtctcacagatataagatgacagaggtcacaagatataggagtggagacgtggaggtgtggtggggcacttcctactgctgaagggtgatgggataatcttgagggttgtgctacatcctccagcctctgtgatgcccagctttgcagctgtccctggatggtaatagggagtgatctgttgagatcctcttgcacgtgtatctacttgtctctgtatgtctttccccacccctcacctgaaaagtatctgttccttataaatatgatgtctgctttttagattgcagctctctcagccatgctgcatttttatcaccagtcttttgctgagtatttttatgtaaagacttattcttcttatcctacctttaagaattcaaaatagaactaatgatctataacctaaagttggcattctcatgcat

SEQ ID NO: 33638 - DNA, 1064 bp, Homo sapiens
gtgccatctcggctcactgcaacctctgcctccagggttcaagcggttctcctatctcagcctcccaagtagctgggactacaggcgtgtgccatcacacccagctaatttttctgtttttagtagagacggtgtttctccatattggccaggctggtctcaaactcctgacctcaggtgatctgcccacatcagcttcccaaagtgctgggattacagatgtgagccaccatgccccacctctttgacatttttgtgtagttgctcccctgccatgtatgttcacgtactatacatatatctgtgctttagacataaaagagcaacaactttcactctgcccaaacaatttttgctcaccttccccacgcttttttttgcaatattcctcctgttgagaatatatgttgtagacctctacatgtttaaaataataccattttattcggcagtatgtttaagaatttgcttaaagaagtgcggatctatgcacagaaatttattgatcgaggaaaggattttaacttggagttggcaattaaaacacggatcatatctgatggcctaaaatactctttagctactggaaactggggtgatcaaaagaaagctcatcaagccagagctggagtatctcaggtaagtgtgccaactatgactacaggctcaataggaaacatgtttataggactagtagattcttttgtttgttgaatataaattattttgcttttctttcttggtcaaaggtaaaactactgggtgccgggtgtggtggctcacacctgtaatcccagcactttgggaggccgaggtgggctggatcacctgaggtcaggagtttgagaccaacctggccaacatggcgaaaccccatctctattaaagatacaaaaattagctgggcatggtggtgggtgtctgtaatcccagctactctacttgggaggctgaggcaggagaatcgcttgtacctgggaggtggaggttgcagtgagctgagatcatgccactgcactccagcctgggcaaaaagagtgagactccgtctcaaaaaacaaaaa

SEQ ID NO: 33639 - DNA, 1028 bp, Homo sapiens
tcatttttacgtttagtcccctagaaacacataccagtctgctatgggtaagcaggctatgggagtttacatcaccaacttccatgttcgcatggacacattggcccatgttctctattatcctcaaaagccacttgtgactacacggtctatggaatatctacgatttagagagctgccagcaggtatggtcagttttgctctacgttatttaagatccttctgtgcttaaggcacttttctgggtgcttgggaggattaaaaaataaatatgacatagtgcctgttctcacggaatttataatatggtgggaaacatgaacataataaaaaggtaggtatgtggaaagtgttttggtggaggtacaaagtcctttggaagcacagactgatggaagcaattaattcctgttggaagtctagatccagtttcatggagaaggtggcattttagattggagcaaaattgatgaaggggtatttgcatttgagaggtggtttaagcaagggcccagatggacgaagacatgcaaaatgtacggtacagttagtcatgtcagcttagtgggagtggagtgtaaatatatggaagtgaaagcttggtctcagtgtggagagagcttgaacaggttgaattttattttgaaaatggagacccatccaaccttttggatcagggaagtaatacaattagaaatttgttttaggaataccattctgacagcggcataaagagtagattacaatcaggtactgtattaacagggagctaatttaggggtttttgcagtagtataaatgtgaaatggcaaggtcctaaagaaatgaaaaagaatgatgggtaagataccttttgaaatacacttgataggacttgatgactggttgagtgtggagcaatgaagagaggaattggaaatactgttggtgtttgtggcttgggtgattaaagagaggtgctttgaataggttgggggaaaaataagattgggaacatgttagaaggggaaagaggttttagaggtaag

SEQ ID NO: 33640 - DNA, 1035 bp, Homo sapiens
ttctcttgtaatatagaaatcagaagatgacaaaaaacatatccaaagtcactcgataaatgtctgtcatggaagaatctgctttcccagtgctgattccaatgttcttttccttcatagacttttttttttgttttctgtgtgggctgtagtattagagttcagaatagtttgtaatatttggaataagggtgtgattcatggtatagagactcctgtggccttctctctgacttggaactgattcatgtatgtggtttttaatctttgttggggattatgtgacattccgtgtctatttcctcacaggcatgaggcatgccatttacgacaagctggatgatgatggtttgatagctccaggggttcgtgtatcaggagatgatgttattataggcaaaacagtcaccttgcctgaaaatgaagatgaattggagagcaccaatagacgctataccaagagagactgtagcacttttctcagaactagcgagacgggcattgtggatcaggttatggtaactctcaatcaggaaggatataaattttgtaaaataagggtgagtacaactttgttcatgtagctagttttagaaagtaaaccaaatccacttaactaacttatttttatatgaatttaggtacgctctgttaggattccacagattggagacaaatttgctagtcgacatggtcaaaagggtacttgtggtattcagtatagacaagaggtaggtatctttgatctccctcatgcccaaaccagttttgttaaatattttttttttaatcaaaatttgctttaacttaagagctcaaagatgatacaggttgaactttttgattttattgttgaataagtatatgaacataccatgtttaaacagaatttgggacatacagtaattcagttgggagaactgaaatgtcagttctagtttagtatatgtatctttgagtcccttttaaaatttttctttgtaggatatgcctttcacctgtgaaggtatcacccctgatatcatcatcaatccc

SEQ ID NO: 33641 - DNA, 1047 bp, Homo sapiens
tgagggactcatagtatcaatgtcagaggacactgtgttagtccatatgttttattttagcagtccttctatgttaattccttgccggctactctcttttggctcagtagaagttactctggaatgaatttttcctccacatacatcatttgtgcgtgctttttccattctacttgggtgctggtaatggctgaattttgattcccaatctttcttcctagtatagctaattgtacattctgaagatcatatttaaattttttttctgattatagtacatgcttacgttgaacacttttaaaatacagagatacgtaaagttaaaagtgaaatcactcaacataacataacatactggcataccactgtgttcacagagattatgtcatacttaatttttgctttgattatctgcatctgtattgtgtgtgtttaatggaaatgagattaaaccatatatagtttgtatagttatctccaatttctcaatgccattatttttttgaaagcattaagtatcataaaatatttcgtaatgtagacatactatgatttatttaaacatttacttattcatgtgggttgtcatttgttgctagaataagtggtgtcatcatgaatatccgagtgctgaaagcttggcctgttctctaatttttttctctagtacagattccttgaagtataattactagatcaaagagtaaataatcatttgactttttctacttggttacagatccagatgcatcattgccttctgtataactggtcctctgaaagttttggaaactctttcttaagaattgttaactctcagttgtgtattgttcatagctactaattcttggttatgtatagttctactatgtatatatgtatagtaacttttactaactctttggttattcttaagaattactaatgctcagctgcacatacaccaatatataaaagcagaggtcagtaaaataatcaaaaatgcaaatttactggttattaatatttaagtaaagctatgcctcatgtctttgaatttaacatatt

SEQ ID NO: 33642 - DNA, 1963 bp, Homo sapiens
aaatgtatggaacgtttgtagggaaaattgttaagatagtagaaaaccactatgagctgtagtaattaccagagttaactgttccagttcatgttgatgtttgtctaggctatttattgaggaaatttagaagatgaagattgaaggcataactttatttgcacctctaagaataattcttaaggatgactgtcagatttttttttgaaagtcagattatctctctcatctcagttttattgataacttcttcagaaagcaagttttgaagggttcttcttaattactggatagaaaagtggttagaagcacttcacaaaattctctttggagagatgttagagtgccaaagaaaagggtgaaatgatacgtatagttttattatcttctcttgcttttattatggcattttgatgaaagagtagaaagtgcatttaatgggctctctgcagttacggatacaacttacaatataagcagagagtgatgcaaaattgttttttatggatttctcattggcctcttgtttcagtgacctgaggaatgagaagtgaaacaatactctcagcttctgaagcacagtggttttgaaagtaggtgtagaaccagattggtgagtggtggtgtgtgtcggtcaaatgcctccacttgtgtgtaagatttataagtcaacatcgtgggcgttttgcccacacactatggggtaacaacctatatttgatttttatttgttttctctaatgttgagggtgtgtgtctgagtgtttgtgactcagtgattgtttgggcattttgggttaccttgtcattcttacattggccagtttctgtctgcttccctatgccttgtgaaacacaatagaaacgacaatatagaagcaagccatcagcttctaagagcaaaattctaacagatcccagacttcaagtgaaggaatgatttgtgggcgtttccaaatataacactctgaattatgagtttataaaatgctaggtaagtgtctttatatttgttaactgcttattttaaatttttcatgcattgcttaattaatcaacactttctattcataaaatttctgtattggtaaattagaaattttttgaaataatttttaaaaattattaaattttaaaaaattgttaaattttcattttcaaaaataatacttaaatttttattttcaaaaataatcttcgtgtatactgtgtggggccgcaaaatcagatttgatgaaaatttcatgtctaataactacaataactacttttatctttactctttcagcttccagacaactttaaatatgtttatttatccatagctaaaatttgttgggtgaactcataaatatttaacatgtgtttatgtatcttaatttgggtctttattgccgttaaatatatgttgtttcaatgtgggagccaccctttaattttacagtttgatataatagtgaccagaaacattttaaatgcacaggtttattttgttctttcatttttaatagtttcctgattaaaaatttattgcttcttactaaagcattatgtatctttatgtttttaaactgaaactgggtcttccagattttctctggaggaaatacagaaaagttggtcttatatttcttaaggccagaaaaagaagtgtgtgtgtaggggatggtgttgtttaacgtatgtcagtagaggattcgcaattcatagtggtcacttagaggtgcagacatgaacacacaactgcttgcttgaggccacctccttgaattctctgtgaacttggtccagactcagcggcctggctaactacatgctactctaggctcttagccattcagaaatccttggcaggacccgagggaaggaatggtggactccaagtgtcggcagacaccttctcactgacttatctgagtggatggcgacacacaaccatttctgatgtcttctgtaggggcga

SEQ ID NO: 33643 - DNA, 1022 bp, Homo sapiens
atccttgcatggcagaagggtgaatactgtatcctcactggtggaaagtggaagggcaaaaaggggcccagctatttccctagagatcatttataagggttctgatcccatgtgtgagggcagtgccctcatgacttaatcacctattaaagtccccttctcgtaatactgtcacattgggtcttaggttccaacatatgaattttggggtacaaatacatacaacccataccatagcaggagtattttccaaaaggatcttgcaagatttcattgtctgcccatctctaaggaagactttctgcatcacaaatttcgtataagaaaactttatttttctttcaaataaagtagagcctaaacatctatgaaacagatgtagatgtctttatctgtaatttttaactcttttaatgctgaaataaaatttagttgaataggtgtcagttttctatacattaactcgatttttttaaacaaattttaagaaagttcaatgggtatgtagagctatttacagatgtttgctagggatatactcatgtgttgccagcagagtttccataaatgtttatttcttttttaatacttgctacaagatgtaattttttgtttatgcatttacttgtttaatgtttcatgagggatgaacctaatttatcttgttgattacaatcttatgcatagggctagggacataggacatgcttgataaatatttgttgaatgaaataatgaaagattttgttgaaactgatgtataggtatgattttagtggctatgatatctagttgtaatgtgtaatactcattgagcacttactgtttaatcttatgcattagttcatttaaaatcctaaaaattatgttgttatattcatttttagatgaaaaaactgtgtgtatatatatgtatcttttacacacacatacatataaaacattgtgcagatttatagcgaaggtataaatcttttataattcctaggaagcatcagaacaatataataaatggctgaata

SEQ ID NO: 33644 - DNA, 1031 bp, Homo sapiens
tttcactgcctcagtcaatttattgtttatttaaggtgttttaaagaacaaatttcactgctattttataatcagctcagctaaacagcaaatactaggttaatattataatattgaatgtcttttggtataatctgacatgatttatttgtaggttgctgacaaaagggatgaaatggttaatggctagaacatgtaggcaaaatcttaaatggatttaaaattagctatcttatatttgtctaaaatactctttattccttgagacaccaagttttcttttaaaagcacatctaatcaatttcaaagtgaagaaaaatagagtccgagccagttttgaaaattatttctccttgaaatgttcagagtgctggaatttattttacagttccacctaaccaggcttctggactgaaaggaagggaatgaatagtgtctaaatctgctttaggagagagcttgtttatcgagctacacctcgttttcctttatctgtcactacgtaaataataggtcgaatttcttggatggttgtattctacgtgcacagcataaagcttgagtcaactaactgtagcaattttgattcttccgtaagctttccttttcttgctaagcttgcttctccatctaaccttcctgtttccaacaggatgcaaacagaattatgaagtttagacaattagagtcttcgtgtctatctttaaattcatgcattcagtctggaaatgaagtacgggtttttttgcaggatgaaatagaaattacagtgaagtggactgttaggaataaatggatttctttttcttttttgaagctttcaacattgtgttcggcaaaatctttcagtaaaggtaacacattcataaggattaactgtgtccaacagtgtttatcagaaaacccaacatattaggggcctagacagtacagaaatacatttctctgtcttggaaaaagaagtttagcagtaagtgatgcatggctctatgttgtcttcatgatctggagagaccaaagctcctgcctca

SEQ ID NO: 33645 - DNA, 1046 bp, Homo sapiens
atcttcttaatcttggatcttcacactctcaactctaggatttttttttttttttcagtttaaaagtcattgtgatcctcaagcagtgatactttatttttcttgcagaagtttcttatcctaagattctttttttttttaatttttttatttttttttttagagatggagtttcacttttgttgcccaggctggagtgcaatggcctgatctcagctcactgcaacctccgcctcccaggttcaggctattcttctgcctcagcctcccgagtggctgggattacaggcacctgccaccatgcccagataatttttgtatttttagtagagaaaggttttgccatgttggccaggctggtcttgaactcctgacctcaggtgatccacccacctcagcctcccaaagtgttgggattacaggcatgagccaccgcgcccagcccctatgattcttatgaggacaaattgcctattttaaaaatgtctagatcagtatcatgcatataagttcattgtgtgtacattaaattaaataaaaacatgtctgtaaaccccttttaaaagctataaggaacaacaggaggtaaatttttcttaactcagtatgttatttactaatattgtatcattaacatcatcattacactattttgtcaaaagatttgaaaaaaagtgagtttgataaatgttttaaagttagaattcattacagacaaataagtgattcaaatttttgaatgacagtgaatgaatatttttaaaactttgttctaggggctgtagttgtaattgtgtttcagttgtaaatgtctcattaactttataaattgattcctgttatttgtttggaagtgaaagcacaataatatcaaattcagctaatagctcgctttgtcagatcactgtattttagatcgtttctgatttcgtttgtctcaaattagatgaacttttttttttttttaagtcccggtagcttgattcaaaatgtgacattttggcactcagtagttaatgatactattctaaactttaaaatcaaaa

SEQ ID NO: 33646 - DNA, 1050 bp, Homo sapiens
gtgcatttgactaactgtagtctcatatcctacttttattagtggaaaaagaatctgtgcctttgaaaaactaaattcaatatttcctacaaaaatgccaacagtttttttgattctctttcttatttcttatacttgaggtcttttatgcacatacttaacacacacacataaaatcaaattttagcatgaattgaaacatgaaaattataacacagtatttcccagctgaacacaaaagtatgctgaaaaatcttaatgtacattccacaaagccaatgataaatcttgcccatagttcttagaggcagtttcattgtaaaatattttccatgattttatttcaccttccaatattttgaattcttcaggatcaaaatgtggtatttctattaaatccatattcccaagtctatcactgacacatttgccctcctatgaataatatcactgtagtctgtgatagatcacaatgtcaagaaactgatcttgtttcaatttttaactctgttgaaagaaataaaaaattccatttgcttccaagttgtggagagaagaaagaagacaattattcaaaacaatagctttaacataatatttatttatggtttctaattagttctgttgattattattcttaaaaccacaataatcctttggtagcaagtatatgttgtgtgggccagtgaacctatttgtttaagtccatagacaagatgtgtatttaagaagattagggttctttgaacatagtattagacatactaaataggtagctcaggaagacattaaatgtattttattagtgcagtttttaaagacaaagataaatattaaaattcaactccccccaaaacccaatatggatgtgttttggtagatatgatgagtaacagttgaaagtaaaaatcaaataagatatgataattaatgttaatatggtatcagtgatcatctgtagtcagtttatacaaacttattaaagattatttcacttcataccatttttcaatttatttcgcttaattgaattagaggtgtgtgtgtgtg

SEQ ID NO: 33647 - DNA, 1035 bp, Homo sapiens
agagtgtaatggtaagaacaaaggctttggtgttagacaatgcggtattgtatgttatttttgacatttactgcctttctaatgttggaaaagttacttaatgtcactgagtctcattttctcttttagggtggttctaagagttaagtaagataataaatgaaaagtgcctagcagaatgcatggcatagaatatgcatcaatacatagaaatttgaccgtcacttgaattaagagactggtttaggagcattgtaatcttatgcaataaaatcttagtggcctttaaaaaattttttttatttttttgagacagggactcactctgtcacccaggctggagtgcaatgatgtgatctcagcccgctgcaatctctgcctcccaggctcaagtgatcctcccacctcagcctcccaagtagttgggactatgggcgtgtaccaccatgcctaactaatttttgtattttttgtagagacaagctcccactatattgcccaggctgggctcgaactcttcagctaaagagatcctcccctcttggcatcccaaaatactgggattacaggcatgagccaacacactcgccattctcatttgttatttgtattaagagaaaaatatccgtttaccaaggtgtaacctcaatctccagggctgaagcttgatcctcccacttcagcctcttgagtagctgggactacaagcatccaataccactcccagctattttttgttctttttcatcttcttcttttttttttttttttttttttaaaggagacaaggtcttgttatgttccccaggctggtttcaaactcctaggctcaagagatcctcctgcttcagccacccaaagttctgggagtacaggcatgaaccattgcaccttgccctcctgtatactttaaatcatttctagatgacttatgctacctaatacaaggcctacacatttttttcatttgagtgggttcgatgtagcacttggcacacatgaaattcaagtttggtatctgggactttttggaat

SEQ ID NO: 33648 - DNA, 1031 bp, Homo sapiens
agccagggaggtcaaggagagcatctcctttcaaaagcagtaacatctaaattgacctctgaaaaatgctaggatttgccatgaaaagagtgaggataaaaatatttgaggcagaaagaaacaatgtgtgtgaagttccaaaactaagacaggattgttctttagtcaactgagttcagtagggttagagcttagacttcaaggggagttagagatgtttgggaacgacgagattgaaatattaagagagaccaaggaagggcttagtaaactatgtttcaaaggtttatttttgagcacaattccatgttgaaggtgctcatcatggaatcaagacttatctctgagcgtcatctttgctatgctcacgttataataatgatttttacattttggcagtgccacagcagtgtcctggcatgtggtatgatcattcagccatctatgacaatgtaattataatacattctttttattatgtatcatatgtgttattttgtagtaaaggtctttgtgaaattcagtatgctgagtgtctgatcatagtaaccctttcaaaattagaaaataaaatcagtttggcatgatttcactaaaagtcaccccttttctctctaagtgctaattctgtgttatatcagttatggttttaccagaaaaaaattaaggtcgccattgtgttgtttctagatttcactcttttttaaaaaaattgggcaacatttgctttcagattctccagacactgtattagcattcgtcattctcgtatcttttactcacccgggctgcttcttacctgggccagtaaccggaacttctctggtctcttattatcattttctctcttttgggccctccttttatcttaatcgtatttattctatcatagtcattgttaagagcgtttatcttaacagaaaaaagaaaaagaaaacaggagctgaggacttatgctctctctctctaattttgttctactttatacaattctaccaacttaccacggaatcacagactccttatccttt

SEQ ID NO: 33649 - DNA, 1034 bp, Homo sapiens
taagcaacctccaatttctgtgagctaaaagtgctatgtaatgtgataaagaatataacatcaggagttttgtttcaggagaaaaaagtgagataattggctgaaatggacaagttttgaaatttactagccttgagcaatgatgaataactgaaagtgctgaatcaaactggcctttgaattaaagcaatataacatactgtagaggttcgtcatttccagcagataggaggtcctggcacacacagtaagataatgtgaagaattagcttcaatctatgatttttgaccttcagtacaagtctaacttaaaatataatcttcgaaatttgcattttggaatttgtcttttccctgttccttgcaaaaccacatacatcaatatacattgatatgtggggaaaatgatctacagtggtgtaaatttaacatgcaattctggaatactaacttttgaatttcgcatatttaagtctttttatatttctagaattttcatacaggatgtgataacttgataacaaactcaacagtaatttgcaccatttcaggtaacctactgattaaatttttttatactttatagttattctaacaatgattccattttcagagaggttctctgggctttctgcttcatgcctcctctagccaccctgaacgattatatcctaagggtccgtattctaaaggttttctgacactggccttggttctccatttcatgatctttctgactttagacagagatgttttctaggctttttctatgccttacttctcttacatctttaaatgcatttgtagatacttttagattaaattgtgctcaaacatattcataaagcagaacaaacagctgacttatatttgggaggacttttacatagtgggagttctagactctaagaacatgccattcaattttaacatcacttctattgaaaaaagagatttatcatgtattgctttgatttaccacatccttactggatgtttgtggacagaatttgtagataggaaatgttctgcag

SEQ ID NO: 33650 - DNA, 1063 bp, Homo sapiens
tatatatgaatttagtgaattgtcactagtgacgattttacagattttgatcacatttattctttgttttggcttttggggctagaaattcctgtactaaattgtttagtgggatttccgcagatgtgtttaaggaatcattttgtgttatagatttttgaatcctttctgtacatttctaattcatttttgtcaattagtaaaatataactgatcttcattttagtcaggtttatttttcttgtttagacagtcttcccattttgttttttgcaagctgggactttagtaagaagacaactgaaatttagaaagaaagcctgcattttaattctttttattttttataaaaaaaatttaaccatgaattcctaggcatactgcttaacactcatattgtgctcatctgaaaaatagggataatacccaatattatcagagtagacatcataatacccaatattaaacagaacagatactgttgtgagaatacaaaaattaatgattaaaagaaattggaaacttcaagtcctgtacaagcttaaatttttattttctactgtaactattagaatgaaactaccccctatttcatttgtttatttaaaagataagtctgaattttagcaagtgtttttttgatggtttctgactacctatggatggagtttataagacctacataatattccctgaaactttactagggccaggcatctaagttcagtttctgacattgccacatagtggatgtataatttgggaccaataaatcatttattctcttgagcctcaagttctacattttctgaatgataatataagcctgaccgagttataaggactagagctatgaatgcgatttttagaacggtgcatagattagttcagtaaatgtttcatactgctttgtcttgatgaatgcagataacataaaaagtacgtattatacggcatgacccaggtagaaacacacatattagttccattctccccttctcattaaacctatttattttatttaatttatttatgtcatatttacttatttaaatactctttt

SEQ ID NO: 33651 - DNA, 1038 bp, Homo sapiens
taaaaatgcattactatgatatatttgacatacatcatattgatactatttgaaaacggtcactatttcaaaagagaaagatcacttttagagcagttgacacttcccctactccaaagataccataaacaacaaaaaatagtagatcaatgtgtagcacattattataaatacaacattattccagtcattatatgtttcttaataagagcaatgagcctatttctgtgtttgatgttgtctgttgcactttttgattgcatgggtaacaagtttattttacaactggtctgtttttaaaatagataattctgatctcggctacatttaaaaacattactaaatagatcccagaaatgttttttgaaaagaaaacctttttgggggtgtctgtgtgtctctttcattgcattgaataggcagctacctaatcagtttattagtttgcatgtgcctcatataatatatgctaaattgccgatttcagtctttatcagtggaatggggacgtgtctatactttgaggaactatgggaaaaataaagatgttgaaaataaatttttaatttattgatgattataaaaatgtgcattatttttagtttttgccttgaatttccgtaaagttttaaggaacagtacttatttttaacaaaacattttttttccttgttttttacttgagtcatatgactttaattgaaggcacaaggtatcctggagatgaggagggattttgaattggcagaacttactaaattcccacctttttttttttaaccctaaattattctcttatttttgatgcagggtttgttttaattatctcaagagattcttgtgttaaatgaaataccctctggaatgttacttagtacctaccactacaactgttaccaccgccaccgtcactaccgtcgccaccaccaccaccaccatcatcaccatcaccactgccactgctactactactgaccactattacagtatcatttgcgagacttcctgctgtgtgttttaccttaagaagcttatata

SEQ ID NO: 33652 - DNA, 1054 bp, Homo sapiens
aaggagagaggtgggggaacaataagacgagaccagtgtgttaataagagaccatgagtttgtttggagagtgagaattcacagagaccaaagaaggtgaagtgaaaggctactactagtggagcctttgaagcaaatggtttataattggttctgtctttatgcttttatctaaaaaactaggtattggattttttttttaattaaaagttgaacagtgtgtggaactgagcattatttactttaatctttcattttctcttttttccttgtctttctatttagactaaaattcttttgtcatagatgtttttaaagatttaacttcactcctaaagttttgtgatattttgattattcaggttcaaaattgctaacatttttcattatgcatattaatattttaaaatacccagaaaacaaaattctaactcattattcattttagattgagatataactataaagtagtgtaatttttaaaaaccaagtacccgagttagagtaattaatgcaaataaggcacattttacaagtagtcatcctggaaaactatatacttattccagtgatgaagatattaatgaatcatttttgaaacatttcagttgtattgtctttataatcaggaatggataagaaaataaatttcattgctttgctgaaaactacatggactatttctttctgtcacttcacctcatcgggcttggcttcaaatatattaggactttccaaaaaaatgaaatccattcacaaaagacgacagtatactattaaatataatatagacatcattgacacctccaaaacgttagtgaattaatgagtagaaatatcaactcatgtgactatccaaatttagaaccattgttgatagaattaacacaccaaacatttgctttttggaagagtggtttggataactaattgcaaagtagttttactttcaaagactgggagatacaatgcctactttgaaagcccagttttagccattaccagctgtgtggttttcagtgggcaaatcacttcatcttcctgtatcacagtt

SEQ ID NO: 33653 - DNA, 1045 bp, Homo sapiens
agtgacaaataaggtattaacaccataaagtttggtttcttgtattcagtgcatgacagatcattttcttgggtatctcttctccaaatggtgatctgtagaccaagattgtttccattttgttgttattccttctggaatatatggcttctacagttgctgtggacgtattagagacccaaaatactgggagctgtatttggaaggccaggtctgctcacattttataagccaaaactcagtcatgtcatttgcaaccttactgcaagggatctgggaagagtaatcttttctgtgtattcaggaagaagaaacaatgtgatgaacgggctacactgtctctgccatagttagtgctcctatgaactcacataatacaacccatgcttttgccctcagtggcactgtcaaataatgttactcacacctaactaccttatgtgtcttagtgttcataacacatcatttaaaattgagaagctgaagaatgaagtaggaggactgacaatacctgacttcaaaaattactgtaaaagcacagtaatcaagactgtggtattggtgaaagaatagtcagattcttattgtcaaaaaagccatgcttagggtaattaaaatactctggatgatactacagtggtagattcacattattatacatttgtccagacccatatatatttgtacacaaccaagagaaaactgtgatagaaaccatgggcttcaggtgataaggatgtgtcaatgcaggtatattaattgaacaaatgtaccactctcatgtgggatgttaataatgggggaggctatgcatctatggggcagagggtatatgagagatctctgtaccttccactcaggttttctgtgaagctaaaactgctctgaaaaaaataaaacctttaaaaaaataaatggaacaaaatagagagtccagaaataggcccacaaatatagtcaactgatcattgacaaaagtgcaaaggcaatttaatagggagaggatagtcttttttaacagctggtgctgcaataactagatatc

SEQ ID NO: 33654 - DNA, 1060 bp, Homo sapiens
taattaaggttttaatgtgtctgtcaaatacaaggatgtttgctggtcaatgccggtgaccaaaatggactatagaaagattagttcaggtaagtaaatggttaggggttgaaagaaagccgtcatctcaagcttgcatattctgtcttgaaaaaaatgcacttatatgttaggccaaggttaaggaatttgctgtctttgaaggctctgacgattgggttgctggcatggtgaaggcatggtgaaagaatccgtattctattaatgggtgaacttctcacccttgtgataaatagtatacattatagagaagtataatgatgagatttatttcctctgtttcagggaaatgaagcaatgtgtgtatgcctgtcttaacttaaaaagctgtctccttaccatttttatctgtagataaaaatggcattttttgagtttaagttataagcacataaaaatacttattaaaattttattttctttgggctctttgtaaagtaaatgaaaaaaatatattggaagattttaactgtggtgtacatagtactggtattgctgatagaactaatatcttcattataaaatagctatattatataaggtcttaccacaaagagccataatgattcaggggacattattggaactctggaatccttataaactaatggggttctgttttacttagtgttctgtttttcagtgtatgtataaaacatcacaaaatacatgcagtaatgtaatatcctgggaacctgccaaattaaaagccaccttaattgaagtgtggtgtatcacttatacggtgttgtatttattcttcacatgttgttcaacacttatttaaatttttagttttatggcatttcttaatcttagtattaccaaaccctttataataaaatttcatttgcactttttgtatttttttttcttttgttttttgacaggatttcactctgtctcccaggctggaatgcaggtcacaatcacggcttactgcatgcagccttgagctcctggcctcaagccatcctcctgcctcagcctctggagtagc

SEQ ID NO: 33655 - DNA, 1050 bp, Homo sapiens
atttctggagttatgagaatgggcttgtattacttacatgggggatacctataaaagcaggatttaaagcatagatttcttttcagtacgttttactcttaagattattcaggttttaaagaaataccattactgtttaagattatccctgtaatgagaaatcacagcatgcctcttgaaaaatggttccacttcatcttttctcattcatttgctagcacaattataaatgcatgagtgcagtgcatggctattcaggtcaaattctctttcaggactgatgttcctgttatacagtttatccatctattaacatcccgaaatgtcaaaagcttcattttttaagagtagaatgtcagtttcttttttacttagagcaatttagccagcacaaaaagggagagatttgacagtcatagctgtcagggcaaagattggctgatgatttgaggaaataggaataaatgttcaaatatatatcagggtgcctgcacttatatacctctaggacaatttatgaggtgaattggaaagacaaataaattcggtgtatgtgtgtgaaaagagctgcatttaactcctaaatttcagggttttgagaaatatttcttaatttctataaactcttttctttaaatgcttaagtgacttttgttttgaaacccagtatatcattgtcattgtaggagaaaagaagttttcaattaagtattgtttacacctcactatttgaagctgtgctctcataattttcaaaattcatttcatggataattctaaatttatttattgtaaacatgttgataaaaagaaaatcaaggaagtcatatatatatggataaggtattggatagagaacaaatactatattaggtatattctacatgtacttatttattgtgtatagaatgaataatataaaatactgaaattgctttaaaaatactgtaaattatattcagatcagtggagactatacaaactgtatatatccctattttcaagttgtcaggttcaaatccaaacaattagtttcccctgaagcctctt

SEQ ID NO: 33656 - DNA, 1030 bp, Homo sapiens
gatgttaattaaaataatatttaggaatacgaaaactattttctgaaaagttgaattccaatataattataatttaaaaatgtagtagaattttttgagttccattgtaggataatagtagagcatgctggtgtttttccactgtcatattaatgtatgtctattaaggaataaatacaacaaagaggaaaataggaaatttgttcttgcaagttaaccaaatcctaaaactatttaatgtatatcagtttacctatttttacaggtatttaaaattacatagttgtaatattcctacgttggcttcctgctttctttagtttacactgtgagtattttaaagagtattttacattttctatattgactgtggtttgatttgtgcatcaagtcaatttttgtagcaatttcatattaataactggccaaatttggcccctgtgaaaatacatatatgtaaatttttttgacacatatgaaagttatcttcaaccaataaacactttgatctgtttggaaaaagaaaaacataaactgagtatctgagaagatattgtttactatatttaaaatggaacacttctatgaaaaaaaatctaaaataaatcacaagcagacacctacatatgatatatgaaggaaacttcaaggtttaaataaacaatatagtcagtggtcaaggtacaggccttagaattagaatgattaattatgaacaatttatttagcttccctattctaatagggaattgcaagtagttacgagggtgaaagttgctgatcaaatatttctcttttcttcctcttttgaacacattcccatcaggctttagttcttaaccattttaccaaagctgttgtttttctgaaaaaatattcatgttgtcaaatccaaagtttaattctcagttcccattttactttatttcttattataaactactggccacctataatctgttctcaacacagaagccagaatgttcattttaaaatgtaagttgtatcatgttatttttctgctcagaat

SEQ ID NO: 33657 - DNA, 1071 bp, Homo sapiens
tagccgggcgtggtggcgggcgcctgtagtcccagctactagggaggctgaggcaggagaatggcgtgaactcgggaggcggagcttgcagtgagtggagatcgtgccactgcactccagcctgggcgacagagcgagactccgtctcaaaaaaaaaaaaaaaaaaaaagaaagcagaccattgatgtcttcttgaaaaacttttctcaactgtctcctggggcatcccactttccttgtatttttctggcatctcccttagttttcttcaatgatttctcatgatcctctctaatctacaagttttggagattcccaaatctccgtcttgggttttcttgtgttttctatattcacttccttggtagtctcttctactttaacattatatgtgatttgaatgcttattatttccaaatttttacctctagcccaaatgttccactctaggtatatagctactttctcaaacatcttcactaggatttttgataggcccatccaactaatatgtccaaagctaaacttctactctccactcacacccctaaaaatgtcttttttaaaagcttttacagtttcaaaaatgacaactcctttctttcattggcaaaagtcaaaaacattgacttcttcctctcatacatcacatataggatccataagcaaatcctatggcttctaccttatgtacattgagatattacctctcactgcttatgctgctgatactttgcaaccaaacgaccctcattactcatctggattattgtgtatctttgcaactagttggactggctgcctataatctattctcaacacagaagccagatgatcaacttaaaatataagttgtatcatgttactcctctgctcagaatcttatagtgggtttctgctcatgaaataaaagctagaatatgaataatagcctacctacttctaccagaattaggatttagccccttgttggctgtctgatccctcctaccattcttctcctccctccctctgcagccgcccattagcccccttgctgctacataaatccctttcagctcttgcctgagg

SEQ ID NO: 33658 - DNA, 1051 bp, Homo sapiens
tatgattaaaattatttaattatttctaactttataattaaaatcacttaatttctataaatattgtgatcggtaccattaagtaaaggtatattagggactttagtaaagtattgtaatgacagatagttctatggatacaattgatgcccatgagtcaaaacaccttgatcatgaagattttagtatttattttcaggaaaactatccacaacatttgtaaataaatatgacttttcttcattcattattaatttattcctgcaccgctttttggtctaaaaacatctatttatccttcatcattcatctattcatctattcatccttgctaaggacccaattcaataccacaagttgtgtgaaccgttttgtaacttgatttttaacttatataatatttataacttatataaaggatatacttaaaaaattgtccaatcaaagatgtgccccaacaaagtgagagactgctttgcattttcgtgtctttctacgtctgagtgatctacagatttcagtgtttatgtgttctgactggggagtcttgagaatttttcattaaaagtaaagtttaaagcctcagagttaaaatgggtgtataacattttcaatgtatcaacttcaatgtccctagaaagttaaccaactacaatatcttccttaaaacattcttaaatatttgtttttttctaagaagtaaacagtagtttctttcatttctcatcatgtattttcagccaagattgtggcaaacatatgccactagcatgcttgtgaatgtatactaacatattcacaaacatgccatgtttatgcatacacacagatatggaaaagtagaagagttatggagtaccttattttatacttggttatattatttactaatgtttctaagattttttctgtaaacgtgataaaaccaaaattggtccaacatatcttcctaagtagaatagacaaataagcatttgagactaatgtagatgtttcagtgtacctaattcattgatattataaaagttagtaacaccctgcttgggggaat

SEQ ID NO: 33659 - DNA, 1354 bp, Homo sapiens
cattatttccttggccaggataaattgggcccctcccattttcgtttctcttaccccactcatctcatcattcacagtgtcttgtctatttgatctttaacagttttatatgtgtgatttcttgctgccactgctatttgagtttacatgaaaggtttaaccttctaactgatttaaattttctctcatctgccactttcaagctgcgtactgatctcagagtcttctttataaaatatcattttcatcctataattctccttagaaatattgaattaattctatctacttgatgtatacagatcaaaatccatgggcaagattgtcctcaaacaaactccccatacaagcttctccttctctatcagctccacctcagacaagcttgctccatacttaactcatgttgttttccctgccttggaattctgctcgtcctcctccctccctccccttgcaacacttacccacacttcagtgtccaggtgaagtcccactctcttccactggacattaatgacacttttctccaaattcttatgacacacattcacatttggaacttgatccaaagataattgtcagcatacttaacagaattttattattgatttcctcaggtttgtgtaccttgtttttcctggcttcctggaaaactcctcaggggctggcaacttattttgttcttcttggaatttctgatactcatcattgtattactcatttctgtaagcagtttttgatgacatgacagaacaaatgtgtctttaataaggggacaaatatgaatatgacatgggtgaaaggaggtaagaatattttagtacctcttttggaaaattgcatgctaaaatgcatatgaaaatataaaactgtatgtacttgaatcactctatcactttcacattaacctgttgtatctccttcctttttttatttttatttttatttatttattttttatttaatattattatactttaaattttagggtacatgtgcacaatgtgcaggttagttacatatgtatacatgtgccaggctgtgatgaaggaagtacttagtgatagtacactaagtactatcagaaatgaacttattttattttttatttcttgcttttttaaaaacaatctgctatatatttaactcccatagaagaggccccatagaagatgttcctgtcttcactgctaggtcctggcattcgtatagtgcctggaagttgataagtgttaaatattagttgaatgaatggatgaattaaatacgtttagcagagtcatactatgctacgatctttctttcttttttttttttttttagacggagtctcgctctgtcgcccaggctg

SEQ ID NO: 33660 - DNA, 1034 bp, Homo sapiens
atactcattttattcctcactgaaaaatcactcatcaattgttcaaggaaaaaaagcaggatggagataagccataactaatctcaaatatcaaaatcgtttcattgttagatgagagcaatggtgggtaatagacaaattccaatacaaattatgtgaaatttatatcaaaaatttactaattcagtaacactggatttaggtggtttcattttcagtcggtgtgattttaaatacattgcaaatatatttgattttgatgcctgaatcagtgtgtagtatcagtgtgtgcctgaatcagcgtgagtgtcattgagaaacaatgacaggaatgtatttatattttgtaatacagacaaagggactgtctttgctggagataaaaaagcacttcttgttcccaatatgcaaatccattctatgcattaaatatcttaacatttagagatataatgccattccatttatgaaggcatgtttgtgtttttcttcacttgatgtatttgttaatatgattaattccttctgataagcagtttttagaaagattggagctttgcctgtgttcataggcttttggtgcagctttcccagcctggcaattcttgaatcccaagccttgtcttcttgccaaacttttggacttgcctgtagacacacctacctgctttctgcctccaccagattccatgagtgacttttgtcttgatatccccagccagcccctgactggagctcaccatgtttttttgttcttgaacatctttcagaactagaccttggcctaccttccttagaaccttctcaaagctgacaacttttgatgcaccaaaaccactttgtggtcaagttatatcctttatcatccacttaaaaaaaaattccccctcttctcccatgctctgttatactttcaccctctcccatgcatatgttccctgactccaggatttttttttattaggctgaaatgttggtggaattacttattgttatgaggtattttgtcattaaaaaactctttcaggttaaat

SEQ ID NO: 33661 - DNA, 1034 bp, Homo sapiens
aattagacacagtcaagtaatatgacttgtcctaaatcacacaacttcctagatacccagtctggactattaacaaagcactgtttcatatataatattctctaacttgactttagttacttaaagtatttccacacaggaagctattatttagataataggaacatctcattctttaggtaaagttgttttggttccctgttttttagttaaccaaggactctagaaatgacaggtaacgtgttcatattcaccaccttcactggacacacttaatattagtcaatggcaacctgagtttctccaccacctttaacaagcatattagaaaatgcaaagagccttacaaagaaaatgatataatggtgtttttctaggcatgatgtctattggaaactataatgtgatattctactaatttgaaataataatgattgacttattttgagttttgttttacagttgatcagtaaccaatttattgaagccacgttagaatagtaagggctgaaaacccaaatggatttgtctgcaggcttgctcagggacggtgtggtatacagtcactcaaccaaaggtggctctgaagagactacatttatgattttaataggctataaagtaattttagaaaattattttttaacttcctttaattgtttaatcaacctctacattaaagaaaactgttaatttcactatagttttaaaaatccctgaaattataagaccaaaatacctagtagaatatgtactattataaattgctaattgattatggtgaaggtcctaataatgcaatgattttcttttaaatgttgaattcttgggtcacttgtcatacatttacccatttgtgatttaaaatcaaaatcttacagcacaattataagtactgtatagtttagtcttacattttttccaggcctgcaatctttgcctgttaagtggcatattgagttcttttacacttaatataaatattgatatagtttgctttaagactatcaggttagtaattcatttttatttgt

SEQ ID NO: 33662 - DNA, 1041 bp, Homo sapiens
gttttaatatttatagatgaggaggcttctataaacctctgtgtgtgtgtgtgtgtgtgtgtgtgtgtgtgtctgtctgtctgtctgtctgagggggagtactaaatgcaggaatagtgttttaagaatgtgtcatagtatggaattctaaggacccttgagtactaaaccttagataccaggaaataacacccagggatttttttttcctgtgaaaccagtttttcttctgtttttctcaatctttccaacagctttctctgctcattgtcattataagtgactgtcagcctgaattgtgcaccactcctcccctccagagcaccaacaaccaactggtacttgccttctcgcctcttagttcagatttctaagaaaggaaatttaatccccattgggttaggtaaatatcctttatctaattactcatgtcactagtcattccctggcccagggcccacacagtagcaactgtgtaacagaggcaatactaggaatacctattataggggtgagaataaagttctgtggagcatgtagggggattgtctatttggtgggttagagaaggtgcccctgaagataaagtggcctctaagctgcaacctaacagacaagtagtagtttgccaagcacagaaatggaagaagaaagatactattctgagtagacgaaacagcaacacaagggcctagttcaggatgattgaaacatagaagtcccaaggataatttctagatatcagtctagtaatgatctggagaagtggtcagagatctggtcaggaagaacacaatggtataacactatgaggagtttgaaattttcctgatggtagtgagggaaaaattaagttgatcttagaggaattaagcaaggagtgacacatttgaagaattaaccaaaacagtcttcaagaccaatggagtgttcatcatgttgatgcagatagataagaaatagacgagtctgttctattggtgggtctgactcaaggagtgagtgatagtagtgatgatgatggccaaataacaggactta

SEQ ID NO: 33663 - DNA, 1040 bp, Homo sapiens
taaaatttgtgttgtagtaagccacttactttgtggtaatttgttactgcgcaatagaaaacttaatacattctcttcttccattttcaagttcattctcctgcctcactctagtatatttaacgtttattcttccagtcttactttcaaagtttacttaaacatacctgtatccttaatagaatagaaaatgcttcacgtttttaaccatgcataaatgcataggtggtggtgtgctattcatcttatttactacttttttcacacaatgctatatttaaactgcatctgtattgctataaagtttgttcagtgattttaatttcaacatattccattatttgaatatttcactgctgtatcatctttcatcttaggcatataccacattttacccatccagtctcctcaagactttgtctgctcatattagtccactctgtgtttgtatcacagtctacttatgtgatggaactacttaggatgcttctaactctttatgattaaaaacaacgtgacaagcgttgtactggatgtcttcttgtggatcagtgtgagtttccttgggaatatatttaggagtagattatacacataggtaactttactattgagcaacattgaccattctccagaatgacggcatcagttttcacttgcaccagtgagtcagctcccctttcttcatagctgcacccaaccttaatggtgttcagttttctgatattttttatatacctgagagacattaggtggtatctcattgttttgatttgcatttctctgattactaaagagaatgaacttttcttcagtaccaattagctatttggacaacaccttctataaatttattctttatagtctttacctatttttctctttgtatttttttcatcctagcttttaagaactactgatggtaagtaagcctttgccattttcaaatgtgcaaataacttcttcctgtctatctccctttagatacatgtgtacagaaatctttcattgagacgtaatcagaaaattctgttttttcc

SEQ ID NO: 33664 - DNA, 1048 bp, Homo sapiens
ttacaacgtgatgtggtttgattgaagcagaaaaaggaatgcagtttatcccctcatttactcttttttggtttgaatcacagaaagccatttgagattttaatcatcctttctactttctccttcaataacttattgattcaagtaaatgtctgtttttaataatatgttttcagcttcctctaataagagttttagcaagacttaatgaaataatttattttgaataacatagagaacagatgctttatgagattttaaatttgtgttctagtaattttgaaaatactcttgtttaaaatcattttggatacccccactttcttgggagagccagagacaggtacggagacaggtgacctatggatgaaactgtggtatgttgtctcatggtatcatattttgttttgtttttccatcatagttcttgtggacattttggggttatttaaatgttatgtatttattgatttttaatgtttatctcctgcccccatctactttgtgaatttcataaactgatgaaacaatgttttattgaccactgaatactcacccatctcaaacggtgctcaatttttatttgttggacaaattaatgaagttaatcactgcggtgaagggttgatatttatcagtcaggaatgtcagaatatgtatttctcaaccaccattttgaaaattcatttttctttcacaacttgtgtttaattatatgtttaatgaattgaggaaacatatgtgtagaaatccagaacctttattttaatctagtctagaaactagctgtgtggccctgaaaaatgtattttataaagactttctattgatttttttgtgggagggaaaatgtgttttattaaccccaatggtatattttgtggttgagctgaacaaatataatagagtgctttacgtgccctgtgtcatttcatgacagttttccaacatataatccttggtaaagccttttcaccggtttcctgtgatttctttatgtggtttttgaagtcaattcatatagctttagaaagttaagtgtgtgagc

SEQ ID NO: 33665 - DNA, 1078 bp, Homo sapiens
gctgtccaggaacagacgtcatcatgatagaaagtgccaactatggcaggactgatgacaaaatttgtgactctgaccctgctcagatggagaatatccgatgttatctgccagatgcctataagattatgtctcaaaggtatgatacttctaatattcttttctttgtgcacaatataaaccttcaacatcaatctgtgttacatgttaagcataagaacataaacagtgttatgtattttaggacacttcaaaatagtttttccatatctgactattccttgtatcaccaaaatgctaattgcaaacagcatttggaaagtattacaatttattggattatctattacatttcatggtctgcatgacattgcatgctgttattttgatagtgttctttagaactgagttcattacatgagagaagaataaatgtatttttcacaatttgcaaaaataagattttctccaaatatggcagaaaaattattttactgctaacaataactttctaacaatgtagggaaaaaaagaagtaaaaattaataggtaatttataatcattaatcaaaatgtagtaagagtattgattaaggattagttggccttggaaaataattttaaaagtattcttttgctattcagcatatgaaattaatttaaatatttgagcaatctaaatatggccatattaacatcatataaatgaatgtatcatataatatcagtgggtaagaaatatttttgattctaaagagactggtcagtaggaatgcatattatataaggtttaaattatgttaaaatgtcttgataagttagctaagtattatatatctcttagatatttgttcactattactatgctttctcagaaatcagggataaagtcattcctttagtataagcctacagctattcagttatttcttttccttctattatttaagaacttctttaaatatagggaaaactatattttagataaaactaaacaaattgaagtctaaagacaaaaacagtagatttcaaggattctctcttttgtacttaggaaagccttccttatttttcacct

SEQ ID NO: 33666 - DNA, 1048 bp, Homo sapiens
caaagatgtaattagttaagataaggtcatatcagagtagagtggacttcaaatccaatatgacttgtgtccttttaataaataggggaaatttgaacacaggcatgcacacacacataggtagaaaaccatgtgaaaatgaaagcggagaccgggctcatgcagcagaagccaagcaatgccaaagattgccagcaaatcaccagaaactagtagagattataaatttctgttgttttagccaccttgtttggtactgcattacagcagctctaggaaactaatatgggcataagtaaaaggtcagtagaggcctggcgtggtgacttacacctgtaatcccagcactttgagaagctaaggcgggcagatcactggaggttaggagtttgagaccagcctggcaaacatggtgaaacctcgtctatgcaaaaatacaaaaattatccaggcgtggtggcccgcctgtaattccagctactcgtgaggctgaggcacaagaatcacttgaacccgggaggtggaagttgcagtgagccaagatcatgccactgcactccagcctgggtgacagagtgaaactctgttcccccaccccccaaaaacgtcaataggaaagataaaatggaatactaaaaatagtagagttatctgtttccaaaacaaggcaaaaagaaggaacaaagaaacaaaatacagattgtctgagatgaattcaaatacctggatagtagacctaaatccaaacattacaataattgcattgaatataaacatcccaattaaaagacagactggataataactgtcagtttctcttaaaaattaatacatatcaactttatggccctgtaatttgaatcctaagtatttatctatgataaatgaaaaccttcatccacaaaaacacttgtataagaatattcatagtagctttgttgataatagtcaaaatcagggagtagcttagatgttcatccataggagaatggataaacaaactggcatattcctacaatagaagattgttcaccaatagaaagggaca

SEQ ID NO: 33667 - DNA, 1029 bp, Homo sapiens
gaaaaatttgaaaaaaactatctcccaaaataggattgaacattattactgccatgttctgaaattggttatcaaaacctatactatatacttttaacatagaaaggaaatttcaacagttacactcgcagacataggaaagggtgactataaattaaaatctctctggaaaataggtttattatccaaaataatactgattcattaggggaagttatttaactcaattaatactttctgctgaagactttactgaagcaactgtatactgaaatagagaggttataaaatttcattaaacaggatttttaaattgtagtctcagtagtgagttaaattaaggaaaatgaatccacatttttctctttcagaagtatgtgttcataagtataatttttcaacttcaatcatatagcccatattaaattctaattaatattggccatcttttctaatgaatttagtatctagatttctacttagtctttcacgttacaagttacatggacaaacaattgagactgtctatatttcatagaggctaactagcacccacactcattaaaggagcacagaattgtctgaataaattacttctgagtttcctgctgacagctggaacctggggagcagttaagagtataatattcttacctccctctgcaagaagtggccagaatagttaacacttccttttactttcagcagccttactacttagaatcatttaaactgctgtgaccaagttatcagatcatgctgctgccactaatcaaagctgttcaacaagcggaatatggcaagaggaaataatagagtatgttttcattttgaatagaaaaaaaaatgcaaaaaaaggaattaaatacaaacaccaggtttgtaacaggtgttttatgagaattagttacagaacagatcgttctccctcagacaagattcaccagagacatctgccctctatggtgttaaataaaaaggttcatgttgccccaaagatccctgtttacatatttagcttcagttgcc

SEQ ID NO: 33668 - DNA, 1070 bp, Homo sapiens
acatttgatgttacatttaacaaggtaacagggaaggatcagaagagagatcatattcacttttgctggagaggaaatgtatttatttctacaaggcttccttttttttttcctcttggattcattctgattgctcaaggaccaaaagaattggtagctggctacttgtgtgtgtatcagagtctaatagaaacttttaatggcagtgtttggtcttgtcctgctctgttacttatcaagagctactcattcagacacatcaagctatcttcaagaaacttgcctgcttagaaaagaatatgactgtggatattatcaagaaaaagctctaagaatttctccttccactttattaggcactcactaatactcatattaaatgggttcaaataccaagtttgagtctcattaattatgaatgactgctctgcaacagatggcttgtgtttctctttttaagaatgaatggtaagtgtaaagtgagaaacatatgttattctgtgtctttagaactctgtacttcttaattcactcatcgatatggtctgcatttgtgattagcactgattctaacacacaatttgagaatttatgacgaattatagtacttgatcaaatcttgacactcgctgctacttaggtacctgatgatagtttctaaaatgttgaaataccttatctttatcctcagacagtagcttgaacactattaggagctgtttaccaaaaatcccatttattattggttttgaagatctaggactgatagggaccaatctatgaaggccatattggccttgtttttctttttaacctaactcatggaaaacaggaacttttttccttttttatggatattggagttaaagagtcccattgcttactacaaatatccaagtgaatgtgatgcttttgaaaaaggtttatttcttcaagacaaacccttacctcatggttactttgactatttgaataagtaatgcatataacagaattaaaacagtttccagcacacaagtagtgcttgataaaagtttgctataattactttaacaaagtctatctaatac

SEQ ID NO: 33669 - DNA, 1035 bp, Homo sapiens
ccaaattactttgatttgttataatgctttcctgtgtgaaagcagaacttgcgggaaaatgacagtgccaaaatttatgagtaaaacaacttaaagataagaataggtttttttattattattattattggctttgtaaggcttaatgatctccactttgtgaaaagaaaagtaataattggaataataatagaaagtataaccttttgtttgatgctattctcttatgctttaattcactattattacaattatttatttagtttcctatataaagtaaccaaattaaacagtaaagtgtcatgttcacctttctaaagcttcagagtaatgaatagctctagctccaaccaaagttttttctatttttttttcttaatgtgatagacaaaccaaagatacagcatgccagaactctaactggtatgtctaaagcttatcatgctagatccctaaaatcagtattattaaatcaccaagaagttttaaagtagtagaataaagattatgttaagtctgagattaagctgtcacatcagagtaatttgattttaaggcttgctccaccacctccattagtactcacatccttgacagagacaaagttcatccaatatcagttcttgttgcggatgaggtattgatgttttgtgatactttggtcagtcaataaggttaaaaagataaagtttatttagttttcaacattgccttcttgcagtcaaatgtctatttaattaaattttccaatatttggcaagaaaggactggcagtgtcagctttcttcagcttgatattaaatagcatcttgtgaaatttggtaaagactatctacagtgatatgaaacagatatactttgattccacttaggagaggagtgagaagtccaaattctttgtcaaggcagttaataacttctaagtttctgaatgctaaaagtatgaattacatctttggatcttaagtatgacattcatttgctaactgacttttggtgacttgtagaattctgcttctacaaatactgaacaac

SEQ ID NO: 33670 - DNA, 1128 bp, Homo sapiens
gagcattaaccttgactatgcctttggctccagccacctttttaagagtaaattgctgggcaggtcggggagggctagtcacagaaggaaactgtaagccagaccaggtgtgaggaggggaggcaataaaaagattacagggtggaggagcggaggctgaggaagaattggggcctagcttggcctgtcgaggaggggagaggtcagatgggtctgtagaaaaggaagattagaaagactcagcgacgcttggggtcggtactgaggggacaggagggagggaaagaaggaagatttgggacgagttgcactgggcacagaggctaggaaggaactgatgtgtaaaagaatgcctggacttcaggcacctcagaccatttgcccattttacgacaagaattatttagatcttgtagggtggaaaaattgaaagtgccgttttctggctatttggaactactcttgagtttgtattggggtcaagcggcattgcagaagaaaataagactcttagattttaggtcaggtgagaattgaagaggttttaagttcttaagaatacaggctaagggagaagaaagaggaatggaaggtggaagcttgcccatagtgaaggaggcaagcccagagaaaagagtagaggcacggagaaggggtgggggtttcttcccctccagaaaagcagagaaagggctgggacacggaaataagggattggggcacagagataagaggtcagggtgcggaaataagggattggggtgcagagataagaggttggggtgtggaaatacgcgattggggcacagagataagaggttggggtgtggaaataagtgattggggggttcttgccccctaggaaagcgggacttgccgctaagggtgaaggagaaggggttgaggggtacttgcccctgccccaggaaagcgggacttgccgctaagggtgaaggaccaaggcaggcgtccctgcgtggtctgacacccttgaaacgtgagtgtataatcagagaggcgtccctgcaatgattaaataccaagggaaggctgccttcccagtccgtgactggcgccggagttttgggttcacggataaaacatgtctcttttgtctctaccagaaaa

SEQ ID NO: 33671 - DNA, 1024 bp, Homo sapiens
ctcaatttgtaagacaatggtagttgttttaaactcttcagaaaactgtgttgcagctggaataataaagaggctgacctacctatcaaattacattatcttgaatttgctacttcatatcggagaacatatttccaactaaaatggaaataaagatccctatgagttgcatgcctttagaaagttttaataaattgttacacaaagcctttctaatgttctttctctctaagtgatgcggggtttttcctccttagctcaactagatttgggttcttttctcacaaccaagaataattaggcacaaggtcatcaaagagtgagtggagcagaatttattaagcaaaaggaaaggtctcagcaaaaaacaaaaaggggtcctgaaagcaggtttccagttgcttccttcacagttgaatacaagggcttaaggtgtgaattctaccccatccttccagtgcacatgtgggtccttagactgagtccctccatattgatttatttctcttactgcacatgtgttaaggaatggaattttccactgtgggcatgtttaggcaagacccctgtgcaagttcccttatctgcacaaaacatctggtataaatgcttgtggggtgggttggaagttctccagggacccttcccttactgtctgcctaaagcaagctggataactcctttcataactgcataattccatattaggagagaaggcctcaaaaatagttcctctcaggctctgaagatcagcctccagttaagcccatttccgaccatagagtattttgaacaaaaaaatcctttcaaatatgattgtcaggttttgaatgggacaaacagtaaattttcctgacacaattgaatccccttttgtcccctaattacaaagacccagaagagatggacccttttcctttaattagttatttttttagagatcaagaactcattgtgttgcctaaactggtctcaaactcctgggcttaaacagtccttctgcctcagcctcccaaagagcagg

SEQ ID NO: 33672 - DNA, 1131 bp, Homo sapiens
gttccttctgcactgccctagcagaggttttccatgtgggccacacccctgcagaaaacttgtgcctgggcatccagacatttctatacatctgaaatctaggtggaggttctcaaaccccaattcttgacttatctggactctcagactcagcaccatgtggaagctgccaaggcttggggcttgcaccctctgaagccatggcctgagctgtacattggcccctttcagctacagctagagcagctgggacacagggtaccaagaggaggggaaccctgggcccgccccatgaaaccactttttcatcctaggactccagacctgtgatgggagggactgccatgaagacctctctcatggcctggagaccttttcccctttgtcttggggattaacattcagctcctcattatgcaaatttctgcagcaggcttgaatttctcctcagaaaatgagattttcttttctatcacattgtcaggctgcaaacaaacttttatgctctgcttcccttataaaactgaatgcctttaccagcacccaagtcacctctttaatgcttggttgcttagaaatttcttcttccaggtgccctaaatcatctctttcaagttcaacgtttcacacatctctagggcaggggcaaaatgccaccaatctctttgctaaaacatagcaagagtcacctttgctccaattcccaacaagttcttcatctccatctgagaccactttaacctggaccttattcatatcactatcaacatttttgttaaagccattcaacaagtatctaggaagttccaaacttttcctttatttatttatttatttatttattttattattttttttttttgagaccgagtctcactctgtcaccaggctagagtgcagtggcatgatctcggctcactgcaacctctgcctccctggttcaagtgattctcctgcctcagcctcctgagtagctgggattacaggtgcatgccaccacacccagctaatttttgtatatttagtagagacggagtttcaccatgttggtcatgctggtcttgaactcctgacctcgggatctgcccgcctcagcctcccaaggtgctgggattacaggcattggccaca

SEQ ID NO: 33673 - DNA, 1132 bp, Homo sapiens
attaggatggattccaatatgtgttttctgcattgttttgaagagaggaatatttttatattttttttttgtggaatatgattcaaaaactggatccattttctcccattgagcccaagcaggcgtatcttgactctttctatgtaactctattaaacatccttctctgcagcatttttgggactgtaatccattttacatataaactatgtggagcatttagaaacagttctgtgtgttctgtttgtagtgtctgattttaattatctttaggttaaatttccaattctttcttacaaatattatgctcgtttaatatctaaatgccagctgtgactttatttcttacaaacaaagagaaaatgcaatcaacataaccaaacccatttagtttatttctaatttgaggagaccttaaaatgttttcatattccagtaaacattgccatgggtattttaggtataaacacattacatgtaaacagaacgcttttgccaaacagattgacttgaagaatattcacttgaattatgacataatgtagcactgtcaggcagatttgaggcattgttaagacagtcttctaagaaatgttattttgctagttttgaccactgtgaacatcaggatcttcattcctaataaatatatgtggttccctaatacaggtcttgacacaaacagtgctttaactaagaacgttgtgatggtcaatctacattttctaatatttactgagcacataccatgggtatatgcattgtgctaagcatcttatgctacttatctccttttatcttcatgaaagttctgtgttattatttttctccaatttataggtatagacactgaatcttagagaaattaaatatcggttggtgcaaaacaattgcagttttgccaatggcttttgcaccaacctaatgtgtaataactagcttcttgctctaattttaaatgctattattcagcttaccaataactactattagtaaactataaagaatagaatgggctctgatatcagactttcacttctcttaccattcttagtgaaatgacaaatttaacttgagtaaccaagtgaatagtcctgatctattttagctcctgtgtctaatttctgtaggc

SEQ ID NO: 33674 - DNA, 1034 bp, Homo sapiens
tgcctctttattggtaggattgtatatgtgtgtgaatatgcttctattcatattcattagaaggagtggtgaaattgtaatggagggcatccagagaatttactggacaatactttcctccctcgcagaattgaagtaaaagtaggaaacagaagaaaccatccagcacccatgtgttgttttctagtaggattctctaataaaaacaccagcctccttggaggaagggctgattctagggctaggggatgaaatatacaaaataaatctggagaatcttgtagcaccaaaagtaaggaagtgctcaaaaaataatttgataggaatatgtcaaagtgagacaggagcagtcaaactaaaagatctctcatgaaaaagctgaaaaatttatgcaaaaattaaataatgtaatattggattatctcctagaatataaaaataaagtcatgagttcctactgataaaaataaatgcatgggtgagtaaatacgtgaaggagaagagacaaatctcctgtagaaaagaattccaagtaattggtgcagatacttcttccttaatgagatggagcttaatcccttcctcttcagtgtgggctgcactaacttgctaccaaagaatacagtgaggaaagaggaaaaaagtaagttttcacttgagaaaaaaacttagaagacactacctttgtcagatgatgaagtttaacatcattagtgataagtcagattaatagtacttacttttgattatgatgtgatcaaaatggtatttcacctctgtggtcatccttccaaaaatctatgatctcagtataaccatgagaaaaggacatcagacaaacacagatttaaggactttctgccaaatagctgaccggcactcctcaatgtctttaaacacaccctaagtgtaagaaagtatcacagaccagaggaagctaagaagatatgacaactgaatataatgtagtatccaggatgggattctgggacacaaaaaaaagacatgaggaaaaattaatgaaattttaaaaa

SEQ ID NO: 33675 - DNA, 1018 bp, Homo sapiens
ttccttctttcttcctttctttcttccttcctttcttccttcctttcttcctttcctcctttctttcttctctctttctttctttttttgcagtcaaaatcttgctgtgtcacccaagctgaagtgcagtggtgcattcatagttcaccaggctcaagcaatcctctcgcctcagcctcccaattagctgggactgcaggcaagcaccaccattcccacctaatagcacaattgttttaatagtccatttgggagggttacattaaggtttagtaataataatagggacaaaggcagatgtgagaaactttaatgaggcagaatcattgggaacttgatcattggtaggtggtaagtgtaaagaaaaggtcacaaatgacttctcattattgaaaggaacagaggccgctttgtgggaaaagataatgtattaagtttttgcatattgagtttgagatgcctacaggatacaaaggtaacataaccaatggcagtaaattaaatgatctagagagaacttggcaaacttttactataaaataccagatagtaaatatttcagtctttgcaggctatgtatggcctccctcactgctcagttctgtggttgtagcctagaagcatccatagataatatataaacaaatgagcatggctgtgtgccattaaaactttatgaatattggccaggcatggtggctcacgcctgtaatcccagcactttgggaggccgaggcaggtggatcaccaggtcaggagttcaagaccagcctgaccaacatggtgaaaccccacctctactaaaaatacaaaaactagtctggcgtagtggcgcgtgcatgcaatcccagctactcaggaggctaaagcaggagaatcgcttgaacctgggaggcagaggtttcagtgagctgagattgtgccactgcactccatcctgggacacagatggagactaggtctcaaaaacaaaaaacaaaaactttatgaatattaaaatttaaatgtcatataattt

SEQ ID NO: 33676 - DNA, 1027 bp, Homo sapiens
tcttcccaactttccttgacaattagcagcatttagattttcatgccaaaatcagggtaacaagcaatgtccatgggcaaggtgagaaaagtaacaattttttatttggtttgaaattattatttaggccaaaaattgtgaacctaaactgattggtgtttattttaccctttaagggaaaaacctatttatcgaccaataaagaaattacaatgctttctttcagttctttgtttaaaatgcactgtagtgccgtatgatttgcatgttaatgatgtgaatctaactgtataataaataggaagaggaagataaaacttgtttcaaagagcaggcttgttttacttgatttcctccttaaatgtttaacttgagaacgcatctatgaggtatgcttatgtgaaagctaataattagtgatcatcaaatggagtgtcaatgaagccagaagtttcattctcagatttctcagtcagaaagcaactggacactggaggcattgaacatcgttgaaaggcagatataatgtagtaaacaagaggcacacagaatttcttctgtgcagtataatctctgaaatcaaaaagcatgaagcctccacaatttctgtttctctctccaacttccctccctaacctaattcaagcgtgcaattgagatgctttgtattttgtgctttgcattagtttcctgatatgttgttacgcatgttctccttaagtaaaatagcaaaataaaaccaatttttaaatagtaatgtgtgatttgaggaagtgtgtcttagaagcactgaatcactagaaattgaaaaaagcataatctgtatttctgaaagccatccagtttccgtttatttacaacctttgagccatttcacaaattgaaaagcaaccatccagccatttcatgtttagattattatatatttaaaagatcctaagaccattatcagcatgcagtagccctctcactgaacaaagacagattagaggtaaatgaagaaattcctctaaatcattgtttctca

SEQ ID NO: 33677 - DNA, 1049 bp, Homo sapiens
aaattgcagagaactacacacatgcacacatgaatggagactttttgaaatggtgatgtattagtttgctaaggctgccataacaaagtaacaggcactggctggcttaaacaacagaaatttactgtctcaccattctggaggctaaaagtccaagcttcaactgtctgtaggtttggtttcttctgaggcctctctccttggtttgtagatgaccactgtctcattttgtcttcacgtggtcatcctgatatggtttggctctgtgtcaccacccaaatcttatctcaaattgtaatacccacatatcaggggagggacctggtacatgaccattaacttgggaggtgattggatcctgggaacagttcccccatactgttctcatgatagtgactgagttctcatgagacctgatgatgattttaaaagtgtttagcagttaccccttcactctctctcttgcttgctgtcatgttagacatgccttgcctccccttcaccttccgccatgattgtaagttcgctgaggcttccctagccatgtggaactgtgagtcagtttgaccaatttggtataaattacccaatctcaggaaatgtctttacagcagtgtggaaacagactaacccacatccttttgctgtgtaatctatgtcctaatctccccttcttatagggacaccaatcatataagattagggaccaaccatgtgacctcattttaccttagttacttttataaaagctctatgtctccaactaaagtcacattctgaagtactcaagattagaacttcaatgtatgaattttggggaaaggggagcataattgagcccataacaggtgaaaactgaataatgtctgcagtcaagttaatgatcatataatcagtgtttgttttttgggttttgtatattactatagctataaaagtcattgtcattgagggaagctggactatctttgcaacttcctgtaagtctataagtattttgaaataacatttttttgaacaagctattgtagtagaacagacatattagt

SEQ ID NO: 33678 - DNA, 1051 bp, Homo sapiens
ttattgcaaaaactgtaatcccaatgtaaatgtactttgtttcggctgacatgttctaatttgtaagcatgttgtaatttataagcaataaaccatacctatgtttatggattttgtatgacagagaacaaccttagaagcaagctctctagttttttgttttgttttgttttataagaaatgaaggaaagaaacaaagaaggcaggaggaaatatgaaaatgtttagctgtaaactttattctacatgtatacatttcacagcatttttaaaaaggccatctgcatttataaagagataccctcaagaaccaaattaatgggtatgagattggcagtttaaaaacaaaactttatcagttaatttgcaggtgaacataatatcaaggtgtttactttttttaaccaaaactcttaagttaggttgatataaatagtaaaaattgatttgtttgtttatgcctttccaatgatctgaatattcacatccgctatcctcggtagtacagaattgagaactggatttataattagaaagtgacttagtgagcataaaatcatagcaaaaggaattggatagccttggggcaaacttagtcagattatgaaaagcacaatacagtagactttttaatgaatggaaatatctctgtgtgccagctataatcatttgcttaattctggctggcaaattctttttcttgcagctatcccatttgtaaattctatacatgaatatcttgatatcctcaacaaatattagtgaacaaggcaaatataatacagtccctgtctaggattttactatctaggagaaaatattgatgaataaatgttagtacactaacacttcagaggaatgaaaatgcagttgagtagattcagctttctttggatatactctcgttctggaaatgtatactgatcactttgattggatttggtgtcttccaagtctcctgagcaacacaagaacacattacaaatgttccctataagtcagctaaatttgtagttggccaaacgtgtctattacgattatgcgtggtttc

SEQ ID NO: 33679 - DNA, 1048 bp, Homo sapiens
atttatactcctttgggtatatacccagtaatgggattgctgggtcaaatagtatttctggttctagatccttgaggaattgccatattgtcttccacaatggctgaactaatttacattcccaccaatagtgtaaaagtgttcctattgctccacagccttgccagcatctgtgttgtttcttgactttttaataattgccattctgactggcatgagatggtatctcattgtggttttaatttgtatttctctaatgatcagtgatgttgaactttttttcctatgtttgttggctgcgtaaatgtcgtctttggagaaatgtctgttcatatttacccacttttggatggggttgtttgtttttttcttgtaaatttgtttaagtttcatgtaaattctggatatttgactcttgtcagatgggtagattgcaaaatttctctcctaatctgtaggtcacctgttcacactgatgattgtttctttcactgtgcagaagctctttagtttaattagatctcatttgtcaactgtggcttttgttgcaattgcttttggtgttttcatcatgaagtctttgcccatgcttatgtcccaaacggtattgcctaggtttggttctggggtttttgtggttttgggttttatgtttaagtctttaacccatcttgagttaatttgtgtataaggtataaggaagggatccagtctcagttttctgcatatggctagtcagttttcccagcaccatttattgaataggagatactttccccattgtttgtttttgtcaggtttgtcaaaggtctgaaggttgtagatgtgtggtgttatttctgagatctctgttctgttccattggtctatatgtttgttttggtaccaataccatgctttttggttactgtagtattttagtgtagtttgaagtcaggtagcatgatgcttccagcttcattcttcttgcttaggattgtcttggctatacggggtcttctttgattccatatgaaattcaaagtagttttttctaattctgtgaaga

SEQ ID NO: 33680 - DNA, 1052 bp, Homo sapiens
tcatcaatgaatttctgttactctgataacttcggtaagtttgttgaccttttctagtagcagttatagattttagtcagggtttcctataaggaagaataactcaaagaaatgagaattaaggaactgacataagagtaagaaattgatagttggtcagctgaaaattgtagtactttagaaaatatacaaaaataagagctggctgccttttctgaccaagcttgtctaaaccaatatttagtacaataacaaaaaatcagagaaagaaagcagtttgggaacatttaattttaagcagatccatttttattcatgttcaccatgaattttccaacaccaccttaaatcatttttgaaacaaggcagggtagaaataaacaaacaattactaataattaatttcatcatgaaacaattagtaataatctcatcatgaaaagactgcaattaactacactaattttccccttagttttaatgtttctctttcactgactattgaagaacttactatgttagtatgttctaactctaactctgactctaactctaactcatgattatggccaagagaaaaaattcttaaaatctattttaaaatatttacgctaatatcagaaataattattcataggctcttattagaattttttctaagtattattttttttattctaatgatacactgtcatctataagccattattaatgttaaaggcagttttcaaagatagattatatttaagtatattagttttaatatctgtgttttaagaatcttccctaggttattattttgcagatctattgtaatgcagttttggtaaatatttaatttggttttatggcagttgactagtatcccatgtggtagagatttgactaaatcatttgttccttttcctagattgcctgtgctgttttcgctgccctgttacatttcttcttcttggctgccttcacctggatgttcctggagggggtgcagctttatatcatgctggtggaggtttttgagagtgaacattcacgtaggaaatacttttatc

SEQ ID NO: 33681 - DNA, 1049 bp, Homo sapiens
tggaagttggtgaaaagagaggtgaaaatcccatacagtatgaaaaagaatataacagaatttcacccagtcagagcatgtttggcaaggattacaaaaagttattaatttcttgacttattttacttaaattaaaagtttgtatattctcttagtggaaaaaagaaatcctgagagtaggtaatacagtccttaaagtacttcatctctttacattccaatgaccctactttatcagccccacagttataggttctaaggaattcaaggctcaatataagtagaaaatactggacctccaaaagtgaaccaggaaacattgtaaattttaatcataaatatcaataagtaaggtatgtcaacttgctaaaaatattttatggatcttgaagtgttactgactaaagtaagttttcactgattacaaaataaaaacaaatataaatgtgtatatacaggcatcttctcatttgtttcatttttcctattcaaatttcaaagttttgaaaagtcataagaaaaaaacattaaacgatcaaattctggaacttaaatttctaattgaatctttaggaacattccacatgtgatgttatgtcttatgctttatagtcaaatgattgcacttagtagaacattgccgtcatatagtggacttttcatcactaaggatataatatgagttaaacttagatttctcatgtaaactaaagtactttggttatctcttttaatgttcattaggaattttggaaatacttccatttcaattcagagtatgaaaattcatagcatttactaaacttaaactaataatctaaaagaaaatgctactttatataaactgaggccctttaaatgtatgtattaaagatcaactcagagacagtgtctccttcatcttctttgtatttacacttaatatataatttccaaaatactttaaaaaaaaacctaatacagaatcgtgtattttttcctacaaccccttttttgaggtccgaaggtcaatacacaacagcaattataatagcaaatatttatatagt

SEQ ID NO: 33682 - DNA, 1106 bp, Homo sapiens
atgtagtaaacattatgttgctacattgtagataatgcaggggatgatggccaagactaaaacgtaaaaatcctcttcacctcttgctcctccaaacttacttcctggtcctaatcacttataaaagttttataatatgcatcagtcacacaaacatatattcacagaaatgggtgtaactttttttaaactatggactgaaataatatcttttgactttctcgtaattgttttgtcatttatctttcatatattttattgatttttagatatatttgctttttattatataatatttgaaaaataaaaaagtgaaatatgtatatgaaatattgaaacattttaataagatgaacacctgtgaactcaacatccaacctaggaaatagaacattttcaatatgttttcctctttatttaacctccgtaaccaatccctatgccttcctccagaaaggctcctaaattttgtttttccattcccgcaacttattctaatcatttctctccttccaaaaaatcttgttcagcattcctttattaaacctttgtttaaaaatggtattttttgtgtgtagtcttctctgacttgggtttttcactcccatattctaaaacccttcctggttataagtgtggcctctgtgcaatatactatatactttttcctctgcctgcaatacttctcctttttctccttttcctcttaaactatatttggtatagtgcagtgagttgttaacctcctgcactcaggagccagatgactgcattccaatgctggttataaggtctgtgccatcagacatgttcattaaccactgtgcttcggtttttctagtgtatagtattacctacctcatggagttcttgtgaggttttgatgggtgaatataggaaaggtatatagtatggaaaagagagcatagaaaaaattaatttatatagatgtatatgcacacacatgcacatatataatatacatacactatgtatgtatatgccaagtatatgtacctcaatgaacaaaaaagacaaaaattctgttttcatagagcctcaagcctaatgcagacataagacattaaatattagacattaaatgg

SEQ ID NO: 33683 - DNA, 1035 bp, Homo sapiens
tttatgcttttgaaccattttctaattgaagagtttgttgttgctattagtttttttaatgttgacttttgagacttctttttgcatgctcgatactagttcttttttggattacaaatatttgtgaatttgttttacaaatctgtctctcagcctatagcttgtgttttcatcctctaatacatatatttaaatgaacatatacctgtcagttcaacatgactattctcatgcaatttgtattttgctttcctttgtgactttttctttctttattcatctaacacaaatacacaattctgtctattattttcataaatgtcctaagtatattaataaaacttctcctctgatctttgcttcttggttaaatggctttggaggatggaaagttgcaactcatgctgatggtgttagaaactaagaacaaaaagtattaacaaaagggtgaaagaatttaacattgtttcattgctatgtcaaattccaaacaaccagttggaaaatggaaaacggaaaatggaattatatatgtgtatattgcttgacatcataaagttaataatttatttaaaatatttaaaaatagcatctatatgttttttatcagatttgtaagatcaccaaattagtatgcttaccatggtgtactaatgagtgattatattttattttatttcatcttaaatgattcctcttcatagaatttcagaaatgtcaaattctgttgtgtcaacaactgctctccaaatgagtgttttatcataaatgttgccttttatccttttttactttcattggaaacaacccaatggtttctgtgaatgagggaatgttttgtttaatttttgcttttttgtgtgtgttttaaacttttttttggcttttgttttgtgttttgtgttttgtttgtatgaatgattagattttgctttttttcactttaattttaatttttagcaagcatgggaatatattcttgcatacaccttgggaaagataaaaccttaaatgtagcttaatcaacattgtaaa

SEQ ID NO: 33684 - DNA, 1052 bp, Homo sapiens
ttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcac

SEQ ID NO: 33685 - DNA, 1019 bp, Homo sapiens
tattatagtcaattcataaaattctacatacagttgtacatggtgggttatcaaagtactccataatccaaatgcatctaaaagtattccaaatgcgcctttcattctagaatactaaaggaaagcgtttgaaagaagaggaaagtaaagcagacttctaactatttaatttaaacattgccattcagattgaataatttttaaatgatgatgctccactctttgatctacagacaaggttacaaaagatttacaattagtccaaaatcagaggattttaaatcttaaaggagttaagtttgtctcaatgatccaagactacaaaatttcttgctacattggcaaggaaatatgtttaaagccgagaactaaaatagctttttaaaatttaaaaattcctctgtttcttctgaatgtaaaacaggcaaaatgatcctgacttcaaaatgaaatatattgattgctctcaaaagatgtttgacaaagttaagtcagtatcttcaatgctttaacagtaggtagaggtctttggggttggaactcaggatacagtgactaggacagagtgcattcttaggctaattagtgcctagtcctctggagtattttttaatgccctgaatttcaagttgtcaaactggtttacatattgaatgacattttgaatcaataaaaatgagaaaaaaacatttaaatttggttttcatgactcatttgagaataaagatttccttcatcaccctaagtaataaaagctgatatgtcttgaaacaactatagacaatcagaatgtgttcatttataaagtatcactggtttgtatattttaatgctgacctttgcctgtgaactagaaaatcaagatttgtagagtcaggttgatttgccttcatttaattcctgcaaatgcattggaagtggatggataacttggaactttttccatactgttttccccctcaccaagcattaaatctaattcaaaatatgtctttctaaaaaacaatagtttattttta

SEQ ID NO: 33686 - DNA, 1046 bp, Homo sapiens
gcggactatatattataatggtggatgattctgaaaatgaggctaggcagttaggcagagtcataccatgtaggaatgtatgtcatcctaaggaattgaactttatacttttaattaatgtgtggttattgcttttatttttataaataatagcttttgtgatgataaaaataatacattatcaataaaaataagattctcagtataatattttcacctatataagagtataaggaaaaagttaaaagttatctcaaatatacaactcagctacaccactgttaccaatttgagaactattctttccaatatttctctgagtaagcaacactaatacacacagacacacacacacacacacgcatgcataattgctccatatcctctttaatcttaaggagttttttaggtaagtactgtatttcatttgtgtgttatatattatatattaaagtaaatatgtatgctatatatcatattatatatttatttataatataaagattatatttatatgatttatatatgaatgtagattctagaagatacatgtgctatgattgagggtctgcaatctttcaccattattgctttatttattataccaaggaacatgacaaatgtttgcaatctgacttgaccatttttactgtctttgctgtgcttgtttttttattgtttttctttctttttttaaattctcggtttttgaattttcttttgaatatttgcattattacatttttaaattttagcatcctagtgaatatctaacaacagaatcattattatctgcaaatgaaactatttttctataaaatcgtcttgtataagatacatattttcccacagaggctacataatgtgtgcatgaagtttcagatatatttaataggctatacttggtcactctggagataatctgtaaaaataaggcatagttttttgctagcaaaaaacaaaatagaatgtgatcaacatttcaaaaggactcttacatgctctattcaagcactactgacagtaaaaatagcatggttaccagc

SEQ ID NO: 33687 - DNA, 1046 bp, Homo sapiens
ttaaaggaaactccagtctatttgaaggtaattgataatgccaggtaaaagctgtgaaaagcatggtgatcagggatatatcatatctgagtgactggccagaatatgatttcttctgttctttctgttattaaattaatggtttgagagagagcaaaaaaatacttggagagtttaaaaaatcttttcttcacagaaatgatatattactatgtttttatctattgccaaatgttgatataactttacaattactcttgaaacagcatatgggaacagtctgagagttattcttaaatgctgaaagttgcttttgagtaagtctacttaccaattccccatctttttcctaattatcattctattaaagcatctattcagggactgattcagttgtttattcatttaatcaatattcattttaacaacctactatgtaccagtctttaaacttaacaactgaagagtctcttgcatagaccactactgaaaattatctgaaatttgctccattcctatgagtttgggtgacactatgaacctacccacttttgatgtcttgtctgtctactattctgtccactactggggcttgtctagaaaatcagtttctgaatttgcaagggtgttcaactgcttgagatagttttaaaacagatttaaacacatgttgaagattactgagaaaagtttcaacttcgaaagctgtggttttatgaaaagagagttttatgtaataatgtgatgtattttttcttgattatagagttggcttaatattatttattctccattaataatacatatattttaaatgtttgaatctgtctccagaatgaaaagtggttttataatttctaaaaaacagttatgtacaaggaacactgaatgagctctaggcaggtgaagtattagaatgtgttgcatggaaaatttactaagaatacctggttataatggtctatagtttcagggtgctttggaggatatcacaggataattggttgagcccaggagtttgaggccagactggacaacatagtgag

SEQ ID NO: 33688 - DNA, 1126 bp, Homo sapiens
ccaggggtgtggggtaggttagtataacagtgtttctattattctctcaatttccaaatctctgcattaaatttctaggtgctttgtcaccttatcttaactatttcatcacttctgaaggtaaaactttgggttttgccacctgtcatgaccagaataaaagttccaccaggtaagaagatcacaaactcactcatcgtatacaatgcagtgtaattttttgtaagtcgataaagttaatcctcattatttacagatactatatttgcaaatttgcctactggctaatgtgcatttgtaattgcaatagctgtactcatgggctttggtgcttattcgcagacatgcacaaaatggtgaaaaatttgagtggcacatgttcccagatgagatagaaaaagacaatgttctcccttgtttagttctcatacaatgaacgagggtcgtttttacagtctatttacagccacatttttcacgtttgtactttttgttgacgattttgctgtttaaattgaccctgaagtgtagtactgaaatgctgtctgggttcctcagtacaagaaggctgtgctgtgccttacagagaaaacacgcatgtcagacatacccattcaggcatgagtagtagtgccgccagccataagttcaatattaatgaatcaatgacatagatttaatagggcatctttaaagagaaacacccataaaagaagattatttattgatcagttgatgaaaatactgtaactataagctagggggaatctaaccatgaatttcccccaagagcaatgattctgggttcattaattcagtgttctcagcaaagttatagaatataagtaccacgaataacaaatatcaactatacttctcaagctgttgtccatctttgaatatttttcagtgttctaaaattgttgtttatgatagtatggctagttatagtatactctttttttctacagtagattccctgaacttctcatgttgtcatttctgaaagtagagtatgctgcttatcttatattattttttcaatattaatatattttttggattttacagtttatctcatagcttcattttgttatattattagctatgaaaattacatgaaaag

SEQ ID NO: 33689 - DNA, 1042 bp, Homo sapiens
caggtttacacagtttattattttggcatctatgttcatgcataatatgtattttttataaaataattttgtatttggttagtattagagataatatttgatgtggctgttatttttaaataaatctggttgaattttttaaacggaaaatttacaactcaatgttgaaatcataaactttccaaaatataattaatttttaaacctacaaatacttagaagtatgttccatggtgggagttgtcttgttcagtaaaataagtcaggaatttgaaaagtacagggagagaggacaatgcgtaccatgcatacaatgtaggctgacgctcttaagttgctttgacaccctacaacaaatgaaaagcaggactgttcaccaaaaattgaaaaccatgcatgaaagtcagaatcctccttggttgcttacaaagacaaccttttttgcagctgtggtagagcagaaaaatgtaaagattaaactcagaatttaatatttagagtctctgagcttcagaaaccattgactctacagatgataaaaatgtgtagtgcaaaatatatgaccctgggtcaaaaagccaggcactctaacacatggcatgggaatatctggatgcataatgcataccactcaagatttcagctcctcacactcttttatatcccaaagaatttacagagttgatccaccattccctaacaagaattataactattcttgagtaaaaaggcaatgaagaggcctctctcccacaacataatatgatctgccccctgaagagtttttccaacttcttggttgatgctaattttagcttaatctatccaggcatatgcaggaaactgtcaatgctcaaaaggggctgcaaaagttagtcagcatattttatcaagaaatatgaaactttcagtatgactgggttatgaaaatgcttgatcaagatgcctgacatacaagactatacaagactgtaaagtagagttaattgatttggagatattattgataaacattatataatactataatatctttgtaaga

SEQ ID NO: 33690 - DNA, 1047 bp, Homo sapiens
gtaatcccagcactttgggaggccaagacaggcagatcacctgatgtcaggagttcgagaccagcctgaccaacatgttgcaaccccgtctctgctaaaattacaaaaattagttgggcatggtggcaggtgcctgtaatcccagctacttgggaggctgaggcaggagaatcacttgaacctgggaggtggaggttgcagtgagcggagattgtgccattgcactccagcctgggtgacagagcaagactctgtttaaaaaaaaataataaaatagcacgagaaagactggcacccatattcagttatctccactgggtccctcccacattgtgtgggaattctgggaaatacaattcaagttgagatttgggtgcagacacagacaaactgtatgaccaaccattatttccactacataatcttgttaaagattttgtgaattttaggaaattcaaaaattgaaatgatcaaattaaattatatactatacctctatattgctgttgtacctgactttatacaagtgatatcacatattctgaagaacttcaggaaaatcattaaatagaattctgagacagtaggtaagactgagcaccagcacccaggcaaaggcttcttattcttatcataagaagtagaaaaggaggatggacctgaaaggaagataaaagagattttattccatggcttctattttgtctgtgagtcacttacctgctgaagaccatagaaaatatttgttttattacaaaaaatagaaattttcttaatgttatattctttggaataatttaaatattattgagactatccggttttaaagattagctcaattgtcctgtgaaactaactgggactggtggtttggggggcaatttcttgacaaatttctcatcatttgagtaaattaatgtgtttcagtttactatttctattgtggttaatgttggaaaattttatttaacaaattaaatttaaattttctttttatctaggtttccatatatgtttacatagaattctatgtaacagctaccctta

SEQ ID NO: 33691 - DNA, 1027 bp, Homo sapiens
tgtccctgtacaactgctctaacagaagctctatcttccttgctagcttactccgctccagactcactggctttcggacgatcctctgagaagagaaagagtttccggttagaaccctgaacttgtttccttggcttaaaacgatgtttctattgttttccacacaggaaaaaatgcaaggcctccgttatatttttcagatctttgttcaaatgtcatctcagggatgccttctctgattttctattaaaattgactcatccctatgctagcattttctattcccttacctggtttatttttctacacaatacacatcatctaacaatgtatatattttgcctatttatttcataattatcagactccccaaataagaatgccatctccaagaaagtaggaaatttgttgttttttcatccctggtcatttgatcactggtctaaaaccaagcctgatacaatgtggtgctccgtcgatatgtgataaatggaaaaatgaatgtggaaaaatgaatgtggaaaaattatcagcatagggaaacttcaaggagcataataagaaacaaaaattgaaatggaggtaaagctatctagtattataaagattcaatctcttaatgaactttcctcacagttaaaccaaattttactcagttcatgtgcatcataggcttggttgttttgtttgtgtatgtgtgtgctttgtgggtttttctttaacaaaaccttgatacacaactaaacacacatttagtcttgttttttcagagtaaatgagaaaaaaatttccaaaaacaaattgccatttttaagatacttttaaaaagtcttataatacctccaaaactttaaaattttcatgatgattttacctgttacaaaaatattttaacacaagctttaagttagataacacttaatgataaaatattttactttataacaacatagaccactgacatgtgacataatttccagagcatatgatcagaattctaactactttatgcatactaaatatctgt

SEQ ID NO: 33692 - DNA, 1761 bp, Homo sapiens
catatagaccaatggagcaaaacagagacctcagaaataacacaacacatctacaaccatctgatctttgataaacctgacaaaaacaagcaatggggaaaggatctcctattcagtaaatggttctgagaaaactggctagccatatgctgaaaactgaaactggaccctttccttacaccgtacacaaaattaactcaagatggattaaagacttgatgtaaaatccaaaaccatagaaaccctggaagaaacctcaggcaacaccattaaggacataggcatgggaaagacttcatgaccaaaacaccaaaagcaattgcaacaaaagccaaaattgacaaatgggatctaattaaactaaagagcttctgcacagcaaaaggaactagcatcatagtgaacaggtaacctacagaatgggagaaagtttttacaatctacccacctgacaaaggtctgttatccagaatttacaaggaacataaacacatttacaagaaaaaaagtaaccccatcaaaaaatgggcaaaggatattaacagacacttcccaaagaagatatttacattgccaacaaacacatgaataaagctcaacatcagagaaatgcaaatgaaaaccatagtgagataccatctcacgccagtcagaatggcaattattagaaagtcaggaaacaatagatgctggcaaggctctggagaaaaaggaacgcttttacacttttggtgggaatgtaaattagtttagccattgtagaagacagtatggcaatttctcaaggatctagaaccaaaaataccatttgacccagcaatcccattacttagtgtatacacaaaggaatataaatcattctactctaaagacacatgcccatgtatgttaattgcagcactatttacaatagtaaagacctggaaccaacccaaatgcccatcaatgatagactggatagagaaaatatggtacatatacaccatagaatactatgcagccacaaaaaggaatgagatcatgtccttttcagggacacagaagaagctggaagccatggtcctcaccaaactaacacaggaacagaaaaccaaaccctgcatattctttctcataagtgagagctgatcattaagaacacatggacacagggaggggaacgtcacacaccagggcctgttgggggtggagggtgaggggagggaacttataggacgactcagtaggtgcagcaaaccaccaaggcacatgtatacctatgtaacaaacctgcatgttctgcacatgtatcctgtttttgttttgaagaaataaagaaaaaaataaggttaatcctaccttggggtttctaacatggtagtgacaggaacttccagatgggagaaacaaccccaggtaacagaacaatttattcagctattagtgcaaagaaagtgtatttaccactaccttgatttccacactcaattccaatcccaattgtagtagtatattcacattattgtgatactttttaaggtattccttcaattacacataatcaaaaataagagtcttcgtaattacagtattgggtaagaattaatactcatttgacaaaaataaaaaaaaaaaatgatgtacttccacttctgttaggtttggttttgaattggcccctagtttcattatccctttctttccatcaagatatatattttctattcatactagttgtttcatttgaaaaatcaggaaaatatttgtaaatcaataagattt

SEQ ID NO: 33693 - DNA, 1040 bp, Homo sapiens
ttgacacagcacatgtttcagggagcacagggttgggggtaaggttacagattaacagcatctcaaggcagaagaatttctcttaatacagaacaaaatggagtctcctatgtctacttctttctacacagacacagtaacaatctgatctctctttcttttccccacacatatttcttgtttttgtttttcctccgagaaagcatacaaacaatgatatcttggtaacaatgtatatccctggtgccaggtgttgttatttaaatactacttgccatagaaacaaggaaaaatgattccagggctgtgtaataaagtgttgagggactgacaggaacatgtcaaagaacacagaggctagcttgaagtgggcctcactgaccaaatcaatttgaacatcagatcaaaaaatgatagtaacgcgttgtaacccataagctaatataaaaatcagtaagtccataataatataaacataaacttaattaatagggaaagaaaaaaatttatttacaatagacttccaactaattaaccaataaatgtagacaacaggatgtagttaattaatcacaatttggcagtcatcagttataattgattcaatcaggaatcatcaatggaagctaaatacagtaagtaaaaatttgatgaggaacaaacaggatgttgatatagtatcacagtatctccccaccaattactcactaattgcaaggaataaaacagtatctttacagagataaacctgacaggcaccatttgaaaccagtgatcaaaattaacatcaccaataatgagacaaacttacattatgtattttcttatattatgcattggcaaattcacagcatcactgtacagcacttgtgccaaaaattgataacctgaattgttgggagcaagccctgcaaaatctggccataaactggccccaaaactggcaataaataaaatctctgcagcactgtaacatgtccataatgaccctaacgcccaagttggaaggttatgggtttgcgggaatgagggcaaggaac

SEQ ID NO: 33694 - DNA, 1051 bp, Homo sapiens
gtttaagacatagaccatacaagagaaacatttacagatgttttgtatccccgaaaggagacccccaataaatatttatccgagaacctacttatcaactgagactggggatacattgttaattcttgttggtaatgatgattatatactgatcagtagataacttttcaggttctctttgtataaaaaggctttggaagaattaaggaaggaagaccttaacgttagcatacacagagtggcacaggcttgtaataatagagcattgtaattacataattggaataatcaaaccggaagttttaagaaaagttagcaactgcagctctcaaagttattttggtagtatttttttcaagtaatgatcttcatcagttaaaaaaacaattctgtttttttatctcacctctgtagatgtttttatacagtgtcccggaaagaggcaactgagatgctccagaagaacccttctttgggaaatatgatcctgaggcctggtagtgacagtagaaactactccatcactattcggcaggagatagagtatgtttattttttttaaatgtatggaatttttaaaagcgtggtatcactaaatacaagtccagatcagcacctgctatgtgtttcgttggggctgaaaatatgaacacaagtggccgggtgcggtggctcacgcctgtaatctcaacacttcgggaggctgaggcagacggatcacaaggtcaggatatcgagactaccctggctaacacggtgaaaccccgtctttactaaaaatacaaaaaattagccaggcgtggtggcacgtgcctgtagtcccagctactcgggaggctgaggcgggggaattgcttgaacccaggaggcagaggttgcagtgagccgagatcacaccactgcactccagcctgggtgacagagtgagactcggtctcgaaaaaaaaaaaaaaaaaagaacacaagaatagggagggaatgtcataaaagcaatgctaaagactgagccaatgctaacatttgcagcagggaagaagaaagaataacacat

SEQ ID NO: 33695 - DNA, 1063 bp, Homo sapiens
caagtattgatactgggctttcttttccacaccaccaccactcctcacggtatagactgatgaaaatagggattttcacacagggtatcattcacatgggggctcaacactgttttaggatgatgactgttttcatgaatgataaatggatgatatgcaggtatctgaaaatggaaggacgtcactagacagaagaaaaacagcaatgggatatcttagtcagagatgagatttacttacttgaagagggagggatggctttcagacactgtatggatggaatacttgtgtctccccagattaatctgttgaagccctaacctctaatgtgatggtattataggaggtggggcctttgggaggtagtttcagatatggttgtgatggcaggcccctcatgatgggattagcatccttataaaaagagacaagagtgtgctctctctctctctctcccctcccttcccatgtgaagatacagcaaaaagacaacaatcttcaagccacaatggccctcaccagaacccagccatgtggtcagcctgatctcggacttcacagccagcagaactgtgagaattaaatcttatgtttaaatcacctagcctatggtattttaattatttatttatttttattatgctttaagttctagggtacatgtgcacaacgtgcaggtttgttacatatgtatacatgtgctgtgttggtttgctgcacctgttaactcgtcatttacgttaggtatttcacctaatgctatccctcctccatgaccccaccccacaacgggccccggtgtgtgatgttccccaacctatgtccacgtgttctcattgttcaatttccacctatgagtgagaacatgcggtgtttggttttctgtccttgcaatagtttactcagaatgatggtttccagcttcatccatgtccctaccaaggacatgaactcatcgttttttatggctgcatagtattccatggcgtatatgtgccacattttcttaatccagtctatcattgatggacatttgggttggttccaagtctttgctattgtg

SEQ ID NO: 33696 - DNA, 1051 bp, Homo sapiens
acaattggcacatttagtgatagataatggaaagttcaggagagaaactagtgatgaaggaatggattagagcatagcaagatacattctatcaggtgggttgaacatagtaattagcaatctataattagcaattttggtacatagactggcatatagtttgtagcaggaaagcctgccatcagttagcctgttctccccaattaacattggtttaagagcacacttcaggccaggcacggtggctcacacctgtaatgccagcactttgggaggccaaagctggtggaggtcaaaagtttgagaccatcttggacaacatggtgaaaacccgtctctactaaaaatacaaaaattagctgggcttggtggtgagcgcctgtaattccagctactagggaagctgaggcatgagaatcacttgaacctgggagacagaggttgcggtgagccgagatagtggccattgcactcctgcctaggagacaagagcgaaactccatctcaaaaaaacaaaacaaaacaacaacaaaaaaacagacttcagttccaagaattttagagagaaggcattaaaggcattagaatggcaagagtaaggcaggccttatcctagctttctggggagatcactgagatagtaaattcggcatagaaaataagatgtgaatcactttaccaggactggcatgttaatttgggaggtggtcttacaaataatgcaggggtttagttcctactataaggatccatgttttctgaggtctgaagtttttacatatgggtaggctttctataagtgggtatgaaaggaaatattttgctagacgaggtggcccatgcctgtaatcccagtactttgggaggctgaggtgggaggatcacttgaggccaggagttttgagaccagcctgggcaacataatgagaccctttctctacaagaataaaaataaaaaaattagccaggcataggagtgcacgcctgcagtcccagttacttaggaggctaaggcagaaggattgcttgagcttaggagttggaggttgca

SEQ ID NO: 33697 - DNA, 1054 bp, Homo sapiens
gaattgctaaaagaaattccatttttaactagttttataggctaagtaaaggaagagaaaccaagatagaatctccaatatctgatatattagattgactctgtggaacatttccttttttacaaggagtcctcaccttttattataataggacataaaataaatgattgtaatatcaaatatgaaatattgtctgttgagtggaatatctttaatttcaaagccatatttatcttttgtgccataaattttagtttatatattacattataatgtatagattatacattataatttatgaaccataatattcatatagaataattatttgtgttatgttttttattacatattgaaccttaagagagtttgttggtttgaaaacaataagcatattgaagcaatcttgtttcaatatttacatttttatgtttgcatataaatagatgaatagattatgttatatttttattgtaatagatttctttatatatatacaaagtcaactaggacttcttaacctttttttgtgctatgagctgctgtggcagtctggtccatccctctcaggactgtgtttttaaatgcataaaataatacaaataggactaaaataaaaaatacattgaaatatatatattttttgcatgaaatgtaggttaagaacccctgagtcaagatttcgaatagccctttagttaatgtgtaaaaaaaaaaaatgcctgaggcaattcctaagacagagagatccataatgagcacacaagaagaaccaagctgagatacattcgttaacacgtgtgtgataaagcccttagattgtatctgtacaagtgtgttatttttgattttaaatccagaagtaagaattatcagtttaggaataagtatatgatagagacttagaggacactggttttgtttcaacttatctacatccctgtgttatctacaagaactataaaatcttggaatgggtttatgtgccaacttgagcattttagcacactacagaattttagccttgtccaattcaactgtagaactgggccat

SEQ ID NO: 33698 - DNA, 1079 bp, Homo sapiens
caattctatccaggttgctgcaaatgccattattttgttccttttttatggctgagcagtattctatagtacatatataccacatttttttattcactcattgattgatgggcatttgggctggttctgtgtttttgcaattgcaaactgtgctgctatgaacattcctgtgcaagtatctttttcatataatgccttttttccctcctgggtagatacctagtagtgggattgctggatcaaacgatggttctacttttagttctttaaggaatctccacactgttttccatggtggttgtactagttaacattcccaccaacagtgtaaaagtgttcccttttcactgcatccctgccaacatctattattttttgattttttgattatggccattcttgcaggagtgaggtggtatcacattgtggttttgatttgcatttccctgatcattagtgatgttgagcattttcccctatgcttcttggccatttgtatatcttcttttgagaattgtctattcatgtccttagcccacttttcgatgggattgtttgttttcttcttgctgatttgtttgagttctttgtagattctgggtattagtcctttgtcagatggacagattgtgaagattttctcccactctgtgggccgtctgttaactctgctgattatttcttttgctgtgcagaagctttttagtttaatgaagtcccatctatttatctttgtttttgttgcatttggttttgggctcttggtcaggaagtctttgcctaagccagtgtcttaaagggtttttccaatgttatcttctagaatctttatggtttcaggtcttagatttcagtctttgatccatcttgagttgatttttgtgtaggatgagagatgaggatccagtttcattcttctacacatggctagccaattatcccagcaccatttgttgaataggatgtcctttccccactgtatgtttttgtttgctttgtgaattctgacttcaaaacaaaattatgttcactgagtatctctgccactaaggatagtaagtatcatatgtggatgaaag

SEQ ID NO: 33699 - DNA, 1051 bp, Homo sapiens
caagaaaccccaacaagtgcattcagctaattttatcttatgattcagacttttttcccacattacaaagtgagacttttagttttctgtaattctttgcaacctgaccttatttaaagttcagctttgaattagatccaacagaggctgtgagttaaagtctttggaaggcttacttcacgtagaacctgagaatcttatatttctttaaggttttagctacttccctctgcaccatcccagctggacttggaaccatatgacctgagttttactttctgctctgccctgggccacattttcgtcttaatatttcatgttttaaaggcataatgatgtcactgactggctgatgaaatcccaagcgtaggtagtatgctacatgaggggtgagttttttgctaacaccacaaaggtctctggcccaatgagtggagtttgataggagttcttgtgacaagtctaatgttattgcatgccagttttgaggagagatgaaaacatttgaaaagcagtgtgttttttttctacgtttgtctgtatttcttactcaggcctctcaggcattacttggcctttctgttttcacaccaacttggtgagttctactataagattctaaaaagatgggtagtgcgtggttcaaattggttcatttgtaactggaaaaaatttataattaaaaaaataaaatatgtttaaaaaagccataatgatgaaactttcaattagcaatgactttgaaacatagtactatgattgagttaatggctatcttatttaacacatgcttattttttaagcaactctttggtaaaataaactatagctggcattctctgtcataaaagataaagcagttatatccttcaatcagggaatttaatatttggtagtgcagatttaaaatgtatgtgacccaggtaatacaagatagaccaataaattttaagaaaggtataataaagtgtacacaaattcagaatcttacttgcccataaattaacttgctattgtcttagttccgtttattttgtgctccaaggccatg

SEQ ID NO: 33700 - DNA, 1073 bp, Homo sapiens
tttgtttttgtagagatggggtttcgctatgatgccctggctggtcttgaactcctggcttcaagagatcttcctgtcttggcctcccacagtgctgggattataggcatgaaacaccatacctggcctcactgcaggttttgattagtccccctggctgcatatttgggctcaaaaaaatgcttttcttcatgttactaagtagactgaaatttatctttgtggttacacattatatatcatttgttatttcttaaagtcatgtaggttagtctttcacagtacataccttcgatgtttaccattttgactgaagatataatgctaaagattttattaaataaaattaaacctttataaattaattaaagttaacttataatgagttgtatacacagacagtagttcttaaggtagacctgtacttcaatttttttaaacctttatacagatttcaagaaatatgaaaaatcaggactatctatttttatttggatattatatatgcttctcctataacacaagactttttttattttaagctttggaagcagtacaaaagactgttgtgatgaagagagaagaagacatgtagcaaatcgtatatttaggcaatcatgttgatatagtgaggaatggataatgtatgttataacatgtcttatgtttttgatgtgccatccatgtgtttctaatgggcccttttgaacacacactaacaggggtttaatatttaggattagcactttcagtttggaaagtttccagcttggttcttccaggcccttagataccttctaagggtctgcaatttgatggcacagctctgatgtttcattcagcagagaagactgtgggttccttcaagttcatgcccattgctttttttaagacctatcttaagaggcctcttttccagtaagctttccttcttatctccctcttttcagattatcacttagcttcatatttccttgccagtttgcacatagtagtttctgatacaaattacccatcacctaataatattaactcattcattcttaatgaattcacttttttctcctggaatt

SEQ ID NO: 33701 - DNA, 1020 bp, Homo sapiens
aatgtttttgtgaattttgtctcttgggttatttgggatatagtaataaatttgccaatctacatcagaaaactgataattctgggagtatcttttaaagtttcaaatttgttcactgcatataaaaatattaagtcataaaattaccataagaaaaatttgaaataatttgggatttcctaaaactttagttcagtaactaccctagtcttttaaatctttattccttctaaatttaacaaatacgtttgtaacagtcactgtaccatgaagtagtgcctataaatctgaaaaaactacttagaaattatcaaaaatttcataaaattcaaatagagatgtggtaaatatattaacatttcaaggataagcagattgatcagatactcataggtagggaaatgtaggaagagtccaggggaagagaacaatgctgtttatctgaagctcaaggtacatgctttgagaaataagactggattgatctgcctatggaaggctttgtgtgtgtgataaggaggtccagtttagagtaagagtctgagaagaaaattgatatggtcaggggcacacgagttcaaatctccattatttttctgggtgaactttttgagttaagttcccaacaactgttgtggtctgcgatgccccagtaacaaggcaggtttgaaacagattttagttatgctgaaatctaaaatccttcttttatgagcaatgtgaacttttctttttaccaataaggtaagtttatgcaacctactcgccactggtagcatatcaccctagtgttggcaatagtttagtcacctcaattaagaattcttgtaagttgcctacattaattttatttatgctactcattgtaattgatcattatttttgtgcattctgattccaacattcgagtgtaagctctttgaaggcagaggcaatactttgtttatactagtagcttctacaatatataacactgtgctcatactagatactcaataatctttatgaatgaataaatta

SEQ ID NO: 33702 - DNA, 1096 bp, Homo sapiens
atctcctaaacaaattcataaagtgatagggttgtaaatttgtgtgagttagagactcaacttaattttttgatacctagaccattcatctgcctgcaaaagcaaattttaacttttgtcgtatattaagatttcatcactcattttaattaataataaagattccccacaataaaccttggtgacttgattaaatatttggattatctaaaacctcagtaatttctattttcttccaggaaagttacctcataaaccagttcctccacctgacattggctgtcttcttttctgaaaaagtacattaaagatatttggctttgaggctctcatattctctcttggcttcctcctctcacctcaatgaccagctctaacttaatattcattccagatatgaatttaatatttatttttaaaaatgttagataaacaacttcttgtgctaggcactattctaagcttcagaaattagctgggactaagattcacagttgccatatgggtcttgcagtttagatgtagaaacaggcactgaacaaataattacaacttccatgtctagcaatatggaagcctaaataattttagaaaacactttctgcataaaacaaatagaaaggatagataatatataataaattccatttcaaatgcaagactgggttcatagaaaagtaaggaaaatcctggaagaccaaaaacaaagaagaatgtgaatagtatgtggtgagactagaatattccacaggcttatgtttagcatttacatagagactggagatgggaccttgggccagtgcaaaataggaagttgaacttgaggttttagaaaaaggccaggagtctcaaagaactaaacacccaataacagcatgaactagaatgaaaaaaatgctcgtcatgtcataaaaaaataaatttatctgtttccgagatccagctttaaattaagaaaaaagaaaaagaagtatcacctgaaaattcataagcatgggcctggctgcacgatgtctgaatcttcattaatactacctgaatactcccagaacctttttttttttaattttattattattatactttaagttttagg

SEQ ID NO: 33703 - DNA, 1042 bp, Homo sapiens
agataatggaggtgctcaccatatgaaagctataaatgttgtttaaatgcaagtatttatatttgttataaatgtaaattttaaaattgggtaataattggattttgcaagtgtggctaaatataattttgtggcttatgacatgcaggtagttggaggcaaaggtacaagtacattctatcatttttcaaaggcatttgtctattcagaaggcatgatgtagtagaaacagtattctccttggagttagagtacactttaagtaaaatcttgactcttctctttactacccagcaaggtcaggaaaattatttatctctgtaagcctgagagtttttttaacatgtaaaaattgagttaaaataccattctcatagagttgcaaaaactacatttagtcaaatcaaatcaaatgaactaataaatgtaaagcacttgtcatgttcagtagttcgtagagtacttgttcccaaggcagtgtgtgtgtgtgtgtgtgtgtttgtgtgtgtgtgtgtaggggagagctcatacaatttgaaactggtcctggatgtttccaaaatactgcccccacccccgccccgcttagattggcatgttcttttgcttctacaaattggtcttattcctaaagcattcatacaaacatggtttaagaaatacaacactcattacaacctgtgatggctttcatgttgacagttattttcttatgttttctacaagtaatttttttttacctgcacttaaccataggaggccaaagaaacatcttgactagaggcattctttaatcttgttaaagaaagaagtgtggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattc

SEQ ID NO: 33704 - DNA, 1025 bp, Homo sapiens
tctggtatccattgaaatttgtaggagaaatctatacttgtctgttggaagaagatgctgtgcaaacagcttagcggacgagggtaaacaagtttctctctagctggctgccttagaatttttaatatgacactataaggaagaatttccaagaaacgagtatcaaagccagaatttttaagatgtgtttgactatagaaaccttttttaattggagccttttaagaaattagagatttaaatttgattcttagctccttttaattactgaattcctcaactctttttgtgtgaatttcacttctataaaggtgaatttgcgtacgtcactggaatataaaaagaaattagttacttaaggtaaaggccatagagatagaccttgataaaggtttgttctccttaattgagggaagtgataatggtataatgggctaagggtgaacaaaaaaaaagagaaaagtggaacaatgtacacatagtttcagtgatgttttcctagactgtgatttttaaagcattaatggtaaaatgactctaacaacttcaaagttggcttgccattttcccaaatgcccataggaaaaaaagctaacaaaaattgtatatcaccatatatagaaactatcaataaaagtatggcaacacatgaatttgtgttttaggaaggtcccacccagaaaaacaattattgctaaacccctagtattttcacttgcttagtcatggaggcagtgcctgggtgggattaactctctgttagttgtaaatgcttgcctatattttgggatgagtgccaatcaattactgtcgggaaaaccactggatgactaacttcagacatgcttacgttagagactaatacaccttgaaatgtcacatctttaacttgaattttttcatctgaattctagctattatttgaaatggaaataatgacaaataaatttgagattcgtcaaaacatggacctaatagacaacttcatatcacatagaaggggacctccttaccattaacttgaa

SEQ ID NO: 33705 - DNA, 1055 bp, Homo sapiens
tcttggagctgatagaagacctgaaagtcaagttgacagaggttaaggatgagctggagccattgttagagttggtggaacaagggatcattccacccggaaaaggaagccaatacttgaggaccaagtacaacctctacttgaattattgctcgaacatcagtttttatttgatcctgaaagctaggagagtcccagcacatggacatcctgtcatagaaaggcttgttacctaccgaaatttgatcaacaagctgtccgttgtggatcagaagctgtcctcagaaattcgtcatctgttgacacttaaggatgatgctgtaaagaaagaactgattccaaaagcaaaatccaccaagcccaaaccaaagtctgtttcaaagacttctgctgctgcctgtgctgttacagatctttctgatgattctgattttgatgaaaaagcaaaactgaagtactataaagaaatagaagacaggcaaaagctaaagagaaagaaagaagaaaatagcactgaagaacaggctcttgaagatcaaaatgcaaagagagctattacctatcaaattgctaaaaataggggacttactcctaggagaaagaagattgatcgcaatcccagagtgaaacacagagagaagttcagaagagccaaaattagaagaagaggccaggttcgtgaagttcgtaaagaagagcaacgttatagtggtgaattatctggcattcgtgcaggagttaaaaagagcattaagcttaaatgaagtttttgcttagcataaggtttttggcagttttggatcaataaatttttacttttaactaaagtcattgtattaatatataatactttaaattttaaaaattcttgtccacaaggaaatttgtctgggttattggacaatttataagaactatgggagcaatatgaaggtgcttgagaaaagagatgatgttgaagttttccaatattctgttgaagttttccaatattaagtattagcttagggaaatttcacagttcattgtggagtgttaaacttagaacatgtgta

SEQ ID NO: 33706 - DNA, 1066 bp, Homo sapiens
ataatctttttttgtaaaaactcactttgtgaagactggagagcttcatgggtaagagttccaataaagtacattactggtagcaggcatcagtacaaagcatcaacaacctgttagttttatggcagtatattaaactatagacagctatgaaaaatacaaaatattaaaaattaaagtagaagaaaacatcaaattagtgatccactaaatagctagtgatgcatttactctgccactaatcagctgactggctttgggccaatttctctaagccagtttcttacctatattcttacctatgaagaagttaaataagatcaacatgccactttaatttttgtgtagaagtaaattttattcgcttctcagacctctaagaactacctaatggtcaaagtttttggcaaactggaaaattactttttgtgatctaaaagataaaatctagcttagataacttgaataattaatttgattcacgtatcttacacaaaatatttgatatatctgaggaatggctggagttgctatgaaataaaataattttaagttaacgtgttaaattatacaagttaacattaccagaataattcaagaaaagtggaacttagtatgctttacatcttggagatcacaatgatgaacaggtactgaacaggaacactgaattatagatgttaccaaaaaaaatcatgtttctaactagaatttaaaatcacactgggccgggcgcggtggctgatgcctgtaatcccagcactttgggaggctgaggcaggcagatcacaaggtcaggagttcaagaccaacgtggccaacatggtgaaaccccatctctactaaaaatacaaaaattagccaggcgtgatggcccacgcctgtagtcccagctactcaggagaccaaggcaggagaatcgcttgaacccgggcggcagaggttgtggtgagctgagatcgtaccactgcactccagcctgggcaacagagcaagactgtctcaaacaacaacaacaaaaatcacactgaaaaaaaaagctgcttcagctaatcagattgtattt

SEQ ID NO: 33707 - DNA, 1006 bp, Homo sapiens
ggcgcccggtgaggaggcagcgggacgaccgcggttcgggcgccggattctacctccgcgtctccccaggccgcggctcctgcctggcctggtctctctcccgtcttgggctgggcgctggtcttcgccggcctcccacgtgcttgggcgggggcgagaagcggcctgcctgcccccctccacccggggcgccctggccctgtcccgggtcccgggctgggaaccttccccgaaggagtctaagagggggcggcgcccggagaccccgtggcccctctgacccgcctttttcgggctcccggcgccgcggcagctgagtaggtgtggctgctgcgccgccgccgccgccagtgcggccttagtaatactagtaactaattttttacgagcgttccttccatgccggtaaatatgacagatccgtcccccggattggaaagagaaatcggagcggtgcatgagaagacaagaagggaatgtgtggctttggaaggctacctcccagggttatatcggttgtcgggaagaggcctccacttttaaagccactggcacacgcgagcgctctgaatgcagctgacccacactccgtgctgtattttttattagtgaactgtttactgtgctggcaaacgagtagggccctagagtcgtcaatgaatataaggactcttagaggaatgttaaatctgattttcaaatacaagctcttacagtatgaaaatgtggctgacgatacaaggcatgctgtaagcgccaaatactttgctgtatgagttctggaaagggagacagaaacttgcctgaagcgatgagggaaggacctttcccaccatacaccctatatttttaaagcacaagtacaaatcttttagctgctctgccctgccaagaaaccctgactcaccttttctgccccgatccatctcctaggaaaagataatatttattgattatttcctatgtgcatgtgttgtgataatcatggttaataagtttgtgtgcg

SEQ ID NO: 33708 - DNA, 1046 bp, Homo sapiens
tttttctacccaagacagttttagaaaaattgttatgtgtataacttgaatatttaaccaatttttagtttttaatttttatacacattgccaaactactttaaacaattaaaacaaattttgaatagcatggtatcataaactttcatattagctactcatcaaagcttggttttgtctttcctgcttgcagttggttgcgtttttctcatgctgtattaacatctgaagtttccaaaagatacagttgtggttttcaagacagttggttcagcagctgaaaacctcatgatattactttctctactttttttttttaagctaacagtagtgtcctaagcaaaagagagtttttactgttaattgtgcaatgagaaactgcatgtttttctaagattgctagaatttgctttttgggatgaaaaagctgcatgctgggatttcctttttctttcttatacagatataaaactaagagtgtatgtgagatgtactacattttgtctgagaatcccacagtgtccagtcctgtggacagcagcttcccagctaaagtatcttagagacattatctctgccagcatagccattccagcatgagagcaaagggtctactggtcagggctttctttcctcatccgctcaccccccatcaggctcagccctccttagcgttctagtgtcacctagctgctcacctaagaatctgttttatcttcacttatgtcactaatattaattcctcttttttttttttttttttgagatagggtcttgctctgtcaaccaggctggagtgcagtggtaccatctcagctcactgcaatctccacctggattcaagcaattctcctgcctcagcctcctgagtagctgggattgcaggcacacaccaccacgcctggctaatttttgtatttttagtagagacagggttacaccatgttgccaggctggtctcgaactcctgacttcaagtgatctgcctgcttaggcttcccaaagtgctgggattacagacaggagccaccatgcccagcctatta

SEQ ID NO: 33709 - DNA, 1087 bp, Homo sapiens
cccagctaacttttgtacttttagtagagatggggcttccccatgttggccaggctggtctcgaactcctgacctcaggtaatccacctgcctcggcctcccaaagtgctgggattacaggtgtgagccaccaagcctggctggttaatttttttgactaacccctttaacagatttcaatccagagaaaatgttacttaagtaaattttcttattattgagtagaaatatgatacctgagacgccattaagaatagatagatatagttatggatatagatatatagatattctaagggtcctaagactctattataatttttttttttttttgtaaatgaggatagaataaaagttcatgattgtctcatacaaataagtgtcatcaggctaactaaatggtgttttattacaaggtctttttcagtactttcacttctttctttcacaattaaggactcattttctgtccagttttatacgctaaggtctttttagtactttcacttctttctttcacaatcaaggactcattttctgtccagttttatactctaagaacaattattgcaaaagttcaaaatagatttatttaaaattattgttcttcagtcattcccaacatagagtaagcttttctttctatatgtttctgttagtttgttgtttttaatctcatattaaagcttttttttttttctttttttcttgagacgggggtatcactctatctcccaggctggaatgcagtggtgtgatcttggctcactgcaacctccgcttcccgggttgaagcgattctcctgcctcagtctccctagtagctgggattacaggcgcctgccaccatgcccagctaatttttgtatttttagtaaagacgaggtttcactgtgttggctaggctggtctcaaacttttgacctcagatgatcctccctgagccaccgcgtgagccaccagcgtgagccactgcgcccagccaaaagcttttacacatctttgaaaagtcttctgtgtgataaccattttgtttcttatataagataaaagctttaatctgttagataataagaaaattctgaag

SEQ ID NO: 33710 - DNA, 1050 bp, Homo sapiens
gtataaaggtcaaaactaggtaaaatcaatctatggtgatagaaatcaggataatagttaccttgaagaggtgggggtagagattggaagagagaaagaatccgatttctaggatttcagtactgttctctttcctgatcatgatagtgattacacagatagatgtgttttttgtgaaagttcatggaactaacagttagctgagatttggaaatgtgtgaatgttggaattcagccatattccacttctgaacagttcataaggttaggcttttgggacaataaactgtcaaagaaccttgttcattccagttctactcagtttccttcagaggctatcaaagaacaaaaatagcatgtgatcagtttttgagagaaacagtaaatttgcagctcattcacttgctgtttttgtgctattttgtcatttgttaatatcttttttttttttttttgagacagagtctcactctgtcaccaggctgtaggctgtagtgcagtggcgctatctccactcactgccacctccgcctcccgggttcaagcgattctcctgccacagcctcctgagtagctgggactacaggcgcacaccaccacacccagctaatttttgtatttttagtagagacggggtttcaccgtgttggccaggatggtctcgatctcttgatctcgtgatccacccaccttggcctcccaaagtgctgggattacaggcgtgagcccagcctattaatatcttttatagtgaatcagaaaagaaataaggaactaatatcagtgaattatattgattgttaacagtgattgaggttgacctttacccccaggtaacttgttgaaaacaaattgattgcagtgttgttttaatcatgatgtcaaattgactgaaaatgaataattcaggtcactgggttttcgtgttttgttttgttttgctttaagagactcgcgctctgtcacccaggttggagtgcagtggtgcaatcacggctcactgcagcttccacctcccaggttcaatcgattctcctgcctcagcctccc

SEQ ID NO: 33711 - DNA, 1034 bp, Homo sapiens
tcaagcagtcctcccgccttggtctccccaagtgctgggattacaggtgcgaaccaccatgccgagctaccaaacaaatgttttaagatgcataaaagattgcaaaattatctgatggtgcatcacaagtacaaatatgtcagaaaagtctgaatacctgcttcaaccacaatactgttcagtcacgtctttctgccagcctattatttaaagaatctattcatgcgcctattatttttttcttttaaaaaattttttctccagtgccacttgccaacatccacctattattctaaaagtaaaatatttactaaagcctttctttttgtagttttttttttactatttttgtagatggctataatcaaccatgatgactatgattcaaccatgaatcaaccatttttgtccttgtctctggatttttgagatttttgttacaataaggaattctgtggatttctcttacagtgaattctacgaacccaatgccctcatgatggaagaagaaggagccataattgctggtctgttggtgggtctgaatgtcattgatgccaatttctgtatgaaaggagaagacttggactctcaggtatgggaaagagactcattcccatgggtgtcactctgagttctgctatctcagaagtggatttgattaggttataccaaccaaattaggccatattctatgagtcataaacaggatttccttccattttgatgggaatataaaaaaaagattgtttttccttccagtttggctcatttatacgttacgaatgttttttagattcttgtcttggctgtactctctgttaaacatacatatacacacacacacatacacatttacatacacatacatacacacacaaacacaggtatacccagagatattgcaggtttggtttcagatcacaacaataaagcaaatatcataataaagcaagtcacatgcattttttggtttcccagtacatgtaaaagtttgtttatactaggccaggtgcgattgttcacacctgtaa

SEQ ID NO: 33712 - DNA, 1068 bp, Homo sapiens
tccctcctcccatctgatcctccagaatcacactttaattacaagaggaaagaatcacatctcattttgatgctagctgccagtaaactactttcagaatcagacaaccatgggatcctgtattgctgttctagaaaaccatggccacttttcacattatagtagaggatgagggtcttttttatcctatagggtaatttctactctgcagtctaccgtgccagctaagttatatattctattagcttttacactggaatgtgatacattgatgaactattactgtgatcacactgcatataacaatactaactttagataaattgcttttttttccatttcaggattaactgatattgaaatatatgaacatttctgttttcccacttaccattagattcaaaaggcatgtgtggttgtattttaggatttatgttatacaggttgtttatcgttattttccataacagagttcagacttaggagtaaaacagaaaagtgaactaaacagtcgcttggaagagaagactaatcagatggctgctaccattaaacaacttgaacaaaggtaaaagtcctgtttctttaatgaaacactttggattgtcagtgctgaagtgaaaagaatgtgctgtacattcggcaaatagaaaatacatgaaattcttccaaattagcatcagacattctggtagaaaaaagccagttgaatgttatgtgtgttttctaaggtatgactgaaatgtttttaggaaatgtcaatcacttgactagcctttaaaaaaaaaaaagaaaggtcagccttttatgactgttttgaacatcagaactcttaatccatgtcagagtcatgtgttagaggaaggatacttaaaagcatggaaggactcttaaatgtatgtatgtaattctgtgattttattgttcatcactgaagtctttgaatacttggatgctaggggatatagaggcactgagagataggtgtcctccaaggatctattctggatctttctctcccttctttaacccttttctcttatctcccttttctttctcctgggtagt

SEQ ID NO: 33713 - DNA, 1027 bp, Homo sapiens
gtttgttcttgcttcaattttagcagaattcatattactctgataggggctcttttttcttttcttttcttttcttttttttttttttgaaacagagtctcattctcacctagaactgagtacagtggcacaatcatgcctcactgcagcctcgatttcccaggctcaggtgatcctcctgcctcagcctcctgagtagctgggactgtaggcacacaccacaaaactcagctaatttttgtatttttttggtagagtcagggttttgccatgttgtccaggctggtcttcaactcctgggctcaagcgatatgcctgcctcagcctcccaaagtgctaggatgacaggcatgagccaccgtgcccagcccggggttcttttcaaactgatgtcttatcctttttagtgactcaaaccaaatcctgattagatatattaaaataagttaatacaagtttattttggtgcgaaatatttttgaagtccatgcacagtcttttcgtaatacgcgttttccatgaactttttgaatacctctagtatataacaaagcaggaagagttcataaactatttaaaatttctagagagtgagctgctaatttactggcaaatagaaaacaatggtatgtggaaatttattaaatagtaccactactaataatttaaagtgtacaaagaaccactctaggccaggcacggtggctcacacctgtaatcccagcactttgggaggccaaggtgggcagatcatgaggtcaagagttcaagaccagcctggacaacatggtgaaaccctgtctctactaaaaatacaaaaataagccgggcatggtggtagtctcctataatcccagctactcgggaggctgaggcaggagaattggttgaacccgggaggcggaggttgcagtgagccaagactgagccactgcactccagcctgggtgacagatcaagactccatctcaaaaaaataaaaaaataataaaaaaaaacactctgtgtagcatgctatctttattat

SEQ ID NO: 33714 - DNA, 1013 bp, Homo sapiens
tacggaaacttcacagggacctcatttaattttgtggactcaaatcttttaaacacatccttagcacctgctgtgtgccaggcgtagaggaagataagagattccagagatggtggatggtatatcgtcatctatgatagatgcaatacaatcatgggggcccaaagtatgtgtagcaatttgttctacttaggctttaggaaagtttcatgaaagaagtgggtgataattaatggaaggtgaacaagagctctctaagaagacaaggggaaatgggagagtacagtcagaggaaacatctttgagtcaagaaattgcctgtgaattgttcacttccacgtttgtgcaagaggctgtagaattttggagctagcaggggtctattagtaacatggcctacttacttctttttgctaaaggggcaaaatcaccaacttgaggttggtggcccaattattggcctggggacagttggaactcaggtctcctgacgtaggtgtttttccttcctgacattttgtgcatataaaaggcagggaaattgaggataaaagtgagttctaagtaatcattcaaaaagtatatttcatgttctcttaagtttctagcatttttaaattatgggtctcttttgactaatggaattctgaaaaaaaaaaatttgacttggaaaagaccaaagtgtaatttcctaatgtaaggctacttatttggaacggagttaaaacaagtacatttaatttaactttttcttgttaagagacagggtcaccgaggacggtggtggctcatgcctataaccccagcactttgggagactgagggggtggaaccttgagcccaggagtttgagaacagcctgggtaacatggcagaacccccatctctaccaaaaaacattagccaggtgtggtggcgctcagctgcttaggaggctgaagtgggtggattgcttgaacccaggaggcagaaattgcagtgagccaagattgcaccactgcactccagcctgg

SEQ ID NO: 33715 - DNA, 1061 bp, Homo sapiens
ttttacttgtaaatttttttttgccagagaatagatttctgcaacatcattttgaatggctgatgaccaagtattatcttacagttttttatctgacaacaaaaaaggatatcagatattatatccttataatatattctccactgtaaggttattttatttttttctttttgttattaaatatatagaatttaatataacattaaaaaggataacatcttacatatatgtcatatattatatccttatatataatatatgttatcctttttaatatgttgtatttttgagggaatgtggggagtggaagtaaatatggtcatcttttcagaaagaactgtagttttgggaattgcaggactgactggctttagtttacttttatcatgtttagagatagcttttttttcctttacatactagagtgcaaaataattgccatttggttacttttaccattattgatttctttctctaagtgtagttgcagtttttgtactttcggagtttctgatatatgaaagcacgtgtctaatacatgtagcacttccctaaactgtgtatttgattaggagatattgaggcaaaatagctacatgttacttgaaaaatatgaaacagttctacctgttaggaatgtcaaactgagtcctgtagagaactttaactctccttttcttcctacgtttccatttttgttttatattaaccaacttaaggccatctttttttttttttttttgagacagggtctcattctgtctcccaggctggagtgcaaaggcactatcttgactcactgcaacctctgcctcctgggttcaagtgattctccagcctcaacctcccgagtagctgggactacagtcgcctaccaccatgctgagctaagttttgtatttttagtagagacagggtttcaccatgtaggccaggctggtcttgaactcctggtctcaagtgatctacctacctcagcctcccaaagtgctgggattacaggcgtgagccaccgtgcccagccttaggtccatcttttacaacacatttaattaagtata

SEQ ID NO: 33716 - DNA, 1106 bp, Homo sapiens
atttaattttattattttatttttggagataaggtcttgctctgtggctgagtctgtagcacagtggcccaacaactgcttattgtggcctccacctcctgggctcagatgatcctcttacctcagcctcctgagtagctgggaccacaggtacacgtcaccacaccaagctaattttttttttttttttgagatggagtctcactctgtcgcccaggctggagtgcagtggcgcgatcttggctcactgcaagctccgcctcctgggtttacgccattctcctgcctcagcctcccgagtagctgggactacaggcacccgccactgcgcccagctaattttttgtatttttagtagagacggggtttcgccgtggtctcgatctcctgaccttgtgatccgcccgcctcggcctcccttaatacagccactgcgcccagccttaatttttaaaattttttgtagagacagcgtctccctatgttgcccagggtggtcttgaagtcctgggcttgagcaattcacccgtctcagcctcccaaagtgttggaattacaggcatgagccaccgtgcctggccagaatgaagttttaaaatttaaaatttagatttaaaatgaagttttaacaatttactagaaaaataatgcttttttcgaaattagcatatagtatagtctataagggtggatttcacaaactgagatatttaactcagtgtatatcttgtttcttagtttttttttgatattttactacaggcaataaactgataatttagtgtacataaacatgtttgggaggcagatggcatatgtggagctctaaaaataactaaattctgggggtagatttaaagttacttttcacttacttctcttaattcttttattgcttttctcatggagtctgttagaaagctatgccagggtttttagtttctgattatttcaggatgaagagtttttttcttttagtaactctttccccaaagtatgagtaaacagtcgtgtccaattgctagtgcatgtgaagaatatgcttttatggcatgcttgttatttttgagtatttacaagttgaactattaagagtaatttatatg

SEQ ID NO: 33717 - DNA, 1045 bp, Homo sapiens
tgatgataaggactgactttttgtttctaaattttattagtttccaagttgatggtatgcaagtctaaaatggatttgaaaagttgtgccttggatttgcttcagttaacaggccatatggagggactggataatgaatctgactagtttggcagatctgtggatgaactggttctcctgggcattttagtacttctcctactgcagtctgccctggatctttattagcggactctggtgcaggaatgggttttgaatatcacatctgttttttgtccttttgttttttttaaaaccacattctaaataagttttaagttaaggactatccatcatgtctgagggaaaaatatgtcacaaagaatgtttctgtgccagagggccattagtctttggtctgacttcctagttaacttcctctttttttagtcttcaaataactggccttagaaatgcagactaagagcagtgacagtattctcaccatgctctaataataagagaaataacaggcaaaaatgaaaaagaggtggaaataaaagagctgaccagttttttattgttgctattattgttgttggaggttgagaaggggagatggtcatcaggagaataaacaattaaacatcttgaattcgtgttgtttttgtatatctacaggcatatatttataaatgcctttgccacttcccctgttctcttaagaaatttgtatccatcttccccctgtacacactcctcacactgaaggcacacattttacctatataaacatactttaggagattgtaacttgccaaaactgttgctctcaacagttactttactgtggtatcccatgtccagaactcaggaacaaagaaaatgttgtcctaaagtttgcatctgtgtttggtttaggcagaacatgattgctaaagttcaggttgtggtggtttaagagagtatattctccctccagaagggttaattttactggactcagtgatcttacactgtgtttcccaactcctagcaaatagcaagggattgatacatagcattt

SEQ ID NO: 33718 - DNA, 1050 bp, Homo sapiens
ataactagcatgcaggtgatcctattattattaacatattcttttatcaggccgtttattgtaatctggtcatgtcttcatgatgttacaatttgattacctttgttagagtttggtgcacattcttggaaggtagcttcagcttttttgtgtgtattggggactgctccgttgttaattctctgtacttctgtacagagggggtagtatttttgagatatagttgtggaatatgaggatggttgggtgggtggcttccctgtatctttggatattttcttccactaaactcaagaagtgagattttatttcttcatccagtagtccttcttccccagactcatccttgatctattccttgaggttatagtatgaatcacccactattcaaatgtcaatttttcttagaatgctgttagtgatgagaagtgactgttttcagacctaaccttggcaaggtcagtcctactttgatgttcttgtttcatcacacttcttggcatttgtagatttggaagaattgggcctttggtacctctgatctcttcgtttagcaacttactgtgcacccatatgcttagcttttgctgttttagctttttttttttttttttaacctgccacctagtggccgaaatgttgctatactattgataaggtactcctaattttggcaaaatagtaagaggcaaagcaccaaagattatgttctctcccttctccaaatctctcttggtgagaatgatctttaaaacataccactcagattattagcaatcttggtatggaacgtttttaaaaataataataatgtactttatgtggtgatttatgttattatttaggcccaaagttttgatttaattgtttccttttagcttatttttgagatatgcagtctgttaggaagctgtctctgtcttgttttttcattgagctgaattcttttggaggatcactattattgtgaagtactattttacttttaattaaaaaaattaagatatttttatttttaatttacagataaaaattatatttaattttata

SEQ ID NO: 33719 - DNA, 1034 bp, Homo sapiens
ttaaagaaatgcacactagctggtgaatcatgtaaataaacaggattccttgcctgcctctgtgagcgctgtagacctcatatgaggactgctattgttagaggagaagcgtcctgagagactctgctggacttaagtgtggcgagatacatatctgtttcttggagtttctttgtgtttatttaaaataatatgaatgaaatctaagaccagagttgatagataagattgggagtggaaagaacaaactgagaagaggaaaatctaatgatgattaacatttctaagtgtttttttcttgattgctaaatgaaggaatcagaatgcatgatttgatgggacaaaggaagctataagcagaacatggatctcagttgatgctgtttccaaggacaacctgtgacttatgaaatttatgtatttttagggagtcatttagcaaaatggataaagaacatccaggaagctagtaagactttacaaaactggatcttactacttttacataatgtaggaatcttagaggaaaggaggaataaagttttatttgaggtcagctaagttgtattccaaatacattttgcctttctcccaatatataaactcttgatacgtttgggtcacaaaaatggaaaatatgctgctgttcttctgacatgaagatgatctttttatcctcagtagtgcacagctttggttatttttccagcaatagggatggagtctcctttactcagttctgtctatgtatgtttacacacacacacacacacacacacacacacacacacacacacacagacacaactcatttgtagaggtggctgatttaattttgtcggaagccatattaactactttcgtaatacttctgtggcaatggcttttattgcatttggtagtctcagcagtgcaatgacatttctaacaagacattgaaaatacaatgagagccaggtgcagtggtcccagatactctggaggctgagttgggaggatcacttaagcataggagttcgaggctgtcatgtgct

SEQ ID NO: 33720 - DNA, 1035 bp, Homo sapiens
gctaacaaattacttgtattttggctgagcgtggtggcttgtgcctgtaatcctagcactttgggaggccgaagtgagtggatcacttgaggtcaggagttcaaaaccagcctggccaacatggtgaaaccccacctctaccaaaaatacaaaaaaactagttgggcatgatggcacatgcctgtgatactcaggaggctgaggcaggagaatcacttgaactggggaggcagaggctgcagtgagccgagatcgtgctactgcactccagcctgggcaacagagcgagactctgtctcaaaaaaaaaaaaaatcacttgtatattattaaagtgtttaggattatacatacttgtccatttcttgttaaataaaagtgtcaaccacacagtgtccactgtgcctggacttgatactgtagtttggtttaagttttcttatgcatatacttttaactgagatttttttttggtccaacaagtaaagtctttgcagcatctttttataatctgtcactcatccagggtctccgcctcttctacatttttcttttcttaataaaaaaaaataaatctcttaattttgttctacctacattcctcttggcaatagctacaacatgtcttgggcatcttggcagaagaccaggttatattagataagccagggaaggcagtatttaactcatattttgggaatattgctgattagttctgaaagaagtatataaaatgctgcatgttgtagaatctttgctttgaactggagagaacagaaattcagctgaaagagtaagagtgtggctataaatcaaatctggaacatccctcagtgtttaattagagatgtatgtaagaggctggaggtaggggatggatggtgggaggtggggaaaggtagacttctgggtaaagattttacctgtcctttggtgatcctttagatagaatacagtactgacatatcaggttaaaaaattatatactaccttattccaaaaagctttagggtgaagggaaagtaactgttgaaaag

SEQ ID NO: 33721 - DNA, 1059 bp, Homo sapiens
tgttttctagatctcacaggtgtgtttcattcttttttcttttgtctcctctgactgtgtattttctttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtatttttagtagagatggggtttcactgtggtctcgatctcctgacctcgtgatccgcccgcctcggcctcccaaagtgctgggattacaggcgtgagccaccgcgcccggccgactgtgtattttcaaatagcctgtctgcgagctcactaattcttctgcttaagtctgctgttgagagactctgatgcatccttcggtatgtcagttgaatttttcagctccagaatttccacttgatttttaaaaattatttcaatctctttgttaaagttatctgataggattctgaattccttctctgtgttatcttgaatttcattgagcttccgcaaaacagctattgggaattctctgtctgaaaggtcatatgtctctgttacttgggattggtcattggtaccttatttggtttgtttggtgaggtcatgttttcctagatagtcttgatgcttgtatatatttgtcaatgtctgagcattgaagagttaggtatttattgtagtctttacagtctgggcttgtttgtacctgtcttgggaaagcttttcaagcattcaaagggaattgattgttgtgatctatgactttggatatgatatcgctgcagccatgtctgcgttaggcagcaccataagcccagtaatgctgtgactcttacagacttgcaggtttaccacctttgtggttgtgttaagatctgagagaattccctggattaccaggcagagactcttgttctcttctcttactttcctctgaacagaagaagtctctctttccatttgagctacctggagttgggggaggtgtgactcaa

SEQ ID NO: 33722 - DNA, 1029 bp, Homo sapiens
tgatgaacatagatgccaaaatccttaacaaaatactagctaaccgagtccaacaacatatcaaaaagataatccaccatgatcaagtgggtttcataccagggatgcagggatggtttaacatatgtaagtcaataaatgtgatacagcatataaacagaattaaaaacaaaaaaaatcacatgatcatctcaataaatgcagaaaaagcattcaacaaaatccagcatccctttctgattaaaactctcaacaaaattggcatacaagggacgtacctcaatgtaataaaagccatctatgacaaacccacagccaacataatactaactggggaaaagttggaagcattccctccaaaacctggaacaagacaaggatgcccactttcaccacccctcttcaacataacactggaagtccctagccagagcaatcagacaagagaaataaatggcatccaaatcggtaaagaggaagtcaaactgacactgtttgctgatgatatgactgtttacattgaaaaccctgaagactcctccagaaagctcctagaactaacaaaagatttcagcaaattttctggatacaagattaatgtacacaaatcagtagctcttctgtacaccaacagcgactcaacggagaatcaaatcaagaatgcatccccttttacaatagctgcaaaaaaataaaatacttaggaatatacctaacgaaggaggcgaaagacatcaacaaggcaaactataaaacactgctgaaagaaatcatagatgacacaaacaaatggaaacatatcccatgctcatggatgggtagaatctatattgtgaaaatgacagtactgtcaaaagcaatctacaaatttaacacaaactctatcaaaataccaccataattcttcactgagttagaaaaaaaaattccaaaattcatatgggaccaaaaaaaagcctgcatagccaaagcaaggctaagtaaaaagaacatctgaaggcatcacactacctgatttcaaactatatt

SEQ ID NO: 33723 - DNA, 1043 bp, Homo sapiens
tctagtgtcaattgaacttcagtgttaaaagagctgaaattcaattcaaataatgacttccttcatacttgaacagactttggtgcctgctgattgctatctactttggtaacacttgaaagtgagtgtgctgcttcacttcagagctggtttctaagcaaataagtactaagtggttttatggttattctggtataaaacctgagtattcaaactttcagacacctttttacattcttcatttctgggattttagaatcccttttgggttgaattttatgataaaaaaaaagtaattatacattcaagggcattttggaacagacccaaacattttttaaagtatttgctgtcaatccttttttatttgaagtgagggatataaataagtaagttaaaaataaaattctgctgagcaaaatggcaagctgtttctggtaccataaaaatcttacctaagatttcttgtccctggctaagcatccagaagtgacccagagtgacctatggaagacttatggaagtcatttttggacttctgttaaatcacaaccttggtatatcagttgggcaggtagtattaggcagaaatatgtggtgaaaagaacaggaggtaagaatgcctatatatctactctttgtcatttactaggcacagatcttgggctcttccattaacctccaccagcctcattttcctcaccattaaatgggaataggatactttctttactgcagagggtcatatggaaatgtaaataaagtgatgaatgtgaagtgctttggaggccttataagctgggcaggcatatgatgttatcatttttattgtcctcattatctccccgttaggtgatacatgatcaatatcaaggtgggatttatcccacgtcaccttttgtagatttttttgtaaattttttcttactcatttactcatcagatccccgcatccacagtgccaacatgccacagggcaaaggccctgtgtgataagtgagggattttttccaacttggttagaggtgaacctaagtggggtt

SEQ ID NO: 33724 - DNA, 1063 bp, Homo sapiens
aaactagggagtgatctggtgaaactggaaagaatccaaggagttccagggaaatctttcattcattcatttgtagattattccacaaatgtttattaagtatctatggtatttatacagcacctacagtactatttagggcactgggtatagcttacaaactgcttaactctgaatatcttttgtgcaaggaataagtagtataatagtcccttgaaatacaggaattcacctagagatcttctcagatcctcagatgtgcacgttttatatcatgtaacttaatccagaaaataaagcataagcaaactgatatttttacacagcaatgaattttgaaagcaggcagagcttctagtctcatataaggggcttagaacttgccactgcatcctaataacaagtaaaaagctgaacaaacaaaaatcaacaactcttcttaacttcatcagaaatgaggacacagggaaaactgctgccctcaaaattggagagacagataggaagatacaggaaatcataaccagagcagaaacctctgggaaccagtgctggggtaggaaaacctgaactgtaattgatgaaatgctgaaggctcactgtggacaagcctgagagtcaaaaactccagggaaacccagtcatagaggagccctcatacctttgtgaactatacttccagtaggactagtatagcatactcacaaagtgaactcagttacgatgccagttgcaggttgggaagtactggcctacaggaatcagagtccatttctcctagtaaacagaatacgtaggtccaagaacaatgtaggtgcagtgtatgtacctattactattagacctaatgcccaggttgactatataattgactacatgatttattgtccaaatggagatacctttaagaataaaatgaagcatcaatcaaatatacataatgtttaataatatgtatgagttgacaaattggttttattatattggtgaacctataagatagttctgtttaaaaaatattttcaagggtgggcacagcagcgcatgcctgtaatcccagcaa

SEQ ID NO: 33725 - DNA, 1051 bp, Homo sapiens
gccacagatatttcatccatataatttcaaaggcataatctaagagcaaagtacatttctgttttttatttgtttggatttgagccacagatgcaaagtagatcatgcagtcgtctgtttattcacagttaatatttgcttcctttttcaagaacaccatttaataggcaaaatataacttataggagcctcaagaatgggaacatctagtaaagtagttaccctatggcccaagagaattctgggctcaggtgaggttcagtgtcttaaatgttcctggagttcacagcattgtgtgtctctagttagttgatgtaatagctcttgaacagtaggttcctatctaacatatatgcctggacatgttctcccaaaatgttctagttcagttcagagttcagcacaaattcagttgctgttgctgctgctgcttctcttccactgtcctttctacctgtcagtctacactgaaaattcatccgtccttttactgagaaggaggccatagctactaggaggtatgagtatgtgactgtgtatgaagtctgatgaagctttcgatgaacttggttaggtttcttggatgagcagttcaaactagctcatcccagggtagtagacaacactgtgatgtgcatgggaagtctcacatccaacccacacccaataactatgtggggtataaaggccttgccatgtgaaaggttattctagctccagggcttccagtgggttggctgagtctgttgtttgactcctcactcttccgactcctgcctcctttctctcccttccacagatactgatcccatggatattccttagttccatgatgaactaaactcaaagtctactttctggaaatcccacctacaacacctttatagctgtaaaaatctttgttagagctatgcttggaaagacagatgcctaatcttccattttgccttcctctcctcaggtactagccctgtggtgaggttatggattaaagatacactgtcagagtaaagacaatatgtgtgattagagtttagaaggaagaaagtga

SEQ ID NO: 33726 - DNA, 1133 bp, Homo sapiens
ccttggccgtagggagtcccactgagggccaagatggacctggggcaggcagccatgccaccctggtgccactatgggtcaaaataaagatttgctggcctttgatgttgcctctggcaaatcttggccagaagggggaaaatgtaaaccaaaaattaaattctaaggaccctcaaccatctgaatggattttctccttggcaagggtactcttttaaaagttaacctgagaggccgggcgcggtggctcacgcctgtaatccccgcactttgggaggccaaggtgggcggatcacctgagcttgggagtttgagaccagcctgaccaacatggagaaacactgtttctactaaaaatacaaaactagccggtcatggtggagcatgcctgtaatcccagctactcgggaggctgagacaggagaattgcctgaacccgggaggcagaggttgcagtgagctgagatctcaccattgcagtccaacatggacaacaagaatgaaactccgtctcaaaaaaaaaaaaaaaatttaccctgagagactgtttcaggccatcatgggaagtgggggtcagacatacctcattatacctctccagcattaacatcaacacagatctttaagtctgataagaatcatttacaatctattctctctgaagcctgctacctggaggcctcatctgcataattaaacttcggtctctacaaccccttatcttaacccagacatttctttctattgatcccaggtctttagataaactcaaccaattgttaaccagaaaatttttaaatctgcctataagctggaagcccccacccttcgagtgttcccacttttctgaaccaaaccagcatatttcttaaatgtatttgattgaagtctcgtgtctccttaaaatgtataaaaccaagctgtgccctgaccagcttaggcacatgttctcgggacctcttgagggctgtgtcatggctatgatcactcatatttagctctgcataaatatcttcaaataaaaaaaaagaaaatcaacaaaaacattagagttaaactacacactagactctaaacacctaattgacatttacagactattttacccaactgctacaaaatacacattcttt

SEQ ID NO: 33727 - DNA, 1050 bp, Homo sapiens
ttttctgatcagaatgaaataaaacttgaaatcgataataagaggacccttggaaactacacaaacacatggaaattaaacaacatgctcctgaatgaccactggaccaatgaagaaattaagaagcagctaaaaaatttattgtaacaaaataggattatattatactaaaatctatgggatacagcaaaagtcgtactaagagggaagtttatggcaataaacacctatatcaaaaaggtagaaagacttcaaataaacaacaaaacaacgcacttcaaggaactagaaaagcaagagaaaaccaaacccaaaattaatagaagaaaagaataatgatcaggcagaaataaatgaaagtgagactaaaaaacaatacagaagatcaatgaatcaaaaagttgtttttctgaaaagatagataaaattgacaagcctttagtcagactgaaaaaagagaagatacaaaatcagaaatgaaaaaggagacataacaactgatatcacggaaatacaaagaatcattagagactattatgagcaactaggtgccaacaaattggaaaacctagaataaatggataaatttctgcatacaaccaacttactaagattgagctatgaagaaatagaaaacttcaacaaccaataacaagtaatgagattgaagctataataagtcctcatctgactaggtgtggcagctcatgcctgtaatcccaacactataggaggttgaggcaggaggattgcttgaggccagcagttctagaacagcctgggaaatatagcaagatcccatcactacaaaaaatgaaatacaagaaaaattagccaggcactgtggcatgtatctatagtcccagctactcatgaggctgaggcaagagaattgcttgagcccaggagttcaaggctgtagtgaactatgatcatgccactcctttttagcttgggcaacagagcaagaccctgtctcagaaaaattaatagtactacaaagctatagtaaccaaatcatcatggcattggtataaaaacagacacaca

SEQ ID NO: 33728 - DNA, 1048 bp, Homo sapiens
gatttgtgttattttacatgagaagcaatatggtgtgctaacagaggctttagagtaagatagaccagcaaggaataccaactctgtgctctcagtttccttccttgtagggttatgacaatatacctagagtgccatgggactaaacgttcaaccagtctctatcaagtatgtataccaacaggcaaaggatttattttattttacttcatttgctttctctgtctcccactacgagattgtaaggtgcgtgagaaaagaaatgttggtggtatttttttccactgttgtatccccagcacgtagaacagagcaagaaacatagtgtgtgctttataaattttcattcagttaatttttaattgagaatctacatgtgctaaacactgtccaaggctctggatatacattaatgagcaatgacaaaactctaccctcagggaatttacattctttgaggatgataaattttgacttagtcaaagggaagtcagtagttgaatatctaatagttatctcgaactcaacatatccaaaactgagctcctagactttcttcccctagggggcttatctaaagccttctccatatcaatgaatggaaatgccacctttctatttgctcagactgcaaatcatgagtcattcttgagtcctgtttttctcttaacactcctcatcccaaccttcaagaaagtctgtctgctctagttttaaaatatgtacagaatccaaccacgttttgccacctcagtttctcccactctggttcaagccactactgtctttctctaagagcactgctgtggcctcctctcagatctacttgctttcacccctcccctcttaggtctgttttctacatagcatagcaacagcgaattcattggaactatatcagtcactgctctgttcagagccctgtaatggctcctctttgttcttagagtaaaagccaaaatcttagagtgaccatcaagacctccgtgagctggggcctcgttggttcttgaatctgatcttctacactcttctttgctcactctgc

SEQ ID NO: 33729 - DNA, 1066 bp, Homo sapiens
cttcaaaatgtgttgtattgtcctacagtgtcataaagaacctgaaaatgaacttttgtttctaaagttggaccttgctgccatgactgtttagtttacagaaacttgaccccggctcatcctgtctctggctgtggcccggcaaagcactgaaaacccctctggtctcagagacagtaggggcagtgccactttctacaacctgccaacccacacactggagtaattctgaaaaaaattattcctaaactctctaagtgtggacggagaatgagcaagccccagaagtattttacaaccagagtgggtaatgaggagggggcttactggaatcgtcatatctctgaatattgaaaacaacaactaaaaaagtggaccttctcagaaaaaaagggcagcaaatgaccaagggcgccccttctggccgtgcttggcttgagtaactgtctctctttccccacccccatcacagggctttcagtttggcaaaggaaaagcagataaaaacagaacattccatatgtttctttctccatcggccaaaaacattttgacacaatgtttgtgaaacacctttggagaggtgcacttctgaatgctgcctctgccgtaaatcctggggcaagggatcagcctcttcccaggaaccatcgccttctataaaccgtgaactcaagcaggcattttttttttcttaccgaaaggctgctattgtgcaagggcacataatgggtctgttgctcttattggcttccaaatgtgcatggcaaagagagagatgtgggcctagagcagatatattcagcaaggtgacagcttcccataacaattctaacacttcttatcttatgtgagaataaaatatttaagggttgaaccttattttgccaaatgtatcttttctgcttttgaattgggcagaagattttagcaactatattctacaaatgttacttataacacacacacacacatctgaaatatatgccgaaaattgacgtctttgacctcagggagagcacctgtccaggtctgcctaaaggaaatggctccagtgggtctaaac

SEQ ID NO: 33730 - DNA, 1051 bp, Homo sapiens
accatggagggggcatccacatgccgcctccccctttgccctccttccgctcctgaaatcccagagttattcaatcacgcccccagctcagtccccattgctgccgttcggccggactgacggcggccgcgccccgcagctctgtaggccctgaagctcgggctaggagagtggtccgcaggtggtaccgcacgggaagggacggatgcgcggccgagctggcccgaactgcctcccacgcccctcggggccgtgggcccctccctctttctctttcgctcgtctgcactggccgagaggagcctgaagtcctgctccctccctcgcagtctgaaactggggcgttggggaaaactgcgagaaggtttaaaacccagctgttggtgagagcatttggctaagaataaaacgatattctttgaaggacaaatccacctgctcctgtcccatcaactggaagagcggtcgttctgcctggtgttatttgttcagatccggcttttcgggctcacccaaatatatatcatttggcaaatgctaccttgaacgtagtagggatcttaagcgctcaaactgctttggggacacgtccaccgctttctgcctgaactcctaatgacatgatttgcggcgttatttaaaaaaaaaaaaaaatggttagccgctgaaaacattatttaatagttgcttagattctaggtttagaatacacttattttgaagtttggttagtgtttaatggaatcgagggtgtatgcctttttgaaataaactttttatttgagaagaattttagatctacataaaagagactaagtataacactttaatggctaactttgttaatgggatcctgagggataatatagtagctttcatttgtcaggctcttaccttgtgctaggttctgtgctgagctctttatattccacattatgctttaatcgttaactaccctgcaagataggtgagagtattctcaccttaaaagtcaaaaaatgagactgagaggggtgaagtaggccggacgcggtggctcacgcctctaatc

SEQ ID NO: 33731 - DNA, 1050 bp, Homo sapiens
ttttgtatcctgaaacattattgaagtcgtttatcagctctaggtgccttttagtggaacctgttgggttttccaggtttagaatcatattattagcaaagagatagtttgtcattttttcctattcggatgtcaattctttctcttgcctgattgctctgattaggacttcctcctttaaattttaagtgtactttcaccatcctagttctatgctgtcttctttttaatcttttgatagtttttctttttttggaaacagggtctcactctgttgaacaggctggagtgcagtggtgtgatcacgtctcacttcagcctcaacctcctatactcaagcaaccttcccacctcagcctcctaagtagctgggactacaggtacaaggcaccacgcttggctgatttttaattttcttgtagagacagggtcttgctatgttgcccaggctggtcttgaattcctggactcaagtgatcctctcaaagtgctgggattgcagccatgagcccctgcacccagccagtagtttttcattttcacattcctcatctcagttttttctttcctagtcactcctgttcccattgtgtcttttttggtcatctttgtgtagcaatgaatataaataaatagccctattggctagcaaaaaatgttttttttaattgaccagttgttagactataattctgattatgcccaatttaccagttgttaaatggattgtttgtcattttcatgtttcccttggtaagtgaaattgtgaacatcatgtagcaattatcattttttgattttacaaaatggcagacaaaatgagtaaagtttaagttctctttactcctgtcaccaatttcagttctctttccagagataaccactattactagtttggcataaatccttccagacctttatacgtaatcatgcctctgtgtaatatacaaatatatatttgtattagcatatttattcttatttacataaatggtatactgtttattgtgttctacagcttacctttttttttttttttttttttttttt

SEQ ID NO: 33732 - DNA, 1109 bp, Homo sapiens
caatttgatgacttttgatacatgtataaacatgcttggctttttcttttaaaagtttgtaactcttggccgggcatggtggctcacgcctgtaatcccagcactttgggaggccaaggcaggcggatcacaaggtcaggagatggagaccatcctggctaacacagtgaaaccccatctatactaaacgtagaaaaaattagccgggcgtggtagcaggcatctgaagtcccagctactcgggaggctgaggcgagcggatcacgaggtcaggagatcatccattttgagttaatgggtgtatttttggtctgttctcttctattgatctatgcatggtacatcatcttgattactgtagctgtataataaatcttgaaattatgtagtgttaagtcttctaactttgttgctcagaattgttttgactgttttaggttttttgcatttgcaaaccaattttagaatcagcttgtgaatttctacaaaaagggtcaactgagaatttgggattctgttgactgtagatcaatttgtgaaaacctgacataaaaatattgtaccttctaatacaagaacacagtatatctctgtttttgcaggtcttctttaatttctttttttttcttctccttttttgggacagggtcttactttgtcacccaggctagagttcagtggtacaatcatggctcactgcagcctctaactcctgggctcaagggatcctcccacctcagcctcccgagtagctgggactacaggcatgcgccaccaagccagcctaaatttttattttttgtagagacaagttctcactatgttgcccaggctggtcttgaattcctgagcttaaacaattctgcctcagcctcccaaaatgctaggattacaggtgggagccactgtacctggcctgttcaatttctctcagcagtgttttggagttttcagagtgtaagtagcacacacctattgtcaaatgtttttgttgatgctattgaaagtggtactgttttttgaattttaatttccgattgtcattactagtatctattaatagaaatacaattaattttgtgtatgaccttttatcctgcaactttcta

SEQ ID NO: 33733 - DNA, 1193 bp, Homo sapiens
gttactattgtaattgttttggggtaccacaaacagtgcccatataagagggcaaacttaagcaaaaatgttttatgcattctgacagctccacagactggcccatcctctctctctcccactctgtcttcccctcttcccctccctccctcgggcctccctattccctgagacataacaatattgaaatcaggcaaattaataaccctacagtggcctctaagtgttcaagtgaaagaagagttgtatatctctcacttttaatcaaaagctagaaatgattaagctttctctgctgaagatacagaggaaggcatgttaaaagctgaggccaaaagctaggcccaatagccaagttgtgaatgcaaaggaaacgttcttaagaaaattaaaagttctacagcagtgaacacatgaataattagaaagcaaaacagccttattgctgatatagagaaagttttagttgtccagattgaaaatgaaaccagccacaacacttcattaagccaagcgtaatccagagtgacgccctgactcttcaattctgtgaagactgagagaggtgaacaagctgcacaaggaaagttggaagaatggatattgtgcatgaaagtagcagatgttgctgcgtgagatctaaggaaagaagctgtctccctaacaaaagtacaaggtgaaacagcaagtgctgatgtagaaactgcagcaagtgtatccagaagatttagttaagataattgatgaattatgctaaatgttcagcatagacaaaacagccttctattggaagaagatgccatctagaacttttgtatctagaaagaagtcaccccctggcttcagagcttcaaaggacaagctgactctcttgttaagagctaatgcactgttgactttaagttgaagccagtgctcacttaccattctgaaaatcctaggacccttaagaaatatactaaatctactctgtctgccctctataaatggacaacaaagcctggaagacagcacatctatgtaatagcatgatttactgagcacacatttactgaacacacatctcttacacttctgtgtaagagcatggttttctaggcccagtgcattagaaaaaacgattttcaaaatattacttctcattgacaatgcacctgatcacgcaagagctctgatggagatgtaaaaagaga

SEQ ID NO: 33734 - DNA, 1028 bp, Homo sapiens
tcatacatcagccagtgatttgataggatgttcttatatatacattgtgggtatatttggtacctgcaaatggttatgctaagtaataatgaacttatatataaccaggtagatgaacaaaacatttgcatttgtaactcgagtagttgtaagttttctgtggcacatagtcagttggcagtgactggtttttaactttccaatttacatggatgacttgaagatatattgtgggcatggtaatgacgtagaggcaaggaaacagtaaaaataatgcatcatgtaaaaactaaatttgtatcagtgcttacctggcaaatcatttgaagaggtcctgtttgaacttaattcaatattaaatatacctaaaaatagattatagaagagtcaagatattggcatcaaggtttgtgaaattagaatagtctgggtggtagaaatttttcggaacacagtgatgattactttaaattcattccttgtctagatctttgaattatatttcggacattttatgagactttccccaaagtgatgcattactattctgattttcattattttatttcaaacaagttttgttttgtttttttaaaaaaagatacaggttataggaatataaatatgggcactgtcaatattgtgaactaagagaatattctacctaggagatgtaaatgtgttgtattaaaattttgaaaactaattttgctggatatgctaattttcattattaactatacttggcagctgttaatggtttgggggcacttggctaatttaaatcttcctcttgattatgtttgtgatttctcatctggtgtgtgatgactgaatttgtagtatggtttatttattgttagagaatatattctctcatggaatttgactaaatgattcaggggattattttttgcatttttcttgatttttttgttttttggttttttttgaaggaagtagaattttccttttatcaggaacttgtttttaaacttgtgactgaaatatcataaatttgcttggca

SEQ ID NO: 33735 - DNA, 1023 bp, Homo sapiens
aaaaaaaaaaattaggccattatgagacaggttagttttaccctactgatgatctgttgttgccatggtaatcctgctcagtaccaacccgcaggttcagacattcggtgtatgtgcttggctaaggagccaatgggacaaagctaccctctgtgggattttgactgaatgcctctaagtcagaatcccgcccaggctgaaccacagggcagcgctgcagggcctcagttggcctcggatagccagtctcccaatggcctgggatagccagtctcctgccatccccgccggcccgcagttcggctcagcaagcgcgcaggtacccgaggccggtgcggagagtccctcctcctgggaaaccgggtgcggccggaaaggcggccgcccctcacccgtcatgcaacggcacgttcgtggggaacctgacattaaactgttcgtagatgacctgcttctgggtcaggatttcgcactgagcagagcagctccctcgctgtgatctactgaaagtcagccctcgacacaagggtttgaaaaagaaaaagtgaaaaaaataaagaaattagggcatgttggcatgcactagtggtcccagctactcgggaggctgaggtgggaggattgcttgaacctgggaggcagaggttgcagtgagcctagatcgcaccactgcactccagcctaggtggcagattgagacccccatctcaaaaaaataaaaataaataataatattttaaaacttcaagtaatatttaagcatttgttcaattgatactgaatttgagcttctaaattaagcttcagagcaagaaagcaacttaatttgaacattcataccttataaaatataaagattaagtcatccaattggccatgtaagtctcctaacaaagatagaaaaagaatatcaattctgattgttccttaccagtgcttctgatttttattataagaaagaaaatacccagaagaatctgacagaaaaaaccctacaaagttttccatatgtaagataaggat

SEQ ID NO: 33736 - DNA, 1110 bp, Homo sapiens
ttagcagagtgtctggcacacagtaaatacccagtaccggtagctgcaattattaataatgttcaggggtttgtttcttctgcctgctcccacctttgaccctttctattgcttattagtttctcaaccactaaacaaaaacaatgaggaacggggtgaagagcagttaacccattgggcagggttaaatggcaaaataaattactgaaattaagttagagattatatatggatttaatttttctggtttttgcctgtctcctgtcataaataattgggagtttaatatattatcatcaatggcaacatcatcatcttcatcatggacctgatcacagggaccaaactgtatactatcaaaaactgacaaccctttcaggactccagtatataccctcattaaaacaaaaacaactacccctgaaaaggccccagagttattgatctcacatgtgagtgaactttttcctagaatttattgcacccgattacaatccaaattcatatcttcactaattgtaactaggaacatttgagatttttgcaaaatgtaatagactgtcctttcccgtcatctctcatatttccctattgccatttgaaaagtttggcccattgaattcattgtcttcgttatcctatttcaagtttagcagttgttttgaactccagagataatcgttaggagacttctcttagttaggaaacatccttgttagaggaggcacctggtgagacagactgaagttcaaattctgactctgctttttttttttttttttttttttaaatcttcggcttatctcctgcatcgatgccatgggattatgtaagagtgccaccacgtggcctgacaatagtaggttgccagtaaataggtgttccttctcctttttacctccaccctcttggtaaatttaaacacccgtttattggcagtaatgctgtgcctttcttgtgtttcaaggatgtgcttttggggcaagacagtggctttggtcttgtgaaggatccatgttatttggctggtcctggatctaggtatgtacatgtacttatgatgctctctgcatatgaatgctgctggtgttaaactactcttgttccttt

SEQ ID NO: 33737 - DNA, 1029 bp, Homo sapiens
agtctttctccaccctcttatcatcacccttctcttatcactctctctttctctctctctcttttttttttttttttaaatatccctggcagcttcaacaaactttctaaagtgacaattgcaagggaaaggcacatgcctggtgcagcccatgtggtaggtagtcagacactggcttccagactccaaacttctatcaagggttcagaggctgagtccacaccaccctccttcatgagcgttcacgcccaacttgctgggtctcttggtgggcagccagcacccatccagactcaaagcctcagccatgatccagtcagtggaactcagggtttagaaaagaaagtcagtcctgatcctcagaagagttcagaagacatcagaacagaggctttggccaaggaaattgtccaccaagacaaatctctagcagacattttggatccagactccaggctgaagacaacaatggacctgatggaaggtttgtttccccgagatgtgaacttgctgaaggaaaacagtgtaaagaggaaggccatacagagaactgtcagctcttcaggatgtgaaggcaagaggtaagtccctggtgatgtcctcagagagacttacaatcacactccttccatggggatgatgataagtctaggactagttgcctgatgttctcctactgccacagctcctgaaccaagagtgacattttatctcagtcttggaggaatggctctggcagtgaggatgtgggacagatatgcaacaacaaagaaagtaatagtaataattataataattgccattagtacccattgttaacgttgtgtgtcaaacattgtattaatttatttatatcaacattatttaattttcacaagaactttctgaggtggctaccaattttacctccatttacaaatgaggaaactgaagtacagaggaattaagaccatgctcaccaaggtcattgaacatgtgagtgatggcacctggatttgatcacagccccatgactgtgcctgtctccag

SEQ ID NO: 33738 - DNA, 1094 bp, Homo sapiens
aaagttatagattaatttatcttttaaattatcatctttaaaaatgatgtgtctacattacagtgaaaaggagacccaaggaattgattaaaagaacaaaactgcccataacccactatcctgatataatagttcttaggtgtttagtctatttcaccacttttttgagcagacataacccatcttgtataaactgccacctagaaaccaaactgtgtgcctgaatgagtcctgtgtgaccatttgaataatactcttaaaatgaaggaagtggatgcttagtgtttgggcatgggccatcctatgtctgcaaaaggaacaaatgattgtgggactctgctgtttccttgatttggatggcctacttgattgattgccagcagaccaagtgtttatattctacccaatgatgatgtcacactgatcatgatcatcggatttagactgtggcgcagcccacagagttttctgtgcctgtgtttctctttataggactctaaatttggttggggatagacgctgctcttggattttatcattttattgggatccatctttcatagtcttagctagacctgtctcaaatggggttagcaaagctgaaccattatttaaatgaaacccaacacatctaaagcttctatacttttttccaaggagatctactttacaatataattgataacctcccccgccccctttttaaaaatctggattgacagaaaactctcaaataacaatacttcccctgacccactcatgcctgctggcagcccatcaatgcagcagctgttgaacataaaaacaatacttgggctaaggtaatagagacagacttctaaaaggaatttgctgggcgatctaaaatgaaattcacattgttccaggcttgacctgagatagaaatcaggagtctgttccctgatatgacaaagccaaggcaccagagccacctctttttaggatcgacgccaatgagtgtgagcacatcgctcaagccaaatggcacaggaagtccagttctgtggacacattctgcccacctgctgaactgtgactgggtaggatggagtgtgaaacattgagagaggggt

SEQ ID NO: 33739 - DNA, 1024 bp, Homo sapiens
tttttttttgcatttttattgtacaaaaaggaaatgaaaatatatatagcataacattaaaatttacctacttgtttttgataataacattcctttgggaagaattgattttttttctcttatagaagttgaggcacaataatgtggataggttagagattgaaaaacaaaataatcctcaacaccctaacacatcagtactcattcttgcctttccaacccacctgttttatcagacatttcttgtgtaccttctatatgcaggtgctgaaattatgttggtgagtacttgactgcagtctttgctgctctcatgaaatctctctataggctgagtaagcaataggatttagcaaggaaagggagatggggaggtggttgtggaagtgttccaagcccaggaaacagcatgtgccaagctctggaagtgagggagagactcttaagaaatccaatgtagcaggaacgtcagccttagggttgggtagggagagtggacagacaagaggctgaggaggtgggaagagactcagttgtgcagtgcattctttataggcatgtatttactgtgtagctctttaaatgctttatattccatccaccctttgcccataacttaagatatctcagatccttgaaattggttgaaggaagacaaagaaaatctgcagactactaattcttcaggattcaataggagagttgagaaacgatcaggggagttgattcctttcatgcccaaattgaacccttaaagaatagaggaaatgaagactgacagaggacacagagaaggagagtccagtgacaacatatgacaacgacaatgctagatcttcctctgcccagttttatgcattgagcctttcctcaggattcagaactagaagttattattttcttagacctaagcaactgagtcctgaagagtgtggtggggctgggggggaagatggtaggactctttccaccttggacttcaagtggcaatcagtgttctccaaaaaggaaattaaaaactcat

SEQ ID NO: 33740 - DNA, 1049 bp, Homo sapiens
gacaggaaactgttaaggcttgtaaaatgactatgacctgattaggcaaatatagcaactattttcagcaaagaagccacaagatgagtatagctgactttttttttttttaatgtataaagtttggagattttccagtgattttctaatagaccaaatttaaatctaacaataatacatcttgaaaaaaattaaaaatttatgtaatcagccaggcatggtggctcacacctgtaattcccagcactttgggaggccgaggaagatagatcacttgagcccaggaggttgagaccagccccggcaacatggtgaaaccccatttctcagaaaaaatacaagaattagctgggaggtggtggcgctcacctgttgtcccagctactccggtggctgaggtgggaggatcgcttgagtctgggagtttcaggctgcagtgagccgagattgtgccactgtactccagcctgggagacagagggagcccctgtctcaaaaaatattaagtagtctagatctcagttaatgcttatgctttattgtagttagaaaagtgcttaacctggcctgtaatcccagcactttgggaggccgaggtgggcagatcacttgaggtcgggattttgagaccagcctggccaacatggcaaaaccgtgtctctactaaaaatacaaaaattagccaggtgtggtggctcacacctgtaatcccagctacttgggaggctgaggcacgagaattgcttgagtccaggaggcagaggtttcagtgagccaagatcatgcccctttactgcagcctgggtgacagagtgagactccatcacaaaaaagaaaagaaaaagtgcttaacctgatgtagctataacattaataagaaatagaaatttatctaactttctctttagttaatggccaatggtttatacacagttttggttaagcttcaattaggttccgtgttgaattattgatggcatggtaagatgatagtaagggaggcaaatgtgtaagccatctatgaatgagcttcattatttagcttattt

SEQ ID NO: 33741 - DNA, 1739 bp, Homo sapiens
aatatttgtttggccaaacaaatttttaaaataagtggcattttagcattttggagattacaaaaggtacaaaatatgagacatttgaacttcactttgaaagttacagagaaatttgagaaaatgttgggaactctgaatcatatttcaggcccctaactaaataaaataaatctttgactttgggcatcaagggaattaataaatgtatccatgcgaatttttcttaagaaattagaaaagagaagtccatatgcaatccagtcgataggagtagggtaaactctaccgacttcatggttcataaagattagagtgtatcacagctgagtaaacacaaccaaggaggcatcacaaacagcaacatagtaatgggatttttctctactactttaaaccagagggttagttaaaaattcacttctgacatttctagcccttttctgactattagttaaaaattcagatgctttcctccagttcttaaaaagcatttcataatacttttgtatgaactgtagaactaaagggcccttttcttggggtttccaaaagaaaaaaggtattggagagactaaatctattttttctctcttatttctgcaaaaatgcccttccatacttctgttcccttcagaataaataacagctcaactcccagcatgacatgcatgcccttccgagacttcatgcctgtcttcctacaatctccattaggctacctgctgggccctgtgtgtgtacccttcgcttacctctgcttttgcatttcacctaaatgcctttctctttggcctgtttccagtctctctatctagtcatccttcaggactctcaaccaggcagagttaggaggactagttttctgaattcccatttttcttaggcttctctaatcagcagatactgtgttgtaccataatagttttcacgccttattaatttttgtatcttaaacacagcatagagtagtggctagcacaaaggagttattcagtaaatgcttcaaaagtaattgtgcagttacaggctcaggtctcttgctatgtagagcgacttagtcagaaaacattactgtggcaaaacatcctaaaaggagattgcagaacaaagaatttaacgatctcctaaattttctccaggaattcttacagttatcagtatttagtggttgagcatctgacaacaggaagctttgaagggctgagaaataaagacatgcaatgaattggcttaagattttaattttcatttcacctgttttctagtctcagtccaatttttctcagccctggattgctcagaccatactagttggattggacagagtgtaatataatttactcctatcaatcagaaaatactacagtgactggtgaggcagccttagcaaatgatataggtatttctctttgatgctgtattcagggccttcccctgggcttttcttagtaattgaaattatgtgtataggattgactcctgaagctgttttttatggaaattagtgggcatctttcagtattttcattttcattgcttatttgcttccagaaaactaccaacatgcttgatgaaagttctagaaataatgtgagaggtgattattcattagatgtctttgtcctgtggaagtggggaaacaggattcattggaacaataagtatttacattttaaaagtttatatatgatatctgtatgtatatcttacataaacatacataaatgtctagcaga

SEQ ID NO: 33742 - DNA, 1053 bp, Homo sapiens
tgcttttcaacagcgtttttcctaagggcatatgagaaatttaatttctgatggaatgaaggtgaaactctagtcccaggtaaacctgggtaggctgtagagacagaaagggggctgcaggtctaggtggaagaacgagaacgaatgcagcatggtatttccaggccttttagattcggcttcatccacaaccaatgtgagttcttatctgcaaagcgggcctaagtgtaatggagggaaggtgggccaggcaccagggtcctgggttctcccgcgcctcactctgtctccacctggcccatgcataaagaacactagtcaagtagccattgtacctgtttccttatctgaaaatgagaaggttggagagtatgacttctgttgaaacaacaaggcgcttacaaattttggtgaagtcgaatgagggcagcgttaagagaaatatcaaagttagtcattggatttcagggcttagggatggaaaccagctggtagtagactggttgtagttatgtccaaagggcagagtgggaaaaatttggccgaaaagagtgtggtgggtgaccagcaaatgttagaggtatacatcagggcacagaggagaaaagctaacatgatactgatgacttcaagtcttcactgtccaattcagaggataggggagggtttaagctgattaaacagtgggctttttttctcctgcaagagggtggaggtctataactgtgcagattttatcagatgcatgctaatacatgttattctgggggactctcttataccttgaagtagacattgctgctatttggcgtgaaaaaaataggaggacttatttgaattgagaatggggataggctgagttccaccgagatgttggcttagagatgcctgggccatgctgtacagtaggaagcccagcagaggagattgggctgtgtgggtcatgacaaagggagttgttagcttatggttggctattaaagtcatgggcaaggatgggcaagaaaagtgtgtaaaatgagctgacaaaagataaatatgttaattaattct

SEQ ID NO: 33743 - DNA, 1061 bp, Homo sapiens
tttcttggctctaggcatgggatttcatggtatagatgacaagcagagtagcaaatgttgttcaaatcatctttaaagaatgcaattctcattggtaatgagatggtccagacattttatattatgaaagttaccccagcaatgcttagctttgaaagcatcccgatgctggcttcatagctgtggtttgggtcaaaactttgcattccagtgttttcccttttgcatgagaactaagggcgtttcccatcttcccattaaccttctttttttaaaagagaatgtgaaaccaattcaatactttctagaatgcagtcagataagagtgtgtatctacagaaatgattaatcagggtacttaaataaaacttactttgcggacagttcgtgaggccagaatttctccagatactgggaggtggctggtggtcagtcaaagattttgtgtgcgagacagcatgttcttttctttacctctcttcagctcagaggcgtctgtactactgaaataggacctcagaaaaagacatgacctaagatgaaggggtatgtacttcttctcttttccaagtgggtattctgtaaggagaaaagacagagctcaaaggagtgtactgtacatgtctcctctgccctctgctgccccatggtttcatctcagctctctttaaaattggacatctgttcccttgaaacctgagttctgatatttctaccttctcccatcaggtactgctgctcagaaagactatttgttttcatctgaatatgtgaaacctgcacatcagctgtacacaggggccgcctattaaattaatattcaacagtgctttggactaatacatatttttacatactataggctggtgaattcactcaaagaatgagtagttaatcacatgagttataaggctacacagcatcctgtcctttggatagctttatggttatgtatttgtgactatttgattgacatctgtgtgccccattaccctgtacgctccatgagttggggaggctttgttttttcatcatggtatccttagcatttaacacagtgt

SEQ ID NO: 33744 - DNA, 1052 bp, Homo sapiens
ggaattccaaatagcttgagcagcttttcaatcagtattttccttttattggtcagaagaatgtttggtgaaattttccccaagatttcataataaagacaatgatggaggtataattttattgggatctggaagatttggatatgtaaacactggctgtaagggcctttcacatagaggaaataatgtgagtaaattctgatgggaagaaacctgggtttgtcccaagaagagtggtcatttaatttaactgcagtgtaaggtgctccctggggagaagtgggaggttcagtaggaatggagacttgaggttagcccatggggccctgaaatgacaggccaaggagtttggattggggaccttgagtaccgagatccccttgatggcaaggtggagggaggaagtattagagagggtgagatcaagtcagggaggccagttgggaggctgttgaattagtaggaatagaaatgtggaggatgtagtattgataagacttcagagttgatggtgggaggggagctggtctcaagcatggctaagtactgttaacagaaatagggaactctggagaaggggcgagtttgggatagaggaatatgatttcagtttcatgaacatcaagtttgaagtacagatgggacaacccaagagaagtgttcctctgatagaaattcagaactggatgccaagcagagttcaatattagagataaattcagagagtcgtttccagatgtgttagtgttaacgacatggaatatatgcagttccctgaaactgggcctggagactcaaaaaagacccctcaatccttggcttgtggtagctaagggaagagctataaaatgctggactggagggatgcggttcagctgctgtgctggaggcactgggtaaggtgctcagagctgccctgtgcatgtcctccagtgccgttctctccagtttttaagcctgttcataaaccagagaaggaacttctttttccctttcccccatcacatactgatgggcagtgactctcaggtttcctttaatactgggcagag

SEQ ID NO: 33745 - DNA, 1748 bp, Homo sapiens
gtatgctcctatcacctgaatttcctttttcttcatgtaaatggacagatgtaaatgatatgtggtggtctgcatggtgccagggatcgtgcagagtggctatccagtttgtagtctacactttggatgaatttagtccatgggaaaggcagatatactgcagatggttaatatacaacaattgttgtagggaaactacaagacaaagagagaaatagcactttataaaatatcagcaaatgtttctgtgtgtatgtgggggttgcagtgggggtgtattttcttaagctgtgttaccaaagtgatttctctgtaaatatatttgttttgacttagagataaagctgagctgtagcattcaatgtagaatattgggctctaacttccaagacagtcaggaggaggatagaattgaaaataaaaattaaacttctccctgctctgtttacaactggtaatatacttgaaaagtagcaattttctacagtacctttaaaggtaatgttgtctctttagtttacttgctgggtctattttccacattgggggctggagggagatgagaggggagggtaccatttactgggcactgactatatgttcgatgttttattcccttcccctcatttcattctcagggtcatatccctagaaggtaagtgtcactgtatccacgtcttagaccttggaggctgagggaggctgtgcttttctaagaacagccggttacttagtatggcccaaattccaatccggatctgtgggactccagtccctcttcatttctccccctatagcaggccttctccatcttctcaaattctataccacctccacctcctcagcccaggttttccttgtatgaatatatgtaagataaaacttggctagtcacagacacacctttagtgctgtgttgtgcttactgactgatttctagttcttgatgcacttgtctttccaaccacagcataactaaaagcaaaacagtgtcattctacttatgctttgatctggcaagcagcagctttatctatgttttgaaagtagataggtagaaattatgtgaactgaaatttcttagtatacaatttcatgatgctgtccttcgtttgtggattttcaatagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagaggtaagccatctgtcctgcttcaagggaaagatttgtaagagagagattttctaaatacatcacgctttagaggacttcatgatggtccaagtactttctacatgcattttgtcacgagtgacctgccaacctggccaggaaaatgggtcagatattctcatccctgtcttacagatgataaacaggttataaaagttaaaactatttttgcagtcacatacctagttagcagcaaaaccgagactaaaactagatcttaggtctccagatctgatcacatggcctgtgtagctctgtgtttcttcaatttacaagtcttaaaacatgagatttgggattctgcgactattattatcttcttagtctatcagccaactcagctagactttggcagtgtctgggggacaacgatctgacacaaagcctgcactccacatctgcgcccgtgcttctgccctcacggggcttgcactccctgcttcagcc

SEQ ID NO: 33746 - DNA, 1024 bp, Homo sapiens
gaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccct

SEQ ID NO: 33747 - DNA, 1116 bp, Homo sapiens
ataaatatgtcttcctttttctatgcccagtgcctagcacacagggttcaagaaatatttatcgaatgggtataataacgtccactgtacataaaaatttataatcagaattgtgatcgttagtgccagaataagactacaagattaattgtattgttgtatcttaggtttttctgttgtgtcttaggttttacctcttaagtactttctcttgaatatgtgacaaaagagagactactattttttaggtatttgccatatatttatagtcctcaatataagatttcatctgccatcatgcttctcttgaagccagatttttaaaatactgaagcatgacaaatgaagtataacagtttattaaatatgaccggctgccttccctagaagtctcttcaaagcagggagccatggttttattaacagtcaccagcaatggctagaaaaatgtggggaatcttctgccagtaggattgctgtcagctgctgggtcagttctcagggcactgaaaagaaaagggccgccatctgtccatggcagcttttacatatgtcccactctgcacaactcgtgatatttctcttgggcaaaattacattgaaatatggaatgactcttaaagatttttatgtaaaaagataagtataaaatattttaatatcccagtacatttttttttggtgttaaaaagcttaatttattttgggagagattatattatgaatttcataagtctgaaatacaaattatactttagtgctaggaatctagcttttgaacctgcatggaaatttttgtacctgcatttgaatttacataatttaaaggttcaaaaaacttttttttttttttttaaatagagatggaggcttgctgtgttggccagaatagtcttgctatgttggccagagtgttctcaaactcctggcctcaagcagtcctcccacctcagcctcccaaagtcctgggattacaggcatgagccactgttccctgctgcctttttttttggggggggggggaggtcgagaacgtctaaaatgtgaaaatgtgtataattgtgggtaaagagccagtacatataagagaaacaacttgattgtgttctgtcttaa

SEQ ID NO: 33748 - DNA, 1035 bp, Homo sapiens
cgggacctcttggtactcaagcctgtgggtcttcccagcccctgtatgtctagttctttttacactttgatgacagtttgtgcttgatcattctgggttccaatactcacagtgttggaattcagtgttagtgtgggtggaacttgcaaccccagacaaccgttttgttaaaggcttgcttgccctttgctattttactattattcaacgtagcaatcatctcacacttactcatttactgctctgaggtttgtccaataaatatttcacatgtctgtggtttatccccttgcctaaactctaagcttctcgtgagaagagaccatacagtctccttcctttatatcctatgggtgcctagcataataatcctgggtaaaaatgtgtgtcaatatttttctacgtggatcacacctgacaatgtttttttccattcttggttgcagtgagttatagtttgtaaaggtaaacacacgtgaggacaaattcatgctctccagagttaggatttcagatcattaacagggcttctgggaggccattgcccattgctacaatcacctgtacctatttgagagtaagatgtagtgatgggcataggctctgcaccagaaggccagtccttgagtcctggtttggccactcattgtttgacctggcgaggtgttaactaaagtgtttgtgcctcagtttcttcatttgcataaaggaactaataacagctacttgtgagggacatagtagtgtgctgcggatgccccagcctctgggagtgcccttggcaggcagccttctgtggacagcccctctggggactgccttagtggcagagtactgcctcatccaaggagggctcacatctaatgactgagttggaggaggtataaagtcctggtcactttggtgcccacacaggacaacccaggtgaatctgtccaatctcgcttctttcttttctttccttttttttttttttgagacagggtctagctctcacctggtgacagaatgtagtggtgcgatcaccactcactg

SEQ ID NO: 33749 - DNA, 1050 bp, Homo sapiens
ctgtgcctaagccaggacactcctgctaagcatagccctagaaaaatctgaagatgtgttgcttgcttgctttctttgccctatgcattttgtgctcatctctgcttcaggacactttgtcccggctactcctcattctttaactagatctgaacatacttggatataataaaaccagaagccagtctttgcttctcccgacaaggtccttgtggaaaaaatggcttatttgtataacttctgccagccatgttagaaggaaaaagaatccccaaatcttactgtgaagtgcctgacatgtgagcctccccctcaggcctccagctttattgaagtataataagcaaataaaaatggcatttaagatgttcaaagtcactttgggaggccaaggtgggtggatcatttgaggtcagcggttcgagaccagcctgaccaacatgaggaaaccatctctactttaaaaaaaaaaaaaacaacaaacaaaactgtgtgtattggtgcatgcctataatcccagctacctgggaggcagaggttgcattagctgagatcacttcagcctggacaacaagagaaactccatctcaaagtacaaagtgtttcaatatatgctgaggtgtttaccacattaaacatgtccatcaccttgcatacttttttgtaggacacttgatgtattcccaaacttcaagtatatgatacactactaactacaatcaccatgatgtctgttaagtctccagaacttatttgagcctgcccttactagggaaggtgactcctaagattttataggctccaatttagagttgaatcatcaaatgtgcaagcaaaccaagctgtacctgctgcgaggctcttttctcaggtctcaaagctttggggttagctgacaaactgaagtagcacacccaaatgcttgttgcctttaaaagccagaagaggctgacttaacattgttcccttagcagtaagccacgtttggtggctgaggaataagaaacccttcactctaatcaaagttctcccttgagtatttctattacc

SEQ ID NO: 33750 - DNA, 1012 bp, Homo sapiens
tgttgctctgagagtgcaagtgccatgttgaggtatcgatgtaagccttttattcccagagtcagtactggctgtgggcttctggggaagaggtctctctactaggctgagggcagttttccagaggaagtggcttgggaaccattagcagccagcagtcttagctactgggtggtaaatgccttgactcagtgaaagggcaccgcatgaagcaccaactattttcatcatacatgctggaacaacttgtcccactgatggcaagaagggggtgtgattgtgtaccagcatactctggttgttgccaaatctgcaacttggtgagtatgtggctgagcatgttgccacatgcagcaggtcctcttcacatctgagaagggcagtgcacaccagactctgtgaagctcagcatgtttgtggtgccaaatgtggagacggaagtatcatagaaatccagaaaggagaagtggaaggaactgtggctggcaggatggcagtgacatgggcatctgtcactcagcatagcagggaccttgggacctcaccaagtagaattgaagagcacaagaaccatattagagaatggtgaaatctagtcagaactggtaacaattcttcccttaactaattctattggaagcagtaagcccagccacaactacttgttttgtgatactttgtagtttagggtgggcatgactccaatttctacttatatcttatgggtctgaaggtcaatgggcttcccagggtatctacttaagaggaacagtctcagctagcacatgtttttgcatttcccaaatctagtgacttcatatctagtgatttcccaaattgagcaatttcatatctagtgatttgaattggatttgctttctagtctctgacctgcttttccatgtagaagcacttggcacagctttcctgtcgaactgctgcctttcctatagagccctccagataaaatctcatcttcagtgactggatgtgcttggcaagtgagatggtg

SEQ ID NO: 33751 - DNA, 1031 bp, Homo sapiens
ccatggtatatatatgccacattttctttatccagtctatcattgatgggcatttgggttggttccaagtctttgctattttaaatagcactgcattaaacatacatgagcatgtgtctttatagaatgacttataatcctttggatatacctagtaatgggattgctgggtcaaattgtatttctggttctagatccttgaggaaatgccacagtcttccacaatagctgaaccaatttacactcccaccaacagtgtaaaagaattcctatttctccatagcctcgccaacatctgtttcctgactttttaatgattgccattctaactggcatgagatggtatctcactgtggcttgattagcatttctctgatgaccagtggtcttttgttcatgtttggccacaaaagtgtcttttgagaactgtctgttcatatcctttgcccactttttcatgggtttttttcttgtaaatttaagttccttgtagattctggatattagacctttgttggataggtagcttgcaaaaattttctcccattctgtaggttgcctgttcactttgatagtttctttggctgtgcagaagctctttagttcaattagatcccatttgtcaattttggcttttgttgccattccttttggtgttgtagtcatgaagtctctgcccatgcctatgtcctggatggtattgcctaagtttcttctaggatttttagggtattgggctttacatttaagtctttaacccatcttgagttaatttttgtataaggtataaggaaagggtccagtttgttttctgcatgtggctagccagttttcccaacaccacttaagtagggagtcctttcaatcttatgctcttttgccacaaggataaaaacctctcagggaattagaactgaaccaaaacctgtgcagtggctatagcagagctcttctagactcctagttccaggttcctttgaggtatgtctccaggcaggagcagttttgtccaagtcttctcataggttcaa

SEQ ID NO: 33752 - DNA, 1028 bp, Homo sapiens
atgcttaagttgagatttgaagggtgagtagacgtttatcttggagggcattcaaatcatagagaacagcacatgcgggggctcggtgttctgaaagtcactgatatattcaggcaaatatcttttttcctaccctgggattggtagaagttgcaatgggaggtaagcaggatcacatcacagaaggctgatcccctgttataaatttggtctctctgacttcaatattcgcttgagttactgtaatgacctggatgagaaatgagggcatgaatgatggaataagacatgatggatttgagaaatttaaagactgaacagatgccagctgaaacttatccagggtcctagttctgttgagcctcaaactaattgggagacaactggctgcccagggataggaaagttggtagttatccaatttgattcgagatttcctgagttgagatccaagttcacgtcactcaggggcaatagaaggcatttagccacactgctaatatttgattctgaacttctttacaagacagtgtgagagcggtcaaacttaacaaaccacaaatctaagaatgtaataggttatgagcacaattcaaagctttaatgctggtcactcctaatgtaaaaggttggtgaaactccagttttcatacaattgatgtccagtgccaaggtccatactagatgatactttctaatttgattatactaatatggtaattgagatgtgctgagctaataatctaatgattgaaaggcaaatagttgcacatttatactattctcactcctaaaattctcccccatttgctttccctgtaacttctctacactaatgtggcagtttggactgcccataccggcagatccctggctaatcagtttgaaagagtttcaaatgaatgacattcgattttaaaacaaaaagccccctggctcttgtaaacagaaataaatgtaatgagaggtgagaggatattgggtagctcatgcaattatcaggaacagggaatcaagctcagaaaatg

SEQ ID NO: 33753 - DNA, 1051 bp, Homo sapiens
aggggaccggtttttctgacccatgatacagtagggatttttaatgtatcctatgtatttaaaaaattatccttattttttgacttttcttaagctttattttctgatcaggtaaaattatcgttagctcatttagaatctaagcataaaaaaaaacagaaaacaaccaacttaatatgtaaattctctttaacaaatatgtaaaaatactggctctgatccagacacaatgctggtgatacaaaaagattatgaccttttttcctcaagaaaaatacttctcgtaggcgagatagatatgtaaataaagtacaggaaaatgtggtgagtataataatagaaatgtgtatattgggctgggtgcagtggctcacacctgtgatcccagcactttcggaagctgaggtgggcagatcacctgaggtcaggagtttgaaaccagcccggccaacaaggtgaaatcccttctctactaaaaatacaaaaattagccaggcatggtggtgcatgctgtagtcccagctacctgggaggctgaggcaggtgaactgctttaacctgggaggcggaggttgcagtgagccgagatgcgccactgcactccagcctgggcaacagagcgagacttcatctcaaaaaaaaaaaaaaaaggtatgtgtttatatatatacatgatatagaagttacagaaaagtagcaatgattgtttggagtagcaatggaacaagtaggtcaaggatgggttctaggaggagttcgaaaatatataccaggtagataaagggtcgttcgtatttcaaaataacatgcatgatgatcagtggaccacacattattgattcaactgttttaaagaaaccaaataacagtgatttaactttgatagaaagttaattttctcccaagtttaaattggttttcagctcagggcttcttcgctccacaggattatccagggatcaaggtttccaccccacctcttttttgttgttgcagtcttctagggtttttttttctatgtggttgaagcttgctgactactatgtctgaa

SEQ ID NO: 33754 - DNA, 1091 bp, Homo sapiens
atccaaagcagcagtcctctcttcagttttcagtcaaaggtgattagtcatctagagactatcagaacagttatagttaatagaagctgccactttagaaggaacatgtgattgtttaaaaatcatgtatgtgtactttgctttttttttttaagttctgtcttctgtaagattgtaaaaatcctttattcacattgtaatcctttatcgggggaacctgcccccaatatttcatcgtaagttctttctattttccataagtgtcggccggctgagaaataaagagtataaagagaggaattttacagctgggtctctgggggtgatatcacatatcgctaggaccgtgatgcccacctgagccacaaaaccagcaggtttttattgaggacttcaaaaggggagggggtgtacgaacagggagtaggtcacaaagatcacatgcttcaaagggcaaaaaggagaacaaagatcacatgcttctgaggccaataaagatcacaaggcaaagggcaaagcaaagatcacaaggcaaaggggaaaatcaaaaactcctgataagggtccatgttcagctgtgcacgtattgtcttgataaacatcttaaacaacataaaacaggtttcgagagcagagaactagtctgacctcaaattcaccagggtggggttttttcccccaccctaataagactgagggtgctgcaggagaccagggcgtatttcagtccttatctcaaccgcgtaagacagacactcccagagcggccgtttatagacctccccccaggaatgcaattcttttcctagggtcttaatatttaaaagaattgagcgatattgttcctacttgcacgtccatttataggctctctgcaagaagaaaaatatggctctattctgcctgaccccacaggcagtcagacctcatggctctcttcccttgttccctaaaatcgctgttattctgttctttttgaaagtgcactgatgtcatattgtttaagcacacgttttacaatcaatttgtacagttaatgcagtcatcacagtggtcctgaggtgactgacgtacatcctcagcttatgaag

SEQ ID NO: 33755 - DNA, 1033 bp, Homo sapiens
ttaagtttaattctgtttagttttaaaattttcttcttcctttatattttaattttttaatcttttattttcatttggactagggaaaattctgagaagattgctatagcttcataggtcaaagtaatttaggggaagtgggtgacagaggaggaaagatgatacaaatggattaagcatgaataggccaggcgcagtggctcacgcctgtaatccctgcactttgggaggccaaggcgggcggatcatttgaggtcaggagttcgagaccagcctggccaacatggtgaaaccccgtctttactaaaaatacaaaaaatagctgggcctggtggcagacacctgtaatcccagctactctggaggctgaggcaagagaatcgtttgaacacagaaggtggaggttgtagtgagccaagatcgcaccattacgctccagcctgggcaacagggcgagactccgtttcaaaaaaaaagcatgaattctgacaatttaggggctcgctggagagtatgtagctttaaaggtctgtaaggttctggaatgtgttggatgtgttgattatggtatgatatagattgataatagcatgttgcttgaaattcaaatttaaaaaatatggcaatgaattaaagataggggttttcaaagaagaaagttaaagaaagagttatgtctttaaaaatgtttggccatgctgagaaaacaaaggtgataattaaaatctaaggtaaaagataattaaaacatgaggcagaaacagaaaggaaggaaggatggatagatagataagagtttggcagtagtggatgaaaccagagatctaaggaaaaggaagtcaggaaataagctttagcattagtagtttatgctgaatgtcatactcctaactccaagccttacaagatgtgtaaggcattcacttgcctctgtaagcctcaatcttttttactataaaatgatcataagaatggtcacctgtggctcactgtattttaaggactaaatcaggtaatgtaaatgaaatagctt

SEQ ID NO: 33756 - DNA, 1029 bp, Homo sapiens
caaacatagaagaaaaagagatcagtatttgctgcattattagtggtcaattgcaattttctggttctaaattttattatttttattattttttttttgaggcacagtcttgctctatcacccaggctagagtgcagtggtgcaatctcagctcattgctgcctctgccccctggcctcaagcgattctcatgtctcaccctcctgagtagctgggattacagatgtgcgccaccatgcccagccaattttcacatttttagtagagacagagtttcaccatgttggccaggctggtcttgaactgctgacctcaagtgaactgcctgccttggccttttaaagtgctaggattacaggtgtgagccactgtgcctggcctctaaattttatcaaaagaaatatcaaaagaaaaataaatttttacaagcaaattattggcagtgttattttatatggccttatattgctaaactggtaaagtattaatgctatgacttgagaacttaataaaatcaagaagtcacaaagaagcttctaacatggctgctttctgaatcacagaaactctaccatggctttttctggagaaatatcttgagttctgttgacatatggaagtcctgtgaagttacagtagataagacagttgccttgggatagggaaacatcattgaattggaggttaagagaattgagctttagtctgtgtcccatcactctccatgtgattttagccattcccacaaacgctgaatcccgggtttttcctataaatgctatttaacaggttacattgaagaggctcatttgatagacaatatgttttatttatgggtgagttagggtagttgcactctgggctgcagagttgtttcactgagagactctatgcttgaaactcaataactcaatgttgggaagagaagaacttggctggaaaaaagtaacctaattcttttattctgcaagcctttattgagaggttctgtgtcaggttatgtccagtaggtgggtacagacatcaaaa

SEQ ID NO: 33757 - DNA, 1045 bp, Homo sapiens
gaagcttaaaggagatgaacatgaagcaactcgtccagtgctgtgacttacagtgctcaataaaggttggctgctattattgttgttctatagcagtgacgactggcaaggttggataaatgactcttcttccctggatcaaaagtgttaagtgttgggattttcctacttgggatacttttgctgagaaatgctgacaaagtgaatcacaaggcactaactcttagcaaatttgaaagaatatttttcaaggataatttaaaaatgtggaatgttgactatatataacactgcaggaaaatccaggctttggagtttgaatcttggcaccactacatacatgctgtgtggtctcagatataatactttatacagccaggtgtcactttcattatctacttaattgggattatatttctcctaggtttgatgtgacagttaactgagaacatacttgtgaaagaacccagaactgtccctgcaaggaacacgtactcacatcattcaggtggtaacaagatgtcggagtagaaatgagtgagttatagagtccagggtcttggttcaggttctggccctgtaattactagctgtatagcttggagtaagtcacttgaatgaaatgaggtctcagtttctaaattagtaaattaagagagttaggttagcttttctccaagattccttagcccagtatcgtgtagtagagctttctgtgatgatgggaatgttccatagctgtgctgtccagtgtggtagctacgagccacatgtggttattgagtacttgaagtgtggctgacgatactgaggaactgaattttaaatttcacttaatgtcaatgaattaaagtttaaatttgagtagccacatatagatagtggctactatattggacagtgcaacattagagttttaaaattcttaacgtactctagtacttaaaatacagcctcatgaatggttctcaccctgggtggaagcttactggagtacttttagcagttgtgagaaaagtaatacaaagtttgttatagtacctaa

SEQ ID NO: 33758 - DNA, 1023 bp, Homo sapiens
ccagcagcagtcgacccaataccctataatcagatattgaactcagtacaaagcagtttgggataagtgtcagtaggtagaagggcagcaccatggtgaagtggcagagctccagattcttggatttaagtctgagctcttcactactgtgtgactctgggcaagttacttaccttgtctttaaaatagagataatagttgtgcctatattacagagctgctgcaaagataaatgagtaacatgtgaaagtacttggaatatagtaaatagatgctcgcaattgagaatactcttattccagaggaaatcgtttttgatcttggccttgaaatatgggccagtttagaattgggagagatgagagaaaggctcttaggatataggatcagtataagtaaacgcataagtggcaaagggagtccagtttgaagcgagagaagtgatgtaacactgagaagggattttaaaactccagatcacatagggcctggaataaggcatttgaattacattctgtaggcagtggggatgctttgaaatggaaatcatttgctcttggattcagagtctgtcagtacaaactgattagtatattgttggagatgagatatcggagcaccatcctctgttgtgttccttctcctttttttcatccatgtccaggtgcagtttctctgtagagctttggagggggtgtgggtggctccatgtaagtgatcatcttcttgaaaaagagagatcaatttgcagacatattccaacagtgagtcagtactaagttcattattagttcagcaaaagtgggttcatgtggcattatatcaagtagaactccctattaataggcattaacccactcctttgatattgatgttcataatgatcctccccaccatcctgaggtggtgatgtaatcttttttcttcctctttattctggtgagcacttctcacaatttgccaagattaaattatgctccagttagtaataggaaaaagtacatttagttgtattaaaatttt

SEQ ID NO: 33759 - DNA, 1049 bp, Homo sapiens
gtgtattcctgtaagctgtttttatgcgaacttattaaggtcaaggatgcttactcagtaagagagactgtatctttaaaactatgaacttggccttgcatggtgcctcacacctataatgccagcattttggaaggatgaggcaggaggacgcttaagcccagatgttcaagaccaacttggttaacatagcaagattccatctccagacacacagaaacacacacacacacacacacacattagctgagtgtggtggcatgtgcctatcttctcagctacttgggcggctgaggtgggaggatcgcttgatccccggaagtcaaggcttcagtgagccatgatcataccactgcactccagcctgggtgacagacggagaccctgtctcaaaaaacaaaactaaaaccaaacaactaagaattcaatttttttgttttgtagataaattattattattttaaattttatttgtatacattcacagggtgcaaatataattttagttacatggatatattgcatagtagtgaagtcagggcttttagtgtatttatcaccagaataatgtgcattgtacctattaagtactttctcatcatccacccgcctcctatccccacacccttccgagtctccattgtctatcatcctacactctacatccatgtgtacacattatttagctcccacttataaatgaggacgtgtgatatttgtctgtctgtgtctcaattgtttcacttataaacagaaagcaattaaaaagggtaaacagtagtgtttttcaaaaaccaaaccacaaaacacagaaacacagtatcattccaacttttgaggaggaagaactttcttttttgtttttttctaagagaaaatggccatgttgctttatttattatactgaaagcaatacagccttgttctaaaaaaaaaaaaacagcaaatataaaagagagaatgggaagaaaactccatgaatccaagtaattccacaaacaaaaataattaatactaaatattagatgagtttattgcagaacttttcc

SEQ ID NO: 33760 - DNA, 1015 bp, Homo sapiens
aaaagatcaacaaaattgatagaccactatcaagactaataaagaagaaaagagagaagaatcaaatagatgcaataaaaaatgacaaaggggatatcaccaccaatcccacagaaatacaaactaccatcagagaatactataaacacctctacacaaataaactagaaaatctagaagaaatggataaattcctggacacatacaccctcccaagaccaaaccaggaagaagttgaatctctgaataaactaataggctctgaaattgcggcaataattaatagcttaccaaccaaaaaaagtccaggaccagatggattcacagccgaattctaccagaggtacaaggaggagctggtaccattccttctgaaactattccaatcaatagaaaaagagggaatcctccctaactcattttatgaggccagcatcatcctgataccaaagcctggcagagacacaaccaaaaaaagagaattttagaccaatatccgtgatgaacatcgaagcaaaaatcctcaataaaatactggcaaaccgaatccagcagcacatcaaaaagcctatccaccatgatcaagtgggcttcatccctgggatgcaaggctggttcaacatacaaaaatcaatgaacataatccagcatataaacagaaccaaagacaaaaaccacatgattatctcaatagatgcaaagaagacctttgacaaaattcaacaacacttcatgctaaaaactctcaataaattaggtattgatggagcgtatctcaaaataataagagctatctatgacaaacccacagccaatatcatactgaatggacaaaaattggaagcattccctttgaaaactggcacaagacagggatgccctctctcaccactcctattcaacatagtgttggaagttctggccagggcaatctggcaggagaaggaaataaagggtattcaattaggaaaagaggaagtcaaattgtccctgtttgcagatgacatgattgtat

SEQ ID NO: 33761 - DNA, 1070 bp, Homo sapiens
gttctcatggttttctgtccctatgttacgaacttcaccttttcataatttatttgaaatgggttatgttgacaatatgtaacaaatgtcagtgaagatcgtggcattgcaaacttgtgactgagaatcaagggacccacctaaacctgtgcttccttgctgttccagtaattgtgaatgtgcataggctggaaagagcttaagtgtaaaagaacaacatagtactctagcaaaacacacaaatggtacatttatgaccatgcaagaggcatgagccatcaagttccagattggagggaagctattgcacatggtgtagagaaaattttaaatgttttgaacagtgtctagctatatgctaatgcagaaagttttgaacacctttggactttgagagccagttgagtattcaagactattaggaaggtaaaaagagtggtctggaaattatactaagtttaaagctattttttctattgattttttttgccttattttcagaacctgacttacaaattactgtggcagattgtcagatctggttaagtccaaaatcgggctttgtaggtcaaagaggcctccgtcacttttaaacttaatcttggagtttggctgatgctgttcccgaggcccccaaaccattaactcatctgtgctcgagatcactgaagctatacatccacgctattcctaaagcgcagctgtgtgttgtgaaaaatgattttctcattgtcattaagagaacaaatgccacaggatttttttttctacaagtcgacaactgaagaaagccatttctccctagttgatagaaaggctgtcattgcacagaatggcctctcttatccttttgtgcattaactcagcataattttcaaatgtaaaacttctaagaggagcataattctagaaatggcaagattataattatgtgcagcataaaggataaatttgtagtttataaatcatggatattaatattcagcaggagcccaattcatggtaaaacttgaaataagtacattgttaaaaataattgaatttgggttttagaagaaattttagcagtt

SEQ ID NO: 33762 - DNA, 1021 bp, Homo sapiens
tgaacaaggcactctgtgcttttttcactgggccccacaaaattatgtggcagatcctggctcttggtgttttacatatgtgtgtgtgcgtgtgtgtattatatatatatagcttacaaacatctttgaggtatggatattattatccctattttacaatcaaggactatgaggctaaggcaatttcctggagagcacacgtgttgtgaaggggcagaatgggaacttttgttgagaaatcttggcctcaaagcccactgtctttccaccttatgctagtgcaagtctaaagtaaaagtgtacaggggaagggaaaagaagctaatggtaaatctttgttttgtggggtgggatggtatggaaacataggggttgctgaagggcttggcttctggcaaccatttaacatgtatacacaccccttaatttttaaagatgaataactcgattttttttttaaagacagcttggcataagactaatttataaggaccttactccacagatctggtgactgacccaacaagtgtgattctgtattattcataaaaggaaaggctaaaaaaaaaatgtgaagggacaagttttagtttaggccatgaattggtggcagtcttcggattagaacacctttgtgcttgcttttgcttcaacatttagctcatgtttttctttatttttttcacatataggcatgagacaacatagtggttttggaattgttttgatgataaaagttgtagcagtcaaaaatgcaactacttggtattcctgtattcacatcaacaaaaaccaaaactttgtgtttggtttccttctcccacctgcattttccccactttttcaaagtgagagtgtattttttttaacatttttcatccaaagcatttggtagtgaatttttttcattagttacctatggcagaaaataggaattttctctctagagaaagttctcaaggaactgagaatttccaggcctgatattcttggacaatattatggcccaatttctaataac

SEQ ID NO: 33763 - DNA, 1038 bp, Homo sapiens
agtatatcagtatccacctctgctcattctggagcatgaaaagaggcagaggaaacagctcattgctttctagtaaactgctttctctgcctttcccactatgacacagaaagacaagtaagagcatcttggcctctggaagtggtttcaggggaactctgaggaaatccttagaacccagcctcaacaccatgaaaggactggtatttagacttttaatattatcttcagtagccactaactggtggataaactcatggtattggaagaagacatttcttaaacaattttaattgttaagtaaagcgtttgaccttcttagtatttcctttttcaattttaaaacatacctggaatctcaagaactggaaatggtttagttttctcttgccctctgagaggtcaccctggacaagtgtctttctggatcttcatgtgtagctcacaactgttcctcatagttttcttcctcctcagaggtggggtgtggtggaggtagggatctggggagagaatagagaggtgagcctagcagggatgtgcatttatgaagggtaatgtattatagtttgctatggtttgaatgcttgtgtccctccagaattcagatgttgaaatcctaactcctaaggtaacggttttagaaaacagggtctatgggatgtgattagatgacgagggaagagccctcatgattggggttagtgcctatataaaagagagctcagagacccagccaacccctttcaccatgtgaggacacagtgaaaagtcattgtctatgagaaagtgggccgtcactagacactgaaccagctggcactttgatctgggacttccagcctccagaactatgagaaataaatttctattgtttataagctacccaatgtaaaatattttgttatagcggcctaaatggactacgacacagttctttatcttagctttgcaaatcagtagtgctggtggaactaggctctatgtccagttgtgccagatagcagcaccttcctgcactcagtgtttattgggacc

SEQ ID NO: 33764 - DNA, 1037 bp, Homo sapiens
gtgatgttagtgtgtcagttttagatctctcctgctttctcttgtgggcatttaatgctataaatttccctctacacactgctttaaatgtgtcctagtgattttggtacgttgtgtctttgttctcattggtttcaaagaacatctttatttctgactttatttggttatttacccagtagtcattcaggagcaggctgttcaatttccatgtaattgtgtggttttgagtgagattcttaatcctgaattctaatttgattgcactgtggtctcagagacagtttgttataatttctgtttttttacatttgctgaggagtgttttacttccaattatctggtcaattttagaataagtgcagtgtggtgctgagaagaatgtatgttctgttgatttggggtggagagttctgtagatgtctattaggtcagcttggtccagagctgagttcaagtcctggatatctttgttaattttctctttcgttgatctgtcttttttgttgatgttgatgctatacctttctgtttgttagttttccttctgacagacaggcccctcagctgcaggtctgttggagtttgctggaggtccactccagatgctgttttcctgggtatcaccagtggaagctgcagaacagcaaatatttctgcctgatcgttcttctggaagcttcgtcccagagggcacccgcctgtttgagatgtctgtcagcccctactgggagatgtctcccagtcaggctacacggtggtcagggacccacttgaggaggcaatctgcccgttattggagcttgaatgccatgctgggagaaccactgccgtcttcagagctgtcaggcagggacgtttaagtctggagaagctgtctgctgccttttgttcagatatgccctgcccccagaggtggaatctggacaggcagtaggccttgctgagctgcagtgggctccacccagttcgagcttccctgctgctttgtttacactgtgagcatagaactgcctactcaagcttcagcaatggca

SEQ ID NO: 33765 - DNA, 1042 bp, Homo sapiens
taagacttgcacatgcacagaacagggtagtggccatggccccctgatttgtgaaactgaattagagaactaagacttgcacatgcacagaacagggtagctgagggccagcttgagtgatgcagtaaagacttccagagtctagagaaggaaaattcagaaccctgaggcaatcaagggtattttcaaccaatatgatccttctaaaattgacctcctcaccttctcctgcctaaaactctcagtggtccctcattgatctgaggccgaggtccaaattccttagcttgtttgccaagacccattctaatctagtttcttcccaactctccaactctccattttctcagctctcacttcccactctttcctctctctaattttccagtctggcagcttcttgttgttgctgcccctggccccaatttgaggctgcttcttcctcagtgtctgttgctacttggctcctgcactagattgctggcctgctcatccttactgtgtctgactggcagctctgattgatcttcaaacaaaactttgcccaggttgttttccatgcagtacttttcccccacccttaaagatagcatcaatctctccttgctcttcctctctaccttgtacttacttctgtgactgcatgtaatgctggtttttttgtttctgtttctgtcataccttccggttttaagctccttattaacggtgattttttaaaaattatgtactcagtatctgatatagcgtttggcacatacaaaatgcttagtaaattctgagctggaatgactactttaaacttcaggtataaatatagggtagattataggaatataggaactaacaactgcatttgtgtgtgtttaatggctttaatagtactgatcacaaagtcagcaccacatacttattgctagcaatactgatattaattgagtctagtcagatcagaacgtgcacactttttaggcgcccttgcctccagaatcaactttttccccccatttttctttctcaaaaagttgaaattgtgcgagtt

SEQ ID NO: 33766 - DNA, 1028 bp, Homo sapiens
ggctcatagacttgcctcatttgggaatatcctatcacattatttggaggtaagtgttcagccccttctgaaataatatgctgcctgaactcagtcaggcagtcactaatggtggggtagtacagcgccagccttgggcaggctgacaggcagcttttgacattatgggctgaggaacaggaccttgggatgtgacagtataagaagcaaggatacagaggaataaagaaactggggcatagccaaaaaatgaaccttagcagactattgattgagcagggaaaatttgatggggtatatgataaaatcattctccaaagtttttctccaatgttatatttgggctttccctcctacaaattatgactttttagctattgttaagtataaaacagcaatttgcaggagacctaagaacattgattcgttttcatctttgggactcctttttatctttcaactcttacttccaccggtttacccttttctctctaataactctttcttagaatctgaaataccccaaatatagccagtactccacagtgggatacttcattagtggaaaagagtctgggttatagaatattgagaatgtgctaagcactgaattttgcattagcataaataggataatttctttaagatttaaaaaaagactgtgaacaatattattagcatttgtgtgaaaaaatataaaacagaaggttgaattatgctaaatagtgcatcaattctcctgcctccgtttagcttacctggttgtcagaagttattacttaaattatttgggctactggctgagacttgctatctagagatattggtgaactatattgttataattggatttgaccttcagccccctttaattcatttatttggtaactttttttttgattaagggaaaagccccaacttagctgaactttttgtgcattacatttccttttaaatgtttcctttttattatgggaaatttcaaacaaatataaaagaatagtgtaatgaacccccatgaattatca

SEQ ID NO: 33767 - DNA, 1069 bp, Homo sapiens
gcttcctatattatttttaaatttccctttagaaagattgtgccaacttataatctcatcatcaacaacagtgtatgagagtgttcatttccaatacttcctccaacattaggtgtaatcttttaaaataagcttcatctaaatcatcttaacctgttctgaaagcgctgagtcagtttacaacagggtactaatcagggctttcgaagtgaggactttgcagtacgccttactctaggtaggccactcacagaaggggcagtgattggagtaagggtgtttatgttcagtgatttccacagttaatttctaagatgttttcatagtcaggatatatgtatacatatacaagccaagagcggtggaagcatggttgttgtttttcactacttttcttcttcatattattattttatcatgattattatttttatttaattttagtttttatgttcacaaagatacttcaaaattatttatctgagagaacaactctgaggtgagctcattgaaggaagggttagagaacctaactgagctatgagaagctcggaatgcacactgtggctacatacacatagcctcaatgagctcagcaaacacaatttataaaatactttcaagtttacaaaacttttaatttttttcttattgaaaaaactatataagaactacatcaagagattcttaaaaagtactgatatggtttggctgtgtccccactgaaatctcgtcgtgaattgtaatctttataattcctacgtgttgtgggaagcacccagtgggaggtcactgaatcacgggggcggtttcccccattctgttcttgtgatagtaagtgagttctcacgaggtctgatgattttataaacatctggcttttcccctgctggtgctcgttctctttcccgccgccctgagaagaggtgccttccgccataattgttaagtttcctgaggtctccccagccatgcagaactgtgagtcagttaaaactcttttctttataaattacccagtctcaggtatttctttatggcagcatgagaatggactactacaagtacc

SEQ ID NO: 33768 - DNA, 1024 bp, Homo sapiens
taattctagctttgctgttagtagtttttgaggggaagccatgtatcctctctgagtctcagttttcccatctataaaataggtataattatagcacttatcacatattggtttaaatgtagtgacacacgtaaaaggccttagctttagacctgcctctgaagaagggaccaattaagggcaagtggaagcctgtaaggagagtggagactgtccaacaaggaaatgagttcatccttcagttctgcactttctagctatgttttcttatgtttaaaactaggacattatgtctgtcctattgagttgttgcaaggattgtgtggaatgggataatgtgagcgagcaactcttgtcactagatgtgttttagataaacattattatgaagatgttagggatcccctggggactagattgcagggtgagagtgtgtccaagaaaggctgagcattagttggaacatttgtgctcagtaacctgattattgtgatgctttctgggttgtgagtttctggaaaacttaaatcaaattgcttattatgagaatttttctgacatgtggaggtagttcaatctggaagtgaccttggaaataattaaaaattaaaagcagctttgttgtctggaatagtatgtgaagaaaatgtcacttgttcactccaaatctcaaggtcttcccttctacaaaacatgagaacagcttctagaaatgaggagttatttgggattgttgattttttttttagaggagtagagaaatgactaattttttcattggtgagtaatatgctacaaagactcgtagaatcatatacttttggacctggaaagtagcttaaggaccatctgattaaaattttaagttttattgatgaagaaattaagctcaagaaaggctgttacttgtccaagatcacagaagtattaactattgaagcttgagaaaacagccagttctctgctcaaatttcagctgaaactacattgtataataaaataactcaacataacattacaacag

SEQ ID NO: 33769 - DNA, 1048 bp, Homo sapiens
gaaaatcggtctcattacctgcagtcatgttccatcagccctcgtcctactcagtttactgcctaaatgtagcacagagctctcccttttttcctatcctcagcgacctggcctgagcttgagcttttatgattgtttgcctggattgttgctgtagtgtaacagctctctttatatcaatttgtgttcctgtcccacccatacccattttctaggctcttccacactgatgctgcaatgatcttcctaacttaaagacttatcttatccctagaggattttgtccatggcatacaagactttttgatagccttccagccttcattccccccacccctcaccctctgcctactttgtgtctgggagtgtccagcatcaatatctaccagactatgagctctatgaggacaggatccattcatacatgtacctctttgaaattctgggatccagaatggggccgggaatatggtggggtggtaaaaacttctgtggaattgaattgaaatttgtacaccttctgaaactaacaagattttagcttgttaacaaaccagattatacctccttctgtctaaacactaaattcttatttgatggattcagcattgtttgtcgaagcaccctgtgaaatggaaaatagacggctctttcctctgactgctcaacaaacctccagaagtatatttagaacatttagcacttgaggagtgttaaagactgtctgtatatttcataaggctgtcctcctcctcatctgatatgaggaggtggtattaatttctaaaaatagtagaaaggcagagtaaagcaatccaagagagtctcctacactgtgttcttcaaagtatcttttgccttttggctatcttgagaacaggaaacgaaataatttagcagatttttcagtgtttcttgaatctgctttacattttcataattcttcccttgtcatattctgtgaatcttttcatgttctttataacattgattttagcatttatccagtgatgtttaaccaaagtggatggattcagtcttatttcaa

SEQ ID NO: 33770 - DNA, 1880 bp, Homo sapiens
caattgtttttgttgctaactactagaaaacaatttgtgggatgagcccgtttctttctctctaaccttttctagacctgaccatgcggggctagacgccttcagtgtttgaagtggtattaaacaagatgcaacaggcagatgacacacagttgtcaacatttcatgtattgctgttctctagaaaaatacacccaaacctcagatgacaaaagagaagtaaagacattggtcttttagtggaggctgttggaacattgccaaactcttataaaaagcattttattccacattttcacattccatttttattcacctttttatgagtaaatttacatgtatagattgtagatatacaactccacttaatttatttctcattctttgaaaattttggctttttctccctattgtaagaaaagtctctgtaatatttctcagtgttaaagagaaaaaaatcctctgttttaattaaatgttggggtcaaagatttcacatattctcgggaccagttaattgaattacctaattattccaagagtgggtaatatttaaaatggttttattagtggagatccacaacttaggaactggtttccttctaagttatgagcactttccaaaagttgtttgggactcggaatgccatcccctgccctaccccacaaagaaaacaatagtttaaattatgataaatgaaaattagttttccatcctaatccacaaatctttgtaacccatactggggctgatctatagtgctgtggtttctttttgcttctttggaaaaattaatgccaagtcacaacgtgacatatgacttccttcatagctccagtgttgaaaaaataatattttgttttccctttgccttggactgttagaagtttttctctccttctgctcgaacagaagcagtataaggagttcttattcatttttctcttttcagtgcagggacatgaaaggagttgggcatggccacatctgacaaagatggtagcagaaagagattttttgctctgcttgtccaacctcccatgcccactgccccacccactggccctgatagtgaggatcacattggccacctggcctgaacaacagttgggttcaataagctggcgatagctaggttcctgcactaggcacagaaagctagaaggcaggtcaagtcagagtccctgaagacaagcattaagtcaaatggtttgtgatagatgttgcagagcaaatagcttggtattaggcagaaatggggtccaaccgtaggcaggaagggaaccgtttgtgtgggatgctcaggagtttccattggaaagggaggggtagtatgcgatgcttggacctctgtgaaaaggatatttttaaagtggtgtacttgttaagtccagagctacccataatgctttggagtaataaaaaaatggaatcagtacagattaaggaatataatataaggaatggaaaccacatttatgatcaattaataaagatctttttaaaatttcatgaaatgttaagaaaatataagaaaatatttagaaaatttatcattttataaaatgctgatgtaaatttagtacttatataaaacactaaaattcttctaaagggaaaaaatcttacctgagataatgtcttatataaatgtaagtcattactatataacagcttccctatggaaagaacctaaagtttaaaggcatgttaaaaacgtttttaaaaatatgttgattattttaatggggttgtacttagatataggtacaacttagttaatatctttttcctttttaaaaagctttataatattttctttattcctttcatcatcgttttcatgaacgtcctttaaaaagtaacatcttactttctg

SEQ ID NO: 33771 - DNA, 1032 bp, Homo sapiens
tctttatttctgccttcatttcgttatgtacccagcagtcattcaggagcaggttatttattttccatgtagttgagcggttttgagtgagtgtcttaatcctgagttctagtttgattgcactgtggtctgagagacagtttgttatcatttctgttcttttacacttgccaaggagtgctttacttccaagtatgtggtcaattttggaataggtgtggtgtggtgctgaaaagtgtatattctgttgatttggggtggagagttctgcagatgtctattaggtctgcttggtgcagagctgagttcaattcctggatatgcttgttaactttctgtctcgttgatctgtctaatgttgacagtggggtgttaaagtttcccattattattgtgtgggagtctaagtctctttgtaggtctctaaggacttgctttatgaatctgggtgctcctgtattgggttcatatatatttaggataattagctctgcttgttgaattgatccctttaccattatgtagtggccttctgtgtctcttttgatctttcttggtttaaagtctgttttatcagagactaggattgcaacccctgtctttttttgttttccatttgtttggtagatcttcctccatccctttattttgagcctatgtgtgtccctgcacgtgagatgggttacctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgcttgttagttgatgcagtttcttcctagcctcgatggtctttacaatttggcatgtttttgcagtggctggtactggttgttcctttccatgtttagcgcttccttcaggagctcctttagggcaggcctggtggtgacaaaatctctcagcatttgcttgtctctaaaggattttatttctccttcacttatgaag

SEQ ID NO: 33772 - DNA, 1028 bp, Homo sapiens
atctctgctccacctccctactcagcttcttcttacttcctctccagttctggctgtaaagcaccagcccagatggatctcagctctcaatcgtgtagttctcttgtttcctgaaaattttttctttaatgcttttccttcctgctcttgttggtttatatttttgaagaaagattctgttttgatcaatacaatgtataattagatgttgccaataagatttggaaagcacaatttgccctatatcaaccaccatacaggtaatacctccctccctgcatacgctcacggggactctgctacagttcttgagtctactccacgttgcttaagatagattgatgctaactctatgcctattcaagatttgtgattttgacatttgtttcctgtttgtctgacattgtgtaaggcttagttcatttgtttattataataaagttgctgaatagtgtaacatcagctaaccttcattttctcactgaaagcttattaagctgaagagatctgtctgtagtcaagaaacactaaatgatttcagtgcaagttcaatttccacatattccattaaacaatcagtggtcataatactttgcatatagaaaaataaagaaataaaacaacctaaaacagagaaaatagttgtcaatttaattctagtggttcaggcatttgaaataaatcccagttaggtagtaatacatgaatacaactgatcatatataatggggttaaagaattgctgaggtatgactggggttttccacgaaaaattaaaagttctgtgactccacccctcccaagtagactggccttcttgttcttgcagcatgaataccagagtaacaatgacaataaaattgtgttttctactcctcataagagaaagtgaagacaactgttccagatttatcttctgtataagatctaccacttcttagttattgacacttggtttgttctcaccatttcctctgcctttcatgtctcctttcctgacattgaagaaggctgtagtgataagtcaa

SEQ ID NO: 33773 - DNA, 1086 bp, Homo sapiens
acccacctatgcctcccaaagtgctgggattacaggtgtgagccactgccacctggtatcttccacattcttatctataaagtgagagtaattccagtaccttcctcagagggtggttataaggatcaagtgttttgatacaggttaggtgcctagcctgatgtctaggatacagtgaaggattaataagagttagctgcttttattatttttgtaattattcactcctccatactttctttcctaattcatataatcttcaacctttttgaaagttacttatatctctttcatacagtattggaaaaggggcaagagatcttcttgctaaaagtttgagtgacaaagatattgggggctattggataagaggaaaagaacatagactcctgagccaaactgcttggtttcaaatgccagcctcatgtgaccatgggcaagttgtttaatctccctgagtctgttcctcatctgtaaagttgggattaataatatctacctcctagggtggttgtgagaattaaatgaattcatatacgtaaagcacttcaaacagtggctgacatgaactgtgtgctatacagatgatggctgttaaaattatttttctgcattttctgtttgggacctggagcctcaagattgggctgtgtaagcactggcatgggggtggtgtctttcagctaatcaaatggttcctttctctttcttcaacattatctggagtcagcctgccagccccagtgctccacgtgtaccagtgggctggagtgctcatcctgccagcctcccctgctgatgcggcacgggcagtgtgtgcctacctgtggggacggcttctaccaagatcgccattcctgtgcaggtaatctctggctgggccacagttgggccagctaccaagacagctccccaaccctgaccccaccaagtgatctggggacaccaggagctggaagcactttttcaaataagagaagaaactctaaacaagacttctgatgggatgaggagaacagtgtgttagagaaatgatacatgttgagatgttttaataaccttattaggttattcggttcttatcaa

SEQ ID NO: 33774 - DNA, 1055 bp, Homo sapiens
tcaaatggtcctttcttcagttatgggagactgcattccaccctaattcttctcacgggtctattctagtttcagaacagctttgattttgttttttgtttttaattgacaggtgatttttactgtaagttatggttttttgaatcttatgaaactcgtgaattcataaaaatgtatgaattcagatttaatcagacgatcaccagagcttgaaaaatgtttcacagtccaaaatagcgctccaggagcagttcctgcccattaactgcatattataagctgcatatcaaaatgcaagcccattggcaactgaatatgtattttcagaaattgattgaatgtgaatttacccaccagagcagaaaaactccaaaagaactattctagcctgctgaaagcatagcatacattttaaagacttaggtaggttatacactaactttctctaagggttgtagaaggattttgtactaagagtcatggaaaaacttttccagatatgcatagttagaaagttttcagtgaacatgtagaaagattggaaaagccatctgaaatcctagtcacaaatggggcagagtataaaggtttaggaacagatgagtctgttcttagtttaagtgttattaactggaagagagtgatacaatgttggaggagacaaaaaggcaaaagttggattttgtataatttgcttcttagcagtggtcttatatacacagtttgctatgcactgcgagtaaacaggaaaagaacagcatgggttctggagttaaaatggatggatcttaatccaagctcaccacttactagcattgtgacccttagcaagttacttaaactctctaggcctcggttttcccatatgtaatatgggaaggataaaattaatcttaaaacggtaatagcatttctatgaaccagccaaaaataaaattatttgaaatatgattctgtgtataataacattacatattacatacctatgagtaaatgtaacaaaagttatgtaacttctagggaaaattgatgctatgactgactatgtagaaaat

SEQ ID NO: 33775 - DNA, 1047 bp, Homo sapiens
tcctacaccccagctttaatttcctagaagggaggccaaggcctaggttttctttccttgtgtattttttctgtctccatcacccacacaactggaattgtctatgtataatcagtttaattttgatcctggccggtcttatttcagatgcttaatatcccctctcccttcctaataaatagtgccacaatttagacaagatgtttaagcacaagtctagttcgcatttaagcgtgattaatcaataattgatgggtctgcctgatcataagattgggtcatgtacttgtgaaaatgcattcaagtttagagtacttgatttggggagagggataccactgagtaggcaaagcggtagaagctaagatagaccaaagcacagacttggtagattttgcattttttgttttggcccaaagttgtttaaacagagccaggaagactcagtagatactgtgccctgaagtgtttttgccatgctcctgcaaacattggtagtttactcataatgacctctgcagtgtctttttaataaatccgtccgtctctctgttgttatttttatataattagttatgttgcaaaaagtcaccgtgaaaactggattagcaaacactgaaccactgctcctactatggtgttagattcctgaaagctgctgttcacaacatttttgtcaactgatcaagatacaaccttgttttatgtctgttgcagtttaaatacaccttatttaatatatttggttgatttattaacattgaaatcatggccaacagctctgtaaatcatgcctcaatgaagattatctcacacttgtattttctctgtagtctttgctccttgaacactagacagcactttagcactacgcttagggactgttttcaacagtgaaatcaccaatagcaagcacaaaaatgagaaaaacatggcactaaatagaccatgaaaaggacacttgtttacactatgtaagctgaaactagaatgtgcacgtcagtagactcacatttttcaccattgtgcacatgtctgcaatgacag

SEQ ID NO: 33776 - DNA, 1043 bp, Homo sapiens
tgtatttcctctagaggtagtagttttattcaaggacaagctactgacactaaaacaattattctaaattttcagtattccaaaaaaacagtggaaatttataatgcatttatctccagtaaaggtgctaaattgtacaggatgggcatggtggctcacgcctgtaatcccagcactttgggaggctgagacaggtagatcacttgaggccaggagttcgagaccagcctggccaacagggtgaaaccccatctctactaaaaacacaaatattagccgggcatagtggcacgtgcctataataacagctactcatgaggctgaggcaggagaatcccttgagcccaggaggcagaggttgcagtaaggtgagatagagccattgcactccagcctgggtgacacagcaagacgctgtctcaaaataaataaataaataaataaataataaataaaaataaaagtgctaaattgtacaaacatgccaaatatctttgcttttaggctgtagtcaactattgtggttaatactgacattctcatgctgggcagattgaaaaggctatgtcttcgatattttaaaaataatgaaaatgaattaatatttgttagtatgtttcatcatggggtgcacagtagggaaacttggaaaaggtccttgatgttgtcaatgttagagaatgtactagaaagtgagacggatgtccttatgttgatcctgggtcttatatagtgttctttctgatcttgtatattatcttggttttctttcaccatttccctcctatttttttgtcagaacttgaagtagtttcatatacatccaatagagctcatttggtagttatcaaaatgattaaagccttgacttgggattccaaagttaagagtcttgaactaccatttcaaagctgccacacttttctagtggtcgggtataatatttcatctccaaaagattgggactgtttattcctttgttttatcttgcatgcatctggtgaaccattcatctacccacagcctgctatttttaggggact

SEQ ID NO: 33777 - DNA, 1047 bp, Homo sapiens
ttgtaagggctgtatgaatccatagtgttcgaggttggatgtaactaatgcccataaatttctagcttgagaaacccttatatacagattcaaggttcagatttgttttcatcttagaatagtggctgttttttttttttttttttttaaatacactaaaggtatttcaaaaagttgtggtgggccattatggatagtataaggtcaatttcactgatttttttctttttttcttttgctttggaagacgaaatataggaaacaatgtgtaagaacctgaatttaaaacaggaccttctcagagcctcttacagaaaatatcctgagtattatattaactgtaattggtattgttggactaatagtctttctttgaaaatgctagtgcttcattaaatttcccgtaattgtagtgattgtccaaatttagttccctcatttaaccatgagaaaatggagtaatgaatgaacccaaagtcacattattagtgttgattgtggagagtagaacttagttctcgtgaccagcactttttctagtagttatggcctctttcttttatttttatttttcattttgtttccttatgcctaagtacttttacttatggcctctttaattggctcctatgctgtataggcattggcctgtagctatagtcatagctcctgtatgtatgggcattgtcctttgattggggtggggacttggaactggtttaagggacctcgggacttttaatagtctgaaggcagctggagtattactgggtgcatggggagtatgaggtggaagacgtattctcaaatatttttgcttgaatttcaaagttaaagcttttctgctttgtattttcctaaggcagtcaaaccatgtgttacagttacttgagctaagatgtcacgattaattttaaaagtttaaattccagcttctcccaggttagtctgttctctcagtttagagaggacaagtcatacatgaaatagtgtatttgtgaactgtaaagtatgtagcgtaaaggtgcaatacttcagcttcttcag

SEQ ID NO: 33778 - DNA, 1025 bp, Homo sapiens
ctccacagacaaattaatatgctcaacatttctgaaaagacagggcaacagtgccgttctaatttttacaagaaggaatctgaggccaggttcccttagaagccaatttacattgacagtttaaagaagtggacatacaaacatatataggaccagaattaggaaaaagttctgtttgctacatatttcaataaagatattaaaaaataacttgattgtccgttttttttttgagaatatcatgaaagttctgtagaccctttccccagaaaaatttgcatataaaacctacatatggtttcagatggtgcatagactttatgtaaatacccttgcattatattcgttgatttcttataatgtttacaatttgaaattggcatacaggttttgtattttagttacttaaatgtttttcatagtggttataggtatttataatcagcatgaaaatattagaaagtgaaagtgtataagaatttgtgtttttagcttacatacaaatggagatcctgctgtggattcaaatgtgtgtatttgtgtatgtaattagagttttacatccaagttttatcttagtatgatttggcttttgtatcaaaagtacgtaagatgtttgtaaggctgtgtctagacttatctctgagtatcagaataatctgactaaatcttgcttactcatgtgctatggttacagtgatatgctataaatgggttataggtgtaccaagatttgatttttcctttcaccccctcagagtagcctggttgtggttgaaggtccctgcctgccaactcaggttgaaagtagacttcatttacccagtggtctggccaagttactggaaaacaacaataataactaggtggtttttcattagtaggataaatacagatttagtcgatggaatattaagtgcggggaatagtggaagtcggtgagcaggatatgccgtactctgacaaggttgagctgtctttgcaaaggagaaattatacaaacttttactctttcaatttgaaag

SEQ ID NO: 33779 - DNA, 1029 bp, Homo sapiens
ttgatcataaaagtatgggtgaatttctaggctctgagttcttttccatgatctacataagtgttaccttctaccagtaccacactgtcttgattgctgtagctttgcagtacattttgaaactgggaagtgtgagtcctctaactttgctttttttcaggttgttttggctgttttgggtcctttgaattttcatatgtatgtttggatgagtttgttcagttctgaaagacagggatttgataaataatttttgaagtatttcaatccagtctttcagtctatgagtgaggaatgtctgtttatttaataggtccttaatttctttcaatgatgttttatagttttcagcatacaaatttttattaagtttattactaaatattttattatttctgatacctttgtcaatagaagtgttttcttaatttatttcagattgttcattgctagtgtatagaaatacagttcctttaggctgggtgtggtggctcacacctgtaaccccagcactttgggaggctgaggcgggtggatcacaagggtcaggagtttgagaccagcctagccaacatagtgaaacctcgtctctactaaaaatacaaaaaattagccgggcacggtggcgggcgtttgtagttccagctaattgggaggctgagacaggagaatcacttgaatccgggaggcggaggttgcggtgagccaagattgcaccaccgcactctagcctgggcgacagagtgagactccatctcacaaaaaagaaaaagaaatacaattgctttaaattttttttttcatttttttatggcctgtgacacatcctctagagatcctgagaacatgagctcctacaaattgctttttaactaattatcttatatcctgcaacctgctgaacttgtttattagctctgatagggggtgtgtgtgtgtgtattcttataggttttcctatgtatatatttaaatttttaggataattttttttttggaggcaggatcttactgtgttgcccaggctga

SEQ ID NO: 33780 - DNA, 1029 bp, Homo sapiens
tacaatactttaggtgtgaattcagtaatatccagaaaaaaatactaaattcaaattggccaagaactgtatctttcatcctgcttcaatgtagtactgattcagagagttatgatattgaggcatgatattgaagtatttagcacttcatattttagaaaataattattttaaaaaataattttttgcttggaagtttctgttttaggttattatttttatcccgagatttaggatgctgattttataaagtattagaaaattcattaataggtaacataaagaaatgctttatgttacctattaatgaagaaaattgaagatggttatcctcagccttcaaaattcagtcactggttccctcctgtttcttgtacaattctcattgagattgataaaaagggaaatacctttgatgtgaaaaaattagtgtacctcattgtgttcacactttacaaagcagaatatttagatttatatatttttaaagtatacttgcattgctaaaattgttatctgggaaccctacaacatttactctaacacaagacaaattcctaaagtttgattgacaaaataaaactggctaagatttcttttgcctaggctatcatctggacagtgcaaagaaagatgtagtctaatgtggacattataccattaatagcatttttttttaagtgttgttaagggagtcttatgttcaatttgatgtatatgagctgaaaatatcttccttaaagaaaaaagcatcataaatcttttgtaaccatatggaacctgttatccctacttcagatatttataattttgtcatgtaataacccagtaatttttttgaactaacattttgaaatttttagagcttttgaactgttttcattggaccattgctgcaatattgaaagcaatcttttgtaaattactgttgctgaactcaccaagagtgtttaggtctattataagctccataataattataaaaataagtgcacttgttagctgagtttactaagttgatatgtggag

SEQ ID NO: 33781 - DNA, 1086 bp, Homo sapiens
ttttttaaggtctcttttaatttccagacagttaaaaacaatctagttatcttaaagcattagaaagttattatctggagagtgcagagatttcagtccatacacctttctccacaaagcagagccagaagtaactgactattgtgcctaaaactctgtttcatttttaaaaacaagtgccattaaaatggaatatctaatgataagcatatgaaataatgtgtaattagctcaatttaactattccacaacttacatattccaaaacaatgttatacatgataaatatatataatttttgtcagttaaaacaaattaaaaaaatggactatcgtcgcacagaagcctagaacaaaaatatgaagagaaatatctgacatttgtaaagaaattataagaagaaaaaaagatacagaacagaaaacattcactactttagaaacactttatgcatggcttcttgccccaaacttttattgtgatggccctaataaagcagattattggaaaaattggaggacaagggttgtataaaaattttattttatgaagaaaatatgtagcggaaactgaattttcaagacatttacaatgtgaaatcatgttgcatttaacaatgtactttattagcaacttcaccaaatattccccaagtcataagcaacaattatttttattaggttttggggggtggagtagttttaataaagtgcacagaatggtgacacccacaaagccttatataaaggcaggattcatgcatcctgctgcaagtacctctgcactaatataccagatcctaaaatgcatataaggtggactagcatcttaattctgctagttgattgtgtctttactgaaaagaacccagctaccaatttgcctttttttacaccacaaatcctaattagaaacttgaggttttatagaaatcatttaatgatagagattacatatgtgaattaatgtgaatatagtatctgtgcttcctgtgtctatgactattttaagatataattgtgctgcgctatcagattaacatttggaagtttctagaacagttaatgctatttacagaaaggagta

SEQ ID NO: 33782 - DNA, 1471 bp, Homo sapiens
tagaaccagaaatatcattgtacccaaaggaatataaaacattctgttataaagatacatgcaggtttattgtgaagcactgttcaccatagcaaagacacgttatcaatccaaatgcccatcaatgatagactggatacagaaaatgtggtacatatacaccatggaatactttgtagccataaaatgaaagcaattatgtcctttcagggacatggatggagctggaagccattatcctcagcaaactaatgcaggaacagaaaacccaacacttcatgttctcacttataagtgggagctgaacaatgagaacacatggacacagggaggggaacaacacacactgtggcctgttgggggtggagtgaggggagggagagcatccggaaaaatagctaatgcatgttgggcttaatacctaggtgatgggttgataggtgcagcaaaccaccatgatacacatttacctatatgacaaacctgcacatcctgcacatgtatctcagaacttaaaataaaatataaagcatgtgcctgaagatcgttaacatctggagcccctgtgggttcgtttcagattttttttgtgtgtcatttctcttggtttcggttcaaattacataatatcttgcaggcatattgccttaattttgtgggttattttaaattttgtgccagataacgtatttgcaaaattgtacaactatcttaatgactaggatgaaattttctttcttcacaaaggatttctgtttgcttttcctaagcacatagaatgttatcaatcaggatactttaatatgattttataatcagacatgcagcaagaacttgaatatttataggttactcagatgatggaattttcacagagaccctcttgattgattttagatttcagtatcagttctgccagcccacgagtctctgtcaaaattctgcttagcctctcaactattccatgagaagggaattgctttccagggtctccatacctgattctgagccaagtaatccctcactatttctattagctttccaatgctttcaaagaaattaaagaaatattttgtctagttttctagttgattcacttagcccaaaagtgctaatgtaacatcattggaaggaaaagccccactcattgttcttccatttactttttgagcagtttgtaaagttctttgaaattgcctgtcaatattttgacagaattatattaaattcctgaactgatttttagagagttaacattttcatatttaatctttcaatccacttacaaaatatctctccatttatttgggtcattacttacaaccctcacaatagttaaaaaatattctaatggtttttctgcatctattaatatcatattttttctttttaaatctgttgatgtggtaaattacattaatatttgttaaaaatgttgggccatccttccattgcctatgcattgcttaat

SEQ ID NO: 33783 - DNA, 1024 bp, Homo sapiens
tcccttctgccatgatagacaaattagctgatatccataacatgtttagaactttcaaaatatgttgttatttaaataccactaatttttggtaggattagttttgttcttgctgtgaaattgttagtggtggtgatggcagaagggttttattttgctttatattttttctttttcattcaaagaggagattttttgataacttattcaaactgtttataatttaagttgaattgttatcaaaactgtaagtgaacatttgatgcaataatttgggtaatttagggaagaaaaagtaaaagatttgcctgaaatatttaaaccctaagcttgttttttgtttagagacacatgtcaaatcttattattatattgttcctggaatagttctgtgcatctggtggctgcccagtacattttaattaatgacagtatttatgacagaaacggaaatcttagacatttggggattttcctacatattctcgttttcggatatgtttatatataggactagtttcactctaaacttaaatttttctccagaaggcataaaacctaacatgcagagtaaagaacagacatgtgctgaatgaaactcatttgacattgaaatggaccattcttgtttttaaattatatttgatttaataatagaggtggcactaaataaccccatatcatcttagctctatggctaaagaaaatgtattttctttttactttttctttgtatgttttaaacaagctgccaacaactattttatacacctagtatatagaggctctgctaaagggttagttgaattgaggagccatcataggcattttatgcttagaaaaagaaagtgtctcttctctcactctttcagctgcagctgtcatgagttcccttggcccatgtgggctgctctgagtcactgactctgccactattaagataagatgagttttccagaatgtcgagggggcttgtttggcatttaatattgaatatagattccattgaggctgaaaaagaaaa

SEQ ID NO: 33784 - DNA, 1025 bp, Homo sapiens
gggtagaacgaaaaggagattttgaagatagtttctgctaatagaagacagaatgcttactgtaacctcagttgatgtaattatatgaacttgaggttagatgaaaaggtgaaaggttgtggggatagtgggacaggaagcgtcagtggctcaggcaacattgatctgttgcagtgccagtctctaatcattcaatcagctatgtgttgaactagattctatatgagctaataaaagtgttacatggtggtactctacggttggcaccacattttatactcactgggagatggaaaaacacacaggaggtatattgaaactaggtagattggtaaccttcacaagatccttgtgtgtcttgtttaccatctcatctcatacatagaacagtacctggtatatactagatgtttaataaatattgatttaataagttattaacatatgattaagaacatagataaatacaacaacaaataaagtctctaggattttggaaagaggctgtaaccacctgggaaaacttcacagaaaatgagagtttcagatactgagaatagaaccactaagaagcagaaaagagaagatattctcgtgggggagaacaacggctgggaggggaggaagcatggccaaggcaaagaggtgggcattaataaggtatgttccacgttctggggctaatgagaagacaatgttagctttatttctttttacttggaatgatatatgttatttataaggttaagtgagattttacacagctttaatgcctaggctggccctggacctggaaatttgagccattgaagtttgggggtttggtaatgacagtgaggcctttgagctgcactgaagctggtctcttaggacaacaacaattagaggaggaaggaaggtaaaggaggcctaagacagtcagggggagggagactccccattcactgacctgtcagttcaggcctgggctcttgccacctgtgatcctgttcatcatttggttaggtacccaaagcttatgtgaa

SEQ ID NO: 33785 - DNA, 1064 bp, Homo sapiens
aaatgtgttacaaagataaatgaagtagaaatatagaaagaaaaatagtaattttaaagcaactttaaaataagcaaacatgtctttataaaaaggaattgagtaggaggaacagagatcaacaaaattattgtttttttttctacaataccttatgttttattacatgctgaaaagatcgccacaacttaaatttcctctttttttctcctccttaggccaagttcacagatgactgcaagttcagggagcgttttcaagaaaatagctataatacctatgcctcagcaatacatagaactgaaaaaacagggcgggagtggtatgtggccctgaataaaagaggaaaagccaaacgagggtgcagcccccgggttaaaccccagcatatctctacccattttctgccaagattcaagcagtcggagcagccagaactttctttcacggttactgttcctgaaaagaaaaagccacctagccctatcaagccaaagattcccctttctgcacctcggaaaaataccaactcagtgaaatacagactcaagtttcgctttggataatattcctcttggccttgtgagaaaccattctttcccctcaggagtttctataggtgtcttcagagttctgaagaaaaattactggacacagcttcagctatacttacactgtattgaagtcacgtcatttgtttcaatgtgactgaaacaaaatgttttttgataggaaggaaactggaattctttgtactaatacagggagcacactccttcagttcagcaagacataaagccttttgctttatgcttgagggatatttagaactttgtattttcggaaagttaaataacagggactacgtatttttctgacttttacagattaacctgaaagaacatacatgatacatttttatttttggtttccaaagaatattttgatgcagataaaatattttgttaacttttgtttttttttgtttgttttcttaaaagtacctctgcattgagcatattttcttacttttattattttaattaatatgacataagcaatca

SEQ ID NO: 33786 - DNA, 1088 bp, Homo sapiens
aagaactcactgtcacaaggacagtactatggggaaatctgcccccatgatccaatcacctcccaacaggcctcacctccaacactggggattacagtttggcatgagacttggtgggaatgcagattcaaaccatacgaatgggttccctggtcgggatgcaactttgtattggatttgatgcttgtgtagcaggcgttcaatgagtccccagatagcagtgctggctaaggccgaagaggagaaaagccaaactctggagttgtgagaaaatatatttctgttttaagccatcctctctgtgatactttattatagcagtcctagagaactaacacattgagtaaggctgtagtatatcagggaaaatgtatgaagtggcaggcccccagagctttgtagggtttatctgccctcctctggagtgaccatgccttttgaaagccaggtactactcatttcttgttcatcctttccaatcagcgtgatgtcactgatggaatcaatcaatgtgaagttctgtgggatgcccaaccagcccagattccattatgacagaggacaggagaataaacataaccccgagacaaaattgtaaatacatgttattgtctgtttaatgagaaatcaaactgattttgactttatttcctaattgaggcagaaaagaacttattcacgaaatcaatagctacatagtatctatctgaagacacattagtctgttccagcaagtagcactgcaactgcaattagggctactacttggaggagcttgtggtagtctacacttattctccaggattcaacatgggggttgtgccagctgccatgtatgacaatctgaattagacatttcagtcaatgatccctgagtggctgcatagacacagtggacctaacccttgcatagacacagtggacctaaccccaagggttaggataaactaacccttggccaggactccatttctcatctgacccccataagcttccactctaagagcggggccacagtgattctttggatctctagataccagtctcagcttgaatgcagattgaatgcagattcagtagtccattaa

SEQ ID NO: 33787 - DNA, 1030 bp, Homo sapiens
aaatctgtgaccttactaattgctttttattgtttctttgtacctcttctctgcctccttttgtatgaattaagtatttttacaattttattttatctccactattggcttttcatttatatggcccctttaaatctattctattgattacactaggttttaaaatataatatatgtcattacgttaatgcctatttttaaataatatgccactttgtctatagtgtaaaaccttacaacagattatttcaaattcatcctcatccttgtgctattattgtcatacattttgattttacatatgcaataacacataatacactgatactgtcctttagcacgtttgtattgtaaagcaaatgcaaatattaaaaaaaaactattaattttataaatgccttcccttattccattttctgttttctttgttaatttgtgtaggtctaagtttttgtcttgaaaaatattccttatgctttaagaacttttaaaaatattttgtttagtgaaagtctgctggcaatgaaatgtctctatttatttttgtctacaaaagtatttatttctccttaatttttataaatattttgggtgattttataattctagattgacataattttttttctgtgagcatcttagagatattacttcatcatcttatggtttatataatttgtcttatataattcttctgtaattactatttttgttcctctgtatgtaatgtgccttttttctctggttgtcatcaagactgtctctgtctttggctttagtagtttgtatatgatattggttttttgtttgttttgttttaatctgtcatgattggtgtgctctgagtttctttgtgatttagtgtctgacattaattttggaaaattctcagccatttatttcttcaaatatttctactgatttgttttctttctcttctccttttgcaattcctgttacacatacgttggactctttgataatgacctgcatgttttggatgctttgttgtttattttttccctcctct

SEQ ID NO: 33788 - DNA, 1165 bp, Homo sapiens
aactcttaacatgctacaaatacaatagcaacattaatgacaaaagttttcaaaagcaatagatattatttattgagtgcttaccatgtatcaggcattaccaagggcttagcaaaatagtgttatttaattcacacaccaatttaggtattattatgcccattttattatagaggaaactaaattttaaaatgtattactaacttaccagtgtcacacagtaagtaggtgacagagccagcatttgaatccaagtctatccatcatgcagtagataagaacctgaatatcatgggaagccaagctgggtgtgagtttggatgctcccctctctagctacatatccttgggagttaccaaaactctcaatgctttcatctcccacatttataaaatgagggtaataatgctatctagccataataaaatgtttgaaacaattaaatgagataatgaatgtgaagcttttaaaacttcactcagaatatagtggcttcttaataaacgataacaagtattcatagaagaaataattactattaactctggagcaaaatatgcattttgaaatgaatacacaattaactgagactgttagtttaacttcattcaaattcttaggcaatccacaaaatataaataaggcagtgaaatttcaaccaaccctcaagttcttgacaactattaatatctgccaccacatctgtctgattatcagtgttatcatttcttctgcctctataaccctcaactgtgccatttaaaagatgtatttctaaaattaaatgtttagttgtaatttcctgacaatttgtcagcaattactacatactaataattccaatcggattttaaaaataatttaataaagcattgtgttcattagaaaaatattttattttagcaaactttttaaaaatttcactaaaaagtcttcttaaaaatcttcccaagtctttgtagattctgtggcacatatacaccatggaatactatgcagccataaaaaatgatgagttcgtgtcctttgtagggccatggatgaagttggaaaccatcattctcagcaaactatggcaaggacaaaaaaccaaacaccacatgttctcactcacaggtgggaattgaacaatgaaaacacttggacacagggtggggaacatca

SEQ ID NO: 33789 - DNA, 1073 bp, Homo sapiens
caaggagattacttgagtccaggagttcaagaccagcctgggcaacatagggagaccccatctctacaaaaaataaaaaattggctggacatggtgatgtgcacctgtaatcccagctactcaggaggctgaggtgggaggatcacttgagcccaggaggtagagactgtggtgaggtgtgattgtgccactgcactgcatgcagcctgggtgacagagctggaatgcagtggcgtgatcgaaaaaataacaatttttaaaaggggcactgattttaagctataacccctatattttaaatacataggctggattttatcttgctcatacagacttttaaaatgataccctgtgtttagccctgaaaagtgcttacttcttctttgtctgatgggtcttaaaattttctatccttgcagcttaccctgtgttaccactccactaaagaaaacaaagtattcttttttacaataaaaggttatttttatatgaaactttgaatttcacatttatcaactcatttgattttcaaaactggttttgttggaggtgcaggtcagaagaggagtggaaaccaacctgccctaatcctattgcacccattttcccatcagctcactaaagagtcgtgtggaaagttggtagctttatcctcagaggccctcctggatcctctctggacctttcccaggtgataccatttcaggaaaatgggtttcttttcaaagacagaatgtctttaggacagaaaggggttgtttgccttctaggtatgtgcatgaggggttcatttcttagcttgattttctttccagtgattcatgatgtgaccttctaacaagttccttttcttaagtctaaaaagtgtggacctggtacccctttactgagtaaagagaaactaaggcatgcggtttggaaactaatggtaatttcagcattgagaccttggtgggactttggagctcacaatcagaccagtgtttgacagttaagcttgtgtatacttactccagctctctctggactggtcttgtatgggtccaagtcgttgtaagttcaggaaggtaatt

SEQ ID NO: 33790 - DNA, 1035 bp, Homo sapiens
acatacctgagactgagtagttgataaaggaaagaggtataatggacttacagttccacatggctggggaggcctcacaatcatggtggaagaagaaggaagagcaaagggatattttatatggtggcaggcaagagggcatgttcaagggagctcccctttataaaaccatcaggttgtcaggtgtggtggctcatgcctgtaatcccagctgtttgggaggccaaggtgggcagatcacgaggtcaggagatcgagaccatcctgtttaacacggtgaaaccccgtttctgctaaaaatacaaaaaattggccgggtgtggtggcaggcgtggtggcgggtgcctgtagtcccagctactctggaggctgaggcaggagaatgacgtgaacccgggaggcagagcttgcagtgagctgagatggcgccactgcactccagcctgggcgacagagcgagactgcatctcaaaataaaataaaataaagtaaaaaccatcagatcttgtgacagttatttactcccagcactttgagaggttgagatgggaggatcacttaagcccaggagttcacgacccgcctgggcaacatagtgagactgtctctacaaaaacaacaacaacaacaacaaaaataaatttaaaaaaccaaaaaagcctaatgtattacattttcctaatactattatcacagacatctggcagtaaacatctgtgggaaaactacatgggaaggctaactttaacagagaaagatgctaggtgacaagatcatcaaagtaagtgactttgagccagggaagaaaagtggctcagcacaaatgtggtctttcttcagactgatcatagtatagctgattcactacctgtgccgataaagctctattctcttgaagtcacagtgtagtcattctgattggaatttggattttgctaaattcttcagtcattctgcctcagataactagctcttcttgtccattgcatgtaatttcccctaagtttattcactggatacagcctttaattattt

SEQ ID NO: 33791 - DNA, 1131 bp, Homo sapiens
gagaattgcttgagcctgggaggcggaggttgggatgagccgagatcatgccactgcactccagcctgagcgacagagagagacccttctgaaaaaacacaataaaataaaaaataaaatcccaaataatacccaagtatgaaaaagtgtctcagcattacaacagtagagcaaatagatgcttagggataaaacttgccctgcagtgaattagataaaaagcctgaatatggaacggccacttgtagtgtcaagtcccatgtggattgtgatggcttaacttggtcatattcccgggttgccagtcacgatgaaaactttgctcagggcagtcaggctaggaagtaggggtgagtggaagatagctgcctttctccaatggcatctgcagaggtggtctgaagaagacattcccacacagagaggggagtcttgagtactgtttgctctgggaaagtgacaggccctttcacaggcagaacagaaagcaggcacttgaggaggtgggtgggtggaagaaacagctcagccccagtgtgtctcctgggaacttaactctctcagcacgactgcccttcagttaatctgttcaggtgctgtgactcttctccaaaggctgagaaactaatggtgattactcttacaccaaatctaaattccacgggatttatatatatatattccagatttctcaccagttttgttctatctgtcctagtaagcgccatctctcttatcacaggcctgtatcccatttcccactctaacttgctccattctaggctgggagtatgacatgtttagggtctggaggtaagagcagatatcttgggctgattaaaccataggattccatttgtcccattatcttctttgtgtttttatttttttgatacagggtctcactctgtcacccaggctggagtgcagtagtgcgatctcggcttgctgcagccttgacctcctgggcttaagcaatcctcccacctcagcactcttgagtagctgggactacaggcacacgccaccacgcccggctaatttttgtattgttttgtagagatagagtttcaccatgttgcccaggctggtctcgaactcttggactcaagtctggcgttcaagtgaact

SEQ ID NO: 33792 - DNA, 1052 bp, Homo sapiens
catatccactgagaccatttgtcactatctgctaaaaacaaatgtgtgcagaagttaggaagtggttaggagggaaggaagacagctctggagacaaaatctgtagtcagtctctgggacaagcatatttctttgggcatatagctgttttttcaagggcgttaaccttcagagaccacaggctggcagcagtgaggtctcttcctgcctaaatgtgcaatgattcccctatcacccatcaggcctcctcttacacagaaaataactggcatcagcttatttccgcacttgtacaatgctctacaatttttgagcctcacagttttgtagatgtacatctatgtatcgctatcacattgtaagatgggaggtgaggtggttgaacgcttgggctgtcaccagattgcgtgggttcctattctgccttcactacttactgggatgtaggtactgcgggataatggcaatacctacaccaaaggactgttgtgagagacaagataagatgcaaagcattcagctggaggacttgttaagcactcaataatgttactcactattagctattatttttgtcttaggacagtgtttcctcaagtggatcccaagcctagtttcataggcaatattttacatcatgaaccggtatacacatatacacttatgtaacaataatgcaaataataaatatgcatatatgctgcttattacatatggactgagtggtgcagagttaggatttgaacctaggggtccggggtcctgtttttctagtgttgtttttttttttcttggaggggggattacaggcacacatcaccacacccggctaattttgtatttttagtagagacggggttttgccatgttggccaggctggtcttgaactcctgacctcgagtgatccacccgccttggcctcccagagtgttgggattacaggcgtgagccaacgtgcccagactctctagtgctctgaaccactactctccactgccttgtggcctggtacttgttatacatggaggagccaaagtttcatcaaacacta

SEQ ID NO: 33793 - DNA, 1024 bp, Homo sapiens
agggagaaacctaatctgaagatggaagcatactaaggacaattttctccactcacatccacatttgaaaagagggacagaaaaacataggtaactctactttcacaaatgaggatagtttaacggatagaagaaacaagcacattattcacctgtgttgtaaaacatctactcttttttgtcactgaataagtgttcccaaagtacagttaatcctaatatgaaaacttagaattgtaaaagattaatgataacgtaaaagtatattgattaaaattccccttacaaagtatattttgatgtttgtttattctacctcaaacagaggcttaagttttgaagtgtaaccagtttatacttcattttatacaaaacttattgctgagaagtctgaatattgtgctttttgttgtttgtaaatagaattgaatttaaatacaccaggataaatcttatttaaaggaagcctgtttgaaaatcaccaactttaacttattgcttatataaatccaagctctgtacctgatctttatgtaaagcaagattcatatgtgtagtatctaatgccctttggtgttacatttgactaaaatacaaatgtctgtattttagtgttgtgcattattctttcaagtgctaggtaaattggaaagagatggtcgattgagacagtgaatattcaaaaattggaaggtcacagatttctcttagataagaatagtctcatcactacatttagcccagttaattgctcctgcacttgtgaaagggcttggagtcttataccagatacaatacactttacagtgaaataaattattcattcatatttgatttagggcagtttggttataatttttactttgcatcttggccatttttttcttcagagaaaagcattccctttaaaaatttatcctgctttccaacaactagtgctaggagagatggatatccacatgcaaaaaaattcactcaaaatgaagcaaacacctaaatagaagaggtaaggctatacaacttt

SEQ ID NO: 33794 - DNA, 1064 bp, Homo sapiens
ctctactaaaaatacaaaaattagccggatgtggtggagtgtgcctgtagtctcagctccttgggaagctgaggcaggagaatcacttagtgagttgagatcacgccactgcactccagcctgggtgacagagtgaaactgcatctcaaaaaaaaaaaaagttaagatggtaaattttgtgttatgtatatcttaccacaattttttaaaaataagttttttaaaagaactacatgatgaggccaggcgcggtggctcatgcctgtaatcctagcactttgggaggctgaggtgggcggattagctgaggttaggagttcgagaccagcctggccaacatggtgaaaccccgtctccactaaaaatacaaaaaattagccgggcatagtggcaggcacctgtaatcccagctattcaggaggctgagacaggagaatcacttgaacccaggaggcggatgttgcagtgagccgagatcgcgccattgcactccagcctgggcaaaaagagcgaaaactccatctaaaaaaaaaaagagagctagatgaacaaaaaaacaaaaaaaactaccatcatgaaaaatcataaggggtatggggagacagacaagaaaaccaagatttataatacagtatgactaatggataactcaaagccagtgtgaaatttaacagaagtttaagataagtacttggtaagtataaccaagttttatggaaataaataggaaatgatcagagaaagagtatctgattaaacctagaagtcaaaaacttccaagatgggtaatctaagagataaaatggatgagtcagccgcaaggaacggcaaagaaaggcattccatgtaaaaggaaccttgccaagacccttagtcctacaacttagtttagatccatatggtgatctcttacaataagttaaatcagtaggtttggagctactattttgaaggtgaaaatcaaaaggcatgcattagatcctaaatgcctttaatgctaagaaagcactggcatttgaacttaatcctgatgggtccaggtgaagaaatgaacaaggccaaga

SEQ ID NO: 33795 - DNA, 1013 bp, Homo sapiens
attagattggatgagatgcccaaaggagagaatgtagataggcaaaaggactgagtatagtgaggcctggagcacttcaacgttaagaggttgggaccaggggaagatgtagcaaatgagaaggattatccattgaggtaagaaggaaatcagaataatgtggagggtggtgtcctagaagccaaatgaggaaaatgtatcaagggccaggtggtgagctatggcattgataggtcaagtaagataaggagtacaggttaactgttggcattagtagtgtagaggccactgataaccttaaccagctgagttttgtgaaatgatagtgaaagcctgattgcatggtttaagagagaatgggaagagaagatgtggagatagtgagtatgggctaccctgtgggggagttttcaaaaaaggtaggaagaaaaacagggtagacgatgacagcagacgttaggctaagggattagtttttcttttatgatccagtagaaagcaaaaatttgatataggggaattggggagaggattcttgcaggagtagacaagagaggaaggaatctagcagagggataggctttagataggaatatgggtagttcatctgtgtcagagattctcagcctcagcactactggcgttttcggctagatactttgttgtgggggctgtcctgtgtattgcaggaggttttagcagcaccactcctctgattgctggatgccaatagtactgctgttcctagttgtgacaagaaaaatgtctgtagacatattagtgatatagtggtggaatttgtgtaagtactctttcattgcattgctccagtattctttttttgttggctttttggttttgagagagggtctggctctgtcaaccaagctgtagtgcagtggtgtgatctcagctcacttcagtgtccgtctcctagcatcccaagtagttgggactacaggtgcacaccactacgcctggctaatttttgtatttttagtagaaacggggtt

SEQ ID NO: 33796 - DNA, 1050 bp, Homo sapiens
tgaatggactcagcatgtaaacttggcagcattaaggacttgttgaagatcataatgattaaaattagatcagtcatactgggcacagtggcttcatgcttgtagtcctggctacaagcctcagtcccagcggaggtgggaggatcttgtgagcccagaaatttgagcccagactgggcaacacactaagaccccatctctaaaaaaaatttgatttggtgctttttcccatcacatttcagctacatgagtacgggaaaggagtgagcaaacaattaggtttaaccacagttgcaatttttgcctaacaagtatgacagcaagagagggacaagggagatgagtacctatgcggttcaatgatgataagttattacaatgagtgaccataggagttaggctaggtaaagagggaagtgaggcctttatggagaaaggcagtgacatgtaagggataagtggtttggagggcacagtgggttcaaggattgttgggtttgagatactagagaaaatgaggtagaaaaacaattttaaaaaattaagatggcagggcgtggtagctcacgcctgtaatcccagcacattgggaggctgaggtgggcagatcacctgaggtcgggagcttgagatcagcctggccaacatggtgaaaccttgtttctactaaaaatacaaaaattagccggtgtggtctcatgtgcctgtaatcccagctactggggaggctgaagcacaagaatcatttgaacccgggatgtggaggttgcagtgagccgagattgcaccactgcactccagcctgggtgacagagtaagactctgtctcaaaaaaaaaaaaagatggtttataactcttactcaaccaatcttacctcttgatgtatatgttttttaaaatttatagttctttatgaaacatttctcctaagtatattgcacgagaaggatgaaaggtatgagactattgcttattgtattgaaaacacttcctcttccagttggcaagtataaaacggtaccaactgtgaaggacttaaaaatatcttt

SEQ ID NO: 33797 - DNA, 1031 bp, Homo sapiens
caataaaactttttagtttttgtgtaatgcagtaaaaagtttgattcccggccgggggcagtggctcacgcctgtaatcccagcactttgggaggccgaggcgggtggatcatgaggtcaggagatcgaaaccatcctggctaacacgatgaaaccccgtctctactaaaaaatacaaaaaattagctgggcgtggtggctgccgcctgtagtcccagctacttgggaggctgaggcaggagaatggcgtgaacccgggagggggagtttgcagtgagccaatattgcaccactgcactccagcctgggcgacagagcaagactccatctcaaaaaaaaagtttgattcccttacggtaccagaatatatatcaggaaaaaacaacatatcttctattattcctaaaattttcttgacaaaatgttgagtcattatgtgtttttctgttacatcctagacagtacaatgtagattataaactggagacttacttgaagattgctaggctatatctggaggatgatgatccagtccaggcagaggcttacataaatcgagcatcgttgcttcagaatgaatcaaccaatgaacaattacagatacattataaggtaacagatgagttgatttggaattacttttgtattggagaattgtaacatactaagatgttccaggacatctgatagatgctcttaaatattagaaattgtttctctgttttgttttgttttgtttaactcttgctttttaatttgtcccctaattgaaatattttccctctgttaggtatgctatgcacgtgttcttgattatagaagaaaattcattgaagctgcacaaaggtacaatgagctctcttacaagacaatagtccacgaaagtgaaagactagaggccttaaaacatgctttgcactgtacgatcttagcatcagcaggtaaacacgtaataatttatacttaaatgaacagttatctttgcttaataactttaggttggttactgttggaaaatttagcaaggaact

SEQ ID NO: 33798 - DNA, 1020 bp, Homo sapiens
gtaggacgcagggtaacactgatgacttgttcattggtggaaatgcctctgctgaaggcccttagggcaaaggtgcctcccaaagtgctgggattacaggtgtgagctaccgtgcccggccaggtctaaatatttgtaacgaactgttaaataaaatatgttctaccctcacatcttgacaaatacacttttataataacctggaagggcaggttcctatttagaattctcagacttcttggggtctccagattatggagacagctggctccctggctgcccatccctggtctgagggcatttcctcttttatttctacctatgccccatcctacactacaaagggctttgtggacacatgtgtggacacctgatgctgcatagctaagctctaaccacacccacttcataaaatgtgtgtcccctgggcatccttagccattagggttgtgtactccagctgtgcagtctgcccttaggaggacttaatcaggaaagagaatgtactagccctgtaaataggctccaagtggtttgggcagataattctgcagtctaaggcacccagacgtagatgaatagtattccattgtatagatcactttgggtaatatggacgttttaacaactttaatccttccagtccatgagcatgagctatctttccatttatttgtgtcttctatttttctaattattttttaaatagttttcagtgtactgatttttgtgtgttgattttggatcctacaactttactgtatttgtttatcttaacagttttttggtggagtctctggggttttctatatataaggacacgttattggcaaacaggtgtaatttaacttctccctttcctatttggggaatgtcttttatttctttctcttgcctaattgctgtagctaggatttccaatactatgttgaatagaggtggcaagaatggacatctctgcgttgttctgatcttagaagaaaggctttccattttcactgtagtgtataatattagctg

SEQ ID NO: 33799 - DNA, 1074 bp, Homo sapiens
aattgcataatttttgcaattttatcttctctgtgcttctctataaattctttctgggacgggtctgttactttctttttggtatgacagtgcctttctgttgcttctcctataagaatttgcattaagaattttctctaaccatggaatgaagggaaaataaatgtcagaaagagcaggtatgggcgggaaaatatgttcttttccccctaagccctggaaagcacacccatgttgagtcttactctgtcccaaatataaaagtttttaaccattctgaatataatacaaaacctttctttaatatcgtgtcccttaattcatcctgtctccataaaaacaaaaatctttagctattcagctaagaaaaagaaatggttaattgctgtttctgtttaatcgcagtgctttggagaagaggttgttcacaacaggtatccagcaatgaggacctggtaagaatttttttttctattagtaaggcctttgcaaatatgaccaaaatgtttttctttttaaaacgagatctggtattagactctaacatcttttattttagctacttgaatagagttctgccgtaggacaaaacaatttgataattactctgagttcagaaatgatgatgaattgattgtagtcatgtagtcagctgagttttgaagtaggggaattcctagattagaagcaaagctgctataataccatatttttcttcctagatcttaaatttaaggatatgtgatttgggaattgttttttttttttttacatagccctttgtaagcaaatgatatgggaattttaaaaggtagtttgggtgagcagaattttagataactgaaaagagactgtacaaagcttagctataggttggctatagtattaacatggactttctgaaagcacaggttcttgctacatgcaaaggtattttgacactaattagaccatacaaagcacttggcacagagctgaagagtagttacgtgagctgaatgtaaattggaaagtttgaggaattggaaaaaacaaaagaacttgtctagtttctctgagcatctgtcttggtaa

SEQ ID NO: 33800 - DNA, 1076 bp, Homo sapiens
ctgttaaaggaatttaaaatgatgaaaatctccttaaccaaagcaatggaataatatgttgatcttggattttacgtgtttaaacatctgtgataatccaacatttaaaataactggagcaaataccttagagcttagcactgtacctaataccacaatgcagttgctcagtacacatttgcttaattaaatgcctagaactatgttagatactttgggcggcacgctaatttcaattagggaaaaaaaatgctctaagggcttgcttttattttttaatttttaaaaaataatcttgtattgctataaagggcttgcttttaaaactcaagtgtccgaaccaaaaaaaaaaactacagtaaaattataaactacagggttttaatgcttccgggttgccactgcagtggcatttctgactgtgggagcctcagtttcccagtcatctgatgagcctgagcagcagcaaagtaccactgtaagccatgagatgtctcgtctgaactggaaaccctttgtatatgacgccttgcctctatcactgctgagtttggaactttccccatggaccttgccaaaacacgacttcaggtaggttcaaggccaaagcattgatgtccgtttcaaagaaacaaaatatagacggatgtttcatgctttgttttggatctataaagcggaaggtgtattggctctgtattcaggaattgctcctgttttgcaaagacaagcatcatatggcaccattaaaattgggatttaccaaagcttgaagcaattatctgtagaacgtttagaagatgaaactcttttaatcaacatgatctgtggggtagtgtcaggggtgatattttccactatagccaatcccaccgatgttctaaagattcgaatgcaggctcaaggaagtttgttccaagggagcatgattggcagcttcatcgatatataccaacaggaaggcaccaggggtctgtggaggagtgtggttccaactgctcagcatgctgccatcgttgtgggagtagagctaccagtctatgattttactaagaagcacttaatattgtcaggaa

SEQ ID NO: 33801 - DNA, 1046 bp, Homo sapiens
catcaggaacccaccctgtctgctgagactaagttattaggtcaaagagatgcttgatatatgtggaatttgaatacagattcattgtgtgagccagctctgatttgttggttgcggctgcctggaactcctatgtttgggagcatctgagctcatcaggaaagagagctgtgatcccatagtgatttctgctttaggtgcaggagaacagtaacccaggatcctctatccttcaactagaacagtgttagatgtttcaaagacatttctgttagactggggttaatacggtggattgcttttctcaactataggaataattccttaagggattatgctgatgtttagcattagaacatcttcagtgctggccaaataccctgcctttctgtagattgcattcaaggcctagcccttgtatcactccttggtaaattcttaattgatttagttgtatttttctttacatttcattcccaagaatattctttgggctctgatcataattggatatttctcaagtttctttgcttataatttatgtaccatttaaaaagatcatttagttttgtctattatatgtttactttgacaagttttactgtcaatgggtgactttctcatgacaataaactcaaattctagaagttgaaatgtgtgtagggtaccctctaaattgctgattttggtaattgttacttgttaactcactgaactttatgctcttctctgactccttcttaacccactggttcaagtaattatcatttattgagcacctacttctattttcttctgcattgctgggtatctctagatgtatgcgtaagtcactgatatggcaagatacttgaggataagccttgaatacttagcttggaataagtttagtgattctccaagccagtgattttcaagggatatatgataatttgttggatacgtatgttaatattacagctttatagtcgagaaaattgttttaggaatacaaattatgaagagtaaaacttggccaggtgcggtggctcacgcctgtaatccca

SEQ ID NO: 33802 - DNA, 1031 bp, Homo sapiens
tatcctttgttgcatttttaaccactgctttaccttcatttgtttagagacttccttttggagccatcatctatttttaaaattttgattcttattttaattaatttattttcaggtgggatcttgctatgttgcccagggtggtttctaacttcggggctcaagaggccctcctacctcagcttcctgaatagctggaaatagctgcttgccactgcgcccagctcttttttacttcaactgacataatagttgtatatgtttatggagtacagtgtcatattttgaaacctgtgtacagtgtgtaatgatggaatcatcctcttgatgaactatatcctttgttccctgagccccttgtccttgttcttgtcctttttgtcctcagtattgggaagcacctcagttctctttcctggactgctctttaagagtccccatgaactataaatgatactcactaaattgagtacacttaaagtgctatcttagctcaagatgttataatgaaaatactgtagcctaaacaacaggaattgatttcttataaatctggaggctggacattcaagataaacatgctggccaatttggttcctgctgggagccctttgcagacagataacttgctgtgtcctcccgtggtggagagattatttcttgtgcctctttataagggcaccaaacccatttgtgagtctccaccctaattacctaattgacttcattatcttacaaaggttacctccagataacattacattggaaaattgcacttcattgtataatttgttttttggcagggacagaaacattcattccatagcaaatataatttggcaaattttgacacacacacacatatatatatatatatatatatatatatatatatatatatatatatgcctatgaagccatcattataatcaagataatgagctagtctatcaccactaaaagtttgcccctttttgtagttcttccctcatccttagacacgtactaatctgctttctggcactatagat

SEQ ID NO: 33803 - DNA, 1035 bp, Homo sapiens
aagagctgattatgtatttacagtgagatgccacctgatgacattttggtcagtgatagacaactatacgacagaggtcctataagattataatggagccaaaaaattcctgttgcctcatgattttattccagttgccaacggtattcagtaaagtaacatgttgtacaaatttatagcctaggaccaataggctataccatatagactagatgtataagaggccataccatctaggttttgtaagtatactctatgatgttggcacaacaacgaaattgcctaacgatgcatttctcagaacatacccccttgttaagcaacacatgactatatataattacaaactacaataagcatttgagaaaaagaataatactaagagagcaaagacggagctgggagactttccagaggcacagtgccaagcacgtgggctgcaatctgaaggttgagtgggaatcaacaaggtaaaggatggagtcttggggaggaccatcacaggcagaggatttctgtgggcaaaagcccagatatttaaagcatgaaacatttgaagcccacaagtgttggaaccgaggagaaatgcatttgttcaatgcattcatcaagcacttaggcagtgctgagcatggtttgacagcacacagtgagagcctgccctccggggtgccctgtggccttctttattggtattatcattgttattactttttctcattccttttcagttaatccaggttcttcttatgtactcatctccttcatctctgatttctcttgcccacttagaaatgtgtttatccattttgccaatctccctccatattcaattctattcatagctcataagcttatgagctatatgatatggttttccttttattttataaaagaataagttttgatgtgaaattagacatgatgaaaaaaaattccatcagctcttgaagccacttaaagtggcttttataagcacctcaaagcctctttcacttctctttttgtcctctcattaatttttcacttccttgg

SEQ ID NO: 33804 - DNA, 1043 bp, Homo sapiens
accagtgtgtgcagggcagtggggagacaggttgaattacctcttctttctttccctcctaatcttcctgaggacaggtggggatttgtcttaggacttctactattaaaaagcattagagctgtgagtagttacgagttaattttcattatgaacttaatccctcaatatatacacccacacattatacatacatacaaagtattaaaatcatacacacacacaaacatacacacattatacatacacacaaagtattaaatttatacacacacacacacacacacacacacacacacacacacacactgctcccgcctcccaagggtgagggattgtgtgtgtgtagtattttctacattgtttcctaattatctctggcattagattttcagctaaataaaggtatgaactatgtttggtaaatttttgctaatcaataaatttgaaattaagtttaaaacaggaaaatagcattttggtaaaatatatcttgaattggtcttctgaactttgttttgatctttgtgtcatcagaatgtagaaaataattttgttgagtttgaggggaaggaaagcttcaaatatagaaaagctaattgtttttaaattataggtactttctattgtgtgtaaactactttttctatggagagactgtagctgattattttgctacatttgttcaaagagaagaacaacttcagttcctcattcgctaccatagatttatatcatttgccctctatctggcaggtaagttaaggaatattctgtattgatatatagttaacatattttccatgtttatttttatttctgttattttaattagtaattttttggttaaattttattccagcctctctttttcattgtttcttgtgtataaagctatttctttcatcatgttcttaaatagcaattactcccttatagtgggtttaaaaagtgcttgttaagaatcactccaggccgggtgcggtggctcactcctgtaatcccagcactttggaaggctgaggcaggtggaacatctgaag

SEQ ID NO: 33805 - DNA, 1032 bp, Homo sapiens
attttcgaataattttccaccttttacattcaggttttttgttactttttaaaattttaaatttcattttattttcccagagattaggtctccccatgtggcccaggctggtctcgaactcctgggctcaagggatccttccgccttggcctcccaaagtgctgggattacaggcacaagccactgcacccagcctttcattcaggtttattgttcagttcagctttccaaatttgttccttcatttaaaaaaacttttcactgctatatctatagaaagtacattcctagaaataggtattgaaaaatttctactcttttactggtactcatatgatggtagttggtccattttaaattctgaccagttggaaggattatgatcatggagagattatgattgttatcagctaagaagaccatactaaaattttggagagtaaaacacttgactctgattctgtgtttatcaaagcacatttgtgcattttcttggtattctttgtagaaactttgagtattttctctcatttaccaaaccagtaagcttgatttattttgttaaaggtaaggtagattctggaatggattctttttttattatgggagagaagaatgtagtaccttctcagtttatatttaaggtaacaagacttctggcattttgagttttgatgataataccaacagtcaaagagtctatggtatcttctgttattgaacccaacacttttgtttcatgtgattattcttgtaattatttaaaacaactgcgggccaggtgcggtggctcacacctgtaatcccagcactttgggaggctgaggcaggtggatcccttgaggtcaggagtttgagaccagcctggccaacatggcgaaacccgatctctactaaaaatacaaaaaaaaattagccgggtgcggtggcaggtgcctgtaatcccagctatctgggaggctgaggcaagagaatcgctgtaacctgggaggcagaagctgcagtgagctgaaatcatgccgctgcactcca

SEQ ID NO: 33806 - DNA, 1055 bp, Homo sapiens
agaagaacctttggctatgtaactgtccattctgctaagtcaggtgtcatcacactctttctgtaaagggcaaacaatacatttattaggatgtgcagaccatatattctatcaaagcttctcaaccctgaaccctgctgttacagtgagaaagccccccgtggacaatatgtcaatgaatgggcatggctggatttaataaaactttatttataaaaataggttgtggcctggatctgatctgtgggacatacttttctgacccctgttccagagacctaaaattatccctgtgtattaggttagatcatcataaagtgacatgttatctcagcaatttcatctcagcttccctcacatggctgaggcaccatctggggttagaaagtggctatggaagttggggtggtcagggaaagcctttctgaggaggtggcacttaagtagagatttgagaaaagaactcctccagagaaaactaagaagagagttccagagtgtacagaggagtggaagaggttaattagcctgttagaaggtgagcaagaacagtgtggctgtggttgagagtaggagatgagaccgcagagtttggtgggaccagatcacacgcggcctacggggtcagggaataagtgaactcagcgagcatttgccagtgggaagctactatgtaaggtgcaatgcagtatacaaaaatatacaagatgttgttcctgttctaaagatgctcaccacctactagggcagacaatacacttccccagagaactacagcaacagctgtgcaggataagtatcttgcgaaggctgtaatagcagagtggcattgagttactgtggctcttttatgctttgactagtaaggaagagaaagagagaaatgggttggcaaaaattaaccaaagactttttcagtaattattttaaaaagaaaaatgttatatttagaatggtattttctttaatggtctccaatccaagattttttgttaaatggtgagttttttttgcatgttggaaaccaaacagctattgctgttgtagtttagata

SEQ ID NO: 33807 - DNA, 1058 bp, Homo sapiens
tttccagtattatatcttctttaacacatgggttatttagaagcatattcattagttttcaaacaaatggagattttttcactttcctcccttaattccactgtggtcggaaaacatactctatgatttgagtattttataatttttgagatctattctgtggtacagcatgttatctattctagtacatgctccatgggcaaaggtgtattctgtagttttgggttgtagttttgtctgtgtcagttaggtgaggtttaattaaatcttctgtactgatttttgtttatttgtttttgtgtttgtttggtccgcttgttctatcagttactaagagagctttgttaaagtctctcattgtgattgtaaatgtatttttttatttgtagttctaccaatttttggtttatatattttgaggttgtattaggtatgtacaaatttaggattgtcatatctctccattgaattgatccttttgtcattatataatgtctgtctttactgcttgccttaaagcgtactgtgttgaatattaaaatagcaatatcagctttcttttggtcagtgtttgcatgttatttctttgtctctccttttatttttaacattcccttttccttatatttaatgtgtttcttttttctagtaagcatatagctgatttttttccctgttttatttataagacagttgataatctttatccttttaatgggactatttaacttatttgcatattatttattgatctatttgggtattagtaattagtggttaaatccttaaaactttgttttcagaatatggcagctttttagggcattaactcatatgctttctttaaaaaaaaaatgctgtcctctcagtagggaggtgtcatgctgagccatgttgtccaccatttgaaagcagctatttagactgttagaagacactgagagtgccaggatgcagctagctgggagcacctgctgacacaattttgcatttagctgaacttgctaaagcagccttccttttctctgttggtctctacttggggtttatgctgtgaa

SEQ ID NO: 33808 - DNA, 1096 bp, Homo sapiens
tatcaccttgattgcagccttgtgagaccttcaaagcagaagaccaagctaagtgatgctcaaactccagatccacagaaattgtgagataacaaatgtgtatagtcctaaaccactacgttagtgatgatattgttatggaacgatagagaactagtacaatgtcctttctagaagaagacctctaacaagagaatgaagagttcaataaaaatgtaaggcatccgaagaggaaaatgtggagataaaagagctcagaaaattaatggaagagctgaaaaatggtaggagaattaatagaagaacacatgattgaatacacaatctaaagaaatcacacaatacacaataaaaaagagtgatataaaaatcatgtttaatatggggaaaaagatatgcatgcctttcatataggcgtaatgaaataaaatagatttgaggaagaggtagaaattaagaaagaaaataaagcaaacaaaaataaatagtaaaaaaaaaaaaaaaaaaaaggacaaaatacattctggaattgaagaccagatttgcagatttaaagagcaaactccgtctaagagaaaaagtgattcagaatcatgttccccaaaacatatcctggtgcaatttggaattttaggaataaaaacagagttttatgaaaattttatgtagaaaagcaagtagcattccattaaaaaagaatcaggttttccttggagttttccatagtaatagtttaatgctagagaacagaaagagtgtctacaacattctgagggaaataaaatgtgactttaaaatttatctgtagacaagttatccttcaactataaaaaccaaaacacatattctcaagggtagagaaattgaggggatacattgcgtgtaagtgctactttaaaaaaagcgtgtcaatggaattcaattaaataagagatgtgtagaaacaaaatacaagaataaagaaactgtggaaaaagaatgataatgaatacaatccctttaagtataaaaccacaactaaaacatgtcaagaattttgattgtaaaataaaatgtaaatgttattaatcttgacattatgaacttaataagtaat

SEQ ID NO: 33809 - DNA, 1013 bp, Homo sapiens
acaatttgaccatacagaatttaatctccccatttaagattatataatatttgataccaactattatgttttgtgatctttgaaagaggaaaccacaaatgttatgatcataccgtgaacattcgagcagttatcatctgacaatagttgtttttaccagtttattatttaccatgcacattctgccatttcatgatcttgctgcatgaaaacaaactctgttctatgaccattctaatcctgtcactgctaggaagtcacagcaaatccttaatgtataaactgcttttatactgtccactgctttttgtcagtgatggaaagcttctgagttccttagttcattctattcactgatcaatgcagctctcaataggcaaaagccaattctgtcaacaaactgtgctgacttgggagaagaaacctgtctgctaagaccatggggtgacacctggaacaaagtcatcttcaaggacatcttcaaggctgttagttttactttcaacgtatgagaggtcataaaagcctaaatagattgttgtaggggacattctgagataaaatatatagtgggaatatttggtggagagtttaaaaagacaagtggctactcattatgtaagtctgcaggcttatggtgataaacctcaagggaaatgtttcctatcaattgaaaaacctctgtataaactttgggacatcatcttgaaggaggggacagtttatctttctgtaattgttgttaattttgtccataaagaaatctcctagttttcaagctagataagtatactttggtgaaatgcatccaatattttttagacatttgcctttttattatttttacttttgatcttaaacttacattattctgtcagtcaaattatattgtctttatagtctattttacttgacatgcattcagcaatcaaagtatggatgaaaatattgtctaatatgaattctctcatattccatgcctttgggaatgtagtttaaagtgtttcattagc

SEQ ID NO: 33810 - DNA, 1041 bp, Homo sapiens
tttcaatgagctaatactttgtttcccaagtcattgaatttgcctatgaaatttgcattgcaatatccaaagatattttggaaatgagacactcgatctttagagtatcctatgggaaaatgagcagtaattccattttcaacctatgagaagatttgtaaatattctgttttctatcttagcctgaattttgaatattgaagtaaaaatcttgaagccagttttagtcattaccacaaataatgacactatggcttatctaaaatacattttcaaaaatgactctttaaagaatcatcattttacatgcaattttgataaatatagtgtttatttaagatgttatctccgtttttgactctttaaactgcttgagaatattttaaagatatggacaatcagactgctccctttaaagccctttccatccaaaattatgagatacaaaacgcatgagatagaaaacttggctggatttttaaaacattagactgtagtttactgcttgaaattgtatgagtaattcatttttcaatgaattatgtttacaaagatatgcctacagagactgtaacactctttatgtcaatatccaaaaagtgtacaatggggttgatttaaatgtcagatactttaatcgttcaactcttactattacacaacctagtattaccgggggaaaaaaacctgcaaaaacatttatggatctcaggtaatggtctgaattgaaaagtttcaacatatttttcactaagctatttcaaattatataatttgattttatcttagaagtaataatttaagaagcaatatttgttgtctttccaagtttatgtgtctctgattactttatgtggctggtcggaaactgcacttttgtttctgacctgttgtttcctttaatattctggattgagaaacaggagttgtgcggtgcttccctggggacttacattatgttgcattccacacagctgatactcttctagctttcctgttttgatgtctgtcaaaaaatttgaaaatttttgattttttcta

SEQ ID NO: 33811 - DNA, 1051 bp, Homo sapiens
accccctcaggaaccatcttcatctcccttcttcccactggagttatttcaaagactttcagcaagtggaaaattacaacatttatgtcatgggtggtattctcagttattcagattcagatgcaaaaaaatgttttgaatacctactatgtgccaaacaccttatgaaatatcttcagtctttggggcatcagacctcaaaggggcatttaggatttccatagataaaggaaaagataggccaggccgggcgcggtggctcacgcctgtaatcccagcactttggaaggccaaggcgggcagatcatgaggtcatgagatcgagaccatcctggctaacacagcgaaaccctgtctctactaaaatacaaaaaaattgactgggcgtggttgcgggtgcctgtagtcccagctactcgggaggctgaggcaggagaatggcgtgaactcaggatggggagcttgtagtgagccgagatcgggccactgcactccagcctgggcgacagagcgagactccatttcaaaaaaaaaaaaggaaaagaaaaaggataagataaagattttttaagatcgaagtatagtctagaatctactaccaattagctttgtaacttacttgaacaagttacactcttctgagcccttatatttactcatttattcaatatttattcattcagcaaatattgggtaagtatgaactaactgacaggcactattccaagccccagggatagaccagtgaacaactcaaagtcactcttctcactgtagtcaagtgagactgacattatataaatacataaatgtgtaatgttctagatagagttaagtgctatggtgaaaacttaaaccagcaagggaataagaaaggctggagccagggaagaaaataattgctgctttatgaagaattgccagagaaagactgatcagatgacatttaagaaaagacttgaagagtttgagagacaataataatacagaccttacttccttcatggattgctagaactttatgaaagggctttgcaaatgtggaagggta

SEQ ID NO: 33812 - DNA, 1046 bp, Homo sapiens
aaaaatgatctttcttttgactttgcctggtacattacaataaatgagggaaaattatagatttctatacctatactgatcttgagtttagggttgcaagcatgaactgagttaaaccttttactcctcacctccatcaactcttaactctctcagtgtgtgggggggtggggggggggtgcgggggctgtaaaaaggtggcagtgagatttagtaaatattgataataacaaaaacatggcagttcttataaatatgaaacatggggtttgttgaggagcatggtagggaaagggaatgtattatttccattatcaacctttccatctgtcagcacaggtttacataaattctctcacacgttgtaatggtgtggtatgattaaattctatcctagcccatgaaggggagcacagctattgatacagagaaaactgctcttaaaagccccactttatacatggatctataaaaagaccataaactttgaattgtttgattgctcatttaactcttaactcacctacttatttaaaaaagtatttgaactaatttatgataaaaacatgctttccattagattagctgcccttgattattttaacatattttgaagttgtaatactttgtgattttaaaacatattagatttttattatgtattttattgtgataacagacacataacatgagatctaccctcttaaattttaaatatataatacattgttgtacagcagatctctagagctttctcatcttgcatgactaagacttatactcactgaatagcacttgccattcctttcccaacctccaacccccagctcctggcaaccatctctctaccttggcttctctgagtttgactatttttgatacctcgtgtaagtggaataatgcaatattgtcctctgtgactggcttatttaacttagcataatgtcctccaggttgcatcatatagtagtatataacagaatttcctttaaggctgaatgatattccattgtatatatatatactgcattttctcagttcatatg

SEQ ID NO: 33813 - DNA, 1035 bp, Homo sapiens
agttttttaaaatatcactagctagcctgtacgtttcttaggaggcaaaaacaattgccttaaattttgttatattttagtgccattttgcacataggttataagcaacagataatttctgtaatctttagaatatcgattaaacttgttaaaatgtagatattttgaaatctcacacaggacacctaaattatgtaaaatgttataaactttatgatttacaggggccctggagatggaagttctgaaaaaatgttgcctttattcagtattagtgcattatcagggactccagatctcagttaaaatgagagaatctgaatctctaggcaatgatgagtgtttctgaaattcagattcaccagaaagaaattgaaagcaaagagaagacagtgttgtcaaattatcatataattcagctaaaaaaaaaatcatggtacttaagtgggagctagagcacatcactgcctttaagaagatatttaggggaataaaagaggtctgggacctcggaggtgaaactgagagaaagacaaagggacttcaaatcaagcatttgaaagagccaatgaggggccagatgtggtgactcactcctgtaatcccagcactttaagacgccaaggcgggatcccatctcaaaaaaaaaaaaaaaaaaaaaaaaaaaaaaaaaaaaaaaaaggctgggcatgttagtcccagctgtttgggagggtgaggcaggaggatcacttgagcccagaaggctgagtcagcagtgagccatgattgcaccactgtactctagcctacgtgacagggcgagatcctgtctcaaaaacaaaacaaaacaaaaacagaaaagaaagagccaatgaaacaaaacccacagagaagagaagcagaactgttgtaccaaagtaacagttctcaaatctttattttctttcttttgtgataagacacacaggccaaataagactgactgcaagttagcacaagagtgcaacgactctatgttatcctggctccctcattcaaggaaacacgccaaaa

SEQ ID NO: 33814 - DNA, 1023 bp, Homo sapiens
tgcttaaccagagtggtcgggaaatcttctttctgaggaggtggcatttggtagcatcatcctgaatgatgagaagatcattctgtgaaaatatgagggaggagcatcccacacagatgtgatagcaggttaggaaattcggtaggtgtattagtccattttcatgctgctgataaagacttacctgagactgggtaatttataaagaaaaagaggtttaatggactcacagttccattggctagggaggcctcacaatcatgacggaaggttaaaggcacatcttacatggcagcaggcaagatagaatgagaaccaagtgaaaggggttcccccttataaaaccatcagatctcgtgagacttgttcactaccatgagaacagtatgggggaaactgtccccatgattcagttatctcccactgggtccctcccacaacacctgggaattatggagctacaattcaagatgagatttggttggggacacagccaaaccatatcagtaggaaagataaactgaagctaaatcatgtagtacataggaggccatggttaggcatttggatttatactgagggcaatgggagattgtagtagggctgaagcaggggaattatgggaaatcactggacaatgcaaagcaagagaataatggaaaaccactggaaggaatgaaggagagtaatcatgggaaattgttcaacagtgaagcaggggaatgatgggaaagatgagaaatcatgggtataaggaggggaatgatgattctggttctctgaggagaatgaactgtgagaggtgtacgtatgtgctggaattggcttaagagagttgatgcttgagatttttatgtgtgtcagtttcttaaaactgttaaaaacttccatgcatgaaatctgcccccaagcatagaatattagaatctagtagctgttcatgcagtcactacccttcactgctatcaccaaagagctctctgggatttcttagtaaaagccttcttctagtgttactataaa

SEQ ID NO: 33815 - DNA, 1073 bp, Homo sapiens
ttattaagccatgtactttctgctcttctttaattatactgtatactcttttttccagttctgaagttcaagtttgatacttttatataggcatgactcattgttcctacggttatgacatattcccacatactccttggccagtgaattttgtgagaaagggcgttctcattgacctgaaagaatttgtattctttcagttcctgtcaactgtaaaaacaaacaaacaaaagaaaacagatatcatagtttctaaccattcttgtctttattctttctatttagaaatgaaaacaaattaaaacataactttttatattaaacttccaagttttgaggggacaaaaatgaaatctagaatgtgtaaaatcaaattagatattgaatattattttgttaccaaagccctccagatggtatcagctgttcaagaagatacattttggaagcgttgggaaggtagggtcaagaatggcagtgtggtcaccatcctagcattaactgctgggcaacagaatacgctcttaacaacacagtgttcaggagcaaggacagaggcttcatgaagccagtaattttacacattctgtccaagaatcctgtaaaacaactgctgtttcaggtcccccagctgcccacccacatactcagttcacacttcccttgttcctctttctgctattctcccctttcacttatttttcaaatttgttttggtgactaaataaactgcaagtccacagagataaaatgaaaaaataaaagcctaaaatttaggagacagaaaagccagacatattttaatttaatcctctgggaaggaatttaggtctgggaattactgaactgagttatgaaaaagtgaacttgaaagtagggagtactacagacataggagagatttttcagtatcagtatgtgtaagaatgacttagagaaataccttaagattcagaaacccagaccccacttgctctcattctgatttaaatggttggagaatgcctaggaatctgcatggtaaatccacaggcgatttttttttttttaatctgcctgtgctgcccagaggc

SEQ ID NO: 33816 - DNA, 1073 bp, Homo sapiens
ccagtgcatttagtagttactcctgtcaacatattcttgttttggaatatgctttgggagaactctgtgtagttcaaagtattctcctgtttgcctctgatgcaaccaagtacgactcatttgagttaatatcactttacaaggtaggggcctgagaaaggagaaaagataatgggccttaggatagaagaatcagtgctgatggaaatgacgagaatcttttgggctgggcttccttttttttttttttccctgaaaaactctcttttaatttgaaaattaaaatgggtcaaataacttaggaactaaatgttttaaagatagcttttaagatagggtctctgttgcccagtttggaatgcagtggctcgatcatggctcactgctgcctcaacttaccaggctcaagcaatcctcctaactcagcccccaaagtagcaggtaccacaggtgtacaacaccacacctagctaattttgtttattttatttttttaaatagagacaatgtctcgctgtattgaccaaggctaaaagatagcttttaatgagtacattaatgtaggacttttaatggcttaagttaaagttgaaagtttcatactagctgtaaatgtcccatcaaaactcccgtctgtaaactgctttgggaggtggagttctaataatcctttgagtttgggaagaaaatgaaaacacctttaagacccttattcttgtttagtgtcaggcactgtgaataagcaccctgctctatcctgcccaaccctgttcccaagaatgtgtgactgtcactaatagtaaggcagtaggtgggccatttcttaggataaaaagagaagaattcctaaataatcttgtatagaggctggtgtagatttaaaccataaacttcacatgtttttcccagagtttgctatcaaatgcatgggaaatacaggaacagggtctggttcaagtgcttgtttagatgtgtttgccttatcctgtgctctgccattgaatcctgcttttttaatttttgttttgttttgatttgttttcacactggaaaagtatgaaaattctctgaaa

SEQ ID NO: 33817 - DNA, 1055 bp, Homo sapiens
acatttatttttttaatatcctttgtttcttgtgtaaactaattatactactgtaacatatttgaccactctatgttcagaattattttccgtattttgagaaatattgaaaaataaaagtggttgctaccaaaaaacttaaaatcttgcttgaaacacacagagaaaagacaggaagccattatatattgtaaaataatgattaactgcaatgaaagctttaaggaagaaagtgtggtctgatttaatcaggattcacttggggagtagagtgtgagctgagtcttgaagacattaaatgtctgtagatgggaatggtatgtcatggagtaaaacaaaagataagagtaagtgaattcatgagggaagtgtttacaaagaaatgctgaagatgacctgtcaaagtgagaaaaggatgaggacagagaagggagtgcctaagaaactaggaaaatgttatgttaaagaaagtgccttaggagagtggagggtaaaggaccaatagttccagatgccacagggagccaaagagagaaggctaaagaaaagtagaacattgtgatcagttgaatattgcagggatagaaaggaaattgaaatgggggatgatatttggtttcaaaacagatgaaagttggatgatctgatctatgaggattcatagggtcagaacatttttcctttttaagatcaaaggtggtgaaagaacagattgattctgtgagattaagagatttaaaatggcagagtgagaaagaatcatctccttttatgaggattgtctggatggtaaagaatgagtcctaggtagaggtattcattttagtcagggggaaacaactttttcctgtaagattgaaggaaaggctacaaagatagatgtgggcctattgatgaatagaaataaaaataagattttatagataatttacacttaatgatagtatcttcagaaagtgctgtcataggaggcaagattatctcttggcatataaaatctaaaaataagattttatagataatttacacttagtgatagtatcttcagaaagtgc

SEQ ID NO: 33818 - DNA, 1113 bp, Homo sapiens
gcctccttgagctggggtgggctccactcagttcgagcttcctggctgctttgtttacctactcaagcctcagcaatggcaggcgcccatccccgagcctcgctgccgccttgcagtttgatctcagactgctgtgctagcagtgagcgaggctctgtgggcgtgggagcctccaagccaggagcaggatattatctcttggtgtgccgtttgctaagaccgttggaaaagtgcagtattagggtgggagtgacccaattttccaggtgccatctgtcacagcttcccttggctaggaaagggaattccccgaccccttgcacttccctgggtaaggtgatgcctcgtcctgcttcggctcatgctcggtgggctgcacccactgtcctgcacccactgtctgacaagccccagtgagatgatcccggtacctcagttggaaatgtctctgcattttctgcgtcgctcacgctgggagctatagactggagctgttcctattcggccatcttggaactgccctcactgcaactcttgcagacccctaaatacactgccttggtgaacttggataagataaggaagattccctaggttagcaggcaaagtcacttgctctcttttctctcttttccccagtcagaaggaacctctctctgtactaggctgcctggagttgagggagaggtgacacagactttcctgtgatcaccacagctgacactacagagtctcacctgaaggcttgcagaccagcacagtactggagttcaccagtactggtagccactaccgcctagctgctgctgatgtttattcaaggaccatgaccactttagtcagcaggtggtgaatcctgctgggactgagtctcttccatcaggacagtgcattttcttctggcccagaatgggtctagaaacaccatctaggagcaaagacttggaattgggggcttcgggaatctgctaagctggtgcccaagttgcaagacaaagtcctctgtgctcttcccactccatcctccacatagaagatgtctccccaagagctgcactgcctggaactggggaggggtgatacaggcactcccttagctgccacagttggttt

SEQ ID NO: 33819 - DNA, 1072 bp, Homo sapiens
atataaattttttataatgctcagtgaccagcactcttgatacatgacaatgttctcttcattcagagggacttacacttaaaagtctttcataaactgtacatgtttgtatgaaaaaactcccttactatcaactatgtaaacaggcattttcatttatttaccttaaaactttacttttcaagataacatccctttaaatgagtagacaggtttatacaggctacactaagctttttatcctctggcttttctcttttattgggtaattttctacttcctgcttgcttggcagaaggtgtacttatttgacaattcctttgaaatcggtttgatgggatggaatttgaatcaagttcctgttgtgctttctgttcaaaaatattgatgtgcaccagagatttgtactatgtctctgataaattaatcttgattattgccactaatttgtagtctaaatatcaagaattattgctctctgtgctttttgaaaatcaaggatcatctttagaaagacaataatagtaaatctatttacccaagcttagcagaagcctcaaccgaacttgaccaaaaaacaacgaaatgcccttaatcacactataccgtacatactttgtattaaatcttgttaatccattctctgtcccgttttcattcattcataaatttgacaaatgtttgttatatgccaggaccctgtgccactgaagaagaaattctaggattgtctagtgacacagtccaatatgtaatcatataattaaattgaaaatgttaaatgttgggcttgtagggatactatctcacatccattacaatggctactatcaaaagaacaggatataacaactgttggcgaggatgcagagaaattggaacccttgtgtgttgttggtgagaatgtaaaattgtacagtcacaatggaaagcagtataaaggtttcttaaaaaattaaaaatagaattaccatatggtccagcaactccacttctgagtatatatatccaaaataattcacagcaggaactcaaagagatatttgcacacccatgttcatagcagtgttat

SEQ ID NO: 33820 - DNA, 1051 bp, Homo sapiens
gttaataatagtacttaccttgtagggtcattagaaagtgaaataaggtaatacttgtaaagtgcttgggacagtacccagcatgtagtaagcatccaagaaatagtaactatcactattatatgtcaaatgctgtgctaggtctagggatagagtggtaaacgggacaaaatccctctgtgcatggagtttatattccagtatgttataactgtatagacagaaatgtatttctgtcctacaggacttatattaatgagcttccttgactctcatctttccatgtcacattttcctttctatctatctctatctatctatctatctatctatctatctatctatctatctatctatctatctctatctctatctctgtctccatctctggttcctcccttttcacatatgtacttaattgcctgaatttctcaagtctgctaagtttagcccttctaattctttcctcttcagccctattgctggcactatggtgaagttctcatttctcttctctcggacttttgtcatatctcctaactcttattcctgcttcctgactgttccctctgccactgtcagattaatacccctgatcatgagggtcttttcccctcaaaaaccttcattgagttgctccttttttacccaatgaagtacagattccttaaccaaacatgaaaatctctccagagtctggtcccaactaccttatgactcctcttttttagatgcacaggctgtagccagtgattattagacagatcttgtgcttctgggcttcacttctttgcatggcaatgcctttctccctgttttcaggtttccacatcctgtgtaccatccattctttcagggagcatctactgaggacttataatatgtccaacactataaaaggtcaaggagatacaaagatgaataaggagtggaccttactctcaaaggaccaggaggctgagagacaaagaaaagatgatgattttgatgatggtgatgatgatgatgatgtgcagggaatatgcacaatgataatagatctatacagaat

SEQ ID NO: 33821 - DNA, 1087 bp, Homo sapiens
ctgaaacaaaagtttcagaaaacgtttttcttactgcactctgatattttttatcatatttctttttttttttaaatgctagtaataactcactaaatagattttatcatggagttatcaaatactaccttaggtcatgtgatacttagtaaataaaaactaatgatgagtagtgattttgctatttgtcaatagcattatataattctgtatcctatgataagtattaaatttatttttttgaaagaaatgaatggaaatttcaggccaggcgtggtggctcacgcctgtaatcccagtgctttgggaggctgaggtgggcggatcacctgaggtcaggagttcgagaccagcctggccaacatagtgaaatcccatctctctaaaaatacaaaaattagccgggcatggtggcaggcacctgtaatcccagctactcgggaggctgagacaggagaatcttgaaccggggaggcagaggttgcagttagccgagatcacaccactgtgctccagcctgggcaacaaagagtgaacttctgtctcaaaaaaaaaaaaaaaaaaaaaaaaagaatggaaatttcaaacacttgaaataaaagtaaatataattttatgtgacaatttatttttcattgctactttcaggcatggcttatttataaaataaacttttgattttgttgattatctttgttctcttcttatcaagcagttttgagaatcatgataatctaaacattaacagaaatacttttttagatcttgtcctagatcttggggctaggtagaagtaaatgtacagattgcttaaatatattctaacaaaatatattctaattgatatagcttaataaaatagattaaaaagttaagattttaatttaatcagagcatcagagaaacctgtcttacttaaaacctatgagcaactctaattgtgaaaaataaatgtagaccttgactatctggaccaaatgttttacagagtcagaactctcatatctgagaggaaggaatgtgtaagttaaagaaaagcagtaaaattgtttctaagggagtgattttgtaatggtacagttaagta

SEQ ID NO: 33822 - DNA, 1046 bp, Homo sapiens
attttaaggacagaaccaatataaatatactaattatagccattaccaggcagaagcattcagcagctaatagtcaactgcatagactaattttaaaagtttaagattgaaaaaaaaattatctcttgaagaagtaattcttctaagacacctaggacacttggcagtgccagttcttaactgtcagtggtcaattgcagcaaagcaaccttgtgatacattattaataaaacattttcttcagtgtgcaccaacctaaaatctgtatgtggtgatagcattagtttattaggctcctgactacaggagtagtctttaataaagaaaatgttaagatggacagggagatacagaattagatggaaagatgtatgcaaatttggggataatgccttatacctagtgatttaattgttcagctcaaatgtaataaagatttttatctataagtaaatgaccttaaaaggtctcttcttatatcttacctccaagatctgtcacagaagctaaagcctaaactagtgggctctctgaccctactttgttacctaatactgccagtgctgattaaatagcttcactgagcagaaagaaatcaaacatttcctgccaagcttaaggtggaaacttacactattattcagatcaacatggtggtgctttagaacttacgcatattagtaatatcatgtttctttcttttgaaacgcacttggacacatttgtgaggatacatggggacttggggagcctcttttaatattgaaatgccatttcgaagtttacttctaagagatgtgaatttttgagtctgggtgaattgaaaggtaaatgatgatatccagtgtaggataatgttaatcacatataacaaaaatagttaaaacacaatgtaatttacaaggaagttttttctaaaatttaactaaaataaatgggatgtgttctattacaaagactttttatattcttgaaatcttacccaaggaatacaaatatgaaatcttttatttgtaaataaagtatatttattgtttgccatttaa

SEQ ID NO: 33823 - DNA, 1021 bp, Homo sapiens
tgtcacccaggatggagtgcagtaataccatcccagctcactgcagcctcaacccccttacccccaggctcaatcaattctacacctcagcctcctgagtagccaggactacaggtgtgtgccaccatggccagctaatttgttgtatttttttgtagagacagggtttcaccatgttgcccaggctggtctcgaactcctggactcaagcgatccaaccgccttcacctcccaaagtgctgggattgcaggcatgagccaccatgcccagcctatatatttcttcataccatactgtgtaatgtaaagattcttctgagatgggaaaataaaatttgtttaaactcttgcaaccttacttaaaatgaaatttgcttgattagccttaaaacaattgttttcctcccaatcctcacctgtctcctcttttctatatagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgagggtaagttgattctcaggttactacacatctaaacctgctctcacagggaactcttgggcaaagtacttttaaaaattgctacaggtatccatctaaagttacctgtagatgaaactgaaatcccatattcatttccactgggattaaatatctttttggttgattttaaaataaacatttagctattttcattattttatctaaaaaataacttagatgaatttagagtgtcctaactatatactttaaaagtatattcataatccttaaagttaactagctatcttcattattgtgggggattattttttcatattaagaaatttattattccatatattgagaagatcagacatggaa

SEQ ID NO: 33824 - DNA, 1051 bp, Homo sapiens
gttgtatatatagatataacaggtttacccccaggatcacaacagctatgtatccttgccctcaaaagtgaaagcactttaagatggtgtgatctatatttttccccttggcttataagtaactgtctgcctgtttatttgtactacaagtgaaaacaactggtgttatctgtgggcggttaatgggctaacaaatgtatgctgcttctttagagtcatagaatattgatgctagaaagaaccttacaggtcattaagttcaaaattttactaatggcaaaacaggttcagagaagatagtgttttgccctcatgtcatatatagaggtctcttaattcctaatccagggtactttctgtttgatgagtttcccaagaactgatttgcatggatttaagattaatcaattattgagcatttactatttataagtgcacactactatgggataagagaataaatgaagtccctctcataaaaagagaatatgattaagctggagatataaggaagcacaaaatggtaccagggactgaacaatagcagaaacagattaggaagtatggattgcagacagtgtggagctagcgagcctttgtgttcaaatttgaaacattagtattaggatacaggctcattctaatctatgttggagttctttccaggtaaaaggcagtaggaaagaccagataaatggttggtttatgatcccatcccatatccaagagtaggctacaaatggatttgaatagcatactccctaatatgttcacaaaactgactaaactgagcctgctatccttattcctgccaaagtttggtccacattttctttaaggatggagaaacctattgggtgtaaaggcatttccttctgaagactttattttgcttctttgattacaggctactcgtaaagtaaatgaaaatagaatagcattatttgctctaataaaaactatattttgaggtaaagatgattatggaaatttttttttttaatgtagtatcgctctgttgctcaggctggagtgcagtggcgcgatctca

SEQ ID NO: 33825 - DNA, 1028 bp, Homo sapiens
agtcttactaagactgtcatgtgccattactttggattaccttttttggcttttcctttcaagccgatgtgaatgaactctggtaatgctatagttttggagaagcatttacttagaatgctttcagcttagcaggaacaaaattgtctctaaaaccttagataattttatgaaatgtgctatggttgataggtagaagtttttaagttgatttcagtttcttcaaattctcccagatagcagggcatattatttaagtgaaattgtatgtatgtgtgtgtgtgtgtgtgtgtgcatgcacatgtgcatatatatctatatatatgcaccttttaagatgcttaccttttatacatgctaccttttaagataaatagttcaggtttcctgttgccttgtgcaacttaaaagggaaacgcactggagtcgatctttgaaaagaatggatgtttaagcacagagatctgaactactactcaaaatatgaaacagcgtgggaaacaaaagggaaatgaggactgtttcccttctgttgtcttacgaaatactactaaactctcttcttaggctcaaggtttgttaatttatctctaattacccaaagtttaaaagctttttttattctataattggattcagggtatgtcgagtaaatgaagacaaaagacaattctgcattataatacataaatatttatggaagcaacattactttattaatgtaggctttcgcaactttcagagactatactatcaatttaatttcagtcagttaaaaaaacttagataaaaggcaagatttcattctataggtaactctgtgttgaaaataggctaagagattgatttgatcttttaggaaatacttttcaaagtgttcacatataacggggcctcatacattctaaactattttcattaagaaggctttggtctacatgaaaattcattacatatccgaaggaaaatagtaaatactctatagaaaacataaaacactcttaaaggaaatttttctgcattttgta

SEQ ID NO: 33826 - DNA, 1055 bp, Homo sapiens
accttactgagatagtcttggacctaacaatgaagagtcttgagttccatgcctaggatttgatcttacattgaagttaaaggagagttgtatttttcagcatcataatgatgtaatgggacctctgatttaggctaatgttgatgaaatgacaaattagagataaggacactaattgggaagctaagataatagttcaggtgggagataatttctattaaaaagagttttaactgaggcagttattttaaagggatgctggagctgaattttagagggaaaggaggattcattcagacggaacaataaagataagcattccagatcaagggcatagcatggtcagagacatggaatcatgagaaaagaaatttagggaactgcaggagtctcagtatggtggcatgtgggggccagggtaaagtttgagaactaagtagggaccagtttttaatcttatgctaaatattatgaggatattttgaagactttaaatgctgagattatagtttagaaggaatctaagaaacaaaatcgtaggcagaagaccagaaatgtccagtgacttgaacatcactggctttaaaatttttagaatttagattgcaaagtattttcatatacattatcttatttgatctttctaacaactttcatgagtagaaaataatgttttattactatccatacactactttcctccaaaaatgtttcagtcttggactcttaaagttgaaataattaaaagcctgatgagaaagaagccattatgttaattaaaattattaatacagctaaacttgatgaagttgtaaatttagtttcaatattcctgtagccagggtaaaacagaaggcataagactgaactatatagaattgctgggtatttttaggtcaaaactgtcaaacaccagagtgctattttgtatgattctcattctctaataaaaatacacatactaattctttaagacagaaaaaattttcttggaattaaaattgcttttaaaagtaaaactacacacaatgtcttaaatactcatagcaaatcaa

SEQ ID NO: 33827 - DNA, 1036 bp, Homo sapiens
aatcccatctctactaaaaatacaaaaattagttgggcatggtggcacacacttgtaatcccagctacttgggtggctgcggcaggagaatcacttgatcctgggaggcagaggctgcagtgagccgagatttcaccactgcactccagcctgggcaacagagtgagaccgtgtctcaacaacaacaacaaaaaaaacctagacagagaataaattattgttaattttaacatttaacagatatggagtaaattcatagtccagagtcatacaaaaagtaactaggatctcaatcaaaatcagacatgaatatttgttaagtgttttctgtttctggcacaaactaaccatattgacattgaaatgtatttaaaaatagtcttacttctttgtctctgtagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggtaagttgttttctctatatttaaaaaaaaatccatattttttaaaagaaggtgtgttcataaagtttccctttagggaaaaagctatctttaaaatagcttcatatgtgtgtctaataaatggataacatatctggtatgtttctgtgctgagaaattaggaaataaggcaaaaagacctgagtataaatcctgactctaccactgacttgctacaatttggcagactcctatggaccaatcacttaattcttctgagtcttggtaactttgactataaaatggagcaagtaacctcacagggttgtggtgaagattaaatgaaataacatatgtaaagcacgtagtatagtatctgctacagagtagacccttagtaaatattatttttgtctgcttctcaaattctgatgagttacctatttgatttttaaccaagtttgaatgtaatttt

SEQ ID NO: 33828 - DNA, 1023 bp, Homo sapiens
tagttaaattgcccaggagtgccggtattctgttttgatctgggtgttggttacaagagtatatcattttgtgaaaatttatatgtgagctctacactttaaaaaatgtgtgttatttttaattttaaaagtttacattaaaaaaagaaacctctttattgtgttgggtcccttcctctttttgtctgctacttcacacttcttaaatagttgaataaatctttaaagcctcactcccttttaaagttccttaatactcttttttttttttttttcccaatgtgagagactggtagagatgggggaaaaaatgggtgccttttgaactcattgttgggatggttgagtgtctgttagggaagtcagagtgctggtactttccttgctctgcagaaaattgcagagttgccctaagggagggacacctaaacgataagtaacgttaggccacttgggttttgtgtaaagctgaaaggagaaagtcattccagatgggatggtttgaaagcagaggttggctttcatgagctgtggaatttgggaaaggggcattctgggctgaaagaaccagggaaggtaaggaatgcattaggggtgtgctgggaaccttttcttgagcgatgtcttaaagccagcttctcttctctgtctctgataaataattggaaggaaaggcaatgaatttttttctgacagttggttctaactgggggccagggcctcgtttgcaaatgaaaggactgctgttggagtagttgaaatcacaatgggccctgactcttttcacatcaaagtgtaaaagaatctccaggggtgataaatgggggctgctggactcattacttgtaaacaaagctgagggatgacctctacatttttttttaattaaaggaaaacagggtttcctagtggtgagcatggggctgctcttcgtttgaattttgactgttcacactggaaaagatctttctttaaggttacaagggagctgccgctgttacccaggatttaccctgaatctca

SEQ ID NO: 33829 - DNA, 1033 bp, Homo sapiens
ccagtgggctctggatgatttttttttttttgtaaacaatgagaaaagataggtaggttggatgcatgaaacagaagactcaagaacaattcttaatcattggttttgtcactgggagatgctgaaagatgggaaagactgagagtggtacaagttcctttttgagtagtccaggtttgaaatgcctgtgaaaatcctggcaagtggagatgttaagtgggcaattggttctctaagtctagagttcattggggaaggtctgggcttaagacacaatttattcagtagaaaatgaatcacagttgtgcatgagatttcccaacagatgagagtgctcaggaacttgaactacgtagcaacttagtgggaactaagtagcagagaaggcttagtaaggaggttgagatggagctgataaagaagctgacaaaacccaggagagtgctctcttggccaagggaagagcaggtggggagaagaggttcagaacatcaaatgctgttaaactgtggattcagtcacctcttccgtgaaacctcctctcttaccctcaggcagtaatggtctcccatttctcaaagatacaaccttttattatggcatttaaattgtttttgtttttatcttccttacaagattctgtcattggacagctgattatgagctagcagacacagtagaaattcaatcaattaatacattaaataatttatagaagaatgattattggcctctgccaccaagaaatggttatgtcttcttagtgatttgcctgctttttgtctccctggatttaggatgtagttttgaaaataacattgacgttccttcatagacgttcgtacagttttcagtattcacaatggcagaagtatgatatttcgactgtgccctatttttatgctgggcaaggacctcaagaacaaaactcctgtgaccttacataggggtcttacactgaaggagtatgggaaatagcaactcttgtaaaaataagctggtcagtgggtggtaggtaagctgagggaaaaga

SEQ ID NO: 33830 - DNA, 1049 bp, Homo sapiens
taggaagaatcagtatcgtgaaaatggccatactgcccaaagtaatttatagattcaatgctgtccccatcaagctaccatcagctttcttcacagaattagaaaaaactactttaaatttcatatggaaccagaaaagagcctatataacgaagacaatcctaagcaaaaacaacaaagctggaggcatcatgctgacttcaaactatactacaaggctacggtaaccaaaacagcatgattctggtaccaaaacagatacatagaccaatggaacagatcagaggcctcaaaaataacaccacacatctccaaccatcttatctttgacaaacctgacaaaaacaagcaatggggaaaggattccctatttaataaatggtttgggaaaactggctagccatatgcagaatactgaaactggaccccttccttacaccttatacaaaaattaactcaagatggattaaagacttaaacataagacctaaaaccataaaaaccctagaagaaaatctaggcaataccattcaggacatagaattgggcaaagacttcatgactaaaacaacaaaagcaatggcaacaaaagccaaaattgacaaataggatgtaattaaactaaagagcttctgcacagcaaaagaaactaccatcagagtgaacaggcagtctgcagaatgggagaaaatttttgcaatctatccatctgacaaagggctaatatccagaatctacaaataaacaaatttacaagaaacaaacaacaccatccaaaggtgggtgaaggatatgaatagagacttctcaaaagaagacatttatgcggccaacaaacatgaaaagcagctcatcatcactggtcattagagaaatgcaaatcaaaaccacaatgagataccatctcacaccacttagaatgatgatcattaaaaagtcaggaaacaacatgctggagaggatgtggagaaataggaaagcttttacactgttggtgggagtgtaaattagttcaaccattgtggaagacagtgtggtgattcctcaag

SEQ ID NO: 33831 - DNA, 1022 bp, Homo sapiens
gatgaacagtatgcttgggagtcttctgctggaggttccttcactgtgcatgctgatcatggtgagcccattggcaggggtaccaaagtgatcctccatcttaaagaagatcagacagagtacttagaagagaggcgggtcaaagaagtagtgaagaagcattctcagttcataggctatcccatcaccctttatttggagaaggaacaagacaaggaaattagtgatgatgaggcagaagaagagaaaggtgagaaagaagaggaagataaagatgacgaagaaaagcccaagatcaaagatgtgggttcagatgaggaggatgacagcagtaaggataagaagaagaaaactaagaagatcaaagagaaatacattgactaggaagaactaaacaagaccaagcctatttggaccagaaaccatgatgacatcacccaagaggagtatggagaattctataagagcctcaccagtgactgggaagaccacttggcagtcaagcacttttctgtagaaggtcagttggaattcagggcattgctattcagtcctcgtcgggctccctttgacctttttgagaacaagaagaaaaagaacaacatcaaactgtatgtccgccgtgtgttcatcatggacagctgtgatgagttgataccagagtatctcaattttatccatggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagattataagaaattctatgaggcattttctaaaaatctcaagcttggaatccacgaagactccactaaccgccaccgcctgtctgagctgctgcgctgtcacacctcccagtctggagatgagatgacatctctgtcgtagtatgtttctcacatgaaggagacacagaagtccacctattacatcactggtgagagcaaagag

SEQ ID NO: 33832 - DNA, 1049 bp, Homo sapiens
gatagcactgtgctagctgctatgaataaactagaatagcatatcactgttttcctatggacaaaaacccagaaatgtaaaataaatagccatgaatgggttgagattccccctgccccctttggatactgatgacagaaatcttatatgcactatgtaagcagtgccctaggatcagaacagaaagtaacttgcaatttttaaaggtgggagaaatgactgaagtttggagtggtcaggagtttccctggaagtctcttgcctttgtgactttgtatagctccctcaaactacctgagcctgagctcctcatttataaaatggaagaattgaacctagcttccaaggtcctttctagcttcaccatgctctggtctgttgtttaatgacatgaatccaagatggacaacaaatggtcgattttgctccttctacagtaaatagatctatcttcttagcagaagtaaaatagtaaagaaagaagacatgtttgaggcctgttgaggcctgtttgctgtatgcattgtatctaatcaaggaattgagaatgtagccctaaatattaggaaggagttgaaagtttctgagcaggaacagaacatgctgaaaggaaattgtgtcagcagcatggtgtacaggagagcttggcagagagaaaggaggcaagaagacctgtgggaggcagccagtaaggaggtgaagagggcctggaccaaaggaagccaaggatgaccgaaagatttaaagatgaagcccagatttaaaagtatcctcaagtatttgtttattcttttcttagcaaattctttttagtacaaagataaaatatggcactctgagtcataaaattttctgaatttcagaagttgaatgtttttctgaatgtatcaacctgttaaagtcagttcctgtttgttattttaggcgtatattcttgggcttttttttttttttcctagagaaactatgaagtactagctgtgcaagtcagggtgggctaagctgctaaaacagatacctccctccccttcaataccctgaagaacaag

SEQ ID NO: 33833 - DNA, 1031 bp, Homo sapiens
tgaccaagaggaggaggggtgacgagggctggaactaaggcatatgagctgggatggaaagaagctagatagaaaggaaacaaaaaccatcagaactgtggaaccaactccatgggagggataagaagagggcctattctagggtgaaacccaaatttctggcatggtaccattaacccaaacagaaagaggagatttccagagaaagaaaagcaaattttgcgggaggtgagtgtgagctgtctagagaatatgcaggtagaactacatgttaactgtaacatatacttgtctgcacctcaggagatggctgattaagaattcaggattcaggccaggcacggtggcacacgcctttaatcccagctgcttaagagactggggcgggaggattgcttgagcctgggaatccgagatcagcctgggcaacatagcaagacactgtctctaaaaaaaaaaaaaaattcaagattctggagtcaatattacttaaggtagcaactgtctattctatagaaaatggacaaatatagataaaaagccacttccctttctaaaagtgtccctgcaattcaagtgaatactaggaaggattgtgttcattcttctaaacaagactcacatgtatcttagcacaaaaagaggattcttttatgatacaaatgcactgagaatttggtcaggctatcacaatgaactgatagttcagatggatttgagtctttataccactctggaatctggaccaactgggcctcctaaggccattttgcagatctgggcttgtttctgaagctacagacaggcctcttccaagcactctaagtgctccacaaataatatttctgtttcccagaacaaccccacaaaaaggtactcttactccatttttagatgaggaagtggaggctcatgatgtcaggtaagctttctcagctcccaagtggttaagccctcagtttaatgtcatttgactccagagccctatgttgcaccatgccttgataataggccatatgggtttcatgtat

SEQ ID NO: 33834 - DNA, 1026 bp, Homo sapiens
tgaactttttaatttgtgctttattttcccttttgccattcatgagatttcttaaataaaatgatatcttttcttttcttcattattattttaaaggtctctggggaacaagactcatggaggaaagcagcactaaccgagagaaataccttaaaagtgttttacgggaactggtcacatacctcctttttctcatagtcttgtgcatctgtaagtagaatatttccttgcactaatgggaaagttttgaaaagatttgacctatccaaatcataattaaaaggaagtgtgtatgcaccagaggggcaactgggaagttaccttcttacctttgtttttaattctaatatttttatttgggcatttgtttattgactatcttcctatggtagaatgcaagctttataagagaagggacgtgatttgttctctgctgtacccccatttcccaaaactgcagatggcaacagaaggctctgaaaaatatataagaaagaatttttctaattgtgactaaattgtgaccaaatgctaagtgactgtggacttgcgtttaacacaggacgggagaggcaaagagttcaattccaatttagaatttggtcaagttctcttctgcactctggtaaacattaattaaaaatcagcattatctgaccagccagttcatcgtcagtggtggtgattttcactatgagatacgcgtggcaacttgccagacaccaagaaaccaagttagaggatttttgtattagattccttaacaatgaatacagtatcaccattattacagtatcatcattattgtcatactattattatatcagttaacataaagtctgcataagaattgtttccagaaaaatgactttccaaatttaactttcaggaaatacaaataatgctactaatattgcttttattggcgtatacatgtaatatccccttcttttggatttggatatgttgtgtcattgcctcattttaattcattatttcttctcaatctttaataattgctggact

SEQ ID NO: 33835 - DNA, 1043 bp, Homo sapiens
ctggtaggagatgattggatcatggggatggtttcccctctgctgttctcatgatagtgagtgagttctcatgaaatctggttgtttggtaggtgtctgtcacttaccccttctttttctctctcctgctgccttgtgaagaaggtacttccttctcctttgccttccaccatgattataagtttcctgaggccttcccagccatttggaactgtaagtcaattaaacctctttcctttataaattaccgagtctcaggcagttttttatagaagtgtgaaaatggtctaatacagagacttggtaccaggagtggggtactgctataaaaaataacctgaagatatggaagcgactctggaactgggtaacaggcagcaattggaacagtttggagggctcagaagaagacaggaagatgtgggaaagtttggaatttcctagagacttgttgaatggctttgaccaatacactgatagtgatatggacaatgaagtccaggctgagatggtctcaggtggagatgaggaacttattgggaactggagtaaacgtcactcttacatgttttagcgaagagactggcagcatttttcccctgccctagagatctgtggaactttgaacttgagagacatgatttagagtatctggcagaagatatttctaagcaccaaagcattcgagaggtgacctggcttttcctgaaagcatacagttatatgtgctcacaaagagatggtttgaaattggaacttatgtttaaaggggaagcagagtgcaacaaaagtttagggagtttgcagcctgaccatgtggtagaaaagaaaaacccattttctggggagaaattcaagctggctggagaaatttgcataagtaacgaggagctgaatgtgagttgccaagacaatggggtaaatgtctccagggcgtttcagaaaatcttcagggcagaccctcacaacacaagcctggaggcctagaagggaaaaatggtgtgagccaggcccaggcccaggccccagctgttctgtgcagc

SEQ ID NO: 33836 - DNA, 1049 bp, Homo sapiens
tggcaggcattagttaacagccacttggaagcaaaaatagaacattagatccctgagttggaagagagaaggtagaaggtgttacttggactgcaattatctgcacttggaattgagcatttagtcaaaaacttatatgtattctatattctattctcatttctgctacagaattgtaaacaatattcttccttaatacagaaattcatagcccactaaaataagagcgttctcatttgttcatttctcaatcatttaataagtatttactaagccactatatccatatatatatatatatcatatatactgtataatacacactgtagtgttttttgtggattgtgtactatgaggtagtatgttagatactgccagtactggggtaaggaaaacagcctgattaggcccttacgaagattcctcagacttgtggggaaaacagacattatcaaatagaaatacttgcaaaccacagttatgtgttaaaaaggaaaaacaaagtaaaaaaaaagttggtgggggggaacctgatctcctggatacagtgcttcgagaaagtttgttgttggaaatgcaaaccattactactgtggaagggaaaggtcagaaaaatgaactcaccattactgaatagtaatagtagctatcaattaggtggcacttacctgcatcaggacctgtcctgagcactttacatagattgtctcactaaccagcccaacaaatatgtaagggagatactattatttttcccattttattaatgtaaaacaattaaataattctttaaaattagacttagaaaagtggagcaacaatcttagcagtgctaggactgaaatccaagtttgcttgactccaaagtctatctctcttccagaaactttttctttactatctgcctagtaggcctgctgtattcctatttgcaacagccttttaaactctttaaaaatgtgtcctgtaaatttcatatatgattatacaaaaaaacttggaataagcatacaattctacttatctgtgttaactgttgaaatttgaag

SEQ ID NO: 33837 - DNA, 1022 bp, Homo sapiens
atatatatagagagagagagagagagagagagagaaagagagagagagagagacagggagacagggtctcactccatcacccaggctggagtacagtggtgtaatcatggctctctacagcctgaacacctgggctcaaatgatcctcctgcctcaacctcccaagtagctaggactatgggcacatgctgccatgcctggctaatttttaaaaaaaaatttgtagagatggcatcttgttatgttgcccaggttggtctcaaactcccggcctcaagtgatccttccgcctcggcctcccaaagtgctggggtcacaggtatgagccaccgcacttagcctgaattttttatttattatacttttcaactccagaatttctatttggttctttttagcaatctctgtctctttattctgtatttgatgatatcctgtatttgatgagacaatgtcatcataacttccttttttttttaagagatagggtctctctctgtcacccaggctagagtgcagtggcatgatcctagctcactgcagcctcgaactcctgaactcaagcaatcctcccacctcagcctcctaagtacctgacactacaggcatgagccactgtacccagctaatttttattttttgtagagatggggtctaagttgcccaggctggtctcaaactcctgggctcaagtgatcctccctgctcaggctcccaaagtgctgggattacaggcatgaaccactggacccagcctcctttatttctttaaccatggtggggttttttattatttgtttgtttgttttaacctgtttgaatatatttataataggtaccttcaggtctttgtctgctaagtctgacatctgggccctctcaaagacagtttcagttgtctttttttttttcttcttgtgtatgggaacattttcctgtttttttgttttgttttttgttgttttgttttgttgttgttgttgttgttaaagattggacatgttagataatatattgtagga

SEQ ID NO: 33838 - DNA, 1046 bp, Homo sapiens
taatttcctcacgcttcattccaaataaagtccattcacttgagaagagttctatattcctatgacctgtgtctccccatgagcaaaactgctactgctttacagagccagggacagtggcccacctctctgtggcatcctgctttatgaacaagtcactgggctcagatggcagtctctgattttctcaccttgcttcttctggcatggaaactccaccctacaagtgggaactgagtggaagaagagagccccattccccttagccactcttaacaggattagaacctctgcaacatgcatttaagaatgggaacaggctgggcacagtggctcacgcctgtaatcctagcactttgggaggtcaaggcaggaggattgcttgagccaggagttcaggaccagcctgtgcaacatggtgagaccctcatctctacaagaaatagaaaaattaactggtgggttgtgtatacctgtaatcccagctactcgggagcctgaagtgggaggattgcttgaacctggaggcagaggttgcagtgagtcaagattacaccattgcacgccagcctgggcaacagagtgagactctgtctcaaaaaaaaaaaaaaaaaaagagtaggaacattgaggctgggcatggtggctcatgcctgtaatcctagcactatgggaggccaaggcaggagtatcacttgacgctaggagttcaagaccaacctgggtaacatagcgagactttgtctctattaaaaaaaaaaaaaaaaaaggtgtaaaaaacttttgtaacaagagtgggaaagccgggcacagtggctcacacctgtaatcccagcactttggaaggccaaggcaggcaggcggatcacctgaggtcaggagtttgagaccagcctggccaacgtggtgaaaccccatctctactaaaaaatagaaaaattatctgggcatggtggtgcacacctgtagtcccagctactcgggaggctgaggcaggagaatcacttgaacctacgaggcagaagttgcagtaagccaagatcacg

SEQ ID NO: 33839 - DNA, 1032 bp, Homo sapiens
ccaaagctcctcccaccaaatgctaccacccaagagggcagggcctatttaccacccatgccaggtgatttactgtataatttactactgaacgtgtgtgtgttcctgatcattcttgtttcttccttccctgaaggatactagttccacacgtgctcccgggaaaaccctgccagaaataagccgaattagccagtccatggcagaaaaatggatagcagtgaaaagaagaagtactgaacatgaaatggctaaaaggtggctctgtctgataaattataagccacttttatctggttctggggctttggtcattttatcctaagatagaggttttggttttgttgtgaaggtatttgcattttgaccatgattctcttctacagcctcttagtgtgactaggtcatcagtgtactcatttacagatatatggaggacatgtgatatcccaggtgacttactaggtgagggagttgcaggagtgaatcaaaaaagctcacaaagcctttaataaggtggactgttttcatatcttcatagtttacccctttggagttttatgagttttggtcttcacagggataggttttatttaaacctacgtgacttgaacaaatcaactataaagggttttggtgagatttagaaataatatgaacaaagtatacccaggatttgggagactcttaagagagtagttattttcattaataattattccacgtcatcatttacttattcagacataataagattttcaaaaggcatgctttattatatgttgtgacttaccccttgttattacttttacagtgaaattagaatgatattttcatctcctgcttgtctgactgcaagttttttaaagaaaaggtaatacttacataagatttaccttcatttaaaacactggaaaatatttaaaatgaaatgtttcaagtaagtttaatttgtgaattttgttattcttgcccacaaagtccaacacagagaactctgtaggttgttatagaattctttcattttatgaa

SEQ ID NO: 33840 - DNA, 1035 bp, Homo sapiens
aataggaaaatcagtgtggtaaaggtctttgagaaattaagtgggaactcaactgagtcttccaggatggaaagtgaagggactcagagatggtttccaagaggtggtgactcaaactgatgttgaaaaatgagcagagggcaaggggaggtgcttgtttcaacaaagggaacaccatttgccaaagtatgacatcatggtcttgagtggcctttgggttccaaagtcttttcaggtacatgttgatttcttggtttccagatgattttcatcctctaagagatgtttagtttcactctcactgggtaacatagttttggcaatttactgtattgctaaacactctcatcattgtggataattaagaattgaccatatgtgcttttatttaataggtggcacacacttgcctatgtttctgatttgggaaaggtcttttcctttggttctggaaaagatggacaactgggaaatggtggaacacgtgaccagctgatgccgcttccagtgaaagtatcatcaagtgaagaactcaaacttggtaaattctataggaacatagggtttggcatagtatctttttagagaaaatgatttttctaactaggtaatgtggcaaagaaagcaacatatgactatgaagggagtttctctaaatactggtttcattttttactggtaaacaattcaagagtcagtctaatttactgaggcaaaataattattctatattactccttcagattaggattaatgtgaatttaaatgataaaatagacaatggattcagaggcatatgcagctctcattccagtttgcaagagacttactaattcttgtaattagttgtttactaattcttgtaattggctggttgccctggttaagttgatccacagtcatataaaaccctcagaataatgagcaatcaacgtatacctggcactgaactgtgctcagcacttacttgtgttatctcaccaatccttgtaacagttcctgggaggtgtattctgtcactcctcttttactgga

SEQ ID NO: 33841 - DNA, 1031 bp, Homo sapiens
gccacctccacctcctgggttcaagcgattctcctgcctcagcctcctgagtagctgggattacaggtgcccgccaccatacctggctaacttttgtacttttagtagagacagggttttgccatgttggccaggctggtctcaaactcctgacctcaggtgatcaacccacttggcctctcaaaatgctgggattacaggtgtgagccaccgtgcctggcctcagtaagtattttttggataaatgaatgattatattgtgaaacaaaaactttctaattaaggagtatagaatcttttttgtttgttttacaaataaaatcaagcccaaactctattttatagaattattttcctttaatttttccttcctatgtctggtatgtggaattcatttctagacaggatcacacagtttttgctgtcaggcatttgcttgatggcctgtagtgatctgcatgtcttacatatgtgaagctgaggagaaagaaaggtcacccctagaaattctgcctgcattactgcagcaggtttgtctgatttgtgaaattggttggaattatgccagtggtgctagggacacaaatatgttgaatattgacatcctacagtgtgttaattcccttacctaaatatgtataaagtttcttttataaccctaaaactgtaagtattctgaaattagaagcaatgtgactatatctgcagtagatagttgtacttgcatggccatgacagcctgtgcactcaagtttggacccatcctccactgtgacacatttttgttttataataacagttattgagatacaatttgcataccacatgatttacccatttaacatgtacaattcaatggtttttagtatattcacggagttgtataatcatcaccacaatcaattttagaacattttcatctcttcaaaaagaaaccacccatacacattagcagtcacttacctttccccttcagccctggacaaccattaatctactttctgtttctatagatttgcttattttgaaca

SEQ ID NO: 33842 - DNA, 1032 bp, Homo sapiens
gcctatagaacattcaccaagatagaccatattttgagtcataatacaaacatgaacaaattttaaaggattgcaataattaaaagtatgttctctcactatactggaattcaactagaaattaataggagaaaaataacaagaaagtcttcaaactcttagattaaaattaagcagcagccttataaataatcaatgagtcaaagaggaagtctcaagggaaatctaaaaatattttgaactgaacgaaaatgaaaatatggtttatcaaaatttgtgggatatagcttaaagcagtgcttagagagaactttgtggcattaaaagcttatttagaaagaaaagtattcaatcaataatttaagccttcacttatgaaatgagaaaaatattaagagcataataaatggaagataagtacaaggaaagaaatagtgatgaaagtagaaattagtgttattgaagatagaagaacaatagagaaaatcaatggaaccaaaagctagctctttgaaaagatcaataaaatgataaacctttagcaagagagtcaaagagaacaaaagaaaacataagttcccagtatcagtgaaacagaggatatcattaccctgcaggccctgcagacattaaaagctttgtaatggaatctgacaacagttctctctatatacatttaacagcttggatcaaatggacaattcttccaaaaccacaaactgtcaaaactcaaccaagatgcaatagataatctaaataggttatctataactataaagaatggaattcatggtttaaagccttaaaaagaagttccccttggccgggcacggtgctcatgcctgtaatcccagcactttgggaggctgaggtgggcaggacacttgagaccaggagttcaagaccaggctggccaacatattgtatttttagtgaaactccatctctactaaaaataaaaaaaattaacttgggcatgctggtgcatgcctgtaatctctgctactcgggaggctgaggaaggagaattac

SEQ ID NO: 33843 - DNA, 1027 bp, Homo sapiens
tggcctctcctcctctgcctaattatcgtcccctttaaagaacagcatattcttcttcctcttcttttttgcccttgttagatttttgtctctttaatcaaaagttgtgttaaataagaggaccatggaggtaagagtgatttgattcagttcttgatttaggacaggtaatgtcttagattcatttcttccaaaaattaatttaattttgtggggagaggaagagtggcagtaagaaaaaagaagtgctagatgttatgttgtgtgtaatactagggaaaatgtttataacattaatggcaaaaatatttcatttgttgatgaccaaaacacaattaaggtttttaacggcatttcatttttaaaaatgaagtaatctgttctacagtaatagcttaatattcattattcatgttcaaattatggatgacttccaagactttgatttgtatatagttttctattataagttaattgaaataaattcactaatttatacctttgtattgtggaaagtaacatagctttgatgtcaaacaagccttggattccaatactggctcttttacttgtaaggtgaatgaccttgggcaggttaacttttctaagcctcagtttcctaacttaaaaattacttactatgtaccttacagggttatggggaggatagaaggagacaagtaggtaaaatacagtatgtgcttgcactgtatggactccctcttccccacctcaagggtacaatttctctattatctgtctttgttcttctgacctgcttcttttctacaactgattgtgacaagagtaatggtgatggggaattgttgaagcaattctctgcctcagcctcccgagtagctgggattacaggcatgtgccacaacgcccggctgattttttttgtatttttagtagagatggggtttcatcatattggccaggctggtctcgaactcctgacctcaggtgataagcccaccttggcctcccaaagtgctgagattacaggcgtgaaccactgtgc

SEQ ID NO: 33844 - DNA, 1048 bp, Homo sapiens
gtcaagtacctgtggatgatcaacatatagctcttgtaacattcatcccactatgcattatgaataactgtttcactgcgactgccttggatataaattattgaggtgtttatgaatgtggactcaaatttactcaatgcacacagtaaacagctgagtaaactcctgtttaagcagtgagggaaaaatgtgaaaaagtagtggaatatagttaaaacatatctagtcatcatttcagtcattaataacaactggattctagattacctggactatttaaagtgtttcaagaatacagtataataatcaaataggaatttttgctttcacaattacatgcagcgaatttcagatattcagactatgtagtattttatgcattatgggaaaatttttatgtaaattattttattctaatgcttaggttcctctttgtgagttcaaatgccccatttattcattttgataattgtttactttttgtattatccactattaatctgttattatgtaatattctgaaaaccaaccaaagagatcagctcatctaaattaattactgctgagtattatttctacaaaattttacgaccattattttcgtttcaataagcaatctattttctggctacctatagtttaattttgattataaaagcatgatggcccgtaaacttccaggtatcaagtattatgataaaaagtcaaagaatctatttctctttgctttatagatgacatttgaaatgctaattctatttttatgttactttctacctttaaaatattctaatctcataggccccaattagattttaaataaaaatctcagagaaatagggtaccttttcaatttaacaaacaaaatacatcattttttatgcataaggtaactccatgtaagtgattgtggaatgccacataatcaaaataactcataaataattaaagagtcacattataaaattaggaagtgtaaaagaaacaataagtgtactcctgcctgctttttgtgtcatatgttgctgcctttaaaatacaatttcat

SEQ ID NO: 33845 - DNA, 1050 bp, Homo sapiens
taaatagcccaagttcaaagagttagaaagtagtagagcagaaggggccaatccatgcagtagggctctcaaccacctcaccctatatacatggaggctaaccaaagttttgttcatgaacatttgctattttattgttgctgttttcaggcaaagccatttcattgccctttgaagaacaatgggagtctaatattgatgaaattgtccatttctatgcttgacttttatattggaggtagtgccattaatccagcatcaactgggaaattactcaaatcaggtggactagtctgagatttctctaagacaatctcaacattcagttatacttaaaaaatgtgttaatctttgagaaagggaaagcaagtaattgaaattaaaaataaacttacgaatatctttggcctctatatgacaattttggaaaaactgtatataataatctaaaccatgatacttctttaggtagtgtttgaaaatcagaaacagacttgttcttagctgaaaattttattattataaacttagtgctcttgaactttgcttaagatatttaatgatgcaggaaaaatagaaacattcagtaaagaaaaaaagagcaatatatttttcatattcaagttaagtctgcattgtatgtaaaagcaatcatttaatgttttttggagtaaaataataagaaacttttattgacaggtcaatgccataaggaagttggaaatcaccagtgtttatgttgacttcatgagctataaagttgacccttgaacaaaatgggctaactgcatgggtccatttaaatgtggatttttgcaataagtagggttggccctccatataggggataaccacatcctcaaccaaacatggattgaatatattcgtgcaatgaaaaacccacataatagcaagggctgatttttcctatctgctaattctacaggaccaactgaagtaacttgaatatgtgcagattctggtatctgcggggagtcctggaaccaaaccctgtgggtaccaagtgtattcagttttccaaatgagtaa

SEQ ID NO: 33846 - DNA, 1048 bp, Homo sapiens
ataaatgtcttcttttgagaagtgtctgttcatatccttcacccactttttgatgggtttatttttttcttgtaaatttgtttgagttcattgtagattctggatattagccgtttgtcagatgagtaggttgcgaaaattttctcccattttgtaggttgcctattcactctgatggtagtttcttttgctgtgcagaagctctttaattagatcccatttgtcaattttggcttttgttgccattgcttttggtgttttagacatgaagtccttgcccatgcctctgtcctgaatggtactgcctaggttttcttctagggtttttaaggttttaggtctaacgtttaagtctttaatccaccttgacttaatttttgtataaggtgtaaggaagggatccagtttcagctttctacatatggctagccagttttcctagcaccatttattaaatagggaatcctttccccattgcttgtttttctcaggtttgtcaaagatcagatagttttagatatgcggcgtagatttctgagggctctgttctgttccattgatctatatctctgttttggtaccagtaccatgctgttttggttactgtagccttgtagtatagtttgaagtcaggtagcgtgacgcctccagctttgttcttttggcttaggattgacgtggcgatgcgggctcttttttggttccatatgaacttttaagtagtttttttgaattctgtgaagaaagtcattggtagcttgatggggatggcattgaatctataaattaccttgggcagtatggccatgttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtac

SEQ ID NO: 33847 - DNA, 1025 bp, Homo sapiens
gctatcagtgctgctctcccacagtgcacacacacatgcatgcacacacacactcgtgcaagaatgcatgtgatagtggaacaaataatgaacaatgaactatgttataataactctgaaaaggtactcactcagctatagtctgacttgagctttttctctgactagattttttacctcaaaggcagttgtacagacaacactagtaatcattgtaaattaaattctttctattgtcacaatctggcagtgttaaggacaatttcagttcactgcagaaaatatatttgaaggatattttcccaaatatttgagtgaacttcctttttagagtaattatttgttaatttgagaagtttcatttagattttatctatacaataagttgtcagctaaaggtggacaaataaataaataataccataaaattttagatgtatgttgcttgtgcccccctctacaaagagaaaacagtattatgagaaatatcataaagcatatcaaaatggaaatatctccccagtgactgctgtgtgcttgaagtatctagcactagtctagaaatagcacctaggggaggagattctgttaaattgtgaatatatgtcttgaaacctgtaagacattttgccatggctcgaaagtgacaagtttgtgcctagtttattattacattagttgattgtcatgttacagagtagacaacacaatactgaggtaaaaagaaatagacaagaaggctctcatttgaagcaaaacacagtactggccaatcccatagcatcttgatctgtcagcagcccctgttgggagttggcagaaagatttgcaccaaagagtaagtttctaagtgacaccaaaatgttcggtggggatggctgaagatctgactgacttcttaaaatttttctttagagagttgtacctaggtgtccattaaaaaatattgctggagcatggagggtagggaagctgatagtagaacctcagacaaatgatattttgaagagacagtgcaacagact

SEQ ID NO: 33848 - DNA, 1125 bp, Homo sapiens
ctcttcaaagagaagtgacctgagtgaataagaattaggataggagactattactatgggaatagaaaaaaatctgatgaacctgattaagcattggtaactaatggcaagagaagtttgctacacacaataaagaggacttgaggggtgtagatatgaaaaaatgtagtttctttatatttttgcctagggctagcccaggggctttagaaatggatggctatactgtggctgacagcagggttgcaaaaattaaggtcatttttatgtacaggtctgtattttttaaactctttgactgcgttttcatgtaaaacttaagtcctttagctgccatgttgtcacgagaaggaaggaagtatgtatttagaaggtactcatagaagcccgtcagaccaaggatctgtgaaatatggttttgtcaagaaaggcacctctgagtctattacaagtacaatacaatgtggtctgtaatgaatccccaaccctagagagttctaaatatagaatagatagtcaggtctttggatggtttaagcattaaactgcctaaaggaaaggatctcctcagatgacctctcagtgccccttgcagctctgtaattccaagtctgagacagttggcttatgacgtgcactgagcatatggatgtgcgcaagtatgtttagtgtatatatgtatatatagatgtgtgtatgtatgtatatatatagatgtgtgtatatatgtatgtatatatacatatatataccatagagacgttgtgtttaatattcgtaatgttccttttttcttatcctgttatatcctgcagaatttgtgttttttctacctttctctgtgtatttgccttatatacaaaaacatatacctatttacttttgcagttgaatagccaacacatggagctcttaaacgtttagtttcttcattaagcattcttacaattttatccctgatattttcttaacagaaaagctatgtgtgtctgtttaactttaaatattgtggtaagaggtgaaaggcatattttcaatatagtatgagttttgttgtttactaggagaaagaagtgtaaagcatatagtttagtttggagacccaggatatttacagataccagt

SEQ ID NO: 33849 - DNA, 1047 bp, Homo sapiens
gctgttagcctaattaggctgttagcctaattagtagcacccagttccctaaaacctgaagtcatgatggcatattgtgttatctccttcccagagtacatgtctctggaccatcccacacctgaaatattttctcaaagtaagcagaatcttcctgcctcatatttaattctttctgagactgccctctaaattctactgaggattatgtaattaataatggcttactacattatttttcctagagagcaaaattaatattttaacccagaataataaatgggcacacaaatatcttgatacctgcaagagatatttttccttatttagaggattttttcagctaaaaaaaaatttctaaaaaactttttagaaaatcatacaaaaaaacccagcaaagccctctttgcttatgaacaatggccattctagagctttcagcacttaactgctatgaagttatggtaattccttaggaaacagataagattacggctgttaggattttcagtagcctaaaaaatagatgagtgtattaataaacataatttgacttggcaagggtttttgtttaacatattaccaagagaccttataaagattacctactagtttactatatacataataatatacataatgtatatattatgtgcataatagattgcctactaatctaccttagcatccttaaaaacagtcaacttttgttttttatagattgtcagtacttatatagctcctatgtactatgtataatgatgctttttataaatgtagagatgaataggaaatacttcctgtcttcaagactttcagtatgtgggtgaaatcagcagcattttttatttaacatttatggtatcatatatgcagatatcccaaagagacactccagaaagctttcaaaatagagtccataatgtcttccaaaccttgtccaggaatatgagaagaagagtagacaaaaatccctcaataagccaattcttagagtgcatgcttcacatgcaaatagaattgcagaaacagctttggctgttcctt

SEQ ID NO: 33850 - DNA, 1118 bp, Homo sapiens
attttgcatgaatattacgtaaacttttttgggttctatatatcttgtagacacttgctcttaaagaacatgctgtagtgataggaaaagaaggtagcaaagatattataaaattagcacaagatgttatataattgagtaaaatgcataatgtaggccaagaccattctgtaaaaatatgtgagtcacatgtgtgattttgttatctcatagccatagttttaaaaagttgaacaggtgaaattaattttattaataaatgtattaaatttaatatatctaaaatattataatttaacataatataaaattattgagacatttataatttttatactaaatctttgaaatcctgtgtgtatttacacttacggaacatcttaatttggacaagatgcatttaaaagcaccaatagccatgtgtggctataggctactgtattgaacagttcaggataaggttagaattacagatgttcagagaaagagaagaggtgtatagtatatgcaacacttgttctgggtcatgaaagttgtgtagaatttgtgtagatggagggcaggagtttataatagtaaggaggaatgccagatttgaaacactgtttactgaagattatcatagtagttccagctgttgaacaggttaccagtttatcatatacttcaggttactattaaggaaagttgatacataatttaaggagtgtatagtacccaattagttattcttaatattttttcccaaggacattggacaaaaccataaggttacacagtatttccaaagaggtattaattaagtataatagtaatctttcaagatattatgaaagtctaattctttggtttaaatgtttcaaaaactaactctttttggtgattcataatgaaccctgacatactacattttcttggattcttggatgtactgtaagtaaaactttttttttttttttgagactgagtgtcgctctgtcacccaagctgctggagtgcagtggtgctatcttggctcactgcaacctctgcctcccaggttcaagcgattcttgtgcctcagcctcctgaatagctgggattacaggcacccgtcaccatgcctggctaactttggt

SEQ ID NO: 33851 - DNA, 1046 bp, Homo sapiens
aaggtaaaatttctggttaaataatgatacatgtttatatagatgtgaattaaggcttctagtacaagaattgtgtgtggagtgcttatgcacagttttgacattttaacttattattcaaatatacaggtatttcttatgatgcattgtctgataaagctctggcttttttgacactaaatccttgatcaggaaggccataccaattatgacattgttccagtggaagcacaatttattttaggattatcagccttatagaatggtttctaggattatatgagtacgatagttataaactggccatacaatgaggacaagaaatagtcaaatatttgtggtattcattaagcccattaaaatataatatcttggtcaaatatgggtaagcgaagatttttaaaatccgctgctattttatctagtccagctcacttcgtttcttataagcttatagattcagagttgcctttagaagcaggattgaataaaaatattccattcatttttgtctttctgaactttgagatgagtcattttcatttagaagctgtcacaatttgtatgtttgttgggcaaaattagtaatagtttattcatacacttaactcacttcttaaatgatttaaagatcggtttgagtaatacttagcacctacattgttacctctgtgataacataatttaataattattacaggtacataataggtggatatatttatggggtacatgtgatattttgatacaggaatgcaatttatattaatactaatcacatcaaggtaattgggttatctatcacctcaagcatttatcatttgtttgtgttagggacattccaattccaggtttttgttattttaaaatatacaataaataattttttcactatagttaccctattgtgctataaagtactagatcttattcattctacataactatatttttgcatacattaatgtccccccaaccctccaactctttccagctcctgttacccatcattctattctgtatttctgtgacttcaaatgttttaa

SEQ ID NO: 33852 - DNA, 1050 bp, Homo sapiens
tttgtttgttctattttctgtgaaacagaaagcaaggtcatcagctgagagtgaggatgagataagaggtactggaggtttgagaagagagaaaaaatgaatacccagtggtccaggacaaggtcggcaaactgggcaacatacatatttttccgtagatatgtggtcacagatcattttttaaagttcactttcaaaatcctcttcttcatgatgtcatctctaaaactgatctgcctgagaatggagatgcaatataggcttttctttcccacctctcctttcactgtctctactccataccccactccttttctgggttctactatggtgccttgtctctggttggtaaaatttcttgaattccaagcaaaaaaaaaaaagaaaaaaacagtatcaggaacaaatccttttgaaaatcaaatggtttataaattctttgattttatcaatactgaggaagggcttaatcaatataacatgtgttagataactaggtattacatttgatgatttattgttatgtgatttttggcattcttagtagttcaacagactgacagacatgcctataacaagactccttccattctcttctactttcttattcttatgtctgtaagatggataatgaggatagaaatgacatgaacctatgttaattttagcaataattcaaatgtgaatcagaaaaataactgaaaatatgtttgtatcttacactgtgatatattccaataaaatgatacctttgtacttgataattactaatccaatcacatttagaataattactgatctaatcatatttagaatatgtttatctattttgattaactgtaaactgctaataattgcaataagtcattatagtaggaaacaatacttaaagcttaatggtcacaaaaataatttgtgtaagtaaaacatgtcttcttctggacaaataacacatttatttatcagaaattaaatcatttataattattgaatttatggtaaaattcattgatttcatattaacaaatgttgaagttatagaatttttta

SEQ ID NO: 33853 - DNA, 1060 bp, Homo sapiens
aaaaggcactcagtaaatatcttcaaattataaataataataataatttaaataaaatagaatatcataatgacattttggtgttttttttgtgttatattaaccaaatcatttccagcaaacgacagctacataaataaaactttaatataataatttctccctccaaacatcacaaacttttaatgtctgatgaatgtttttctcccttatcatgcaggaatctacagggaggagccgaaagtatttaatagagacttgtgagaaatttgctcatttagaatttcaagttcttgttttttactattttctctcaaattgttatctactgcctttaagtttttgtctctttatacaccactccctggttcatcactttctccttattccttttgcttttgttcactcgctttttaaatttcatccacgattcaatttagtcatcagttgtcagtgatgtcctcgatgacttagttaattttatgttgctataacaaaattctgcagactgagtaatttataatgaatggaaatttatttgacttaaatttctgaaggctgtgaagtccaagagcatgtcacagggacctggtaggggctttgattctgtgtcattccatagtggaaggtggaaaggcataagagtgtgagggcgagagtaagagatagaaaggaagggaggctaaactcatgcttcatgaggatgcttctcttgagatgacaaacccagtcccttcctcaaaatggggacagaaccctcctgacctcatcacttcttaaaggtcccacttctcacactgttgcattggggattaaatttccaacacaggaacttgagagtacacatttaaaccatagcaccagtcatgctgttagcatgtggaattacatcactgtaataaatacctgaaccaaactttaaatgtaccgtcaatgttacacaagcctctatgtatcatcatttttctctcttttgctttatagaataaaacaaatatttactttcctcaaatttttttttctatttctggttttactcttaattctattcttgtgtgtt

SEQ ID NO: 33854 - DNA, 1025 bp, Homo sapiens
ttcttatgtactgcagtgtgtatcagtaggctatttattctaattgtggagtagtattctattgtatagataacacacactgtatccattgacctgctaatggatatttggattgtttacagtttgaggttactgaaaataaggcttctatgaacatgagtgtaaatagggacgtaggtatttatttctcttgagtaaatacttaggactgaaatgatatggtcaggacaggtttaaatatttaggagacttccaaactgttttcaaacaggttgtagtatttcacatttctaccaggagcatatgagatttcctacccaaaacttggtacagtcagactttttagttttagccttttagatttgtgtgtagtcatttttctttgtggttttaatttgcatttccctattgttgagcatctttttctgagcttatttgctatctgtatatcttctttaatgaagtatcttttcatatctttttcctatttgaaaaatatgtgttaattgagattttagaactctctctatattttggatacatgtcaattattagatatatgctgtgaaagattttcttccagactctggctaatcattttattctctgaatggtgtcttgaaattaagtagcactagtccttcaaatctatgattttttttcaaagacatctagctactttatgtcctttaaattttttttaaattttagaatcaattgatcaatgtctctcaaaaatcctgctaggattttgattgaaatacatgtaattatagatgaatttgagaaaaatttttatcttggcaatatttagtcttagtgtccatgaacataatatatctgtttaggtctttatataagcaatattttttagttttctttcatatttctgtcagatttctatgtattttgtatttttgattttattgttagtgatattattttatttcaaatctatttttttcattgctaatgtattgaatacaatggagttttgaatattgatcttgtacaaactcgttaaa

SEQ ID NO: 33855 - DNA, 1035 bp, Homo sapiens
tactgctttttaaacctaaggctgttttgaaccaaaagccaattttctaatactggaaggctcatttgctccacattattgagaaacatatctattttatttaagtactttagaaatatccttgctagggctgtgtcaaatttaaataccaccggaaagataattgaaaacgctaaataatcttgaattgtttcttctgaatatttctctttacttggttaacatccaagactatgtatcttactgacaaattgtttaatatctgtcaaagttatatttcttttttctagaaaccctcagaagaggaaacaatttttttttggtaatgaattgtggtaaaagagcagtaaatattgccatggatacatataattctctggaccacaggccaaaaaactgctggcgttgattttggggaaaaaaatcagcagataacatctaaatctctgtgcatatagcaaaaataggaattttgggggaaaaataatcatactatatagtaatttgtgtttggatttgagaatattataatagtagagaatgaaagtgataccaggatgcctgaagtgtgtgtatgtgtgtgtgcaggaacatacatgagtgcaagtacacaagtgcctatatgttcattgggtttgagtgtgtgtatttgtatacactggggtttaggaggtagagttggaagggatcttaaaaatagacctaaaaaacaaacaccttaaatgcatagatgacatctattgcttcctctctgtcaggttaaatttgacctcattgaaatttctacccaaccttgcaaaaaaataccaggatgcataaaccaggaagtatgtctgcattcaaacattgcttctgagccatttcttggtatccttattgtcaggtctatcctgcttttcttcactatgttaactgaacttactatttctgtctacttttaggctctgactttgacctttcctgtgtgtgaatttaatttctccctcttagcagtaaagcaatgcatagattacttttaatgacccaccctttcct

SEQ ID NO: 33856 - DNA, 1052 bp, Homo sapiens
atactgcatctctgaaattcattcatattatgcaaatagtgtgataaacatttttattcctctattcctgcctttctcaaactccaaattataacttacctacagaatcccctgtattgaggttggtttttaactgtgcttttaatttattctgtagtttttaaaactgctttagtatttacaatagttggcagtcatgaaggtagtaaattatgacctttattcgttatcataagaaccccagtttgaacagagattgcacatgactttattgtccttctgtgcttcaggagtgtgcagttgcttttctgaaactccaagggagaatttgtgagtgtatttatatatatgctactagaaaagtaattgaagaatagaatagaagaagcaatgtaaaggcttcttagaaaacattaaactagtagagattattcagcctgaagaatagaaggctgaagcgcaatatgcagcgaaatgtttaactatagtgtgagatgatttatgttaactataaaggagaacctccctgggctgaatgatagttattagaccatggtacagattagagaaagagtttatggaataactccaaaatttcctaaaatatcagagtgtcctacttaaatcgtatgctattggtcttactgaaaactataaaaatgcagagattttatacactgtttttgttctttaaaaaaacccagtgtttagtaacatgaaattaaagaaataatggaacacaattccacaagtatcagaaaatgtgctaccttgttgagtaaattgaaaaaggcaggcattacttccattctgcttaagaaaaaaaaaaaatttattttaggtctgctgtgtgatagttgacaagcagtaaggactggcttgtttgtcctataccactctttgtttctttctttcttttttttttttttttgagacttagtctcactctttcacccaggctggagtgcagcagcacagtcttggctcattgcaacctccgcctcccaggttcacgtgattctcctgcctcagcctcccaagtagctgggact

SEQ ID NO: 33857 - DNA, 1077 bp, Homo sapiens
gaagtagatttcctcccaaggaaacactttttctgctcatctgtaagaagcaactcctcatctattcaagttttatcatgatattacagaaattcagtcacatctaattctggttcttttgttatatttccatcacatctgctgttacttcctctcctgaagtctttgaagtcttgaacctttcaaagtcatttatgagggttggaatccaaactcctgttaatgttgatattttgacttcctcccatgaattaagaatgttcttagtggcatctaaaatgctgaatcctttccagaaggtttttaatttattttgcctagattcatcagaggaatcactatctatgagagctatggccttaggaaatgtatttttaaaataataactcttgaaaatcaaaattccttcttgatccatgggctgcagaagatatgttgtattagaagacataaaaacaacattaatctgcttgtccatctccatcagagagtcttagataactagatgcattgttcaacacgtagtaatattttgaaaggaatcttattttctaaggagtaggtctcaacagtgggcttaaagaatattcagtgagccatgtcattaaacagatatgttgttatccatgctttgttgtttcattaattgagcatgggcagagtagatttagcataattcttaaggaccctagaactttaagaagggtaaatgagcattggcttcaacttaaaatcctcagctgtgttagcctccaagagagtcagcctgtccttggaagctttgaagccagcccttgacttctcctccagaaaatctgttatttagcatagccacctttatcaattatcttagctagatcttctggataacttgctgcagcatcttcatcaacacttactgcttcacctttcacttttatgttatggcttctttccttaaacatcatgaatcaacctttgctagcttccagtttttcttctgcagtttcctcacttcttttagccttcatagaattgaagagattaagggccttgttgtggattaggccttggtttaagggaatgttatggctggtt

SEQ ID NO: 33858 - DNA, 1071 bp, Homo sapiens
aatttattgccatattatttaatcctatgtttttcttttagaagaggacggttaaaaataagcttttcaggcatccattataatagatacatcattgagttgaacactttttcctcccgtaatgtaaatatgaactcaagaaagccaggcctcattaaaaaaaatgtttaaaaacatgtatcccttttcgtgttattcaacctactgtgttctcactcaaagcaaatattgaaaattatattcttacttgagtgtaagtaagcatgtaaacaatcatgtttctccaaccttttcaaatgtaatttactttattaactgtaaggcaagttctcggctcatttgttaacaattgaatagcaaaacatgggactgaataaaggcacttgtagaaatgatgatttttgaaaaaaattgaaggcagttgaaaaactgaaagtgtatcattatgtgtaatcaggttactatgcataataaaaagggtgagctaaaaataaaagactaagaaatacatatggctaactagcactttatcagaaatctagagaggagtaattttgatactttcagaattcaaattgaataaaatggtatgcccttgatactttaataacagaataattcctgcatgataagagaaacattctttgtgcatgaaaatcatatcatgaatttatcttaaaagtaattccccacttgctctacattctattataatttatggtattatttcatgctagtcattttagaatagaatattacagctccatggatgatttacatagaaatggacagctgtaagtactttcaaatcctctttctttttcatatttaggaaacattacgaacagaaaagtaatagattaggtatacttaaacattattaaagtgtcaggctactttccttcttttttcaggagaattaattgcatatattccagaaaaggcttatctcagcagtaattactctcctagtcagctctgtaagacagatgtagagtgtgaatgtgacagtatcctatgatacataatggggactgcctccagtttcttacacactccagtaccctgatg

SEQ ID NO: 33859 - DNA, 1070 bp, Homo sapiens
agtaaataggaaagtagtgggaatgtagatgcaaaaatgggtacagaaatgattagtccagggatgaagcaacatctggattatacaggaaactggtctaatttagtcagcactggagtcagaaagggaaggaggaggaaatttgggaatgttcaatagggcatgggtttggatgtgcagaaaagagactgtagtaattgacctgacatgtctgatcattgaagagaaccatcagaaaatgaagcaggaaatagtaagaaatgggcttaatgttaggaaaaatagctccttcaggaaagagatgtataagaaggatgcagttcactggtaaggtataggcagggattctcagggaactaatgcaaagggagtgggtcattcaaagaaccctcatggttagagtaaccgtattctggtttgtccaagacaatgccagttcacaaagtcattcttgcattattaatggttccctttctcccaaaaatttacagtttttatcatgtttgtagtcaatactcaaaaaacatgtgtgaggaggcttttgcttgttagaactatgaaattgcttttaggttggcagagcacatgaaagccatttctagacttagtttgaaggggatgacatctcttgaaaagagtcagcacaggttaataaataacccttaagagctgcactggatggtttaaggcccaacttttcaccacggattatttgcatgaccttgggtaagttacaagttacataacctctcatttcttcagttttctcatctgcagtgcaaaggtaataatagtatctacttcatgtaatgtggtaaggcttaaatgagtcagtgaaaaaaaaaagtgtgtgtaacattgtggctatttactgctaaactggttccattctgcatccagtaaatgtaattcctacggattttcaggtggctctttgatctgctgcattaaaatgtggttacaggagaaactggtaataaactaagagttaggcctcaaatagtttaaagcacttttcaaatgcaaaatattcttaacctgcattaatttatgagttgggtatcattttg

SEQ ID NO: 33860 - DNA, 1073 bp, Homo sapiens
agaaagatcaaaatgaaatgtgaatgcctaatttcactagtctaatgtttgaagtgacagaagtgaccagtgaccaggacaaattcatatgtagcacacagaaactgatcccattctagtcttacttctgacacacattgttgtttggcacaatggaattaactaatttctctttccctgaatctcatctgtcatgtcaggctaaaggaataataggggaaacataattttagttactgtaaataaagtttatgaatttcacattgtggaaaaaatgttattgtccactcaatatatgtattttgaaggaatattgactgcatatttaattaatttctctttcaaaatcatgatacaactacagtaattgctctctttatgggaaaaaggctctttctctagcgaagctttatgattcataaacactgacaaaagattcaaggaattctggcttatgtaattaccgggcatgtatttaattgttttccttggaatacttgtttataggatgatagaattaaaaaataattgaatcctaaaatctgaacttcaaatttctatttctctctgatattatgattaatatagctatttatttgcaacagttctcagatcattgtttttctttataagacaattttgtggtgcaagtattacttaatacaaaatacattaataaataaagttaagtgtaccaaagcagatgctgctactaaacacatgtttctttgctagaatcaagatatatttaaggactgttatgagattaggaatcaaagtgaataattttggatctttgccgttgttgaatgaatttattgttttttaacacagattttatttcatatgtatggcttagtcctcaaataggtaagacttcactgagacagttgtatttaaaaatttgatataatttttatcaaacagatttgaatttgaacaataagtactagatttgaggtatgaaaatgtgagcctttgtgtcaaaattaaaaactttttggcattaaagatgactatcaagaaagtgaagacaaccaatacaatgaaactgtttgaaaatcatgtatctg

SEQ ID NO: 33861 - DNA, 1018 bp, Homo sapiens
atttctttttcagattgttcactcttagcatcaagaaatgcacagattcttgtatgttgatttttgtatcctagaagtttactgagtttatcagtttgattgtttttagtggaatcttcaggatttttcaaatataagatcatattatctgcaaacaaggataatttgacttcttcatttccaatttggatgtactttatttctttctcttgtctgattgctctagctaggacttccagtactatgttgaataacagtggtgaaagtgtactcttgttgtgttccagatcttagaggaaaggcttttagtttttctctgttcactatgataactagctgtgggtctgttatatatagcttaaattgtattgaagtatgtttcttatttacccagtttttttaggactttttaatcatgaaataatattgagttttattaaattctttttccgtgtcagttgaaatgatcacgattttgtccttcattttgtttttatgatgtatcacatcgatttgcatttgatgaaccatttttgcatcctggagataaacccacttgctcatgatgaatgatctttttaatgtgttgttgtgttctgtttgccagcattttgttgaggttttttacatcaatgtttttcagagatattggcctgtagttttcttttttgatgtgtctttgtctggtttggtatcagggtaatactagcttcactgaatgcatgtagaagtacttcctcctcctctatttttcttagttgtttaagaaggattggtgttagctctttaaatgtctgataaaatttagcagtaaagccaccaggtccttggctttttttttttttttttttaccgggagactatttattatggcttaaatctcattacttgttatggtctattcagattttggttttctttatggctaaattttttgggttgaatatcctcaaaatatatttattttttctattttttccttttttaatgtatgtttgctcgtttctaatgatctttt

SEQ ID NO: 33862 - DNA, 1035 bp, Homo sapiens
tgtacctggaggtatcaccattgaaggcacttcgctgggctggggaggttactttgtctctgtgtcatgcctgcgtgggccgtcatcctgcctggcttttctccattctccatgggttgagttgtttcctctattagtcccaatgcaagtacttagatgtttcagttgaaggtgctgaatttacctgccccttttgcccctctccgagagagccacgcacactagctgcttctagtcgaccatcttggccacctccctaaaaattaaaaaaaaaaaaaatgcttaagtgtttttagtaaacataagtatgatttcttatatgagtttttaaaaatttttaaaaagaaaaagaaaacatcatgtttcttaaaaacctaaagtttatactttcactatacaattttacactcttaaatatcaacctcaaactcgtttccacaatgccatctttctcatcttaaaatactttgaaagtataaacatacacacacatgcaggagaggagagaggcagagactgagacagacagacagacagagagagagagaggggggaaagagattttaaaagtgaactagaaaacagtaattcacatttagtttggggaatagaaagaaaactcccaaacagattactttgagataactccaagaccttttggtccttatgattatcctcaatttaaagaaaaacatatgtacacacactgccagatgtggtggcttgcacctgtaatcccagcactttaggaggccaaggcgggtggactgtctgagctcaggagtttgagaccagcctgggcaatgtggtgaaaccccatctctaccaaaaatgcaacaacaacaacaaaaaattggccaggcttggtggcacacgcctgtggtcctggctactgaggaggccgaggtgggaggattgcttgagcctgggaggcagaggtttcagtgagccaagatcatattactgcactccaagctgggtgacagagtaagaccatgtctcaaaaagaaaaagaaaaacatacacaaaaaacac

SEQ ID NO: 33863 - DNA, 1031 bp, Homo sapiens
tacacacacacctcgggctctctccgtggtaactgtattttacctatagaatgcgaattgtcttatttttctgactcacagtggaagtgtcttcatagaaagggatatattttctttttttcccttagtgtcccctcccctctaagcaataaccataatatgcatttaataaaaagttataaaatacaaatatattcctatcatgaaggtgaaatttctgtatactgaaataaactgataataattttagtcaagactttaatcattatatcaaatcaatgtgaaactgaaaatacatgatgatactttgtttctatatctctgataaaatatatatatttatgaaattaatatagatagatttattgtataagaaatcaaaattatctgcaattctaccctctagtaatagctacttttgtggtacattttctgtttaattatctataaaactctttttgtacatattaaatttatcaatttataaatttccatctaccatttagaaatacaagagctccatcaagaatcatctcctgaaagctatgtattctttctttaatcttctaagtgtatgtgatagacatttgtcataaactttcatatgtttacggccttctattaagctaaaaatatttaattcttaattattgtacctaagtctataggaaacttagattttattctctacatctgaatatggcacacgtgcatacgtaataccataataaataattcaaacacatcatttgttgtgattaatgcctacaagagggagtaacaatgacatcccttgaaatgtctgtgttttatttaagttccaaagataactgttccttatttaaagtttttatttgtttgtttgttcttgttttggttagtatattggttaataaagttgtttggaattttatttatcattatttgaattttctaagtcttataactcagagcagtaatccagaagttaccaacaatttccaactcctatcctcaggatgaaagcccttgaaatagaaatgtgagctgtg

SEQ ID NO: 33864 - DNA, 1048 bp, Homo sapiens
atattctatgcttcttgcaaattatacttcttttcatatatattaccagcacaaaatgaagtctctttttgtaaaaagggtgacatattttgaaatgtcttgtatttcttattacttaaaattgcaataaagtttagagactaaaatataataataagataataattgttgcagattagcaaaattctgttgaaactttgtgtttatttagtactttggatggtgactacgggttgcaaaaatactaggacagccacgtgagacttatgtagtgcttaattatttaattttcttgcagttttctttaagatggaagaatacataaagaaaaaaagtttattagaacttgtttttgtactctaattataaaaccaagggaatgaaaatatttgctaattaatcttccctctttaatctcatgtttggtaatagagcatgtttaattggaagttgggagcctataagcattactaatatatttgttataaatgttaagagcaatttttgattgagaaaatcataaatagaaccgttttatgttggtctgtgtttgttaaaagtgtgtgaacatttaaaatattcatattaagtaaaatttcattttattttattgatttcattcatttctttttgttttcttcttttcaaggccctgtggaatcctacatgcactgaaggtttatttaaaccagtacttatttcaacttaggttaaatcattatctgacaataagaaatgcatcactaatctgtgacatgtaaaatattgagtaaaatcaattttttcatcatttcatattttaagtatgtaatatagaaaaattttcagttcaattacttcacaatttttgcatttgcaaaaatcatataaaatattgatgaattaagattcaactaacatatttctgctttattctcattgtatttttaaaacaaaaatagattttgtttaaaaaattctttctatatgtaaatattctaaaatgtaatattccacttggcactaagtatttttgttcactcttctcatccatgtcattggtctccct

SEQ ID NO: 33865 - DNA, 1068 bp, Homo sapiens
aaaataaaactattatatccattgcatctcttttaaagataaacattgacactctttctacagtcagacttagtatcttagtctgtacacagtcagacttagtatcttagtgaattattctttatttcattatgtcgtttaccaaaatatccctattgatgtgttttgtcttaaattccactgtctgacttatttccagacactgcccccaacttccatctcccttggctaagtgaagctgaaggctctggccagcaggaaaggcgaaggcagaataattgcctgacaggttttggattggaaaggaactggggagggaatggaggaggtagctttcaacctctctctgtcgttttattttaggtgtatatctggtgagtaatataacaccaaaaaattattttaaatataatttcataaattatctgttaataagtgagtttttgtttgtattttttgtaattgtaattaattatatttggacagatctacatcttattttgtgttgtttcttgcctcttttctctgcctctttttattcttctttcttacctctgttgaagtgataggcttttattccttatttttacctttactgtttagaaagccatcagattttttttttcttctttagcggttactcttaaatatttaataaaatatttggctaactttttaagataagaaaacaaaactgtaaagggctaatgttactttcttaaaatcacacagttaatattggcaaaagtgaaattccaaattaagtctgtcttcaacaccaatataataatgcctcccttaaatatttgttcattgtcttcagctctgttatctgccatacaataggtgcttctaatttttttattttggcaatgaaagagattcctgtgtactctcagtattagtaatacatacattttctttttattatacgtcatctgaatggcatgtctctttgctgccattcatttctatttaactgataaaattttaattcgctggctaattttctccctgcaactaatgaccgcccacttgtattttaggaatgtgttaattgaagaaaaa

SEQ ID NO: 33866 - DNA, 1049 bp, Homo sapiens
ttttaaagctggtgattcaagtgaattttaaagcatgtttatgctgttgcattatggggcaaactcagctggttaaattacccgttatcctttgtcaaaattaaattatacaaggtctgcagacactcatcacttttatctaatgtgaccaccttgaactgtaattcccttttgaataaataaggctgattcaggtggaaagaagattaactgattgcctgaagttatgtaatgcatgtggatttagtacataggttttaaaatgacattgttaaatggtatttaaactaatgtgtaataattaaggaaggacactctttaaaatgacacaaaagtgatatatgaatatgaggaccaagaaactgtgcattggcatatagaaaatattagtcattggacaatacaattaattgatagaacaagtatttttcataatttctgctaacataggaggtgacataaaagggagtaatttgaattttaaaaataaaataaagattgtatatattttaggaggtcataaatttgtaggtattaagtagcatgaataactcttcttttccatcctgaaaactctaccaatgtagagttaatactctataattcatgaggtagtctgtaataataaaacattaaaccaactgggctcttttcccgggaatcactgaagcaagaaatactgtatcaggagaaaggaaaagagaaaaagagagaaagaagaagacaataaaacagaaaaaaaaaaaaaaggaaagaaaactagatggccaaatttaatagggtaaatggaaaagctgtccattttatatgcagtcaaataaaattttctttctaaccttggaagggctactcttaaagcataaaccagttttatgttatgaaaggacattcaaatatgccttatttcatgtaactgtggggaaagcactttatagctctgcctttaaaccttaaagtcagctttaacgtgtttctaaaagttatattccggtattgctgagatattcctatcacaaagctatttccaaagccatgtttgtggtctaagc

SEQ ID NO: 33867 - DNA, 1068 bp, Homo sapiens
actcatatgtctcagctccttttaagggcttgtgtggtttatgactaagtatctgattttttttaaaaaagtgttacatatagtgagagaagtaattaccaactgttccactatcaggaaggaaataaccaattatcttacataaaatgcaatgttaataataacgagttcaagatctgtacataagacaaattttgaattactttcacttatttttaattaaatatattatttaggttaaaatatttgtatatgtattttttcccattactacatctaaaactttgatacctagtaaaaacagctataggagttcacatactatatttataaaaataataaaaacatataattcatgtggatctgtatatgtttgcatgtatattagagaaaacttaaaaatataattctgtggatctcaatatgtatacacagattttagagaaaacagtgttccagagacacttattatttttgttctaaaaaacaattgtgtaaataatagatgactgatatctaatatgctacccatatttacattttcccaactgttctgaaaatgtcattcatagatggttttattttattttattccttcaatataggatcaaattaagggtgatgtactgtctttagttttcaggtaattttgtctcctttaatctagaacagttctcccctctttttttttttttttgattctatgatgttaatattttgcaagattccacactgttgttgtatagaacacacactgacctggttgtatctgatagtttcctcattgcttcaatcaggctaaacatttgtagcaagactgctacatgggtgatgtgtgtacaagcagtatataatacctttgtgatcaggagacacatactgcattatttaattgtgaagtgtcaaatgtgtaaaactaatttcagatagttcattaaaagaaaaaatctatgtgtatacatatttatatatattaatctattcatcaatctgttgatctagataggtagatagatagatagatagatcttgcattataaaaagaaacagatgcagagaaacagataa

SEQ ID NO: 33868 - DNA, 1064 bp, Homo sapiens
acacacaaacgtgcaggcaaacgcacatgcacgcacacacacacggccttgtaagactttagttttgttcactaagggtctcagtaagtctagtttgcacctcaaagtggaacagtgacttccttatttctggctcaatcaggtgaatcacacaaaataacaaataccattgaaacaatgaattggagagtcagaagataattaggacataggcattaccagaagcgaatccatattggcttgctatctcaaaaacatcactccctttaaacatcttaccaaaagtacagcttttaacttttcttattgcctccttattctctcactctaggtcttcctgcaatttaagctttctacagtacagctcggatcatatttctcccctccttaagatttccagtgatttcccattgctcattaaattaaggacttatctgaattttaacatttgagatgttactaacatgcccctcactatctttaattttgtctttttccccacatgttctccgggcttcagcaacttatagttttcatactttggataatactatttcttctgattagaatgagtcctcttataactccgtctgtcaaaatctcaaccattgttaatgcctatattaaatcaatgccatgctgaaaacttttgaccccagtagattggaaaccatattaattatttcattctgtgttccatattgacacttgccttactctcctatattcttgtcatagtgttttccgataaaaatatctccaaaaattagataaatgccagtattaaaaacaagatggcattatgtctgttagtagtatacatgtccttttaagataaatttggaaacataaatattaattattaatatacattaggtattattggatcacagttgagaagcatttttgtcctttaagagtggaaggattcttcccattaatattattttctaattgggaataaatattttccttacattctttagtagtttgtcagaaagaatgtgcagcagataattatttttaaaaattagaatcagtgaatacattcagaaatttactgt

SEQ ID NO: 33869 - DNA, 1050 bp, Homo sapiens
ataaaggggagtttattaaggagcattgactcacatgatcacaaggtgaggtcccacaatagtctgtctgcaagctaaagagcaagatagccagtctgagtcccatagctgaagaacttggagtcccatgttcaagggtaggaagcaaccagcacaggagagagatggaggccagcagactaagccagcctaatctttccatgttctactgcctgctttattctagctgtgctggcagctgattagatggtgccacgcagatttgagggtgggtctgcctttcacagtccactgacccaaatgttaatttcctttggcaacatcctcaaagacacacccaggaacaatactttgcatccttcaatccaatcaaattgacactcaatatcaaccatcatattaagtacattaattctgaagaacccaatgatgatctatgctattattaaaatccaatgataagtaaaaaacaggatttttgtgtgtgtgccttgaggatctgcaaagtggccaaactccctgaggacttgaaaactgcttaattttcccaccaccaaaatttcaaatatgagttcatctgttttgatcctctccctcttgtaacaaaagcggtctgtgttctgaatctcatacactttgtccttctcaaaacttttgcttattgggttaccaacctttatttgacatctcacctcattcccagattttctgcttgaatatttcaaacaagatgtcaacactgagcttcccaactgatgtaatttgtcagacctgcagctggtcaagaagaacctcccatacctgcctcctccaggcctgcctctgggagctggctctcttgtcagtttatcacagtgcgcataaaatgttaatcactttcttatgagtaacatgatgcattaagtagggaaacactgactttatagcatttttttgtttgtttgagacagagtctcgctctgtcgcccagtctggagtgcagtggcacgatctcggctcactgcaagctctgcctcctgggttcacgccattctcctgcctcagcctccc

SEQ ID NO: 33870 - DNA, 1031 bp, Homo sapiens
gaaaaatgtttctctctgcttttacagaaaaaagagtcctcaatagacattgcttagtattaacttattttccctgcttctgtagtgtggagtactgacatttaaaagactttaatttctattgataataaatgaatgcacagccagagaagagaactctaaaataattagagggatgcatgtcaagtctttcaggccctcatattaatacacagtgcatgctgcttcttattgttgcaaatgtcaaccttcttttagataagtgtcttttgggaaatggtttactacacttcaaagggatataataaaagaaaagggcttggggcaatatttaagcaatgaaagaaacacaggacatttatgactagctgagaggaactgattgcctttggctgtgccttgggaaatccccaggaaacacagtaagttgtgattactattgtaagttaaaatgatataaagcatgcagaggaatttgtgtttttcttatgggtgatactgcatttcatattctcagcataccatcagagttcatatctacctctgtgtttcttactgaagtactagcaggagatgtattattgaaaattgccaaagaataattttcaagaggatcaatttaagaaaatgaaaagaatgtaaagctaagtctatctcagaaaacatatgtgttttcgcatacctcaattaaatgtttctcattaaactagacattttgaaattaatcataccaaaatttgtactgagaatgtttgttaaaatttgcatggtaaatttctactatgtgtataactatggcaaataacattagaggtaaataaaaaagaagggcatacatttaattttatcagtgcatgttcacagtggttatttccttaatagacatagaaatgtttagatctggcagcattattggggggatgtgaggatgtgatttattattacccttataggttttcacttctgagtttctaccaggctgttgagaatataaaggaaattatctcacaaatctgttatttttttcttta

SEQ ID NO: 33871 - DNA, 1035 bp, Homo sapiens
ttacacagtagtggaatatggcaaaccctttaatttccaaaaagctagcaatgttatctcaatataatgacagtgagaaaatatgatttaagctatctaatgaaatatatgaccaatactacctttttggttagagatttttctgtattgtttataattttgaaaatggcaaaatgaaataattcaagtaaatgcagtggatcttagtttttataggatataaatagaattacaaatttcttcttgtatcagaaagtgagatagacaaaatatacaagaaattaatttttaaagaaatacagtattgtttgtaaagaggcaaaatttttactacagttagtctccaaaaataccataaagattttgagtacaaaatttattagaaagtaagtctgttatctaaatggttatatatttttttctgaagaaacgttaatatttaattactgaaatatgggaaagtaaatattttgaaaaattaaaatatcaattttattattttacaaagatcatgaacaattattttagaaaacatagaaatctgagagttataaagatgtatttatattcatgcatatgtgatattgcataatgcatacaaagagaaacctctaggtttgtttgttctggttgttgctctttttgtcattattctagagaagagtggctcatgatgatagcacatcacagttttcctatttgctctttggtgttacgcatcataccatgaatcagcctcctgtgtttttatgtatgtctcagtaatttgatataaatagctgttttaaaagccatttgagtatattttgtattaggatattttatgcagaaaaaaatacaaattaaaacaaaaaatctttaacctagggactttatagtaactaaataaagatgtatgccttctataagtatagcggtctatcaaagtatttccatgataatgtggctttttgaaatgaaatattgaagtcattcctcaaaatcttaatttgaaatcagatttgaagtcacacaaattttcaggtagtttgtctc

SEQ ID NO: 33872 - DNA, 1063 bp, Homo sapiens
ttcttattttagtggtattggtaaagcaattccaaaattctacgtgtatttttggaagaagggagatacaaatgtagaatttaggaaggcaagggaaaaccccatgagatagattggaattaatgttatcagtaagaagtcatgatttcggatacatatgtgtatgtttgtttttacatacatataaatatacgtgtatatccatgtgtatttatacatacacacacacacatacatatatatgtatatgtacactcacacacacaaatgcatacatatatgcttctaggccctcttagtaaacagatattcaagctctgacacccaagaataatgagcacttttagtgccctgaatcctgttttttttttaaataccattccccagtgaatggacccagggttccaccaagaaatggctgattacagaactggggcaacaagagtccaaggtaagcctggagaaacttttgatgtcagataataaatgttgaaaaaattataggagtttatcaaaaggtcacaggggatatcttgaaggagctctcactgtaaaatctgagataatttaatctccaaataattaaggatagcaaggaataataaattgtttaacaacagaattcatgagtctatattagtattaaagagatggcaaatagatggattatttaattgaataaatacataactgtggaagaagagagggctttcccttatagtagaatatcaattgataaatgtgtagatggtactagagttggaaaatcatcactttgcaaccaccataataaaggttagtcaagagtaaggatcatcaatggatgataagtctatgggaaattatgatgcggagcatggtttaaagtgtcctcctacagactgccaataagttggaaaagaaaaaatagtaactctagactggggaagctggacggcactttatccaggtgattgtaaatgaaagcaatgaactttgtttctgcatgtgacagcctacaaagcacacagcgtctcttatgtattagccttcccacatatatacatgtatatatagcctgcat

SEQ ID NO: 33873 - DNA, 1052 bp, Homo sapiens
tgagtaatgtaatttagcaaagttttacataggcaagttgctacttcataaggcaatgatctacctgaggataaaagcatgaattgaaattggatcattctctgcattctggtccaaattaatcggtctcattttgtattaatgctctacctttccttttagtattatcaacttatattaatgtttgtctttcaaattttcaaatatttctatttgacagactaatttctctgttcttgcttttctataaatttaattttcagcacacacacattattcttcacactttctgtaaattctcctgttcttctttaaatgtatgaagcttgattgtgtaactcagggaatttcattcaataaaatatcttagctcaataaaccatttaattacttaaataatagttcaaattgcttaaaacatatttatcaaaaacaaccaattacatatttggatagataatgttacctgaaggtgttatttgaaataatcctaactcattcagtgtgtggtcttagatagagttgcttattttgagtgttaagagtgtttctatatttttatctgatatccatgtatccatgcaaaaattcagggtccttggaataatttggcgttttaccataataaaataaagctaataatgattattatgatgataaaaagttgttcacaattttactgaacatttatgatatgccatatattatgtgccaagattaattaatcttgtgtgcttaattaatttattcattcaacaaatgtttatgtatcattgtaggaactggtaatacaacaggggaaaaaaatgcatgaagttactgcccttgcagaacttgcattctagtagggagaggcagacaacaaaggaattacaagtgaatatacagaactatagacagtgataagagttttgaaacaaataagagggaataagaatagtgatggggtagggggtaggtatggtttactgttttacatggggtggtcagggaaagactcactactaatgtcacatacatgtagagacttgtaagatggaagggagtgggcc

SEQ ID NO: 33874 - DNA, 1041 bp, Homo sapiens
tgtggctttccaaaggtgaaagagaaatcaataaaaattcttacattattaatgccatttaaaacaacacaccaaatcaacaatggcttgggtagtatatatgcatcaaattcttcttgttgataaacataaagatatctttgagctagagggcatatggttcctactgtcattttacaaatagaaaagaaatcaaaagcccagatagtaaatgactgattcaaggtcatagaatgaagtattacgactatattccagtcttcttgaccactagacaataatcttaattcatcaggtggcaaatacccaaatcatatttattggtttataagtttgtagccattgcttacgatcattaaaaggaatatagaagtcattgttcaatgtttcctgaaaagtctttcaaaaaaatcttactgatcccaagcttttctaaagtattaataacttgctggactaactgatttcaattatttctataaaatataattactggttattcctgctgactgtaaattagaactattcaactacattttagctgctgggcaattacattatttctacaagtaaattattttattttcaagagtctgtttttattaatcttaaatatgaattattacccaattgttcttgttatagaaacaatatgtcatttagttaaatattgtagaaaattgtttaaaatataattacgtgatttttatttaaaaactaagttgaatacttgagacagtctcaataaggatcagtcactaaaaaagatgaaaaaatcgtaacagtctcagagattctgcattcagattgataggcaaatgtattaaattctagtggtgctttaaaaatgccaaagctagacatcagaaacaattagtggatatatagtatgacatctgcaaaaaagtgtagttaaacatgattttttttaaatgtcaaagttcgaaatggtataactatgggcagactttgaagctataaatatttcagttgatcatatagatgacattacttatatttctatacctactttatatatac

SEQ ID NO: 33875 - DNA, 1062 bp, Homo sapiens
gagctgaaagaggctgtagagatcattaaaaaaaaaacttagatattagaaaaatgatgcctggagagatgttgtatgacttttccaaggtaaagtacttaattaaaaaaactaaaaatttaaggggattttaagtcatcacccccagccctgtagattaacttaaattttatcaaaagattagacatattaaactattaagtattgcttcaaaccactctcagagatttattttaaaatttgtgcactgtatatgtggttgtcatataaaggattgacaacacttttttgtgtatgtaaatgaaaattgtattggtttagtgctggatttacagtttaaggattgtatttaatgaaagcctctcaattggtatgtccttgacataataaaaattttcataatttaggttttaattttcacattatgttgaaaattcaaattatttccaaatatcctgtgtttatatttactatattaattcaatcaaaaatatactagttgaaatttggactattccctatcttgagcacacaacatgcacacaccccacacactttacccattaacatggtgtacacaaagaatcttagatattttattcttttcaaagttgagaaatgcttgttaatttttaatcaagttgagctattattcaaccatttaaatttaccatcaacatattgtggaataggataccttatgcctaattaacaacataagtaagaatcaaaatatttcatttgctacctgttaatgctgtcttatgattttgctcatgtttactaatctcaattataaaatatatttttatgtgcacaaaccagtatattttatttattttgccttcatctaccttaaatgttaaaatttttaaaataaacctttatatatttatttacacataatttaataattaagtttatcaatatttctatttttgtaaaggaaattactccaggacccatttatatgactatttaggctaaaattgtattttccatttttttaaacaaatatttggtaccagaataacaaggtatgcaaaatgacaactaaattta

SEQ ID NO: 33876 - DNA, 1046 bp, Homo sapiens
atgagccaagctgcctggccctcacactgaagttttttttaatgtaaattctctgtcagttactacacaacttaaaaggtaaatgagaacagttctttttgtttttttcagttccatcatttactttttcatatggctagtttccaaatgctgcaccttttacatgatcagctctgagagctttatcttttattaattttatttatatttattaatcatggttatttaaattatttgtttgttgagtgctctgtatgtgttaagatctgtacggactgttttatatttattaatttagtaaatacctgctgagttcattctatatatctggtacttgaattcagtacagtggaacaatggatgtgttataggaattagaccttatacaattgtgggaggagctgaggaaatacagatggaaaaaggagaaagtttgagaaaagatcaccagtcagtcttcccaaagcactgtcacctttggcatgagaatgctgagaacccaagcacatttggttgctgaagtgggactgcaaatgaaagtttgtagaaaagtcagttagaagcttttgaccctgtaagatctatctgctgtaggcccactgctaagagtctggtagtgggtccaaggctgctgttattcaaacaggactaatagatgagaataagaattagacacaaagcagaagagagtaaaaacaagctagagtttgctgggcgctctgtttcagtcactctctgtgtctgatgtaggtttagagagtaatgcccactgcttcactttcctatcccaaatcttgcacaagttccttttctgttcaactctaatccagaactatacaaagaaaagaacactgggtagtatagttaatagcttaactattagagagccaatagttcaaatctgcaagggatgcttgggattcagtggtgaaaagacagaaaaagttcctcgcttcttgcagttacattctagtggtagagtcagaaaataataaatattttatttaatgtcaagcagtggaagttcaggaaaaataattaagcag

SEQ ID NO: 33877 - DNA, 1033 bp, Homo sapiens
ttctctcaactaggagtttgataattattgcaaaggaaagagttattctttcttcaaaggacctgtacttctttctcttcctgttcatatgtgggaaacatatgataccatgtattatatttttctatattccttgggatgttaaacttacaactggacaatactccaagttccctgtgatcgtagttgatatgacaggatgaccaactcctttggataaaataaattggatttttaaattaagttccaaacttttgggagtgagaaatattttggtagtcaagaaatgctcatgatgatgactacagtgataaactggaagtaatattttatgaacaatgacacataagccaccaacatgtggtagttaggaataactataaaacatctataaaagaactaaaatttacaaaaccctcagtgtaatgaatatgagaaataaaaatctcaacatcaataagtgagtcaatttaacaatatttctcactatttctatagggtaataataggcttttgaactgaaaaaaaaaaaccacaaggacaagcttctagtttcttctgatatttcaataaaaattgtctatttacaacagcagtcctaacaacaaaaaatactactttttatactcctctgattaaacaaaaattcaaaagttgcttgtaaccagaggagctaataatcattattaagtatttactaggataaaataatttaatgaatggaaaaaacatagttctcatgactatctaaattatatttcaaatgttaaaattaagtcttgtattgttattaaacatttttaaggcagttaaatttttaattgtgttgaattcagcagaatcttttaggttattataataattataagatgaattttcttgactaccaagccaaaagaattatttcaaatagtttaaatacaattttctgtagaaagagaagtaaggaagatgatttttttccacatgagtatcattattaagtagacgacagcaaatacaaccaagaaaatccatctttgaagtgtgctaa

SEQ ID NO: 33878 - DNA, 1028 bp, Homo sapiens
atttgattgattaattacagtgatttttctcttttacaaaagacaaactgctgccacttgttgcattttttaaatgagcagtttgcaaagattgtatcttttatgtaggttgcttatttcatatatttggaaacgggttatatcagttggtggacgatatgtcaaaaatttagaactttctcccatctttccaagttgctaaattatatttcagtgaaaagctttctctctaaagtgctaaaggtatttctcaatggaagcaataaaatgaacttttttggcagctttcccagaaaaaaaaaaatccctctagcatttttggaaatgagtaggggaaaattataaataatgtaaaataaactcacataagaggcttatatgaactattatacaatatatattaggaactaaattttcttccattattcctttaggatcttgtggctctagtagaatgggaaaatgcactcccatgagaaatttgacaataacagccaattctgcacggaaaaaaatattgaatggtttatatataagtttaaaatctattttaaaagtaagacttgatacgtgagagactagtcaagtttggtgattaggaagtctctttttctactaaattcaaacctacagtgttggtgttcactgaatacactaggtagtgtagaggatgcagaactcaggggaaaaggtctcaataccaacctacataatgaaaaagaaaagatatgtgtgaggtgtggctttaaaacaaaagatctaatctaaaaagatctaatctatgtatcacttttgggatctatatgatatgacagttatgccttatgtttggaataataagcaatatgtaaattacagcaatatacaagctactgtatattagtagggaacacaggttccatttctccttacttcttcctggcatgctatgataacaacttaactatgttatgataacaactactagtcatcctgcttcctgtatccctttcttgtgtaccttagacacacgtgcatttttcttctta

SEQ ID NO: 33879 - DNA, 1062 bp, Homo sapiens
atttatatatatctatatttatatatatactatggaatactacacagccataaaaaaacagtgaaatcatgtcctttgtagcaacatggatggagctgaaggcaataatcctaagcaaaataacacaggaatagaaaaccaaatattgcatgtcctcacttatatgtgggtgctaaactttgagaacacatggacataaacttgggaacaatgggagcaatagacactgtggactacttagagggcagagggaggaaggaggacatgggttgaaaaactacttattgggtactatgctcactaccggggtgcaatatacccatgtaacaaaccttcacctgtacccctgcatctaacttaaaagttaaattaaaaaatataaaatgaaataaaaataattattctattcttgcaccttctccttctggttgaattggtcaaaggcaaataagaatataatttgactccatttagttatgttaactgttttagaaaatacaatagttacccaattaaaatctactttttttaagacgagattaatttaagtcagaatatgagcctatttgttaatttggtcttatcaaatcatatcacagggcagattgttgctcaattctggcttgtgattgacttgtctctggctgaaagaatctagagacgcataacttaaaaactctaacggaagaagatgttactaattaattcttcaaactcagtatacatcacttaaacaatgtattattttacaatattaaatgcttatttttattattaacattattctctaaattctatgtctatcattgttttagaaatttatttttaatagcaacatctgtgaactataaatactaataatatgttgcaacataggattgtatccatacatggaatattttgacagaatacactagacacatctagacaaacttgttgttcaactgacatagttggtcaaaagtacaagcttggctgggcgcagtggctcacgcttgtaatctcagcagtttgggaggctgaggtgggcggatcacaaggtcaggagttagaaaccagcct

SEQ ID NO: 33880 - DNA, 1075 bp, Homo sapiens
catacacaatagcaacatagattccctgttatacaatgaagaaataaggtagaggatctcttgtataaacaggtagaatgaaataattttaggtggctaagaggatcacaggcagagatgctgataattttaggttgccatagagacaattagcaggattgacacaattatactgttcaggcataagagtagaatgttggaagttatacagaaattaagggaactaacagaaatgtaggcaagattgaatgagatccgggtacataagcatcatggaggctgaatgaataatcacagcagcttaatgtaccatttaaaggggatattgattgtttagaattataaaaatataatgtaatataaataaaacattacaaaatatatgaccatatttagagttagttctaaattaaaattcaaagtaattgtgtagggtggtcattttctgatctgagaacctcctgataggtgagttgtggagaggaaggaacatcagaacatattcctatgcttctctagtgagatcggaaagattttagatagtattcaactccatgacattggcaactatacccagacatgcaaacttttgatgcaactatgagccatctttatggctaaataagttatagaggctttaaagtaaatatgtatgaactgaatttgtatttcctcaagacagaaaaaaactactattcctttagcaaaaattattctgcactgattattattttcaaataagtaaagcttaccatgtaagcaccatgtcctttaaattaatgttgaatattttgaaaatgatcctttacaaaatgaattgcaaatttttatttattttaaaaaactgatatttatcctaatttcagaatgactgacacacaatttcaatatatgtacacactctcctttaccttgtattccttctttgtggatgtcagaaatcagtttctaaccctccttctagttataccctacctttgaagatttcagtttactggaatctgaaaacaaaacaaaacaaaacagacagccatacttcttagatcttgtataaatgagcagtaaagaaggtctg

SEQ ID NO: 33881 - DNA, 1044 bp, Homo sapiens
atgttttacctgaacttccagaataagacattgatatatacatttacagtatatagagccactgattttaccatgcatagaagtggatggaatatcaaaatgctttgttccagtactttgtgattataatgaagacttatggttttttaaattttgacaacttttaggcaacagtaaatatgaacacatagattatattttttgtttgtagagtatttattaactatataagcaacatctgtgaagtatagaataatttccatctacaaaaggaaaatgttgtaatacatatttagtttataatagtatgttaagaaccatcaacttattcttttaattccatattccacagatgttcattagacacctaccattaaatgttaacaaaatttcttcatgggtgaattgaatacacttagaggcaacccattttttaaaaaagtatgagtataatctggattcctgtgagtataaatgtagctcatatttattaatgattgtttactctaaaaatattcagactggtttggcaggctctctgtctgaggcttgaagagcttgctctgggatccttgttttctcagcctctctaattgagggcaccttcacagtttcagggtactttacagcacggagaagaacctaaaaacaaaacgaaaacatgatgggtcataactatgaggaaataaaaagaactgtataaattgcaaagtctgaaaatcaaaaatgtaatacttgaactaaattcattttaagataatattaatgtggaaaggaatgcatctgattgatataaaaagtgtaagaacacttgcagtttaatgttaagcagttacattgcaaagactagtctcaaattttagaacttcattgaaaaatcagtcataaattgtttctccataaacaattaaaaaccagttttctgattctggttaattgtttctttttcattaaatttgttaaatggggatcactaaaagtaaggtctcacaagatagtgtgcatattgctttacattttaaacttccatatggcagatctttc

SEQ ID NO: 33882 - DNA, 1050 bp, Homo sapiens
tcagccttgcatcctggagatttgtgtatgttgaaccatccttgcatcctacttgatcatggcagataaactttttgatgtgctgttggattcggtttagcagtgttttgttgagtattttcacatagatgttcaccaaggatattggcctgaagttttctttttttcttgtatctgtcagattttggtatcagaatgatgatggcctcatagaatgagttaaggaggagtccttctttttcatttttttttggaatagtatcagtaggaatggtactggcttttctttgtacctctggtagaattcacccatgaatctatctggccctgggctttttttggttattaggctatttattactgcctcagtttcagaactcattattgccctgttcaagcattccgtttcttcctggttcagtcttgggagagtgtacgtttccaggaatttgttcatttcttctagattgtccagtttatgtgcacagacgtgtttatagtatcctctgatggttgtctgtatttctttggggtcagtggtgatatctcccttatcatttctgattgcatttatttgaatattatttcttttcttctttattattctagtgaggagtctattttatttttttcaaaaaaacagcttctggatttcagttttcgaagggtttttcatgtctctatctccttcagttctgctctgatcttgattatttcttatcttctgctagcattggggtttgtttgctcttggttctctagttcttttgttgtgatgttagagtgtcaatttgagatctttctagctgtttgatgtgggcagttagtgctataaatttccctcttgacactgctttagctgcatcccagttaatctggtatgttgtttctctgttgtcattagttacaaagaacttgtttgtttctaccttaatttcattatttacccaaaagtcattcaggagcaggttgttcaatttccatgtagttgtatggttttgagtgaacttctgaatcttgagttctaattttattgcactgtggtctgag

SEQ ID NO: 33883 - DNA, 1028 bp, Homo sapiens
tgtgtgtatatatatatatatatatatatatatatatatatatatatatatttctcagaatgtattttaggggagggtgtaggtggggaagcagttgacaaatcaaagtcagaaacaatcttagtatagagaatattcttgaatagtattaccttgaatgctaagaaatatttttgtatttttgaatgtatacttatacaaacagaaagttctgaagtggtctcatgtactcattcatgttattaaacctgagcaaggtatagagggctcaggtgagagagggtaactagaggattaaaaattaatacacaaaacagaaaaggtcacattcttacaggtcaagggatgagaagttgtcatattagcctcattctacctgctcagaaatcctgcttttattatgttatatttatttgttcagtaagctttagtgtttagaattgtgttgcacagttcaaagttttatctctatattaactccaagaactacgggattgtgtaaaaagactgaaatgatgactgactatggggactttttcgttgatgctgttgttgctgccttctgttgtttgtttttcttttaaagtcaggcccctcttctgtagggctgctgtggtttgctcggggtccacttcagaccctattcacttgggcccctcccatacctggaggtgtcatcagtggaggctgcagaacagcaaagatggctgcctgctccttcctccgggatctccgtcgcagagggaaaccgacctgatgctagcaggaatgctcctgtaaaaggtatctggtgacccctgttggagagtctcacccagtcaggaggcataagatgcaggacctcttaacaaagcactctggctgccccttggtagaggaagtgcactgtgctgggggcactcccatacatctggactgcctagattcctcagagccaccaggaaggactaagtctgttgatccatggagaccacagccgtccctcccccaaagggcttaaccccagagagaccagagctctgtcccta

SEQ ID NO: 33884 - DNA, 1035 bp, Homo sapiens
tgccctggctggactgctatgagtaagagaaaggcatctctgtcttatttaatacccactttatgtgtgtgatattgttccacttttaaccctaaacataacgatcatacctgtctctaaatatttcactacatgtaacagaagtatcattctgcccaccttagtaaggatatccaattctgagaactcagatgctccacttctgttttttaccattttcttcttttcctttcccttccccctccttttccacttcctcgtccttcacgctgtactgagacatcatttagttcatcttattaaaatgtacaattaaactattaatagtaagtttacagagttatatggccatcaccaaaatccatttgtagaacttttccatcacccaacaagctctctcaagtccaatcaattgacagttccatactaccttcaagccaaccacgaattgtttctatagattagcctcttctgggcatttcattaaatggaattagataatacaaaatcttttgtgtctggcatcttagaatgagtttttgatgtttatctatgttgtagcaagtgacaagatttttttcttttaatgatgaatagtgttctattatagggatatatcattttgtttttccagtcaataattgaagaaacttagtttccagcttctcttaggaaaagtgctgtaatgaatatttattgaatagtctgtgtgtgtgtgtgtgtgtgtgtgtagctgtatatatatatgtgtgtgtgtatatatatatgtgtgtatatatatgtgtgtgtgtatatgtgtgtgtatgtgtgtgtgtgtgcatgtgtgtgtgtgcatgtgtgtgtgtgtgtgtgtgttttagcctgcttaggctgcataataaaatacaacagactgggtgtcttaaacaacagaaatttattttcttacagttctggagtctgagaagtccaagatcaaggtgccagccaggttgaagtctgttgaggactctccacttaggtttcagagggccaccctctttatatgtactcata

SEQ ID NO: 33885 - DNA, 1025 bp, Homo sapiens
gaaagacaccatcttcaaaaacccatcacattgaagcttagggcttcaacatataaatttgagaggaaacaattcagttcataatatcagtgtagctacactaattcttttatggttaccattgcatgcagttcatcgttataccatccacctatttgtatttgtgttttaaagtgtttctcttacagacagcataagattagatcttttttcttaatccagtctcaaaatttatgccatttactataggtgtttaaattatttatattattgtaatatttcatatcattggatttttgcctgaattgtgctttttattgctatacctcatcatattattctggctattcttttttactgtgatctttttgttaaatatataaattgaaatgtgtcattttaattccttattagtttttgtactatatatttatgaattattttctatttgtgctaggtatacaatatgtgccttaatgtatcacagtctacttcaggttaatattaacttgattccagtaagatatacaatattgctcgaataacttctacccactgttgttatttctactcactgttattatgctgttattgtctttatatgttgtatgttcaacaacacagttttgtaattgtgatttatgcatttcttttaaatcagttaaagaaaagagaaaataaactatgtacactatcttcatatttgcccacataattatcttttccatttctttcatttgtttgagtggattcaaattagtgtctgatttcatttcctttcagaatgagtgctgctgtagtgtttattggaagaaaaatctgctagcaatagattctctcagtattttaaaatgtggtaatattgtgatttcaccttcaattttgaaggatagttttcctggatgtaggattcttggttgacagattttttttttatttgtttaagcagtgtctttccactgccttctggcctcctttgtttcttgtaaaacatcagctgctaatttattatggtttcattgtaa

SEQ ID NO: 33886 - DNA, 1034 bp, Homo sapiens
taaatacatataaatatataaaaatatatttataaatacatataaatatatatttataaatacatataaatatatataaacatatatttataaatatatataaacatatttataaatacatataaatatatataaatatatataaatacatatatatacttttttttttctaagttggcgtctcactctgtcactccagtccagtggcacgatcactgcaacctccacctcccaggttcaagcaattctctgcctcagcctctcaagtagctgggattacaggcacttgccaccacacccggctaatttttttgtatttttagtagagatggggtgtcaccatcttggccaggctggtcttgaactcctgatctcgtgatccagccccgctcggcctcccaaagtgctaggattacaggtgtgagccatcgcgcctggccaaaattacacacacacacacacatgtgtctgtgtgtgtgtgtgtgtgtgtttgtgtgtttgtaattgttttcaggagctagagaaatttcggttacatacacacaaacattcacttatcttttttctgagtaactgcaatgaatttatcatgaaatatggtaaacttctgtaccactagtttctacttttgttcatcgtctggttttcccctattatcttgggcacatttcctttaagccccatgaaaatagagaatctgttattattgtgttaaactatgtcttacttttctatcaaatatattttggtaaaactaaaaaatgaatttaaatgttcattgattttaatgaggacctattgtatgctgtacttgctggatgttccacagctataaaacaatagtgagccagcagatttgggtgggaacaacatcttcactatttcagacaagtcactaggggcatagcttccattcttacagttcctaaaattatcagtgtgggctcatgcccaagcatattatgaaagctgccctttgtaatatatttgtgacatcttatgtggtcataaattcttgaatactttttggctat

SEQ ID NO: 33887 - DNA, 1001 bp, Homo sapiens
gtaaagcaattcctcaaaaaaaaagtaccatgtgattcagcaatttcacttctggctatacagccaaaataagtgaaatcatggcctcaaatagatgcttatacacctgtgttcagagcagcactattctcaataaccaaaaggtggaagcaaccccagtgtcaatcagcagatgactggacaagcaaaatgtgctatatgcatataatgcaatattatccagcttaaaaagtgaggaaattctgacacatgctaaaatacgaattaatcttgaagacattatgctaaataaaaaaaaatcacagaaagacaaatattatatgtttctacttatatgaggtacctaaagtgtacaaattcatagagacaaaacagattggtggctgccaggggttgggaagagaggaggttggggaaataatgtttaatgtgtacagtttcagtaggggaagatggaacagttctgaagatggatggtggtgatgattacacacagtgtgaatgtacttaattccacaatgttgcacacttagaaatggattaaagagcaaattttaagttatatgtattttaccacataaaaaagagattaaaaaataatatagttcagtaggttcttggctagtaagttagacaaaagatcagaggaataagacaacttggcaggaaccttatgaaaaggattctgctactgaaatggttaaatttaataactcttaggtggtaagaaaatgaccctgtgtctatgtattaattcttattactggtatatccactggcctctttctcatttctccttgcatgtgaaaaaagtttttctaattcatgccccaaattgaactcttgatctcctttataaaacaccacaaaaagctgctcttgctgcattacattccgtctcagtgggtgacaactccatcattctgattgatcatgccaaaatgttggaggcattttccctttctctctcatgatatatccagtcgtacaagaaaatttac

SEQ ID NO: 33888 - DNA, 1073 bp, Homo sapiens
tttatcaatattgtgggtgtggatcatgaacctatgcactgttcaaaacccatagaactcattgttcaattcccacctatgagtgagaacatgtggtgtttggttttttgtccttgcgatagtttgctgagaatgatggtttctagcttcttccacgtccctacaaagggcatgaactcatcattttttatggctgcacaggaaggggaacattacacactggggcctattgtggggtggggagaagggggagggatagcattaagagatatacctaatgttaaatgatgagttaatgggtgcagcacaccaacatggcacatgtatacatatgtaacaaacctgcacattgtgcacatgtaccctagaacttaaagtataatttaaaaaaacccacggaattgtacacaagaaagagtgattttaccaattgtaaatttttctaaaaattaagtaacagaaaaagagaaaaacaatagagtcattggtttgttgatttaaaaatgtatattcagaatgtggaagatgaagggtatatggtaaagaaatggaagccatatgcattctgttttcaaaacgtttcccagttaagaagaaaaaaaaagaaggtagcttcaggacatacctcagttgattaaagaaaggttatttaaagagaggaaacttggagatgtcttttatagaggttaaaaaagaacatacatattcaaaggagagtaaataattaataaagaaaatctttgaggccattggaggtaacggaaagagagaaagagtctttttttttttaatatacttaaaagagggcaaaaggaatagagaatgaatatagatagaatcattttaagggatcatcacttcaacatgaatcttgttaaaagattgttcactggaatttgagatggaactatagcaaaatcttgtttagccaggtctaagacacctttcttattaatagagtccaaatattcaggtttcttaacctcccaaatgccctgccctcttatgagtcccaaagtgcaagtgttgattggtctaaaccaatggctctctgtatggtccgtagaccagca

SEQ ID NO: 33889 - DNA, 1062 bp, Homo sapiens
gctttattttgtctgaaagtttgccaacagtgttgtaccattttaaagaactatattactaattccagtcatcatttttagtcaccaattcgacatactatatcatttttatagccatcacattcatggtgattatacatttacaaacataggaccacttaattttacacagaattaaaaatctaaatacttacgctagaattactttcctcttaattcttctgtaaatgttagatagggagttatattgattttttaaaaaatcagctaagttacatgtctataagctgaatctcaaatagtaaaaggaaaataaaaagtacattataaaaagaatctgagtcttctgaaatttgaaattattgatttacatatatgggaggtctggctttttgactatagagccaagcacaaatgctgtatccaaacggtgggcacatttctttggtagaaatatatagattctgaaaacactcttgacacattcagacctataaatggatagcaaaattttgacataaagatctgaaaataaattctaaagttggcataatagattctcttcaagcagttcaaatacaaatatattaaatgcctcattatgcaagacaccttgataaatgcttggatgacaaagacaaatatgaaataattcactcctctagagagttgatattctagtgggagagacagaaaaatatctaaagaatgctaatgcaatgttaacgtggaaagatttattttatacagttctataaaagaatgaaagaggcatttgagaggaagcctggtatgagatgtagcttttgagctatgctatggcgtatgttgtagagtgcctaaaatattgtgcgaaaataacattgcaaggaaagagacaaaaataaaataccattttaaacaagaaaataacagcaagaaaacttttctcagatggttctgtgtttgaaggaagttcgactgtgttgtaacagaaaacatttgatggtccctgatgggtttcttggaagaatagagtgatgaattctgtgagagaaagaaaaatcagaattattctgcaga

SEQ ID NO: 33890 - DNA, 1096 bp, Homo sapiens
tgatttgtttaactttgttcagttaatatatgttaaagtaaacacagtatgtctatacttaaatgaagcacacattttttgagtaatgtaataaatgtattttggatcaaatgtgttcacttaaagtcacagatgtaactgcattaaaaagaatatgcagttgtcattaaaacaaaatgtattttcttgttcaatgaattgaactacaagaaaatagtgttttattgaataaccactaatcaagcaaattgacttctaatatggcacaattcattcattcacatacttccagagtgttgctgccatgctccagaattacacttgttttccaaaaagcaaaatatcccaatgtttctatgtgacaaatgacatagataatttacaaaatattaaatacaatgaatgattgttttaacattaaatttttatagagaaatataaggatcccatttttcatacaaaattatagtatatttactaaatttatgtttgtctaaaaatatatattactcatttgtagaaaacctgtgagaaaatttgttacagtatgcatggcagtataaattgaaaagattttaatcacatgtgtaatcaaccttaaatgtgcccacaaatacaatctcataaggaaaaatttgagactattttgcaagaaaatattccccaaatcaggaaaaaattatatagtttagataactctataatagcaaatgtgaagaaacataggaaaaagctgagaaatgacctaaatatccaaaaatattggaaaatttgaagaaattatgaactgtgtacttgtttacatggtgttttgccagtaaaagggtaattatggaaatacagaaaactccttttgcttcagctgtaaattttaaaagatacaaaattttaaatatagtttatttatagatgcacacatttattatataaaagtatatatttttaaaaatttcaggccaggaatggtggctaatgcctataatcccaatttgggaggctgaggcaggacgattatttgaggccaggagctcaagaccagcttaggcaacatagagagaccccgtctctgcaatttttttttaaacagctagacatg

SEQ ID NO: 33891 - DNA, 1058 bp, Homo sapiens
agacttttttttaccctctcagctaggtaggctacagggaaacatcagcttttacttttgctattgtaacaatctataatgagctagagtgaacttaataaagatcttttatttctgtgttcaacaaatatttataaattaacttctaggctttagtcacttttatcctaagtgctgggtatacattgaaaaactatgcacaaagcccttatcctgatggagcttacaactgaatgataggacaagggaaaaatgcacatatatgtattttcccataaatatacataatatttatacagtctgtcctccatatccccaggttctgcatcccaggattcaaccaaatgtggctcaaacatatttttgaaaaacaataaaaaataatacaacaatttaaaacaatacacatttaaaaatatagtttggcaactattacacaacattaggtattgcaagtaatctaaagatgatttaaagtgaacagccatatgtgcataggttatatgcaaatactatgatattttgtacccatataagtgacttgagcactgctggacagagtaatatgtggagcgtaattttttgtaggatgatcatagaatgcactttatgctttaaatgagtggggatacgaattaagtgacagagttagctatagggttatttgaggttaatagtatttcaagagaacacagtgaaagagggagagagttagtagatgaggctaaatcacaaagggccttgaagggccagaagactttgtattttactctgagtgagactagaaatcatttaggggtctaaacaaagaacagatataatctcatttaaattttgaaagcatcactttggttgctgggtggagaatggaatataactgctaaagaaaaatttatttatgttaaaaaaaacgttaaaggcaggaagtccagcacaggaagagtagactcatcaggaaccagcctacttccatctggttccctctttattctccacctcatggtctaagatggttgtctgtgctctagcgattccatccataatctaaccttttcttt

SEQ ID NO: 33892 - DNA, 1031 bp, Homo sapiens
gctatgtctcccacttctgcataatgaggttgaaaaaagttactatattttaatttttttgagtgggagtactaaactaattgagtattcataatgccagtctacgatctgtaaagttaaaaaatatttttgaaatatttaattccaggaccagcgactcataatatccattttttttttttttttgtcattttgcactttcttaaagcttctggacataaataacttgttggtaaatctagtatcttggctttccctttgtcctcctacattaccttcttagatattccagaatcataacattttgcgtaaagagagtaattaagattttttatattttaaagaaaagaaatttgtttctgtgttcatttatgcaccagttccatataccaggtcagtggcagagctgagcagtaagacagttttctccgttttgaatcttggacgttttctgcctttgtatcctgtactacactgcttgtcactttcacatcctatggttgtgtcttgtttgattattttgcctagaatgttcatttttttgcctaatttttatgccaaaggaagtctcccttccttaaatattccaatggatttgctcaactggttaatatactcaatagcaaaaataggtacttcagtaacagttgaagtgtttgggactttctgagggtggagggtcggaacagggagaagatcaggaaaaataactaatgggtactaggcttaacacctgggagatgaaataatttgtaccacaaacccccatgacacaagtttacctatgtaacaaatctgcacttttacccctgaacataaaataaaaattaaaaaaaaaaagaaaatagttgaagtaggaatgaatgtctgtagggccaatcaggcttacttactttgaatatgttatgcatttaatttattttagaattattaatgaaaataagccttctgttagtagaatatgtgttttgggagtatttgagctgaaagttggctctctactttctcttgggcatgctctaccactttct

SEQ ID NO: 33893 - DNA, 1034 bp, Homo sapiens
ctgccagttcatgaccctgagattggagaaattaataagaaaaatataaacataattttaaaaataactgatagaaaatccacttgggaacacataatttttaaaatctaaaatcatttaatgataaaatagtatgtggtcttgccaaatgatctactcttctactgtgaaaaccatagattattacagatttgtaaagttgttgacactttaaaattaattttatttgttaaaggaaacaatttactaacattaaactgtttagcataaaataaaacagcatgcagcatttcattacagcaaacatgaaatatgaattctaaagaaataaaatatgaaagaaatgcattctttttatagcctgaaaagacaatattaatcaaaataaccaaaatactttgaaaatcaatgttgaatgtgaatgtttctggttttctttttcttggacttgtatttacttttgtcaaggtaacataaagctacagtatatatcctctgtaacagtaaaactcagaatgtagattttttttctgagtatagtgcctaccctagtgcttaccctacttatctttataccccatagagtttaaacccgtgactagcagaagtgagtgctcactgatggaaattaaaatgaatatatgcctgaatggatgaataaataaagttaaccatctgctccttcttgttcgttccttcagaactctttattccatattggttagattatcacttttcaacccaggggcatggtggggaaataggaaggtatctggattgacataaatcctgagcccttgtcctggctctgaccctttctagttatcagacattaggcaaatcactgaacttctctgagcctgtgttctcacctgcaagatgaaagggttagaatagcatgatcccaaaagtatgcttctatattataacatagtagcccatgtgtaactttttttttcctcttaatctttacagtttgtcaaatctctgctccatgcttttcttgggtgtaaagagataattaattatttctg

SEQ ID NO: 33894 - DNA, 1027 bp, Homo sapiens
aagacaaactccatcataggtcatatttcttgcctctcccgccattctaaccttgcaccactctctaccatgctctttgcactccagccacttggctcctctttctgcctttctggtatttcattgtctctgtgtcacaggatctttgcacattctatttcttcttttggaaacattttctttactctttttcgtcaaggtaacctccatccacttaattagttcctacttacccttcaaattgcagctctatagtcacttctgtagcaaaggcttccccaatctctagttgaggaaaaatgtttttgggctatcatagaataacgttctcttttggcctggaacctactcagtatgtcattaaacattcatatgaatatcttctgtctcacccattatactcttgcctattttgggccattttgcaccctgagtacctggtacttgcctgatatagaaatacattttatatatataatatacaggtatatatatgcacatatatatgtgttctttgaagaattgttactaaaataaaaagataaaaagataggagattgatctgaatttccttaaatcgggagctatgaaatctatcattgaaaaattataaagtaaatatgctaaatataattatattagtaaatatctgtatatttagtaaatatactaaatataattatatttatatactgtatatactaaatataattatatttatatactgtatatactaaatataattatattatatttatatactgtatatactaaatataattatatttatgtactatatatactaaatataattatatttagtatatttactaatttttgtaattatatcatataattgtattttgtatatttactaatttttgtcttgtattttaaattttatatataaattttataaaacttatgaaaatatataaattatatataaatatacatagtaaatatcaaaaaatatgtgttccagccttgtctctactacttaatagcaatgtaaacataagcctca

SEQ ID NO: 33895 - DNA, 1023 bp, Homo sapiens
caaggcttttttgatattggcataaggattgacaaatagattcatgggacataattaggagtccagaaatcaacccacaggcatagagtggggttgattgttaaccaacatgccaatcaattcagtggtgaaatgtttaagcaacattgctgaaccaattgggtccctgtatggaatcaaaacaaaaataaattttactctcatctctcactacacacaaaaattaattcaagatttatcacatactaaaactaaaaccttagaattagaactcttttagaggaaaacataagacattatcttcataacttcaggatatataaagatttcttaggtaccaaaaagaacattttggactttctcaaaattaaaacgttctgctcattaacatacaacattaagaaatagacaaactatgaactgtgcaataaattctaaaacatagatccgaaaaacgtataaatatgtgaaatatgtaaagtgttcaaagaatacacatatttaaaaactcttaaaaagcaccagtatgaaaccaaaaacaattttaaatgggtgaaagccttgtccagaccattcacataagaagatatataaatggcaaataaactgtgcaactttattagtccacagaaaaatgcaaatttaaattacaaggagatgccaatctgcatccactagattggctgaaggcaaagactgacaatccaattgcacctctgatactttgctggttggaatgtaaaacatacagccacttaggagagctgtttggcaattttttaccaagttaaatatctacttaccttgtatacctcacctatttcactccagaaaaatgagaatgtatagccacacgaattcttgtacaagaatattcatagcagcattattcctcatatccaaaactggaagcaactctaatgcccatcattttgagaatggttaaattaattttcatacagtagaatactattgagcaaaataagtaatgaactattgaaatatgaagaaacactgagttaa

SEQ ID NO: 33896 - DNA, 1029 bp, Homo sapiens
aatagctaaacaaatataattttgttagtcttaccttattagcccaaatccaatttctttgagtgatgacaatgctaaaaaattgtgttttcagtgaaattggtgttctgtgtcctccaagtccccctctacctttgctttttggcaaggttcctttcccctctcctctgcgaaatcatagcactcaaaaagatactggagcaatctccttaggaagatcccattccgctgtctacaattaggacacttgttagccctctttaatgggataaaatatgggttcattctgtatcgtgtaggcatttctctaatagagctgttattagtaaattgtgggctcataagtaaattgatattagtgtggatcataagccagtagtatcactgtcacctgggaactagctagaaatgcatattcttaggcaccaagctgatctactgaacctgaatctgcattttaacaagatttttatatgcattaaaatttgacaacactttgtctacaccagaatggtattaacactgaatgatggccaagaaaaaataaaatgtccagttgcaaaactgcctcagtctaaagaaatgatgtatatggtgacagtactaggctccatgtcagggcaggtgaagctaatggctgtttaggactgtagcggtagcatatcatacagtcatcattttctcagtctttgacaaaagttattccttattttactggaaaaagtttacatcataatgcaaatttaaaaaggatttaaggaacagtacatatatttgcaatgacagagaaagggaaagagagagattctgagaaacttttatttaagccctagcagaattttgacctcttagaaatcaagcaatagaagtatggctttgcctttaacttctgaggtttgagcagaaatgtaattttccagcctctcatcatttctgtgacctttctgaatttcttcacattcttcattattactggagtttagaactgagtatatctcactactttcttaggaaaggccttaattaata

SEQ ID NO: 33897 - DNA, 1037 bp, Homo sapiens
acctatacatttgcaggtctcagtttctttgctttgtaaacataggcttcttgtaaggattgggattatacactgaaaaagcttagcacagtattattactattatgctatctacattatattataggtgaaacactacagattataatacatacaatatatactaattgtattatatattgttattttttgtcattatgctatttactattgttctatttaataactctctagataatttaacaggacaaaggtacagaacaatctggcccttacaagccggcggagacgggtacgaattaccatgacaacagcgcgcgcctcgacattgtcggctcgcgcgttgtttgggaagaaaaagcctaggctgcgtgttgcgtcatcattacgcgctcttaaggtttctccgtggtgttttggaaggtcccggcacggctaccgtcgccccacgctaggaaattttttttttattttcaacctttgttacatagcactgaggctacaagatcgtaagtactgagggaagaaagaacaagcgagcgattgaacgttaaaaagatgccttagcatgcactccacctctgaaccttcctgtgtgttcttaatcctatcagcttcctctcagctgggatcgcgccgcgtcaacttccgggcggatgcccgccagcacggcctccgccgctccccttctttggcccctttgtgtccccgcagtgtcgaggcgcgggccctggcaggtcctttctcgaggcagggggcacggtagcacagggagcttctctttgtgggcgggcgcgaggcccgctagggggttatactggggaacgtgcctgcgcgtgcttgggtaagaggaggttgcatgagggtcagctcgtggtttcagtaaggaggggcgggcgggggaggcggacgaaggggagtgaaaagcaatggaaaattttaaaagatacccccgtccaccttctaattgttgcggcctaacaatgaagcgcagccataacagtcctgagccactggcatgtttgcgggccctttat

SEQ ID NO: 33898 - DNA, 1050 bp, Homo sapiens
tttggaaggccaaggcgggcggatcgcttgagcctaggagttcaagacaagcctggcagaaactctggcagtagataaaatctcctgggaaacatggcaaaaccctgtctgtacaaaaaacacaaaaataggtgtggtggcaagcacctgtggtctcagctactcaggaggctgaggtgggaggattgctagagcctgtaagacaaaggttgccgtgagccaagatggcaccactgcacaccagtctgggtgacagagtggaaccccgtctcaaaaaaagaaaaaacacacatattctgttctttggaaatttgcttttagatgttcttaggcatcacatgttgtgccataaaggacacaacagaaataacatgagtacatatagagaaattgcatattctagatatgtgtctaagagagctattcagaaatagaattagcagcatagcaaagtctgagttcactaatgttaagattatacctaagtatagtcccatcttgctttcattctctgatctctataacttacattcatttgttactgttctagttctgatctctagagtgcctaccatgtttgaaaaccaaaatttcaaaatgagatttttttgtttagggaataaatgagtaaaatttgactcaaaatgtcttttataaaggataaacatatgaagttaaatagaacaggaataaagttagttgttggagaataaaccctcatatgaaataaatattccctgtttgctgaggaaatgttttgtttctggcagagattcctatattcaatgggaccattctgattttagcagttagatcctgatcacacctaggtaggcctgaaaattactttatctttgtatccatttaatcttcataatttcttaggagtagcataacttcgtctgacatagagagtattggtgaaagaagatgagtaaagaggaagtgggcatgcaataaatgcgtgtgagtcctaacaaaataaatgctaggaagttccttttgttcgtttccatcccagctcagggttgagattttttcagtgtatac

SEQ ID NO: 33899 - DNA, 1032 bp, Homo sapiens
ataagtagcatatgtagctctagtttgttttcttccagtcacgacaatatgcagatttcctgttactgctgtactctatgttatattctcttgtttttacattaaaagcatttgttgcttaagctctctgtatctctatcctcctcatttgtgaaataaaaatgttacctactttgtaggtttgtgtgtgaaaagtaaatgaaacaatagtttataaaagaccttgtgcaaggcctggtacatagtagactcagaaattgctggtttctgtgatggtattcagataacttacacttggtgggggtcagctttatttcactgctcaacactcagccacttggaagaatccctccctcctaatgttgctctgtagaattactcatcaatttagagatgtatatttttagattaaataatgtgatggtttatgaatatagtattacagtgatttctacttctgaaagactgcaaagaatgtttactttttttttcaattcagtcatatgtagaacaacaaacactgggcctgatatcaagagaactgtctagtattcattataatacatttttgcctttgttttacattaaattgattttttgctatttctgtgcaaagtttgagtgtgctgctctgctttaaaaggtggtgggcccaggaaaagaaaattatcttcttcttcagagccatatgaggaagatgaatttaatgatgatcaatctataaaaaagacaagactggatcatgtaagtttacatttgaattacagtatcaaaattggctgcttaaggttaggatatgtggagtttgtggatattattagacctgaaaatccacctaaatgaattcctttctatcacaactaagggaatttacgtctacatttaatttgtgactgtttttgctttttaatttatccagtatgaagcctgcttaagcacagactattttgtgtctgtggatatcagacctgaaaatttgtctaaatgaatcattctttcttttctttcacagctaagccagataatttgtgc

SEQ ID NO: 33900 - DNA, 1040 bp, Homo sapiens
tttgtatttttagtagaaacggtgtttcactgtgttggccaggctggtctcaaactcctgacctcgtgatccacccgcctcagcctcccagagtgctgggattacaagcgtgagccagcgtgcccagccataactgacaatcttaagaggtattttataaaatgaatcaagcagtacacaccctaatgaagtatatcttgcctccagtgtgcagtgagctcccaatgtccagtctaaagaggcagataggtgcggcctttcttttttcttaagagtggagtttgcaacatgctccagactacactcccacgaaagtggtgggcctcagagtgaggatggttattccttcaccctgatatgtggcatgtacgtatctgaccagtaccattgaaaatacccactacctgtatcaagtccagtcaacatgatgtcagtatagtggatcaagtgatactctctagactgtgcaaaaccatctaagtccatgagtactgtattatttgagagagccaggaaagttactctaactctgaagactgaaggtatatcattaaacctgccaagataaaaacggattgtttctgtttgatctaattgggaaaggggaaaaagcaagtacttgattgataactgcatagccatattgatttgctccagcaaaaataccacatcctgtaaagcagctgcagctggagtttgattgtttatgatactcttaaatacttgcaagactcatctactttttgtataggtcaaggaggcatcttacattgggatgggatggtggtgtcaatatctgcagttcctttaggactgtagtaattgcttattgttttgattgagagggacaattctagggacttggatttggtgtttcctataatagtagcccatacatcatgggtcagggaactgatatagtatgggatttctgccagtgccaaatatgtctgttccaactatgattctggagatggaaaaataagcactgggtcgaatcatatcccttgggcccgctgagacagatacagtcccaaatt

SEQ ID NO: 33901 - DNA, 1043 bp, Homo sapiens
gtagtttaatatatgtagtattctgtgttagcaagttttttctgtaaaagggaagatagtaaatatttcacactttatggactagatggcctctgtcacgtattctttgattttgttttttaacaaccctttaaaaaattattaggtcataagccataatttacctgttctatatgttaaactatttataaataatctttcatcatctcataaaggtgatacgaggacacaagttacctacttataaaagaagaccaatggttttcgtattcattgctgttgataatagcggacgtcaattatttaaattactatatcatttatcacagaatgttaaattattaataatggttttaatttatctctcctcccttcacctttcactggggaggatagacatgaaaggagtggctctttaagaaaaagctaatataaattttaccttcattcacaggcaaataaccgtttgctgctcacaggcacacctgtacagaacaatctgttagaactcatgtcgctgttgaattttgttatgccacacatgtttagtagtagcaccagtgaaatacgaagaatgttttcctctaagacagtaagcataaatgcatattttctcccaaatatgttatttgtgttttatctgggccattcttctgttaggtctcttttgttgttttcatagtgcatatgctctatgaagtaactttaagtaggtgataactctatatttggattggtttggaaaccagccaaaatataatgggaaagaaaatagcaatttccctaatcaatggccagaagtcttggttaatatcctaattttctgaaggatgacgattttaaattgatgaagagctcagatatatagtatgtgcggaaagtttgatcattacatcatctgtatcaaaattggctacgtaaattagtaacatttctttatgggtaaactataaaactagacaaagctagaatatccagaaaatgcctatgctgagaaatatattctgaaataaaagttcataaaaccaaagtcacaactaaaa

SEQ ID NO: 33902 - DNA, 1047 bp, Homo sapiens
tatatgaccatgcatctaattagtcagtgcaagaggatgacaaagatggctaccttaactagcttacagtttagggatgatgtgtgatgtgggagaaggtaagcatgtttatttcaaaatactaaaataatttttttgaagtttcttaagttcaaaatttttatttttgtatatgtttttgaaaagaatatgttcaaaactcagaaatgaaagaacagacgcctcctagtcgccccatctcccaacttccccaatagaggtgacaagtgttagccttttgtttttgtgtgtgtgtgaccagttattttatgtgtataaaaataaacacgtgttctttcttttatgggagaaagggtgcatgtcaacttacgatacactcttctgcatcttttcttatttaatgttaaattaattggaaataagcaagttttttcattctaattcctaatattgataattgttcattttaatttagcaaatttctgttcatgacagacactgttatgtctgtgttatattaggcactctgttctgtaaaaatcaatatactttaatctgtctacagcgagagagaagtgcgtatgatcaaataattactagtctttcttgcgtagcatttatttcagggtgctgtggaagcttggggaggtgggcggtagagaaagtttgagtaagaagcaactgagatctttaagagtaaggataagtagagtgatcatagttaaacaattagcagtcattactaggctttgtgtgcatgtggcaacttgccagtttcaggttgtccaggaaatacagtaaagtgaatgcataaggcagattctctttgggcaatgttttccttattattttggtagggcagcttttagaatttagtaaagcatttaaattctttttcagcaatactagcaaatatccaaatatatggattttattctaacaagtttctaaatataatagaaccataatagttgataaaattaactataagtcttttcttatgggctagttcatttcctcagagggaaatttttcaacctcctgtga

SEQ ID NO: 33903 - DNA, 1073 bp, Homo sapiens
attatgatgaccatggggtttatgaacatttataactttttataatttccatattacatttctcatagtatggacaactttttgccactaactgaattctccaaatactcacacgtgaaatttcaaaaaagaagccacaaatatgtagttctgaagatgttgaataatcattttacaaagcagttttctgaatggggattagttggtgattgtttgtaacaaatatgctaatgctttagaaatgtcagtatttttgtaattatttctacctccaaatatatatatattgtctttcactggataatgtgtgtagatttttacatgtgccttatttgacaatgcttatgtcttgtttttgcttgtctcatttgaagttcttttttattatgttaaagaatgcagctgtatagattatatagctttcattttattgctatttgaagcagatgttcaccaatgtcagcaagaactcaacctgaatttaaaggtggcattccatatactaacatcccccaggtcctctcaagtacttctgctgaaacaaatttatttggctaggcactaagttgttttccagtgaatagtaactaaagaagcccctaccttgctccatggattaattccttctgttcattttccaactgcactaattgtgcatattactctgcctaatcttgtgcatgttttcattgatttccctctcccggcttttgcttctcttgaaactgttgcccagtcacttctgctccaattctcttcctctctaaatagtagtttattactgccacatctccatgcatcagcaaaatgttggtgacatttttctagcctggcagaacagattacttaaagctatttcatttcaaagcagactgaatgtgacttcatctaaaggcagcattaggtactgcatggaaataggtcattaacttgaaactcttatcaaaatatattttaccagtttccagaatttccagtacaggaccgcctgaagagagagccattgttcaattccaattcagtgtgagtgacaaagtgaaatttagaagtgaagttgtctatttgatatttaa

SEQ ID NO: 33904 - DNA, 1030 bp, Homo sapiens
aggtactagctccatgttgtgatgctgatacaacagaacactgtgtacatacatatgtgccctcccctggcacagaagaaatgctttccttgtgtagacagagtgctaattaaaggattttgaacatactgattaaaagagactatggtaacaaagctgctgagttatttctgttctcttacaaaagtctctgccatctactgtgacctttttgggccttgtgcagtggggcatgcaattcattctggactggagaggattggaaggggaggggaaggagagaagggaatgttggctcaatcgggctgctaggctcttggcctttcattgtagttatttttaaccccttgtgtggtttaaatatgcctagtaacattgcctaataaaggtttgcgtttaataactaatttatattgtggtaagattgttaatgttataaatttttaacttactctcatcttaattagttctttggttatactttttctgccttaattatgtaaaattactgggatattactggtcatcaggttctttaattaatagtatcaagaaacaattaaaacctgaaagcatgcttaaaacatgtaatttaatgattcacttactttaataatgcacatgaaattcttagcaaggtctggcagtctctcaattatcttttataataatattataaactttaaaaagaaaactatttagagacttgaaacattaaatatttaacccccgtagttgtagggaacatacagttatggttttgttttgtttttttaaacttattgtccactgaaattaagaaaggaaaaaaaatcagaagtttgtacttagctgggaatctgcatctttagagttcaaaactgtgcaatttttcctctgattaggtattattatgttgaactccaaagggtcatttacattcctttataacactggagctctggtgtatcgaattgtgttatgagataagccactagcagggacttgaacattccattttctttagattttgttgtatcagcatgtgaat

SEQ ID NO: 33905 - DNA, 1077 bp, Homo sapiens
gccagctgcagtttccctcctaccggaagacagaaagactttcagtcctcaagctgaaatgagagagccatcctaccttgaataaatgggcccattgttaattttaagctcttgagtattttcttttatattccctccaagctaccctgtcattatgccaagttagaaaattaatttagtttgtataactatatgatgtatatttcacatgtgtgttcactctgctttaaaaatattaattaccttttgtgtgaagttcagagacctgtcttttcccatgtggcagttttatatgttttgtggtcacaaatgtcaggaatctcaatgtaattctggataaatttttctgctctatgatttgtaaagaaatgaaaatcttatattttttaattgaaaattagtagttttagaaaaaaacgcacttatttgattttagtaaacgttgggcattttgaaaagttattcagagaaatgttactggtaggcaggacttttgtatctgatggaggaaaccgatgtagggtttggataaaataagactagcaggctgggcacagtggctcactcctgtagtctcagcattttgggaggacaaggtgggaggatcacttgataccaagagttcaaggttacagtgggctgtagtcatgccactgtactccagtctgtgccacagaaccagaccctgtctcaaaaaaaaaaaagaaaaaaaaaaaggtaagaatagcactttagaccttgggaaagaacgttttcatgtaactattcatctactcgtgagttaggtatatctacctacttaaactaagaatagatagataatagataatgtacagctgtatattggaatgacttggatttaaatcttagctggaaaatcagttcattaatttgagcttctgattttctttgatgtatgggaaatgctttataaattaaaaagtatacaggtagatttgattattattaataatttggagcctgtgagctttcaattttttttagaacttctgaggcaaagagcttttctttatgatagttgctagtcacactacatgtgaatacacagttgaacag

SEQ ID NO: 33906 - DNA, 1041 bp, Homo sapiens
gaagggaagcaggagaaagcaggagagttgggcacacttggtgtaacttttattgaaaaaaatctgtctgtaagtagacccgtgcagttcaaacctgtgttgttcaagggtcaactgtatgtgtggttttgaattctagtctttagctccttttaaatgatgtgacaaggagactgaccattatgaggtgttcactatggtccgaggaatggcaaatttcacccttatgagactcagtgtgtttttattatcaacctttattagctaatggaagttaactgaaatcaggtaggtttatagagtgttctgtagcatagtgagtcaggcattgtgaaggtatactaatgtgtggcacaaggtagttactcattttagcctagtgtgagcagcagagtgtatgtgttggtaactatagtaacaaaaagagtaaggatgccagggatatttatatttttttgtagtaaagatgaggaaaggaggaatttctctttagtgtgttgctgtaaatgttaaatatgatgagaagagttttgaattagagaagaatttgcaacacttgttatttggattctgtgaattgttaaacatttttttccccaaggtccagagattgatttaacaatggccactgtacttcatgataattgtcctggctaaattttaattgaagaaaagagaaagtagttacggtaatgacattaacaatttaatgctgtttaccattgattggatcagggatttaagtgttgtgattcagttccattgagatctaattaacagcccagtatttttcaaatgatttctgggatattaacttttggaagtggtagaattaagagatttagtaaggctgtataacactagccagagcagactatgttctgaaagtatgtttgttctgaaagtatttttcttctgagaaaacgttaccggaggacagatgtcctttagaaaacaaatgttttgtcccttaactaggaccccttagaaatgttctggagaaagaaattatatctagctagctagctatcgtgttacaca

SEQ ID NO: 33907 - DNA, 1051 bp, Homo sapiens
catggccaatgtaatatatatgtagttaagaaattatgtgaagtgagtgaaccgcatggagttctgtttagttcataaaccttatccataagaaatattattggctgggtgcggtggcttatgcctgtaatgccagcatttgggaggccaaggcaggcggatcacaaggtcaggagttcaagaccagcctggccaatatggtgaaaccctgtctctactaaaaatacaaaaaaaaaaaccccaaaaaccactagccgggcgtggtggcatgtgcctgtaatcccagctactcaggaggctgagtcagaagaatcgcttgaacctggaaggcggaagttgcagcgagccaatattgcgccactgcactccagcctaggtgacagagtgagactccgtctcaaaaaaaaaaaaaaaaagaaaaagaaatattatctctgatggctcttttaccttttaaaaaacatgaaatcatgtgacatcggtgtggtgaaaggtcagtcaattacgaattgggactcaggatgaagaggaggtctcaaaggcccccctcacgatcaggaaggcggaactggggactcagtgcatttctttgagattccttagatgaatcctatacatctaagttctgccaccaggatattagttaaaattcttatgttccaaccactcagtacagacctgtagcttatcgtctgtgaacatctaacttagtattagcatttctttcctcaaaatagtgtacacatttttttttgttgttatttggagatataaccaaataataaaggatactattaaaaatcctttagcttttggtaagttaggcaaggttttatatgtagcctctacataaacattctcttatttatagggttaagtttcaggagataagagaaagatcttttgtgagtaggatacattgaaatattagactgtaagtgagctctgtagaccaaaatgctgaaatagcttttctcataagaaagttttgtgtgacaaacactgcaatttgcctatcagatacttttcatccccttttttcttactagaa

SEQ ID NO: 33908 - DNA, 1029 bp, Homo sapiens
gtatttcacgtacttttctagtgtttattcttcagtttagcttttactacttcttctttgcttatttgtttttaattcttaggttggaggatgacagtttttcagaaggactaagtctgattgattatgtcccccatccatcattaaaattagaaatgctgcttaggagtgggaaagaggacaaacatgtattgacatgctttgtgaattttttttttcttacatatatcattaaatccttatatcaatccattgaggaagaagttagcctatttcaggtgaatatataatgccttagaggtatccaatcttttggcttccttgggccacgttggaagaggagttgttttgggccacacatacaatatgctaatactagcgatagctgatgagcttaaagtagtcacaaaaaaacctcataatgttttaagaaagtttacaaatttgtgttgggctgcattcaaagccatcctgggccacatgcagcctgtgggccgtgggttggacaagcctggcctagagagtttgtgtgatttgcctaacaaactcagatcagttcatagcttatgccctccttactttctttgctgtggcaaaggacttaatgactagtctcctagtagatatttgataagatgggatagatgcataataggggtcactcttcctctacttatgagcaactgcatctctgttaaaaagtacttttcattttttactctcccctgtcagtattctgtaataaaaattatacctaaattattttctgtgtgctttaaaaagatcctatatgttagagtgaaaggaaaaagggggggaaagcttataggttaatgggccactagatagaaacattcgtttggatactgacttgtgtatatggtttcccatcctaagccagaaagtcatcttttatttttttcttccaaatttataaccctattgactatatttgctagttcattcctatgcttctatgtatgcattctgtgagtaactaaaaattctggaattttttaaaaaatatgt

SEQ ID NO: 33909 - DNA, 1056 bp, Homo sapiens
ccatggcttagatgtagtcatagaagataccaaatatatatttattgctttgagttgtagagtatgccacttttataaatatggcaatttttgctactgttgcctgataaatttagaaatcatttacaagttattagtgaggtaaatagtgacaagctggtcattgtcctttagttaatggcagcagtctccttagagttccagataaacatttttgtccatagctcaaggaatttttgaaaggattgaaattcaagtcattcccaactgttttccagtggctgttgttgctattatagtctcaaagactgaaatagcttaggctttatgtgagttgaaaagtacatgggagtgattggccatgcaaaacacggcagagtatttacactgtcaaattcttttgtttaatgtattttaaagcctgcattttcattgtaagtcagctttaaaataggttttcaaatgttactagtcctacctaataacttctttttacctgccgtgatccctgttaatactctttctctgaaattgaaatgcggatgaaaaatggtctttcattcattttttttgtttgtttatgaacttttaatttcttgggtaatatagtaagggttcatttccacatcacagtaaaattcacagggaataatcctgcattcaaatacctctcttacagtcaagtctgcctttatcttggctgttctggctgaagtttatagcactttttcctgttacaatgaatgtgagggactttccagattcttttgttttactggaattaggctttgaaataataggttatttattagtccagaatgttttcttatcctgagaatttctggtacacaaattattcttaaaacagaaaagtatttttatgttttgaaagaaaaattttacatttgaagaggatttaaataaataaattataacaatattcttgattccaagaactttagataatagtatttcttctgagatatgagagaaaaagtgttcaagttgttagggaagcagcttgttttttagtgcatagtaggaatttagtaagta

SEQ ID NO: 33910 - DNA, 1067 bp, Homo sapiens
cctcaaaatccctccacttgattctagggtgccaaaatgtcctctctcaactgtacatatgtagagcttgaataaaccttatgtaactgaattaaagaaattggaaaagtgttgatgtaatgacagattgggatgaatgatgatggtaggagagagcagagtagcattgtttagtcactggaagtttgagattatgaaaaggaagaatttttaaaactaaggacagtgataaagtttgctgggatcttcaagaagagagatcctagtttagagggattccatgattaaaagacagggcaagtaataagtcagtacaagtactcagttttcccaggaatcagatgagatgagctggactggaggttgggatcaagcatagattaggaaaagaagcttgaaacgattgtacaaaccttagtaatacgtgaataagtaacaagatgaacagagttccccaagagtacttatatgtgtctatgtataatatatatgtgtctatttataatatgtaattcataccccgaattcatttgcagtgtagaaaaactgttacatgtgctttaggctgaacttgtcggctaaagaggacttatatgggaaatggaagaatgcagaagaggattggggccacagaggccatgatatatgaaggaaaaaaaacactgtcttttcctcatttcttttcttcctctcttctgtaggcatttatttaactacagtggtatgccaggtctacggtaggattagggaataggtagataaaagaaatgcatctctcagttcaagaagctcttaatggaaagaaacagacatataaagtgacaatatttataatacaggtggacgattctcagaatgtaggtatgtacaagtagcaactggaacagagagaaaggagtgtagaggagtcaacatgttccaggagatattgcatgaattaaaacttaaatatagaatttgctaggtggttgatagtaggaggaaagaggccattctaggcagagagcacagcttaagcaaaggtgcactcagttctgagaacttgtcagtagttcagtggggcaaaa

SEQ ID NO: 33911 - DNA, 1033 bp, Homo sapiens
aacataagtcataaaatgtatgtgggttttactatgtattggtttaaaagaagcagtgcttgggaaaatgtaatttatatcagtcaagactggtagaacacaaagatagaagagaaagcataaacatttataccactagtgaataacatgtaaaactgagttgatgtccaaatcagtgtcaaaagctgatggtaaagtctcttaagaacctttatgatttttctagagttttaattcaatgttgctggcaggttcagacctctatatgtacagttgtgtgtcagtggataatagaaagtccacacatctttgaaatttgttaagagagataaataccaactgattaaatgtcaccattggtgtagatgttgggaatcactgtggtataactttcaaacctcacttttgtgttccattggtattgacactacactggctcacgattactagctttaaaaacaggcaaaaatcacattagataagaacttaaaataattttattaattagcttatggttattctgaacgtgtactaaaagtttttttggcatcacaccataaagtcgtattggaaattcgaagtatctgtcttgggacacatccaagagaattaactactgaattatcagagcaacttcattccgatgtagttgtggtctccctaattgaacagttttatgttttttatatataggaatattgcataccagtgtaaacatccccaaaccctgttttatgttttgtccatttaaagttaaatttttctggacggagacttaggctatttactagattccagtgtaaaaatgttagacttgtaaagggggagaatggcgtttggaaaaataaacatttaggttagatagaatttttttttaattcaagattaagattcattaatctgttaggtattactatgcattgttctaggtgtttctaaatgcattatgtgatttgagtctttaaactctcatgccaagagattacatacctttctcaagtcacacatcttataattaatagagctaagattt

SEQ ID NO: 33912 - DNA, 1116 bp, Homo sapiens
tttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttgtccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcataggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaatt

SEQ ID NO: 33913 - DNA, 1071 bp, Homo sapiens
tcttacagaactacatataaaatccttttgccagcaaaagcttaatttggattggcggtttccctttttgggtatgctcagacaagatcttggttatatcagaaacacataggtactgatgtattattagcaggcctggtgttaattagggagaattaccagaaatagtttgcttcgtggaaatttattgcagaatcacacttgactgatggcagaataggagttgctgagagagagcagctcccactcataaccactaattaatagggtgccaaaattccgcagagaaagtttcatcccaagtgtgggagcctcccagggaaaatggttcttttgcagtatttaaaatttaacagaggaaaggtgctaggacacatggctacctaacagaaatctcagactgatatggttttgtgttgtacgtatgaatgagaggatttaactcagtaagtaccgggcccaaatgttgcctgtgtatttatcgtatatggagatatgcatattatttttaatgcggcaagtgcctgatttgccaaactattcattttctgaggagaatttacaggactgtataccatttgtctatagtattatattacagaacttttgattctgtgatttagaatctgtctgggtaggtggcaagattgcatcaatgattaataagaaaggtgtagccttcataccttgaacacagggttggggaaaagtgagatgcattttgtgattttcgctaaaggtagagcactaggggagcccttttaaatagaagtttgccaagaaggcaatttttttattttgtcctgtctgtgactgcatgtaataacacacaataaagcttggagctgttgtttagtgtagaatgggatatttccatgtccgaaaaccacttgtctgaccttggggagataaataaagcaatttagaattctcagggagtataatttttcaatttctcaaatatggtaaatacagttcccaaggaaaatgacttctatgccaggtccttgagttgattgacacggtctcttatgcatctgtgtttcaaaggacaaagtttctgctctttct

SEQ ID NO: 33914 - DNA, 1050 bp, Homo sapiens
acgctgcagttcccttgagttattagaaactgctcttttcttagccacctttccagcaaggtgaggtcagtgactacgagcggccacaaaggtgccagtgaaagacaacggaggaagagagccgtttcactacctccaacagataaagaaaatgtgttaataccaaacttacctgcagcaaagcagagccacctgagaaaaggttcttgagttctgcaaagaaacataaaaggctccactggaaatgagagggttcagctaaaaagtgtttgcaaataatttgaaaaagcacttaatggaaatctcttgctgtgctaaattgatgccaacgaatctctgttttcttacatatatttttaggattccagtgacaactctcctaattattgttttgggcaagttatgggaaatgtcctgtgtcaactgggatgttagtatttaagaaaatattcagtctttgtactttatacccctttacactctagtgatcaagaagaattatttctagctgtaaagaaaatagtaaaggattcgtcagtaattttaaaacatgagacatgccggtgatcaataatgtttttggaaaactttcattataaggatgttttgaaggatgttacatcttagtgaaatatgtaagttattacacacttagatcattgtgcaatgcaaaaaagtttgtgttataagcagatcatagtagtgatgtctttttatgggaaacatagctgggaaattaattgctctgattttcactgttttctttagtcatgcataatgtacctttgtgtttagcaaaatatggcctagagctacaaaacttgatacagtgtgttatttgtccaatctgaattaccatttagaaaaccaccttttccttttagttacatgatataagttgatatgatctcattactcatgtgctaggggccgctgatgaattttaatggcactgatttgtgtttttaaatcaaaatgttagtttttggtgagttaaaatcttgatttatgtcatgttagtgaatcatcactatttataggggctttgcc

SEQ ID NO: 33915 - DNA, 1062 bp, Homo sapiens
ccactgacttggcatttcacatgctggaaaaacttagtatcttttgcagacctggaaaatttaatctatatttcctcttttacatcatttgtaaaaatgttaaggctacttccagcaccttccctgtttatggttttcctgccaaaataattccttttttcactgtctttgtttctccagtaaaaattcatcgaatcctatgatgactcagttcattataataacttttgtggtagtaccttgtcaagggcttttaaaaaaaatccagtggattatattgactggtttctcccttgaggctctacacaagttttaacttaccgagacatgattagccctgcaaaaaaaaaaaaaaaaaaaaatgaaaagctagaccccctcccatgattatatgtgttaaattcttccgtgaccttatactttagcatacacagaccttagaaatttgtcaaattgctaagaagtaattataacacgaaattagggaaacgtgaggggctgtggataaaagaggtgacattgagacttaatgtagatggttgaaatgcaagtacatacaagtagcagcaggaagaaaaagcagatatacacacacatacaaaccccgagaggctacggtggttttcttttatatgttctaggcagtgcgtaggcctgtcacattgaagatagtagttactgtcaacccattttacagatgaaggattttaatgcacagtgaggttcagccagtggtagtgctggattctaatgtaggaccctcagcttctaaatccatgctcaaatgttggaggtctgttagagccagatattatactggttattgatgaaacaaagatgactgacaatcagccctggtggttcatgagcttgaaagacccctgaggcaaggagacatgtgtgacaactgtatgagatgataattgcatgtggaaggtgctgatagagcacagagaaaggttgataattaaagagccttcgagataaagacttgggttatcaatcatatcctgaggagagaggtggataaagagagacagtgtttaaaatatatggaaaaat

SEQ ID NO: 33916 - DNA, 1050 bp, Homo sapiens
tgatgaataggaagtttaaaattattcattttaaaatgggatatctgcctcttggggaatcacaacaaatacttgtttattaaagattctgagaaattgtgcggtaggaaaagaggatctgttaaatcttgactgtgaagcttgtaaaaaaattgttaaatatctattgatttctaatagaaaatagtttttaactatggctgtacctatcttactgggcagagttgtggccatgccagttagagcctacaaccaaagagaaatcagacagatatttgaataacttttcatataactttctttgtaatactttttttttttttttttttgccaaggaccattaccaggctgtaatgaaggtatttttcaaagtaagtgtgtagttcaaacctattcatccagtatttactttgaactgaacaccaggtaaaaatcattttctttgggaactattttttggtaaagtagtttatgtgatgtggaaactattttgtaacacgtatgcctaagcagtcggccttttgttagatccaattagagttttctcttctgattaaatgtgagactctgaaatgtttcgcttggctgcaggcaaactaaatcacttgggacctcttctgcgtcagctttctgcagatggagagtataatattaatactatttatgtttacataattctggaattcattatagacagaaatagccaggatgtacacttttctggagtaatgtaataactaatagaacttactttagagttcttctatgatctataaaatgaagaaatagccatcttgtgcctgtaagtatagtaagacttagaattatgtaattgaagaagcacagaattttggagcttggagaagctcagccagtgtctatatataccatatttagaagcagaggaggccagagaagttaaataacagttttaggatcatgtagtgagcgctagaatataattttatctttattggtaaactgaacagtaagagctaattaactttgtttttggtcaaaagattacactgacactcagggaatctgatt

SEQ ID NO: 33917 - DNA, 1052 bp, Homo sapiens
aattcctatctctgatcatatatatgatggttagttaatactgagggtcaacttgattggattgaaggatacaaggtattgatcctgggtgtgtctgtgagggtattgttaaaggagattaacatttgagtcaatgggctgggaaaggcagacccacccttaatctgggtgggcacaatctaatcaactgccagtgcagctagaatgtaagcaggcagaaaaatgtgaaaagggagactggcctagcctcccagcctgtatctttctcccgtgctggatgcttcctgcccttgaacatcggactccaagttcttcagttttgggactcagactggctctccttgctcctcagcctgcagacaacctattgtgggaccttgtgatcatgtgagttaatacttaatgaactcccctttatatgtatatatgtatctatatatctatatatctatatctatatatccattccattagttctgtccttctagagaaccctaatacagtatacgaacatcaaatcaaaatagattaaagacaaatctgacaccccagactgtgaaactactcaaaaaaaaaaaacgttggggaaactctctaggacataggactaggcaaaaatttcttgagtaatactccacaggcacaggcaaccaaagcaaaaatggacaaatggcattatatcaagttacaaagcttctgtactgtaaaagaaagtcaacaaagtgaagagacaaaccacagaatgggagaaaatacttgtaactacccatctgacaaggaataaataaccagaaaatataaggggctcaaacattgaatgggaaaaaatctgatcaaaatgggcagaaaatctgaagaaacatttctcaaaagacatacaaatggcaaacaggtatataaaaaggtgctagacatcactgatcaacagagcaatgcaaattaaaactacaatgagatataatctcactccagttaaaatggcttttatccaaaaaacaggcagtaacaaatgctgttgaggatgtagagatatgggaatccttgtacactgt

SEQ ID NO: 33918 - DNA, 1050 bp, Homo sapiens
gcttaaacctattttaaacaatacaacactttttttagtggaatagatactaatatctcccagaatgttctttaaatatcagtttagaaaacaatgtgttaatgacaaaaatatatttttgaaaaacatatgtttatgtaaaatggaagtaaatacaccagattatttactttttatttttatttttttatttttttgagacggagtctcgctctgtcgcccaggctggagtgcagtggcgcaatcttggctcactgcaagctctgcctgcagggttcacgccattctcctgcctcagtctcccgagtagctgggactacaggtgcccaccaccacgcctggctaatttttttttttgtatttttagtagagacagggtttcaccatgttagccaggatggtctcgatctcctgacctcgtgatctgccctcttcggcctcccaaaatgctgggattacaggcgtgagccaccgtgcctggccaatacaccaaataatttaaaatgatcactgaatagaattgttttatgcttgtatgtaactcctgaattttcctcaacaagaatttcaatagaaatgcaatgcttttgttataaaaatatatagcaagtaaaaaatatagaaaataaatttggctataaaacttagtcattagaagacataaaatggaaccatccttctgatggaattcatgccataatttttttctattatagaattttggattaggcatttattttaagatgtggcaagagatattttgaccaaatttttagtgatatacatgagttagtttctcctgaactgtaaattagttcaaatagaccaaaaaatggaaagagttatcttgagtctaagaagagtgaaaatagttgttttctgttcattttgttttaatcaaagtttgaatacaactcttgttatttgtattaactccaatcaaatgaaaaatggggcaggtaggctagttgctgttgatggttgaagggtatgggtgtgtgcatgtgtatgtgtgtttaaactttgtaacttctacttcatttttaatac

SEQ ID NO: 33919 - DNA, 1100 bp, Homo sapiens
tctcaagtggttgtgggtccctctctctcaaatttattaatgtaatcagaaagttcagtacattatcctgaggtaatagcttgtatagttgtattaatttcttgaagctgctgttacaaattacacaaatttagtggatttaaacaactgaaatgtattctctcatagttctggaagaccaaagtccaaaatcgttgtccctgagttggaatcaaggtgtcagcagggctgtgcaacccctggatgttctaggaggtaactcattccttgccttatccagcctctggtggctgctggcattccttggcttgtggtttgcatcggtctagtctcttcctctctggtcacattaccttctcttcttctgtgtgtgcaatttccctctgcctccctctcatgaggacacgtggtggcatttagggcctatgtggataatctaggatagtcttcccaccacaaaatccttaatctaatcacatctccacaaactcttttttaaaataacataacacttacaggtaccagccattaggacctgacttttcaggccactacaacttttcaggccactacaaagatgagtaagatagtttgactaatgctttggattttctttaaatcatatatgtatatatatacacacacacatacacacacacatatatatttaaatcatatatattatatataaatcatatatatatgatttatatgacacttctgggaaattatatggttgaatatgaagtgcaaatatgaatataaagatgtgaaggcttccgatagtattatctcttcctagtaatatatgacctcctgttaaatgtggtatatttctattttttgagatgcagcaaaagaagcgttgatgttttataactggtgtttaagaaagttttcattagaaacgtgaaatttcctaattcaaattcatgaaaatttgagaaaatttattatagccactgtcaaagttaaggaggaaattaaaacttttccttttgaaatgggaatgtctgtactggaattaaactgagcatgttttctccctataaatactgttgatgtcaactaagtttccctgttcgcccacacatggtaca

SEQ ID NO: 33920 - DNA, 1048 bp, Homo sapiens
tggaaggcaaagtgggagaaggccagtcacatggtgaaagcaggaccaagacagaggaatggggggaggtactccacacttttaaacaaccgcatctcatgagaactcacccacattcatgaggacagcatcaagaagatggtgctaaaccattcaagagaaacctgcccccttgatccactcatctcccaccaggccccatctccaatattaggcattataattcaaaatgagatttggtgggggcacagatccaattatatcaataaatacaacctatttcactgcaggattgtagcattaaaatgaaatgacatattgatatttttgtgaattttgaagtatctttttagaagttgatggagaaagagtcctttttttgtaatctaaatatgttcatctttaaaagaagatcctaatattttagataaataatcttggattagcaatttttctgaaaaaaaaaattctcattttgttagcatgttttctttccttttttgttggctggggaggggcagagccttgctctgtcacccaggctggagtgcagcaacacaattactgcagcctcgaccttctgggttcaatctatccttccacctcagcctcccaagtagctgggattacaggcatgcagccccataccctcttaatttcttttttcttatgtagagaagggagtcttccagtgttgccccatctggtattgaactcctgggctcaagcagtcctcctaccttggcctcccaaaatgctgggattacaggcatgagtcattgtgcctggcctagcacttttcttatatgtgtgtgtaacatgtggatacctcttgtgggacgtgtgcgtgtgtgtatgagagagagactgagagatgcctatatgtcattctcattctattgtgctgtcaacacaatagcaatgtttaatggataaagcaaaccacaaataaaacattatgtatataaagtgcaaaattagtttcgttttgcagactacagaaattaatttcaatagtctgttgataatgttttagcactattatttt

SEQ ID NO: 33921 - DNA, 1050 bp, Homo sapiens
aaaatgaaacagagtaaaaggacagagagtgacttgtatgtgtgtgaggtggtgtattagcagaaatatttagggcatggctttcagagaggtaatcttagagctgagaactaaatggtgatatggtagcctttgggtagatgctgatttcattcagttattgccagccactttacctgaaagaatatacaagattcatattcatctcagtataggcagaatgcctgggacatcatagatgctcagaaaatgttagcggggagaacaaaataaaatatatatgggcatatgatttcaggggaaaatgccttatctttctaaagttatgttgcctctaacagaggagtgaaaagtttagattttgtgtgcatttttttgttgttagactataatgtaagccttggattaattttttttcctgtattattgttatttttgtattttataggtttcacagtggtaaagtcagtgggtgtacttgaagtgatgtgccttgtataaacgataaagtcagaaaagagtgcttctattggaacattttgtgctacaaatagcagcagcatgtttatctgaccgtggtattcatgctgtggagctctaaatcaagttgaatttgctatgatagtatacctcacagaaattaaatcattaatgttaaaggaaaaatcataaaatgattttttatgccaagttatacagaggcagtttgccatatgtctaaccaaaggtgtaagaccagtaatttgaatttcgtgggacagacaggagcaactagagaagggaagaagtcaaatggtgtagtggccaaataggatgagtgactgtagactatttactgctttcaaatgaatttttgtacccattgtcgaaagaaagcctgatgaacaggtatgtttgcagcttctttgctttgacaggttttttgttgttgttgttgttgggggtgaggggagtgggctgcaagggagatggaatttatttatttttgaacacgtagtgtttgaaagacattgggagattattggatagataaagagtttccagtgtagg

SEQ ID NO: 33922 - DNA, 1050 bp, Homo sapiens
ttgaggatttttgcatcaatattcatcagcgatattggcctgaaattttctttttttgttgtgtctctaccaggttttggtatcaggaagatgctgacctcataaaatgagttagggaggagtccttctttttctttgtttggaatagtttcagaaggaatggtaccagctcttctttttacctctggaagaatttggctgtgaattcgtctggtcctgggctttttttggttggtagggtattaattactaccacaatttcagaacttgttattggtctattcagggattcgacttcttcctggtttagtcttgagagggtgtgtgtgtctaggaatgtatccatttcttcctgatgttctagtttatttgcatagaggtgtttatattattctctgatggtagtttgtatttctttgggatcagagatgatctcccctttatcattttttaattgtgtctatttgattcttctctcttttcttctttattagtctggctagcagtctatctattttgttaatcttttcaaaacaccagctcctggattcattgatttttttgaagggtttttcgtgtctctgtctccttcagttctgctctgatcttagttatttcttgtcttctgctagcttttgaatttgtttgctcttgcttctctaattcttttaattgtgatgttagggttttgattttagatctttcccaatttctcctgtgggcatttagtgctataaatttccctctaaacacttctttagctgtgtcccagggattctggtacattgtgtcttcgttctcattggtttcaaagaacttatttatttctgccttaatttcgttagttacctagtagtcattcaggagcaggttgttcagtttccatgtagttgtgcggttttgagtgagtttcttaattctgagttctaatttgatcgcaatgtggtctgagagactgtttgttatggtatctgttcttttgcatttgctgaggagtgttgtacttccaattatgtggttggttttagagtaagtgctatgtggtgctga

SEQ ID NO: 33923 - DNA, 1053 bp, Homo sapiens
actaaaaatacaaaagctagctgggcgtggtggtgcgtgcctgtagtctcagctactcgggaggctgaggcatgagaatcacttgaacctgggaggcggaggttacagtgagctgagattccagcctggtgacagagtgagactccatctcaaaaaaagaaaatgagaaagaggaagaagtaagtatagggaccgtggaaggaaattagttttgggtgtgtggggaagagtgatagaaagaaaaccagcattcatggattattttcgcaaaggggaaagtgataagaaaagaggtcaaagaatcagatcgaggccaaaccatgtcgttcacagtagtgagtgtggttttgttcgaaattgggagatgttaggcagtgaagtcatgtgtgttttcaactttgtggtcaggtcatctctttagttgcttagtggagaactgtgtccatggcaggacacagtggagttaatagactcacaagaggctgttacagtagtttctgcaagacagatgatggtgacttgggctggggtttttgtagtggacatgaagacaaggggttcaatttgggatatattttgaatatagtgctactagttaccacacttgtggtagtgtaaagtatgatgattgacttggcattttgcacatgaattgtttcatagtcttcttgatctggttatgttctcagaagttgccacttcagtagctttgaacactttgttagaagaaggaggtgagtgggacaaattttggagttgatctttagatttgaaagtgattttcagaaacatcacctttattagaaagatgaattttgaattttttcaatatatgttatagaactttgaccaaagtcttagttcactagaatggttttttaatatctgtttactgtaggatagtttatcaagataaagaacattgttcaaatttgtgctatgacttgatacaatcttaatagcattgctttaagacagcacatgtaattgtcaatgaaacatttgtttaatttttattagcactggcatagatttacaattgcatgtttatgt

SEQ ID NO: 33924 - DNA, 1029 bp, Homo sapiens
ttatttcattaatcatttttaattaaaaattttaaaaaattaaaatgatttaagtattctgaatttggttcatattggaaattacagaaagagtctattaaataagcataatcattttcttgagttaatattcatcttctattttcttcaaatttgaccaatatgatatagctcttgcttttggttgcatgatagtgacaaggaagctacttcacagttgagtcttttatgaaggtagctttctaaaaatctatctgttatgcttcttggctggggaaacaaaagttctaagagataagggggggaaatcattgctagaaatagcaaacatagttttccctcttttacagatttctttttcagcagtgaattagaagtggcgggctttggagagatttgttcttagtaagttaatatttgacttgccaagccatttgggaacacggaattgccatgatatcttctgggcatctccccggttttggcaactaggaaacattcaaggctgtgacttcatgaagagaagtttgtctgtgtgatattatcctgactgctatgcaacattttggtgaatgttttctttgtagacacaaatccagtgtgaaaaccctttttttatgaaaaaggtttatggcactttcatagtagcagggcttgtcttgttgatttagatcaaaatcatttcctcccaacatcataaccattttactgttcagtggtgcagaaggcattataaagagttagtgaattgttttggatccttcagaattggatgagggactgaaaagaagaaaatatcaccaacagagatgatactctggataacttcttcttaaggaaaaaaaaatattttcacactgagaatttaagtgttataatgatttgagcctttcaataaacatctaatacaaaaccaaatgtttacagttccacttagtctttcttcatgcctatgccactttaaagtcttactgttttctctctcagcttttaggaatgggaaacaggacttctgttaatgtctaatga

SEQ ID NO: 33925 - DNA, 1043 bp, Homo sapiens
aggtgggcagatcacctgaggtcaggagttcaagaccagcctggtcaacatggtgaaaccccgtgtctactaaaaatacaaaaaattagctgggcgtggtggcaggtgcctgtaatcccagctgtttgggaggctgaggcaggagaatcccttgaaaccaggaggtggaggttgtagtgagccaagatcacgtcattgcacttcagcctgggcaacgagagtgaaactccgtcttaaaaaaaaaaaaaaaaaaaaaaaagaatgaatgaaaaattactgcttagaaaatttttatcacatttctaaaatagagaagatgacttagagtgaaataaagtcattgtttttagtatagcccattttaataaaaatatttcttaatcaagacagtttgtgtcataatttctaaaaaaacatgccagtgcaagtaactcaaaagtaatgtaggttttcaggatttactaaattttcactatagtgagtagtatgagtatcctagcataatttcctgtcctagaggaattttcaatctaatagtagaactatacaagtagggttctatgtacctagaactataaaactaacaaaatgaaaaatacagaaaaaataaaactgtataaaattctacaaaaataatctcataaatagattacaaacttattgatgaagtttaattttgggatttaaccacttggtgtagagttcaaactgcttgactcacacataggacaggttgattacattcatataagcccttatattttatgaaatcttgtaatgaattataattaacctggaacaaaagaggtgtatctagtggatagatgtgtgtgtaagtggtgaataggcacagagttacaatgtcattgcaacctggagagtcatactgggagcaaagaccatgtatatgaataggtatgactacatgttaaagtaataaattcatggattaaggtagaagttaggtgtgtaacatttatgaaatatagtttggagttttcattaaatagaatagtttttagctcttttgtttctcttcaaat

SEQ ID NO: 33926 - DNA, 1051 bp, Homo sapiens
tctggataaatatcttgcttagtctagcttagtctcttaatacctttcattttaacatgggacctacaaaaggatagagtacagagatcctcaggggatgcgttcctagacccacagtagatgcctgaaactgtgggtggttctgaaccctctgtatacaatgttttttccggtacatacatacttgtgataaagtttaattattaaattaggcacagttaaaagagtaacaacaataactaatgataaaatattattagaacaatatactgtaataaaagttacgtgaatgtgtactcgctctcctccccatctcaaaatactttattgtactgtacttaaccttcttgtgatgtgagatgataaaataccttcttgatgagatgaagtgagatgaataatgtaggcattgtgaggtagcagtaggctgctattgaccttctggggatatgtcaggacaaagatcatttgcttcaggtgatctgagactgttgagccatgatgatgttgatggttggagttcaggagcagataatgttgatgtctgtgtcaacaactaatgggcaggtagcatatacagcgtggataaaggacaaagggatgagtcacattctgaatcagatggaagtgtgagatttcattatgcaactcagaacggcatgcaatttaaaacttacaaattgtttatttccagaactttccatttaatattctcagaccacagttgactgtgaaaatttccaaaaccgtggaaatgaaattatggaaagtaaaactgctgataaggggcaactgctgtagttctctggggggggaaatgaggttctggaaccatggctgatcatcatgaaggttagactgatagaaacctagaatggattaggtgcctctgtacattaagtatgttgtggaatttttgtcaaaatattaaaactgcttctatacatatctgtctcctttactaaactataaactctttcagagcagagtctgtgtcttgttagccatttgcttagcatgttctaggcacttacctaagtatttaatgatg

SEQ ID NO: 33927 - DNA, 1092 bp, Homo sapiens
catgcctggctaatttttaaattattattattttttgtaaagacaaggtctccctatgttgcccaggcttgtctcgaactcctggattcaagggatcctcccgccttggcctcacaaagggctgggattacaggcatgagccactgattctggcctttgagtgttcttttcaaaagaaatacgtaacttcagaaatgcaacctgacacaacatagtacactgattgggcatatatttctttttagaaattgacgatgaaaaagattgtatgaaccagagaatatgaggttggaagttaatttgttcatctttactctgctgtgcacagaggagaaatattagcatatacttcttccattcaaataaaccccaaataggtttttgtacgcacaaaaagaatctttaaaaattaacacacctttgtgctgacattcaaaatttagaggatttgtaagaagttccgtgggcgagtttaatgtgggagggtagctttgaccataaattatagtaaaagattttttagaccttttaaatgtattattcccttatataatagacttaagactgatatgaggcaaaggacaaataagatatgacatatctgtgaatatttcagaattgggctctcaaagtatttaataataatagtaatacttcttaatgccagctatgattttgtgctaacataatttaagtgttgtgtacattatttcaatcccatatgagatagagttattttatacagataagaaaacatagaggctaaatatcttacctgtcatcacacttaagtgatgatagttggattttatgcactagtttgtttctctcctttcatttcttttcagtaaatgagaatttatgatggcagtggaatgtgtagaggtggtctgagtacagcggtagcagcatgtaacctgaaagattgggctggtaactgatgtgaaaatgtataaaaaccagcaaaagttgaactgctttatgtctgttcctctaaagtagttccctgcctttgacctgtagcagcaacagactcacccgggaacttgttacatgcaaattcttggatccactcacccagacttactgaat

SEQ ID NO: 33928 - DNA, 1031 bp, Homo sapiens
tttgacttgaatatatttcctagtttagtttaaaaccagaatacaattctggtttccattcattgtactttatccttttctctgtgttgtgtgatatatccaagttctatttcttgagaccaaaaaccatgtttatctctgatttttgagcccattatcagtttgatggaaacctgactagcatgaaagtgagtattttaaaataccactttagttgtggtacacaaatctgtacatatgttagaattgcttagaaccatacatgcccatacacatacactaatgcatgtaaaaactgatgaaatatgaataaggtctgacattgtaccaatgtcagtgtcctggttatgctattgtgtagtagagttatgcaatgttaccattggaggaggctggataaagggtacatgagacctttctgtgctttttttttttaaataacttcttgtgagcctctaattacttctaaataaaaagttttaaaacctcacctatccagaaagcatatatattctcttccctatgggaaatgaccttgttgtttcagcagtacctgaggtgggaggtgggggcagcaggcatacacataaaattttacagcatagctcacagcagtaattttaatgagtttgtgcaattaatgtgaaagacaaaaatgcctgtaattttttctccctccaaattggacttttatggaaaaaaatcaacaaaaacctaacagccctaaaataagatttacggagtgggaattcgtatttgttgggttaggacctagggacaaaagcagagtaaatttcctagaaagggaataactgatagggaaatattatagaccaaaaaaagtgaaattatgaactcaagtaaacaggttgatattaaaatgagaaaggacatttctgccatagagaataaaagacagaagataaatgaaagtataaaaaaacctttaagtagtaaagagggcactcaaaagtgtatttctgggtatagttctgtcttcccagtaaggtagatgtcaggctcatctgtta

SEQ ID NO: 33929 - DNA, 1032 bp, Homo sapiens
ctgaacatttagatttgtaatcctaatgttcagttttctgagacatcatccacatagaaattgcccagtaatttagataatttacatctatgttatggaaaacaaaaatttggaaattagatttctaaatgagatttgaccaattgttcttggctggttcatctagctagttactctggcagtataagaattttctgtgatctgatgagctgattagcatacagtcctgttttccatctttataacaatacagtaaaactaagtggataaaactgttttgtttcattttagtgtggatttcctcaaaaattttcaaaattatgaacatagtatttctgaggtcttactatataattgtgtgtgtgtgtgtgtgtgtgtataccataagaaattacatattttaagttgtatcatctaatatgattcagcaacagtaataaagatgtgaccttagtttcagttcttatatttggaaaatgaaaatctttcaaattgtaactaacttcgtagctgtaattcctttgtgagtcatttattttgctgatctttgtgctatatttctgtagctgaatagtacagtgtggtagctactagccaaatttagctactgagcaatttaaatgtggctagtctgagttgagatgtaactgtaagggtataaaacacttggattttgaagatatattgtgaagatgataatacaaaatattttgttaatttattgatttgcatatcagagtgatatatattgaattgaataaaatattactaaaattaattttcacctgttttttaatgtgtctattagtaaatttaaattacacatgtggttcacatttatggctcacacatttctcttggacctcttctagagggtggttatattttatctaaggtgtcagatttagaatgacacgtattcttcttttaatttattttcattcttatgttcaaaagttagaaagtagtctaaagctgtttgtatgttctgacagttaagtaacatctgttttatgcaatgtagatggacac

SEQ ID NO: 33930 - DNA, 1122 bp, Homo sapiens
taaaattaataattagccaacattaaatttcaatgtttcaaaaatgtaaaatggttaatttactaaatgggactaatttttgaagggctgccagttttgatcagtatcaaaaacaaaaactccacagccctatagtatgatttaagcattcttactgtgaacattttaaaaataaacaatattaaaatagttttatcttcgttatatatataccaggagtagctttaaaatatgaacactgtttgcagaagtaaaattattttatctagatgctaggtttacttcgaataattttttaaaactctaataaaatctggctttagaaacaagttcagagcaactgtagagatctcattttagaaatttaattattgtaaacagcagtttcttttctctgtaaaacatttttagaccctagaaacaagtgatgtatcaataattttcagatagcctatatggttaattaaatgcatataaatctgtgatattaaggcttcacaatacgtttgtgtcacaaaatatccatttgtttctttatcatcttatgtgaatcactgtgtggatcagacattcaaattttggtatgttcctggtatgtaacacaaataaggtctttctgtggtttgtttcataatggcattttaagttgtgatattttggcagagacattttatttgcatattagacatgcagtattattctttactttcgtgtgttgtagaaacacgtggcccttttggcatactttttattttttttcacattttatagttgtgggtccaaagaaatattctcaataattcaaaaaaaaaaaaaaagataaaccttggcaataaatggctactgatatttggcccttgttgttagtgacaacagtgaatggtggggactgtggtaagttgaagagcccttgtcctattgaaaggggaaaaccactactcttctctagccagttgtttctgtatgacggtttggccaaatactgcccaatctttatattttggggatgggaggtgggggagaaagctgaaatgtctagtttgttatgtgacatctgagttttaaatgttggattacatatttttaatactatagaagctaaacagaaagtatcttcaggcc

SEQ ID NO: 33931 - DNA, 1022 bp, Homo sapiens
atggctatatatttttctcttttgtgtggtatgtgtgttgtatgtgagtatataatgaatttggctcctgggtagttagacacattttcacgaagcaacatgattttcatgaattatggcaatacctacaatgtgccatttggctatgctaactttttctcccaatctgccataatttcaaatattactgcttcaatttgtatgccaaagattgtattaagcgctataacatttctttacttttcacccctcttttacctggaaccaaaatttgtaacattgtaaaagcagtccagaaaagtgatagatatgccaagttagcagaacatgaagagcattatcttctaagtggtattcttctgttatcttctccataaaatgtgttattcctctgatgtccctggactgttggatttttcatagtttgtaccaacagaactgagggggtgtgtgatgcttacatatatgcagacatatagtggagtttgactcacattcaatgcatgcgctagtgctcacgcttacatacctgaaatttaatgattcatcagctctgcagtatttgacaaagtagtgaaaatgaatacatatataaataaaaatactgctaaagaacaaggatcttcagaggtgaccctctagtaaagagccctatctactggtaagtaacctaaataatttctaacttggaaagctccttggtgcatgattattacaaatactataaccataatgcaactattctgccaatataatatagatataacactattgtgtaagtattttacctttaagtgttgtgaattattgctaaatttcatattcagaaaaaaatttaacatcaaaagtataaatacagattacttagttgagtatattttaattcttatctccttttagatttcataacttcattacaaaatttgaaattgttttattagagtatttgaactctaaacataaacttccatttttccatgtttattttttattcttattttggtaataggcccctttctatt

SEQ ID NO: 33932 - DNA, 1022 bp, Homo sapiens
tgagggagccctggcctggtaggagagaaaagaggtaagtaaagagttgcaaagacaaccttgtctaccttgctgatttctctggtatacagggaaaataagccattgaaaacagtttgatacaagttgctgtgctaagatagcagatttgtttgagaggctgcgtagaccacctctattcagcctagtctcccccagtctatgttaaaagataaatatgcagctaatttagttcagcccaggttcatactataatttcagtggttactgccctaccccatttggaggaagaaaggataagagaaaaatatgtgtatctaagacttctcgagtttatataatgagtcagttatgcccatgtaatagctaggttgtatacatcaacacgggagtggaacatgtatgcaccagaataatgtttctcctttcagagtgagctttcttgcctgttaacaagtaatgtatttttattgattcgtgtaaatatcaagtgtttaaaattcatgtcacatacttctgaatatgacatattactaaatgctacagttactttttgtcaaaatgtttttaataaaagtgttaaataacaaatttgtgtatttttgctgactagtgatgagatgtaatagcttaaagatgaaatggaaataatttaacaagtgcaatctatttcagaattgggacagaaaggaaaatacagctctgctttattaagtttcataaattttacaggattaaagatgttttcattttttcccaataatgaaaaaaagattgttttcctcctgattgttatttatgcacaataatattaaagagaaattggcctttaacccaacactctttaatataaccatggaatttttttttgttcccttcgagtcccaatgaatgtgtttacataatttttcatacttaaaatcatagcatgaatatggttttaaagtatgcattcttatttaacatggaataaacagaatgagactttgcctcttttaaaattttagttggaaactaactaa

SEQ ID NO: 33933 - DNA, 1047 bp, Homo sapiens
ttctgtcacatgtgacgaatacgatgttttatctattttttaatcccatattctataaggcaaaatgatttcatagaatagctattcaataaacatttgttgaagtagttggtgagagggcaggaatttttttttttaattatactttaagttctagggtacatgtgcacaacgtgcagatttgttacataggtatacatgtgccgtgttggtgtgctgcacccattaactcatcatttacattaggtatttctcctaatgctatccctccccgctccccccatcccacgacaggccccagtgtgtgatgttccccagagggcagaaattttaaaaaggactcaggtatctgttccggaaaagtgagatgaaagtatacctggccaaagagaggacactgttcatttctgatgtacacatttccttagttcattccctactcttccttctactacactggtcttttaagtgtgattagaaacatagaggacaaaatgacagttcaaacatcttccctaaatgattgcatatgtatctgttcatctcttatggtcttctttactcaagctcttttgtgatttttataaaattttttactaagaattctgtgtctgtttcaaataaactgttgctgagtaaacagtaaattggggaggttagaaaaagctttctaaaacagattgatggggaaaaatgtattagatgccagaacacagctaccataaaaacttagttcttggactctatttagcaagtttgatcactaaacaagtttgggctcaaagcaaagatactttctaaaaatagttttctcaaaaaatttttatgaaatggaagcataaagcaaaccctttaaaaatattttagcaaatttggaaaatatttccaactacaattaattttgaagctgactcaggctttttaaaatgtccagaccttcaaattattaaaaatattgaaaatagagaaaattatttttaaaatattattgagacctcctactaaatcagatttagttcaagagttctaagacaacggaacccttgg

SEQ ID NO: 33934 - DNA, 1029 bp, Homo sapiens
aaaatgctcaatgtcactaatcatcagggaaatgcaaattaaaaccacaatgagataccaccttactccagccagaatggccattactaaaaagtcaaagaacaatagatgttggcatggatgtgatgaaaagggaatacttaaacactgctggtgggaatgtaatttagtacaaccactgtagaaaccactgggtatctatccaaaggaagagaagtcattatataaaaagacacctgtatatgtatgtttatcgcagcacatttcacaattgcaaagatagggaaccaacctaagtgtcagctgatgagtggataaagcaaatttgatatatatacatcatgaaatactccccagccattaaaaaaagaatgaaataatatcttttgcagcaacgtggaaggaaccagaggctgttattctaagtgaagtaactctggaatggaaaaccaagtaccaggtcgtctcgcttacaagtaggagctaagctgtgggtactcaaagacattcggagtggtataatggactttggagactcagaaagggggagggctggctgagggtgagggataagaaactacatatttagtacaatgtacatactaggatgactgcactaaaatctcagactttagcattaaacaaaaaacaaaaatggtggtacttatagagagtttatgttgtttcatatgctagctaggacttgttgttaacagactttttatttttgccagtctggagttgtgtattactcatgaacagcagtgttcactgggctatttgcatcagtacacttgcaaaaatttaaaagggtttaactgtcttcaaggggcttatgctattcttgtatagacaagaagtactggaaaaaagataaataacagggaagtgctagtgaatgttatagacaaggaactatgttttccttgaattttttataattttactgagtttctctagctttttactgtgacaaatttcaaacaaatagaaaagtttaaagaagaatatagtataattgcagtatac

SEQ ID NO: 33935 - DNA, 1051 bp, Homo sapiens
aatattgctcatgtggaggacacagataaaacagctaaagaacagtttttaaaagcagcacactaagtagctgaacaatgtactaggtaaagacaggctttgaaacgcctcatgaaggagttaagaactgaattttgataaataggtgtgaaaatcaaatagaggagtaggtaaataaaatggtatatattaaggtgaaggagaggacattctctgcagggaaaggatgtgtttatggaagtaggagcaagctgaggcatgtaggtaatagcaagtagattagcagctttactttaaggaagagtccaagtacagaaatataaggaaatgaaatgatcgttagtagggatagagaccttgctgttcagttgaatatttttttccaaaatgtaaatatttcctgttaaatatattgttataaaaaggagtacatgatctttgcagaaatttaaaacagaagtgtgttaggtgaaaactatcataattctagcatcctaaaaccaaagcattgtttggtttcttatctttccagatttttacatatgtactatatacaggttaagaacatggatgctgtcttaagagggcctgcattcaaaacttggacttgtcattaattacccctgtgttttttggacatgttaatctgtgcctcagctttctcatctgtaaaatgagatatctgtgataatagtacctatgtcttggtagtggtgtgaggattaattctctgcctaatcagtgcttggtatgtagtaaaatctcaaatgttagctgctgttttttatctttcaaaataaaatagaattgttgctctgcattatatacacctatacagttttgtaatttaccattttttacatatctttaaaaaatttgttataaaaaacatttaattttactgtcttaattatttttatgtgtatagttcagtagtgttaagcatatttatgttgtgaaacagatctctagaacgttttcattttgcagaactgaactccatagccctataacagcaactctcctttgtcctgtttcccaaacccctggt

SEQ ID NO: 33936 - DNA, 1041 bp, Homo sapiens
ggaggattgcttgagcccaggaattcgaaaccagtttgggcaagatggtgaaaccctttctctacaaagaatacaaaaattagccaggcgtgttggcatgcgcctgtagtgccaactacttgggaggctgaggcaggaggaccccttgagccctaaagagtttgaggtggcagtgagctatgattgtgccactgcactccagcttaggtgacgaggtgagaccccatctttaaaaaacaaaaacctcccaaaaaacacacatgaccaaatacacaaggatttatttctggattctgttccatttgtctgtgtatctgtttttatgccagtattacaccattttcattactgtagctctggtatgttttgatatcaggaagtgtgagtcttccaaatttgctctttttcagaattgttttggctatttgggtcccttgagatttcatatgaattttagaatttttttcaatttctgcaaaatatgccattgggatttggtgaggattgcattgaatctgtaaactgctttgggtaatattgatatcttaaccttatcgttttcagatacatgaacatgggatgtctctctatttgtgttgcctttacttgcttttggcaacgtgttgtagtttgcattatacaagtcttttaacctccttagtttaggtttatttctaggtattttatttttaatggaaatttatttttaaatggaattgttccttaatttatcttaaaattattcattgttagtgtatagaaatgcaactgatttttatgttgattatcctgcaactttagtttattagctctaacagttttttttttaatgaaatctttaaggttttctacatgtataagatcatgtcatctgtgaacagagataattttacttcttcctttttaatttggatgccttttatttctttttcttgcctaattgctctggctaggacttccaatacaatgttgaatagaagtgatgagagctggcatctttatcttgttcctggactcagatgaaaagctttctgtctttca

SEQ ID NO: 33937 - DNA, 1045 bp, Homo sapiens
ctgggattacaggtgcccaccaccacacctggctaatttttgtatttttagtagagatggggtttcaccatgttgcccaggctggtctcgaactcctgacctcgtgatctgcccaccttggcctcccaaaatgctgggattacaggcgtgagccaccacacctggcctttttttgtatttttagtagatacagggtttcaccatgttggccaggctggtctctaactcctgacgtaaggtgatctgcccgcctcggcctcccacagtgctgggattacaggcgtgagccattgtgcccggtttagccatgcttttcattaaactattgttagtatataattttagtcaacagttttcttcttaaaagcctatttcagaattaatctggtggatagtctatatttagatgacaatccttttcatttatttaatgatatttaaaaacattttgtcattttattttcacaagtcatcataacataggacagagtttaaggctcagagggttatgctgtaggcctttttgtgaaatacctatgatgagtggtagtagtggttggtactcattaggtgaaatcacatatttattctgaaggaaaatataatacattgatattattcatttaagtaagattcttaaggtttctattcagtgctttaaaagtgatttgattctaattttgtttgatatcctggagaactttctcttcctatgacttgctgtgattctttgaggaattcattcatctatttttttttttttgagacagggtcttgctatcactcaggctagagtacagtggcacaatcatagatcatatagatcatagctcatagcttactgtaactccaaactcctgggctcaagctatccttccacctcagcctcctgagtagctgggatcacaggcatgtgccactacacctgactactttttttttttttttttttaagagacaggatctcactatgttgcccaggctcatctgttcttttttcttttcctctacttttccccattatagaaatgagagaagactacct

SEQ ID NO: 33938 - DNA, 1024 bp, Homo sapiens
tacgtaactggttaagtgtctgtaatttcaaatttgaaattctaaatgctccaatgggcatttctttgagtgtcctgtcggtgttcagaaagtttcagattttggaggatttcagatttttggattaggaatacttaacctgtatgtcattttacttttcctttgtgcagttaccagtaaactggtttgtgtatgtgtacctgactggcacaaaccctgttgtatattgtttaagataatatccagtactgttactaaaataaaatactgagttcttcatagtagcatgtgtccaactgttttcacatttttcaaattttaaaatctgtaatttcatacagattttttcttttatatattccaaattattttttctgtattataggcatgtattgcaagaaattgctacccttctcccctgaattattataatttcccaaagtcttgttgtacctcagtgaatgaagtcatttgccatggaataccagacagaaggcccttacaagaaggtgacattgttaatggtaagaaaaatatgttactttcatcaccatgggcaaagaaacaacaaagcttggggaatctgacagtgacttgtgttttcttgacttgcttcctgtacttaaactttttcctttttaaaattcagtatcactaactcttaaatctacaggaagctctcttaacggttttgtgcatgttgcttttaagatacttccggtgtgatgtgtttggtgcagtgtatttctttaatgcttatctcatatgtgattggtaaataggtcaaagatgtcagtgaaatgtggagtctagtttttttcccccagaagttcactaatggttttgaagagaccagggcaggctttgttatagatacaggaaaacccttcataatatatgaagacctaaaggaaagctgaaaatcttgcagaagtgccttacttgagtggaagtagctttaaagacccctatgttaagctaccttgggaagttacaagtatagagagtagaggaagtagtttaa

SEQ ID NO: 33939 - DNA, 1049 bp, Homo sapiens
caccgtgcctggcttagatggcattttaatattgatggaattagactctttgttaataagatatcttaaaggaactacctatcaaatgaggaagcatgagcccaagtgttagaggctgcagataattgactgattgtgatgctagctgtgaatgatagccgaaatttaactatgacactatttttattagaattgctactgctttagttagggtatctgttcataaagttccataggttttgaggccaaccctgtttttcaaatataaagcctgttatttttattatatgtagaatgtgtgaggtttttcaggaatgtatgtgttgtgctagaaccaaaatatctatattgtgatgttacaggttgattgaaatatgtggtttaaaaatactcaatgtgctctctagatacattataatggtataatagtatataatatatagtataatagtaatctatattcttaaacatggggacaaagagaagaatgaatattcacaaataagagaaaagcaaatgagttttaaaaaaacaggtgtagagcagtgtaaatttttctgttattccctagcaggagtaaggaacttgtaaaagataagtgaaaatggtattttgtagcaatgtagcaaagttttcaatttaatgttactaactctggtaatttattttgcatgattgtgtcccacatacatttttcttttgccacaagtgatacaattactataagagtataaaaacccactatctggcttatgttacatggccatattcctgctctccacagtgagttcagttacatctcagggagcttctgttgggcaataactatctatccattggtgtctaatttgagaatgcagaagttgtctttttcattaagttgctagatgctgtcatgttggaaaaacacttgaattttgaaatgaaaataagtatggtctttatatttgcacattctcttgcagtggatatcactctttatcgcaatggttatcatggggacctgaatgagacattttttgttggagaagtggatgatggagcacgga

SEQ ID NO: 33940 - DNA, 1045 bp, Homo sapiens
tttctgctctgacaggtttatatgttcttacaaatggatccatagtttgcagtgatttaattcctggttgggatttggcctcccctctcccccatgctaattatttacccttgtaattgtgcatagggaagcactcacccaatgagactttctccaatgtggactctgtgtgtcagtgaatgaatgtagtaaaattcactttggaaggttatcaggcttttaaaaatctagtttatggcaaaaatagccattttccaagtggtggctgactgttgcagggaatgagaatttcataatacactgctatttcagacctctgtttggtcagaaatggaaaagaaaaagccccctttcttcccttttctgttttacttcaagggcataccttggaggtgctcagagaagcgtgaagtttgcactatggtggaggatggggaaagagttctaaagtgtctccagctgtgaacccaggaggtcaagtgggctattaaaatctaacgttgagtaaatgtgatagtgatgagaaaggaattttgtgtactgtaaccttgcagtagagatgcagctgtccttcgtgtgtggaaacacacctctcctttacatagttgggaacctcattagaaatgacctcagctgccccatatctacgttcctttcagcagttgtccaagtaggagtgtatccagtgaagacatatcaaatcacaaagtcattgtcattagagtgtacttgattactgggcatccttgtaatataatttcataccactgacacattatacttgtaagagaacatctttcccagagtgcctcagaccttattgctttaaaatataataatgttttcattacttttattatttgaatgatttagtaaagttgactgaatctggtatagactttgggagtatgtgtgtgaagtttttatcaaactgtaatatttgtgaatggaatgccttgcaatatgaatgttaatataatgtgtaaagggagattaaaaagtttgaatgattatcctaccatgtagtcattaactttgctgcatt

SEQ ID NO: 33941 - DNA, 1037 bp, Homo sapiens
tatttttatgtgactgtgttaatttgaatgccttgtcattgagttctgaagttctttcctctccttgttctagtctactgttgaaactttccactgcatttggtaattctgtaagtgtgtctttcatttccagaagttctgattggcttttcttcaatatatctctctctttagaaaattttttatttatatcctgaattttaaaaaaagtttctttatattggttttcacctttctctggtatctccttggatagcttaataatcaaccttttaaattctttatcttgtacttcaaagatttaatcttggtttggattcattgatgaagggctagtgtaatgttttgggggtgttatagaaccctgttttgccatattaccagaattacttttgtagttccttctcatgtttgtagactatttttcatgattatccttgaatttatttttgctttgactgtttttttaaatttctttttcccaccttaaggttgtgacttttatgtttatagtttactgtagcataacttggctcttggtgctctcaggggtgaagactctctatgagttacttagttacagagagtctttgtgtgatgaatttctcagatgctggttgtagcagcaatgtgctcagtgtgtgagcaagttcaccctctcctatagtgttgaaatggcagaggtctcttgaagcttatctaattcccccatgttgtacacttatttattatttttttcccacagtattatatttactgggttgaatagttcaggcttcagcccagtaggagagctttccacaggtgaaagccagctgtggctaaagcaggtgggtaaatgcaatacctaatggtgggcagaggtcccagacttgacagatgtgactgggggagcactcagtgaaatacactgaggtcttctcagagagaaggaccagagccacttcacctcccctgccaggcccacaggaaagctgttcacctctcagacacactcctgacccagtgttctggctattcaaatcagagaggtacct

SEQ ID NO: 33942 - DNA, 1075 bp, Homo sapiens
cagattcagcctcagggcaggaaccgtataaaaagtgtgaccatcacaccttttattaaaatcccaaaacagatgtatgtgactccccagtcctttcaataggatggaaatggctcagagaagagtccaaaggcttttctttcaataaataatcctgagataactggcaagccacatgtagaaaaatgaaactgggtcctcatctctcaccttataaaaaagatcaacttatgatggatcaaatagttaaatctaagacctgaaaccataaaatttctagaagataacattagaaaactcttctagacattgtcttaggtaaagaattcatggctaagtacccaaaagcaaatgcaacataaacaaaaatatataaatgggacctaattaaactaaaaagcttttgcatagcaaaagaaatagtcagcagagtaaacagacaacccacatagtgggaaaaaatatttgtaaactatgcatctgacaaaaggactaatatccaggatctacaaggaactcaaacaaatcaccaagaaaaaaaccaaataatcaaaagacatgaataggcaattctcaaaagaagatatagaaacagtcaacaaacatatgaaaaaatgctcaacatcactaattatcagggaaatgcaaattgcaaccacaatgagataccacctcactcctgcaagaatggccataattaaaaaatcaaaaaataacagctgttggtgtggatgttgtgaaaacggagttcttttacgctactggtgggaatgttaactagtacaatcactatggaaaacagtatggagattccctaaagaactaaaatttgaatggccatttgattgagccatcccacttctgggtatctacccaaaggaaaaagagtcatatgtgaaaaagaaacatgtacattcatgtttatagcagcacaattcacaattgcagaaatatgaaaccctcctaaatgaccatcaaccaacaagtggataaggaaaatatcgtatatgtatatatattataaatactactcagccataaaaaggaacaaaataatggcattcgcagcaacctg

SEQ ID NO: 33943 - DNA, 1013 bp, Homo sapiens
tgtttatatctgcgaagaccctatttccaaataaagtcacattcacaggtaccggggattaggagttaaaggtgtctttttgggagggaacacagtttaacccactacagccccttgacatatttatttaatgtgtacacatggatgtagagagtggaatgacagaccatggagattcagaaaggtgagggatgggagggcagtgggatgggggtggatgataagaagttacttaatgggtacaatgtatgttatttgagtgttggataccctaaaaaccctgttttgactactatacaatctatgcatgtaacaaaattgcacttgtaccccatcaatttataccaaaaaaaaattttatttaaaactcatctagtaaggagacagattgttgtagtgaaaagatctttgaactcagaatttgaagatctttatataagtactgactactacagatcagctcctcagacttgaagaatcacttagtccccgtaatcctcacttttctcatttgtaaaatagaaatgctagcaccacactaacagggatgagtcaaaaatattcaatgaatgtgctttgtaagcataaaactgttcctatcattatattagtagttatgaaaggatagcagtgtccttttttctttttctcctatattttattttgaaaaatgttggaaaaaataaatagaaatgttggaataatctaacaaatctacattggttcttaaaaccgacattttcgcttttctctttgctctctttttcgtgtgtgtgtgtgtgtgtatatatgtatatatgtatatgtatatacataatcatttggaagcaattttcagactctggagcaattataatggcaatattaaattatttatgtaatgattccaagaagtatttaaaacatggagatttgttcattcatcagctatttattgaggtattactacgtgccagaacattggcttagtggggaaaaaataagtgatatatacactctaatttcaggaacct

SEQ ID NO: 33944 - DNA, 1032 bp, Homo sapiens
tatctgaaagatcaacaacctgacaaattatgtaacagctttattcattcactttacatttctcttactcattgttcacactgtcctgagcctcagtatgtagttctgtaaaactgcagttaattacagtattagaattacagttaattacagtattctgctgtctctaccagcttaacttaccagccactcccaggaaaggcagaggtgatttccattcattttcatttataaggaaatacgtatgcatacagttcacatgcactgagcgatatccatctattatccttgcacatgtagtacctcttagccttcctccttcctttggtagccccagccttttctgtgctgcctttggaacatgtaacctaacatactgaaagtaccagtgggaagtaaaatgttagaatgaactattgaattctcttccctctggtgtcagcctctttggagtcaggagaggaacattttttcaggtgcttccccttaccactagagtctgtagagaatagctcagaactgaaatggcctcctcactgtatccaactctgtggatatttataggaaattggatgggaccaatgctgtgaaagagaaagaaaggcaatctttaatgtctgcctataggaggtttcagttattagggaatggaaataatggtgtagttccccacagaatgaggacagtcagtaaatctttggatggataaactaatcacatttgtgtgtgactgaggatatggatacctgtcctcttgcagctgtattacccaatacattttctaagtattcttttcattagctcaggtgagtgaaacacttttgcattttgtaacatttaacacatgctaactaggtcacaagcttaaataaagcatccactgcgttgtggtttccagaatcgtgacattatatatgtgttatatttggtcagcatttgatataaatgtcttaatgattgctgaacaggctatccttataaggttgaaattagatgaaagtttttgctgtgggggcaagaatgccacatgaa

SEQ ID NO: 33945 - DNA, 1034 bp, Homo sapiens
gaaatgatacttctgagcctacatttgccacatattcattaagtgcatttgttcaggcattacagtaaaatgccatgggctgtgcttttcctcagctacagcctctctccttccaacctcacaccctgtcttcctgtcatgcctttgtgagagcgccaccactctgcggtgcctggagaggaacctggaaacgctgatagttcagtgcatactcggtcatatggagacagcaggaaagagtcaggggccaacttgaaagatttggggcctggctgtggtttgcaggctgtagacaccaaactatactttatagaacatgtgaaaatatagcctgtatgggttactctcttactgattgtctagatttgatgccttacattaaatcattttaaaaccaactctagaagtctactcaaatcctgcattttctactggaatagtgtcccatgcataaaaccctgtttcgcataggtgtaggctagcttacagaccctcttaccatgttgagattatttctagaactcaggctactgaaccatctggtgctctgcctgtgtctttcacatagctaagaagaaaatttccatttagctttctgatatcttgctgtgcaagtcttcatgctctttttttaaaaaaaattttaattataaattctttcaagcatatagaaagtttaaaaattgacataacagacactatgtactacaacacaaatttaataggtattagcatcttaccttatttgcttttgatagctctctctctctctctctgtcctctctctctctcaaataaaatagttacagctaaaaccccacttatccatcactttgtcctccttccttctcttaggtaagctgctactctgaactttcactccccaagatgtttttatatttttactacataagaatgcatctataaatactggcattttcaagaaagttaatttttactaacttcaacccaaatttgccattgtataggatggctccttttcagggcaaacataggttcaaactggacgccat

SEQ ID NO: 33946 - DNA, 1023 bp, Homo sapiens
aagttctcagtatcttactcaagcacaaaaaggcagcactacttcttgaccaccccaacggggacggtaagagacaatcacacatcattggtgtaactttctccaccttctaaatatctactaggtatttgataaacgtgtgttatttgatttgcacccaaaagtgctttccttagtcacctggagttcatcatctcttttgggcatttctgttgctcaccaaagctaatttttttaaagatgatttggaatagttagtaggaggagaaagcagaggcctgagtaaagattcatcttgaagtacacaaagcgtcgtttattcagagaatgtttatttatgttcatgtctcctgagaacataataggagactgtgggtcttcaaagcagaacaatagacttatagtatctttactgtccctccccatgattcagtttttgccatttccttcagcttcacaagggccatcttgtgagttagccatcccatcctgtgactgtccctttgcttggactctaggtctgaatgccattcatctagccatgatgagcaatagcctgccatgtttgctgctgctggtggccgctggggctgacgtcaatgctcaggagcagaagtccgggcgcacagcactgcacctggctgtggagcacgacaacatctcattggcaggctgcctgctcctggaggtgaagggcacacttatttgcttttgcattaaatttctgagggagatttaaggaaatcttttcaaagaaggaagtcagtagctgctgttctcccttacaatcagctctatttgtttaacatttatggagggcttcagagtaccacctttagacattcccccaacccccttgcttggcatctctaactggggatttcttcaatgacagagccagcccaaagtagcaattgggctagtaataggacccaaggagccatgcacactgggaggtggggacaaaagggcaaaagaaccttccactaacgctttcttgtgtgggctggattgtagggtgat

SEQ ID NO: 33947 - DNA, 1049 bp, Homo sapiens
tccctttcattaaattctaacaatactatggtgcttagtttcccagacacttaatgcatgtcatatctccgtacctttgcctatgcagcttcctctgcatggaatgaagctcctcctcccatattcccatgaacttctgtactcttcatctttcagaaacctatttaagtatcaaaacctgtacagtttttgctcatgccagtaaaaagtgaataacttgtacctctgcgttgcttctgtattattgctgatagtacacagtattatgatcgtcttttataggtctgtcttccatactaaatggcaagctcctttctaacagggagtgtgttttataatttttgtatcttcagtacctgtcccaccacctgatacatgtgagtgaggtattacaattttagaaggtgctgaaagtttttttcttaaatattttaagtagtcttcctgtattttaacttacactgtcattattcataagccatgaacaaagacaagtaagtacagaccttgtaggaattatctcaaatgccagtttattggagtacaaactcaattaggctaaaacttactgaggtcttggtttatgtaagtctctgttaaagggtagggagttagggattttttgtttagttggggaggagacaaatatttacctaactatatagttttaaggcagaatgcattaatagtttgaattgtgttctgtagtttttactgagtgggttcctacttcattcgtttctcccagcaatcctatgaagttagaagactctttacttttctttgtgccttgaaaattctgcgctcaagtgcttgagctcctggcttctcattcgttaggtctctgcttaaaggttcttttttcagaaaccttccctgaccccttacctaaaattgcagccaccctactgctttgccccaggttagtttttctcttatgtcatcctttatttcctttataacagttactatagtctgtgatcatcttgtttatttgttcacttgtttatagtctctgtcctctgaaatatataccctatgagagaagg

SEQ ID NO: 33948 - DNA, 1018 bp, Homo sapiens
gaattgatgcagtgtaagtaacttgtagaacttgaggataagtggtaaaagaaaaaaaaaagtaacttggctcttgaaatacatgtcttcggtttctagagccttcaaaatacagccctgttgttactgcgtcacatgattgttttgaggactgcttctgcttacctaggaaactactcatgccttactcagcaaatgaacatcactattacataaacatcaggtatccaaaagtgttagcaggcttgaggtatgaatgattcattcatatgggtaattaagcaagttgaattatggaaagcacctcacaattcacacaattcagctttgagttcaatgccaaatacgatgattcattaagttgactttgtattttgtaacctaatttgttaataagtaagttacaggaagccaattaagccagctgctgatctatatagtactaccttcctcattgtgattccatagtcttccaatagaaatgtgctgtcagaatctgtatagagagtttgtaaatgccactatttaacaaggttcttaagaatttaggtggatgttttatttgatacctaccaaagaagcctaagtaattgtataatacttaacccatttagaattcagttgtggcagcataaccaatctggagagaccaggggagatgttactaatgcttgtactttattcagaaatgagtgcctcattggcttggtgcagtgacgacacacctgtaatctcagcactttgggaggctgaggtgggtggagtacttgatctcaggagtaccataccagcttgggcaacgtggtgagatctcatctctacagaaaaatgcaaaaattagccgggcacagtggcgcaccagtagtcccagttactcgggaggctgaggcacaagaatctcttgagttgaggaggccaaggttgcagtgagccaagattgtgccactgcactccagcctgggcaacagaagtgaaaccctatcttaaaaaaaaaaaaagtcttttttttttttcatct

SEQ ID NO: 33949 - DNA, 1048 bp, Homo sapiens
gctgggcatggtggtgtgcacctataatcctagctactcagaaggctgaggcatgagaatcacttgaacctgggcggcagaggtagcagtgagccaagactgctccacggcactccagcctgggcgatagagcaagactcggtcaaaaaaataaataaataaataaatttttaaaaaaagtcttggtaaagggatcaattcatcaagaagagctaactatcctaaatatatatgcacccaatacaggagcacccagattcataaagcaagtccttagagacctacaaagagacttagactgccacacaataataatgggaaactttaacaccccactgtcaatattagacagatcaacaagacagaaggttaacaaggatatccaggacttgaactcagctctccaccaagcggacctaatagacatctgcataactctccacccccatatcaacagaatatacattcttcttagaaccacatcacacttattctaaaactgaccacatgattggaagtaaagcactcctcagcaaacgtaaaagaacagaaatcacaacaaactgtctctcagaccacagtgcaatcaaatcagaactcaggattaagaaactcactcaaaactgcacaacttcatggaaactgaacaacttgctcccgaatgactactgggtaaacaataaaatgaaggcagaaataaaaatgttcgttgaaactaatgagaaaaaagacacaaggtaccagaatctctgggacacatttgaagcagtgtgtagagggaaatttacagcactaaatgcccacaagagaaagcaggaaagacctaaaatcaacaccctaacattacaattaaaagaaccagagaagcaagagcaaacacattcaaaagctagcagaaggcaagaaatcactaagatcagagcagacctgaaggagatagagacacaaaaaacccttcaaaaaatcaatgaatccaggagctggttttttgaaaagatcaacaaaattgatgatagactgctagcaagactaataaagaagaaaaggg

SEQ ID NO: 33950 - DNA, 1058 bp, Homo sapiens
tgctttggaagcctatttcctaatcttccaagatttatcatcaccttcatatgtccatagcatgcatttctcagacaggtaagatagaattggtatatatttggtatagcaaaaagtcaaggttgtctttagattatatccttggtttttcatgtggtactggggagaaagcctactgtttcttcatctataaaatgaaggacctgggcaagataacattctgtgaaatttcactgaactttgagctcagcaaagtagggatgcgtgtgtgtgtgtctatttgcaatgcatcacagaccttaaataaatacagttgacccttgaataacatggaggttaagagcaccaaccccctgcactgtcaaaaatccacatgtaatttttgactccccaaaaacttaactactaatagcctgctgttgtctggaggccctgctgataacacacacagttgactaacacatattttctatgatatgtattgtgtactatattcttacaataaactaagctagagaaaagaaactgttattaagaaaatcgtaaggtaaagaaaatatatttactatttattaaatggaagtagatcatcataaagatcttcatcctttgttgtcttcaccttgagtatgctgaagaagaggaggaaaaggatgggttggtcttgctgttccaggggtggcagaagtggaagaaaattcacatataagcagtccatgcagttcaaacctgtattttaaggtcaacggtatttgttacattgcattttgtaagtgaccttgttaatttttttcaatgaaaaaaatagtgttccattcaaatgcctgtatgtttatgagaaacatttcagaactatgaaagttgaattcaaggtttcttgcagattgtttgtatactttctgtaatgtttgtcatataatgagaatactaatggtcttacaacttgaaactgattaactgattaactctttaagcaacttaaaaagaaaatctttcagtgaggaaagagtattcatcagaagtattctagtagatgacatatttttggtaatgaaatt

SEQ ID NO: 33951 - DNA, 1021 bp, Homo sapiens
taaagtttatatggagaggcaaaagagcagaatagccaactcagtatttgaggagaacaacaaagtcagaggactgacactacctggctttaaagcttactataaagctcagataatcaatgtagtgggtactggtgaaagaatattcaaatagaccaatggaatagaataaagagcccaaacaaacccatgtaaatataatcaaatgatctttgacaagggagcaaaggcaatacaatggagcaaagatggtcttttcaacaaataatgctggaaaaactacacattaacatacaacaacaaaaattttttaaatccaaattgagtgtaaacacagatcttataccctttgcaaaaattaacttgaatcatagacctaaatgtaaaatgcagaactataaaactcccagaagataacacaggaaaaatcctagatgactttggtatggcagtggcattttttagatacagctccaaaggcacgatacatgaaggaaatgattgacaagctggacttaactaaaatttaaaacttctgctctgtgaaagacaatattaagagaatgagaagacaagccacagatggaaaaattatttgcaaaagatacttctcataaaggactattgttcacaatgtgcaaacaactcttacaactcaacagtttgaaaatgaacaactcaacttaaaaaatgagcaaaaaacctgaacagacaactcaccaaagaagatacacaagtgtcaagaaagcataggaaaagatgttaaacatcatagtcattagggtattgaaaattaaaacaacaatgagataccgctacatacctgttagaatggctgaagtcagaacactgatgaaaccaagtgctggtgagaatgtggagcaacaggaaccttcattcattgctggtaagaattcaaaatggcatagtcactttggaagacagtttggcagtttcttacaaaataaacatactcttcccatatgattcagcaatagcgctccttggtatggacttgaaa

SEQ ID NO: 33952 - DNA, 1047 bp, Homo sapiens
tatgtgtcctttgctcttgaaaatgaactcagaactctacatctgagtggttttatgaatttatactctcctagtccacaggttctcatcagtgcctcaagatctatgcacagattaaaattacataagatatcatatactacatctgaattagggttttccaaagtatgctattccatggaaatactgtttattcagggtgctccataaacaatgatcctgtgtttcattatgtccaggaaatgccacacagcacctttccagacatcctatcatcatattaaagactttgaggccatgcattaaagaaagttttaaattagaaaaaaaataagttttcttgcttgagcacagaactttattttttctcaggctggttctccttttttaaaattacacgttaatatcccaaagaaccagtcccatagatagatatcacatatgataagaatctgtttcaatggtgttggtgtacatgtgtgttcaggtacctacacattaggacacatctctagtttattaatactgcacttataaagagacatggtagagacatcaagaagacatcattttagggtggacaccattgcctaggacctgcttcttaatgtcaaaaattcagaaacccaattttatctctcccgcagagttgactcgagtgaaggaaattgagttgttttaattaaactcacatgagattgatgtttaaacaaaattgtaagtttatcaattaataatcaagaattctgatttttaattttcaaaatattatttatgtccactgtccagggtacttgctttaagggcacccagtgattcttgaagatgaagagtcttaggaatatttattttctagacctcaatgaagaaagctttttaatcatcctgccccatagaagaatttatgttcctagtgatgtgatcatattggccaatccagtgtttcttttccaaggacagtactgataaggagcaccaaatctacctctttgtcctgaacagatcatctccatctattcatagtttggctcagaagttggacaaggc

SEQ ID NO: 33953 - DNA, 1050 bp, Homo sapiens
gcattttgtattagtgaaatcatgtatttggcctttctctctggcttctttcatgtacctcaatgttttcaagtctcattcattttattaaaaaaaaaaagtaccttttttctttttcttttttttttttttgtccacgtatatattcacaccacattttttgagacagagtctcgctctgttgcccaggctagggtgcaatggtgcaacctcagctcactgcaacctctgtctcccgggttcaagtgattctcatgcctcagcccccaagtagttgggattacagttgtgcaccaccacacccagctaatttttgtatttttagtagagacagggtttcaccatgttggctaggctggtctcaaactcagcctcaagtgatccttctaccttagcctcctaaagtgctgggattacaagcatgagccactgtgcccagccacattttctttttccatttattagttaattgacatttggatcgtttctactttttggcgattataaattatgctgcaatgaacatcggtgtacaagtttttgtgtgaacatgttttcagttaccttgggatatacacctaggagtgacattgttagtaatatggtaactttatgtttaactttttgaagaactgccaaactgttttccaaagtagctttatgcttttacatttctgccaacaatgtatgaaggttccagtgtatctccacatcctcaagaaaatgttattgtctttttaattgtaaccatccaagtgggtatgaagtttatctcgtgattttgatttgcattttcctaatggctgatattgggcatcttttcacgtgtgtattgaccatgtatttttttgagaaaagtctacttatatgtttttaattgtattatttttagagttgtaagaatatgttatgttgatacttgaactttgtcaaatgcctggtttgcagatattttctcctatcccacaggttgtcgcttcactttgataatgtccttaaagtacaaaagttttaaattgattttgatgaaactcaatttctttttaattg

SEQ ID NO: 33954 - DNA, 1042 bp, Homo sapiens
ggtgatcatgtcatctagcaaagacaacttctttctaatctgtataccttttattttcttgtcttaatgtattagctagcatttccagtatgatgttgaaaggcattggtgagaggcaacatacttgccttgttcctgatctcagcaggaaatcttcaattttatgttagctctatggttttgtagatattctttatttacattaaatatgttagctgtatggttttgtatatattctttatcaggttcaggtagttcccctcttttcctagtttactgagaggcttttgaaaatcattaatcagtgttggattttgtaaatactttttttccacctattgatattaccatatgatttttctttagcttattaacgaaatggattacattaattgattttcaaattttgaactagactggcatacctggagcaaatcccacatggttgtgatacattatttatgaatgcattcatggtcatggttgctattagtctgtagttatcttttattgtaaagactttggtgttggtattaaggtaatgctgccctcatagaataagttatgaagtattttctctgcttctgtcttaattgagattgtagagaattcatataatttcttccttaaaactttggtagaaatcagaatgaaccatctgtgtctggtactttgttttgaaaagttattgctgattcaatttctttcatagatataggcctatttagattattattttgcataaatattggtagttgtgtccttcaaggaattggtccatttcaccttgattattaaatgtgtgggcacatttgttcataatatttctttattatcctttgtttttgagacagggtctcactctggttgcccaggctggagtgcagtagtatgatctcagctcactgcagccttgacttcctgggctcaagtgatttacccacctcagcctcccaagtagctcggactacaggcacatgccaccatgcctggctaatttttttattattattagagatggagttttcctatgttgcccagt

SEQ ID NO: 33955 - DNA, 1034 bp, Homo sapiens
agttagaggagaagatacggctgggatatacatgtaagagtcagatcatatttaaagctatggcactggagatcacccagaacagtgctgtcatattgtgagttgtgccccattaatgagtcaggaaatcaatgtaatgagtaacaaccagcatttaaaaaaacaagcacagagtaaaaaatatcagatttatcccatattgtaggataagtattgcttcatgacatttttgtttctattttattcagtgtattgtgtgttacattataaaatatatacctaattgtgtggcatgctcaaaagtttgaaagccagtattcgaaggatggagtgtggattgagcagagagcaaaacactgagctgtgggtcactgagacatctgcagagtagccaatgaaaggaatcaggaaagaattgccaaagaatttaatccagtgcagaaacttgtcaaataacccagcctttggaatggaagtttatatcaaggattactgaaaccagcatacttgcttagaataacataatatctgacaattttcactttggtaaaattgcttcaatttatgaaattttatttataaatagtactgttatattagaacaatacctattcttaaatgtctctaaataagatcttttatgaatttaattaatacttttggactgatgtacaattctcatctctataatggaaataaaatacttttaaggattgtgagcattagaagtaatgcacatgttctgtgtgcttagcacatagtaggtggacaataaaatgtatgtaatatttaaaactttatttacctaacatttgttgagctcctatcaaattgtagtcacaaagataacttatttgaaaaaacaaaaaacaaaacacaggttaatcatttgcagcagttatgcactttttggtcttcattatataatatataatttatctaatatataatgttatgtatacataatgccatagatcttgacttgaattttgatcacaaaattttcaagctttattttttctggactgtggaga

SEQ ID NO: 33956 - DNA, 1049 bp, Homo sapiens
tttatcaaggctaagatatattcattagaatgaaagtgaaaaaaaaaaaccagatctgaatgcctaaatattaaacctatgactaattccaccatttaaaaatatattagaacattcctgagtaatgaaatcaaagacataatcttttctttttacccatttattcattcggcaagattcccaagcaaattggcacgtccaggaaagagatgcacactctatttaatatcctgaagtttgtggttttgtctgctactttctcactccctctctgcagagtggcacctgtcaaagctgagaaagagtaaattactctatttctgtgcttggcaggaatgtaatatggagtaacaagagctgtgccgcagaagccctggagacagaagttgattctatagtacctaccttcttaaagctcgtgacagaaaattagcgaactaaggcattctgaagctagaaaagaaaaaagaggaaggatttttttttttttgcctgtgatatttgcatacttggagcaaatactggttctactctctaaaaaggcacagtgcaagccaaaaacatcacatttgtacaggtttacaaatatttaatatttattttaaaaattatattagtacataatagggagacattattcaaggagagtaatttttttttttattctaagatcattaagtaacatttttaatctcccagggggaaaaccaacatctatattaaaaaaaatacgttaagaatcaacagtactttgttgcattttctctcaggcatctcattaatttttagatatcaccatgggcaggttattgctattctgttttgctgacatttagcattttattaagtgctaacagtgagaagagtttatagaatatgtctaaaatcctattttcatattcttatgtgccttacaacgtggcaaatataggcatactttttaaaagaatatttctacatatcttaaaagctattaaatagcatggctttgtttccagttttttaaaaagtgttaggatgagcctcgtaattactattttttagactgt

SEQ ID NO: 33957 - DNA, 1239 bp, Homo sapiens
ttacaattgaattttggctgtatacacttaagttgtaatatagattttgaagaagctaaacttagaatttactaaatttaaaaatccaattttcattaatatttatgtttatcaagaaatgaaaacagagttttctaaatgccacatgttttgctttatccataattcatcgacttggagacaaaataatattttcacttattagtatgagcaatcaattacatcagctaccaactgaaggagatctcacattaaacattcatggctggtcgtttttctggttagaagttcatatctaacagagttcatggaatatattactcattacatccctataattggatcatcttgttttcataatattatgacaaagaagcaactctaacagcagggctacagggtatactcacattacattcactgtttcttaaaaggtttatagtctgttaaagtaaggcagaattgtggcattttaagtttgttgttttcagttctggtaatttcaaacattgcatgataataagatctttgtgaaataaaattatgtaggggtatggaggatcactgtgaaaacattctcaagattcatgtttctgtactgtcaggagaaatctctaatacaatctgtattaagattttattggtacttggttcatttggatgtctcaacgactgactctttatgctgaattcatttaattacatcaagattttggtgcatattataataaccattctttttactaataaaggctgtattaatcctcatgatataagctattttttaggcctatccaatctgccatcctctgctcttacccatttctctccccacatcttatctaccattccttgaactttttactgtttttcttttatacaacctatatttactatttacatgtctttccttttttcttccagccttgaatattcttcttcccactccccttgctagttgaaattatacttgtcttttaaggatcaattcaaacgctgcttccttcattaagtcttctctatggagtcaacctgcctgaaatttagttagctacctagctagataacccatggccagatactcaacttctccgtgccttggttgcatcatctgcggaatggagatcatagtgtataccttatggaattgttggtacagtcggtgcattaatatggaaagcaattagcacagtgcctaggaaactgcaaatgttaaatatttgctcatatggaagtgag

SEQ ID NO: 33958 - DNA, 1027 bp, Homo sapiens
ttatattaaatggtttaaaatataacaagattgccaagaacatgtttgctatttgcttaataatactctttggatttagtgccaaaatattagtgtatatcagtatagaaattgaaatagatatatattacatacgatatgtattatatattgtatatatgagtgatatatagagcaaaacatgtgttaaatttatttctttttctgggagaaagttagagaagtcagccagagtaataggaaaaataatttaaactggcaaagagatggataaaattttactgggcaaaattgtccattatgacattaaacattccttatattaacatgtttttttaaaatagaatactaattaattatgcttggcaatcaagaggtgttactgttgataggaatattttataataggttttaatgaaaaccataactaatctggtgagtttttaaaaataaaaaagtaatgtaccatataatctttattggtgaggaatgtaacaaggaggtagagaactagtagaaaggtatctttatttttcagtgttaccatcttcttatgaaatattaaaaggtttaattagaaaaaaagaaacgtaaaatgcacaattttattataattgtatgataataatacacttattatttaaattttaaaaggtttttaaaaatttcacgtgaagtaacacataaaataatttaatcaaatcctcctgaaatgtatctgtaagtacaacatagtttttatcaaaatctgaagactttttgtagctgtagacaagcttattctaaattttatatggaaaaaaaaatttgaaaaagagcaacagaatcactctagtgagtgttaagacttactatatagctatagtaattggagagatagacatacagaacaataaaacagaataataaaacaataaaacagaatagagaagcataaaatgcataaaagcaactcaatggaagaaggatagtcttttcagcaaccattgctctatcaattgaacatccataggcaaaaaaaaaaaaa

SEQ ID NO: 33959 - DNA, 1056 bp, Homo sapiens
atgagctttgtggggccatccatctctactatgctgcagtatgctttgggggagtcctattactttataactacctgccattctccattctgtatctgtccaactcaatctatgatggttgttggattaatcttcataatatagaaccctaatcacattgagcatctgttctggaatggaaaagaataaaatgttaataactttcttcatgcaatgggagttttgtgagttaccatttattaaaagctgaccaaataaattctacttagtaaacaaaaatatattgatacatttttatgtctggtacattctggcacctaaggatagtgaattgattcagaatttatgcatatcacactagtagggaaattaaaattctataattttgtatttaatcttagccgatgtatgtgtgtgtatatatatatatgcttatctttctgatattaattttcttacgtagaacatggatcctccaggcataactagtttctatttctcatgtacgtcctcagaattcccgaaacctctttgttattgccaatctggaatgactttcctccctttatcacatttctatttatctttcaatatgcagcttagatattagatagcaagtcttccttcctttctcaacatcttccttctttttctatggaacattactttttaaccttgaactataagttacttaggttcacattttctcctccatgagactgctaccttttgcaggcaggaagtagcttaaaagcataagcttttgagtcagatagaccagactctgtctttaccagttttgcctacctaggcaagttacttgctttctctaagtcttggttttctcatctgcaaaatggggatgttagtaatgacttctgtatagggtagcagtaagagttaaagaagacaacgtttgtaacacacttagtaccatgcttggttcattggtaagtttccaataaattcaaggcatttttaattattatataattttaattatatattaacaatcccttctaccctgtgaactcttacaaatcactcagtgttttg

SEQ ID NO: 33960 - DNA, 1050 bp, Homo sapiens
aatagtcatacctatcatgttaggtagttagttaatttctttcccactacctcaacttttttcttgttatttttttttctcctgtcctatttttttccctgttggaacttgtaaataaataattggagtaaatatcacacaaggatagttgtgttcatataccagcataccttggcgatattgcaggttcagttccatactaccacaatgaagtgaatattgcaataaagtgaatcacatgcattttttggtttgccagtgcacatgaaagttgtgtttacactatactgtagtccattgtgcaatagcattatgtctttaaaaagcatacataattttgtttaaaagtactttattgctaaaaaaaaaatgctaagcatcattggaaccttcagcaagtcataatatttttgctggtggagggtcttgccttgatgttgatggctgctgactgaccagggtggtggttgctcaaggttgaggtttgtggcaaattgttaaaataagacaacaatgaagtttactgcatggattgactcttcctttcacagactatttctctgtagtatttgatgctgtttgatagcattttacacacaatagaacttttttttttttttttttttttttttttttttgagacagagtcttgccctatcacccaggctggaatgcaatggtgcgatcttggctcactgcaacctccgcctgctgggctcaagcgattctcctgtctcccaagtaactggaattacaggtgtgcaccaccatacctggctgactttttgtattttagtagagacagggtttcaccatgttggccaggcaggtcacaatagaacttctaaaattggagtcagtcctctcaaaccctgctgctactttatcaacaatgtttatatagtgttctaagtcctttgttgtcatttcaacaatattttcacagcatcttcatcaggagtagattccatctcaagaaaccactttttttgctcatccataggaagccactcctcatctgtacaggtttatcatgagattgcaccaatt

SEQ ID NO: 33961 - DNA, 1070 bp, Homo sapiens
cctaagtaaagagagacttataaaagtaaattttctaaactcttttttgctcagagcctgaagagggttttgtagagaagccgcctgatacatggggtcaggctttgaggtcagcatcctgcccctcagtagctgttttgttgtgggcaagttcttaatttcccaagacttcatttcctcgcatctaaattggagataataaagtctttcagggatgttgtgagcatagttctgagtgccatcacccagcacagcatagtgccagcacataaacactcagtaaatgtcagtttgctttccctccaggggaagatgtgtctataatttttactatgaaattttctccaactagtcatgaaaataaggattagcctgttttttactctgaaaagctgactaaaagaagcagatgagaaatcaaggttatttactttcccattccctgtagttgttgctgcctttactggataccagccttcctaggctgttttcagagtgaaacaagaaaggtgggatgacagcaacatggagattgttgacttctatgtggctcatgtaagtctagaaggaggaggaggaattcaggaggaggattaagaacagagatcttgctttcctcttcctgatagagtattgtttgtattgtttttagctttccagttcaaagggggcatctggtttataatattttactttcgctgggcgcggtggctcatgcctgtaatcccagcactttgggaggccgaggtgggcggatcacctgcggtcgggagttggagaccagcctgaccaacatggtgaaaccccatctctactaaaaatacaaaagtatgcaggcgtggtggcacatgctgtaatcccagctactcgggaggctgaggcagaagaattgcttgaacccgggaggcggaggttgcagtgagccgaggttgtgccattgcactccagcctgggcaacaagagcaaaactctgtctcaaaaaaaaaaaaaagtttctaaaatttacagaaaatctcctctttaccctgagagcccctccctaccctgaagttggtgagggaagattataa

SEQ ID NO: 33962 - DNA, 1022 bp, Homo sapiens
gcatattgaaaattcaacatttgattttctaactgtcatgggctttacttttattgactattgatgtggctgtttattgtcaggtgaaaattttttaatatgttcacacactgatgattgcatatttgcagcacacagcatcttaaaccactcagaggtttgtcacaaaatgtgtgtttcttgctctgtaatttttttgtcattttgatggcatattttaattatgcttttatttctctccttctaccaagtggagacctctgtaacaaagatttttcagggttgcatatttcatctttaaaagctgtgtacactgtggaaacaattgttaaccaaaagcactagataatttaggataactgagttcaagttctgacttttgtacctgaataggtgtctaacatttctcagctacagttttcttattacacaagcatatttccaaggtatgttgaagctctaaactgcaactgaaaacttccttaatgtagaaaaactatataggatctaaatattgtatttttgtatggttgtccttctgtttactcggagatttgactgtatatgtggcttatgacaatagcatttttgttaaaagcattttatagaagtgtgaagaaaaactaaaaatacaaccagttccaaggtttaacaaaactattccgtttctgagttctttggctgtcattgagcaacttgtggtttctgaaggaaattatgtgaattaggatggttttgtatcatttatccttaagaacagggaaaattgagatgttttcttatgtttctgctggagattttggaaagatgtgaaacctacacctacagattgaccttgcttagttagctctgaacctcctgctgcctcttccacgtaaagtgaaaattttggattcttatcggcttcagataaacttacaggttagtgaaacatagggactgagatatagtaattcattctgaagctgttttggagtggtcaaataattttagttggataatatatattactggctaatgat

SEQ ID NO: 33963 - DNA, 1043 bp, Homo sapiens
tccaaagtgtttagtgcctcctattttattttagtgttaagattttgtaggtacttggtaattatcagcagaatatttacataccaacaaatagcaaagccattgataattaatagaaaaacaaaatcatagcttatgtttagttgtattttttagtgtatttcagtgtttagagttgattttatattgcatatactaactgtggtaatagtttctactggatagattatttcaagttcacatgattatagaagtattttatgaagtttgacatagataatggtggtttcagggtcccttgtctcttgggttgagtttttacatcattgaagaattaaaagattgtgtcttggtgtctatgtatggccaagaattaagacattctgatgtacagtttcattttctaactaaggcaaaaatgttttttgaaacaattactttttaggataaaagtataaaattatgaagaaataatgtgtaggtttgctaaatgttgtgttcttaaatcttgtgttgaggtctgatgaatttttttatatctttaatagttctaaagtagtgtactgaaagttaggatcatccatgttgctacttaacttgttgtccatagggtctgttgtcctggatgttggtgttataaatgtacagagttaggtagttttctgtgaagagtttgcaggctaatatcactgtttttgacaatgaaaaatatagcatgaaaattaaggttggggtatggagaactttctagagctattgctttttctagctgatgattaaggttgagaggcagaagtacattgtgtcagggaggacctttcccttttatgcatgcacctggcatttatcacctttaacaaagtgtgtgtgtcatgctgtgctgcttgcttaaggggctgtatgcctccagtctgagtcacatggtaactgcatcagcagtcttagcctgtagcattttattatttcttttcaaagtttacacttggcctaatacttagacattttataattctttacagtaaatgaaactatacatgagaaga

SEQ ID NO: 33964 - DNA, 1048 bp, Homo sapiens
gcagtgcctcgcccagagttaccactaaaatagtattagccattgtggctgaagcatgtcccctgtcagtacatacagaacaccctcattcttatttatggctggctgctattccattactcatcagatgtaccacaatgtatttagccagccctccacagaggaacataagttgtttcaagactttaggtagttcagacagtagtgcagtgaataaccctatacattcattatttaatatatgttagactatatccatagaataaattcctaaatgtggaattgctatgtcaaaagagaatttgtattttgaattttgatagattttattaaattgccctttataaaggttgtagcaatttacacttcttcctacaatatttgaaaaccattcccaatatattataaaagtattttcaaaatctttgccaatcttataggttaaaaggaatctcttttaattttactttgcatttcttttattgtgaaaagttgatcacattttcatatatttgtcattttttctctgatgttctttatttttctttagtatttttattgatttatggaagttttctatacaaaaagaaaaattatccttttttaatttgttgcaaatatttaaaaacatttttgtttgtctattttatggtatttttatcttaacatgcaaatttggaaacttaaatgttcttcagtaagaaattggctaaatggttattggcatacttgcagcaatgcaaagtgtatttgctaccatagaaaaatggttatacaagaagcaacttacaacactgcaaatatagtattcctttttttaaaaaaagttcatattcatgtgcatttatgtgaatgtattacataagaaaagttcagaagtcaaaaccttcacaaatacctctagattttgtgaattgaaaatttaaaggcaccaaccactacagaattaaaaataaataaactaacattttataacccaactttctggtcaagttttgcagcatctattatttaccctccctccccaaaattcttgagatattgtgat

SEQ ID NO: 33965 - DNA, 1071 bp, Homo sapiens
ctggcctaaggaaacaggaaagagtttgagacttccttctaaaggagccacgtttgagaaatgggatgcaggcctaagttaagaatgctacagaaaaatatcgatccctaagcgtatttactgttatgtgaatgtgtgtgtcaaaggacttaggtgctttgggggagaggagggtgaagacaggaatttattcattgagcgaatagttattaagcgcccactctattccagacaccgttctaggcattaggtgaacagcagtgaacaaaacagacggaaatctgtgtctacttgtagctcacattttagagaggaaggcacatactaagcaaagtaattagaaacatactgtattttaggtcgtgatagtcctgaagagaaacgtaaagcagggaagaagggtataaagtgacacaggaaggtcttgctgaaaagatgacttttaagtaaagggctgacagaagtgggagatttaaccacgcgaatatcttgggaaagtgcagtcagacagagggaccagccattgcagaggtcatgaagcagaaacgtgctagaatagcaaggaggcctgtagggcagagttgagtgaagggtttagtccttcactggagattaaatcaaggcgagcaggtcatgaagatcttgaggacatctaacttttattctaaatgaaataggactttggagcgttttgagcagtagagtgatgggctctgacttccttttaagagggtcactctttaaggaaaatacacagaggaggacgtggtaggagaaaggagaccaataagaagagttttgcaataatccagaggaagcataatggtggtttgactatgggtggtaagaaatggccagttatattcttgatgcacttaatttggatatgtaagagtattatagatgacagggttaattttatttaattaggctttggaggacacttgaaaaatgaattccagtgtgagtttcagagtggcaaacacaagttaaaatcatggctttgctatgtggtacttgaagggattcagataagtcatgtaattttcctggatctgtctataaaatgga

SEQ ID NO: 33966 - DNA, 1043 bp, Homo sapiens
acacttacacccacttagtcataacttaatcttgtcattatttcagttgagttatatatgcactattggcatatagttgttgagtgtaatttcccttttaaagatcatttagaagattatgattagcattagaatgaaaagttactgtgtatgtggggaaacaaagggtgatacaagataaaaatccagggttaaatttaaaagaagtctgtcaataaataatataggatgtgtctaagtaataagaaagcattgggtcagttgattcaatagtgttttttttcataatgtacataaaataatagagcttcttgggattgaagccattttacaattgatggcattttagatttcttgtatagtatttaaagcttccaacaaaaatgtaaatttttacctactgtaattctgaaatagggaaattagaggttttgagtagagacactttcaaatttgtgtagcgttcctatatagcataagaattctaaaattaaaagtctgcctgtaaaactttgatttcaaagtagtaacttacttatgtttgattcccaatgttgtcatcgtggggcagagattttgctttttcaaaaagattgcaggcaatttagatggtgtgggtggggaggactactgaggaaattgctcagtaaacaaaaatgatagtgaagatctcagaatctcaaaaatcatcttttgtgtgtgtattttaatgattaagatgtactataaattcatgtacagtatttgggattctgcattagaggcatcgtatgattaatggctttttaggtttgatgaagtatgataattaacattgagaaggacaaaattaatgtgaagggacagaatgatttagataatatgtttcaaaagcttttgtcctaaaaaatgcattattaccattttaatttagtaaaggaaaaagaaaaggtcttgatcctcaccaaacacaattaacatacttggtctacagttttctgtgcttctctcttcataaatgttttatattttcaattactgtgcatgtcattcttatatctatt

SEQ ID NO: 33967 - DNA, 1037 bp, Homo sapiens
ttgacttatactcaatgtaaaattgaaaaatcacaggggagtaattagcatagagattaatgaaatgagcactgggttgaatggtaaaagatttgtttgagctttaagcagtattgttgttaaactatcactgtgccctaagcgtaacattattttaaaaatgtcttcaactgtgtttcccccatttgtctgaaagcttagttagttcaaagaacatgtttatttttgttctctactataaacccagcacatgacacaaaatcagggagtgtaaagttggggtcatgaacttattttaggagcctggtaggtaatataaatggcagacaacagggagtagtaaagtgtctgtctgtcttacttaaagacattcacatcagttatttccaacactgttagccctggaaaagaaagctatccctgaactttgtcaggctagtttgtgatccctagaaaagattagtgattaagaccaaaccctgaagaacagcatcattaatgggacagattaaaaaaaaaaggagccctgaaaggaggtgacaaggaagtaggaggtgaaatcaggtacaagtaattttttaaattaagaaaagtatagccctctccctctccctctccctctccgcaccgtctccctctgatgccgagccgaggctggactgtactgccaccatcttgactcactgcaacctccctgcctgattctcctgcctcagtctgccgagttcctgggattgcaggtgcgcgccgccactcctgactggtttttgtattttttggtggagacggggtttcaccgtgttggccgggctggtctccagctcctgaccgcgagtgatctgccagcctcggcgtcctgaggtgccgggattgcagacggagtctcgctcactcagtgctcaatgttgcccatgctggagtgcagtggcgtgatcttggctcgctacaacctccacctcccagccgcctgccttggcctcccaaagtgccgagattgcagcctctgcccggccgccaccccgtctaggaagtgagga

SEQ ID NO: 33968 - DNA, 1045 bp, Homo sapiens
aggtgaggagcgtctctgaccggctgcccggtctgagaagtgaggagcccctccgcccggcagccgccccgtctgggaagtgaggagcgtttccgctttccgcccggcagcggccccgtccgggaggtggggggcagcccccgcccggccggcgccccgtctgggaggtggagggcgcctctgcccggccgccccatctgggaagtgaggagcccctctgcccggccgccaccccgtctgggaggtgtacccaacagctcattgagaacgggccatgatgacgatggcagttttgtcgaatagaaaagggggaaatgtggggaaaagaaagagagatcagattgttactgtgtctgtgtggaaagaagtagacataggagactccattttgttctgtactaagaaaaattcttctgccttgggatgctgttaatctataaccttacccccaaccccgtgctctctgaaacatgtgctgtgtccactaagggttaaatggcccctgctctctgaaacatgtgctgtgtccgctaagggttaaatggcccgtgctctctgaaacgtgctgtgtccactaagggttaaatggattaagggcggtgcaagatgtgctttgttaaacagatgcttgaaggcagcatgctccttaagagttatcaccactccctaatctcaagtacccagggacaaacactgcagaaggcggcagggccctctgcctaggaaaaccagagacctttgttcatatgtttatctgctgaccttccctccactattgtcctatgaccctcccaaatccccctctccaagaaacacccaagaatgatcaataaatactaaaaaaaattaaaaaaaaaaagtatagaaaatttagataactttaccaaggtcacacagtctaagtatatataagcaagcccaagggtatatatacccatgttcctctgccagtgctagtgatcattatctgcatgttactagaaaacattaacataaacttatgcatccaacctatatttttaaaaaatttaaatgataattaatc

SEQ ID NO: 33969 - DNA, 1042 bp, Homo sapiens
ttcgaagaaaccacacggctgccttgggccccaaaagctgcggaaaagcgcagtattcagttaagcaaataactacttacactgtttattttggttacgattccttaagtgagaagtaaatcaattaacaggacaaatgacacgatggttaggcacgaaagggacagtgctgccacctcattagcttggagcaaccttccagctcataccatgcggactgatgactaaccttgccaggcaacgctgtgaggtttggaaacccacctctttgacctaggcccggtcaacaccgataaaccctctgaatcaacgctggcgctcccaagcccactcacacgccgtcaggaagcagtttccgaaacaggccgggtgcgggggtgggggatcccgttccagccccacccctgaaagttgctgggagtggcacccaaagaactttcccagattgatctctgttgccgctcagggaggtcagctccaggccctcagcctttcggccgggagccaaactgccctgcctgccaagcccctccttctctgcaccttaaacagccgcgaggggagagtcggctgggattttcttcttaagaagtcgcgcaggtttttcgagctccactctgcgccaggagagccacggcagcaggaacgggcactgctgccaccgggccgacgggtgagtcactgtttggaaatggagtgggcgggcgagggtgtgagagaatgaatgatgtcaagagcgcgctgggcgcagggcgcagggagcgggccgcgcgcggcgggcggggagagcgggcgcggggccgcggtcaacactgagcgccgcgccgtgggccgagtggggcggggagacccagccctcggcgcgcacggagcctggccggtgctgcagcgccgccgagtgcggcctcgggggcggcggccgcgggagggacccggagagctgcttcccctagtcaggccgcggcgtgggagggcgagaccccgagcaaactttctagcggcttcggcccgagggtggtgacgcccggggctggtcgcggcg

SEQ ID NO: 33970 - DNA, 1020 bp, Homo sapiens
tactttgagaattatgtatcaaaaaatgacctcagggttatgcagcggaaaggccatgcgatcatggagcattgctttagggcttccagtggatatgtaatgctctgaagctagatatgggtttttgctttactgttttttccttctgttatatccccctttttatataagatataataaaaatgcagtcacaaaaagtaaaccacagtaagtcagatgaaatgtttgggctctgtgacatatatggaaaccatatttatacagacacattagtgactcatttaggaaaagaaaggtacctgaagctctctgggaaagggtaagataattctggtgtctttgagtgtgtgggctgccacattcattcaactgctattctagggctgggctgcaggttcttggctagtggccaggaacaccaacacaaacaggacatggactctatccttgcagctcataaccagcagaggagatagccctgtgttaagcagtgagcttttaaaaccctgtgctgggctgaagagatgtgtaggagcataggtatggggagaaagccaatggcattcaatctcaatctgatctttaagagttctaagttcgcttgaatttatctttgcaagggaaatcagaatgttagagaattgtgttgggaatgtgtcaccacatgccaggctagtggctctgcagttcctgagcaatgttttgtagtagtgactaaaccctgctctgaggaagtggtgacattaggagatgcaacggagagtaaaagtagttggaacctttcttcctgaacttgcagagtctctctctctggttctgtctttgctgactgagagatggtggtgtttcccaaggaagtagttggcctgaaagtcaaaaggatgaaaaggattggggagtgactctcagagttgcctcaaaagccagtcataatagttaattttgaattaggtagaaactctggtcagttgtacaacataagtacatgacgttttattcaacagctatagagatttcttt

SEQ ID NO: 33971 - DNA, 1029 bp, Homo sapiens
gaacagcctgccgagtcagagctaccaaagtaccaaatgctggcttcactgcttactagttggtgaccttgggcaattcacttgatatctctgtgctcatctgtaaaacatgggtaataatatttaacctcatagaattgtggagatgattaaataagataatcaaagcatttagaactgtggcatttgggcaatagtaagtactatatgagtgttagctatagctcttgttcttaagtctaggctatataaatttattttttttatatggaacacttcgcgaatttgtgtattacccttgtgcgggggccatgctaatctctgcgtcattccaattttagtatatgtgttgccgaatcgagcacaggctatataaatttaaatcattaataggatacatagtcaaaatttttaaacacttggaaaatattccaatctagtgttgttaaactgaaataaaaatatatttttggcagaggaaatatagcataatagtaataaagcccaattagctctgcatgatcacaatgttgatgaaattgtttaaagtgtatatttgtaaatacttttccaaataaaagcttaaaataacaacaaagccacaatataataatcacttgggtttgcaatataaattagattgttaaaggcttggagaaattttcacttttacttagttttgcatgattttatcgtaggtaaggaaagctacacaaagtggtcaaccaacatttcccagaaaactctttttgacagttgatcttcaaattaaggtttctgattgcacttcggtaaaaacctctgcaaagaaagtgtgtatttaggctgttatctgttgaagagcaataatgcctttgatgagtgcattcttattcttaaagttgctgcccgccaggtgtggtggctctcgcctgtaatcccagcagtttgggaggcctaggcgggtggatcacctgaggtcaggagtttgagatcagcctggccaacatgggtgaaaccttgtctctaccaaaaatacaaaaatcagct

SEQ ID NO: 33972 - DNA, 1136 bp, Homo sapiens
atagaaaatacagtcttaggaaggattgatgtgatctctgggtaatttctagcttattatgacttcatggttagcaacaagtgatagtgtctgatgaagtgtttgcaatgttaggtcctgatttttctttaaggaaatttaaagggaactgattgttaaaatgttcctatttctaccaatactagctcaaaaagagacaagaattccaagataaaactgttcagtattttgtaaataaacttgatctcagcagctttaactaggttctgacgttacatttataaagcaaatggctttggtatttgtttccttagtttaagaatgtttctgttttggatggttgacagttggacaagcatagtttctgaacataattttgttttgcttttaggtgggatagtaacatctttttgagggaagaattggcttcctttcttgaaagtggtgaaggtacagcatatagctgcatggaagaaacagtaatcggatggctaccttctacattttgtattaggaaacaaagtccattgtaagagtccatgttgatcttggaaatagaaggattgaaaaaagctaaatttccacaaagaacaagaacttgaccatctcctttttgatctgaagactaggggacaatggatatcatagagacagcaaaacttgaagaacatttggaaaatcaacccagtgatcctacgaacacttatgcaagacccgctgaacctgttgaagaagaaaacaaaaatggcaatggtaaacccaagagcttatccagtgggctgcgaaaaggcaccaaaaagtacccggactatatccaaattgctatgcccactgaatcaaggaacaaatttccactagagtggtggaaaacgggcattgccttcatatatgcagttttcaacctcgtcttgacaaccgtcatgatcacagttgtacatgagagggtccctcccaaggagcttagccctccactcccagacaagttttttgattacattgatagggtgaaatgggcattttctgtatcagaaataaatgggattatattagttggattatggatcacccagtggctgtttctgagatacaagtaagtaaatctaatgttttgaggatttgtcatgggtttgtttttg

SEQ ID NO: 33973 - DNA, 1033 bp, Homo sapiens
ccaaaggtaaaatgtgctcagattataggcacttgtaattctaaccttgtatccatttgatcaaagaaaatttgtagaacatttttacctctcatgatcacaatcattagtgtctccctttataacgacctatgttttgtttactttgaaacaccaaatttgttgtcttggttttttttacatgacagaactcatgcagtttcttttttagttgaaagttcacatcttgccccttgaatagtttgaacatttctttcttaattcttttttgtttttgttttgcactgtaaaactgatgaaaactttaagccaatcttaatgcactagcctctgtagtgtaaggaagtgtgagaaggagtttcttaatgagtttacacgtttaaatcaagcatattataagttatatgccatgtgttgaaggcttttctatttatatatataaagatttttagtatttgtttttagtgtccttgtgttgcaataatttaactcctttgactcagttgctgaaaatatttcttctattaagaagtgctcttgacttcaacacccaaacactgaaaatcatgtcaatgttacccaaagataagtttttatacagatacacaccttataagttctgatttattttcttactcattatgctgtgttctaaataaatcatgaatgagaagagtgctttattgtgaaattatttaaaactgtcctttaaaagaaaaagaggaaacgatgaacaaaaactaatctaattgccaagttagaattcattatttaatttacctcctatgcaatgattaatgctgcaaaatgtatggttatgttaccgtatattcacaaaagaaatattattacaaggtttcagaggtagccaattgcattcttttggaaatttactgtactgtttcaatgtgttaagtgccttgttgtaaagtaaaattttaagtctagattcattattttcctgacatatatttttcattatgatatctactgtatgctattgtgatagttttatgaaatgcttacattttaa

SEQ ID NO: 33974 - DNA, 1052 bp, Homo sapiens
tgaactgcgatcagttttaattctatcagttatttttgatttttattctgtaattgtgcagtctttgtcaaagtagttttctctcctaaacggcctcccggctctccccggtctttccttcgcttgctaggttgtaaagaatagtagtagtcatgacttttgtagcactttgtaaagtcacctaatggaagattgctgaggtcctggttttgacctttgaaatagtgccgtctgtgcagagttctgagcttgcgattttggcgctgcagcggaataagtctctctctttttttttttttttttttttttgagtcggagtctctttgacccaggctggagtggagtgcaatggcgcgatctcggttcactgcaacctccgcctcccgggttcaagcgattctcctgcctcagcctcccgagtagctgggattacaggcgccccgcccggctaattttatatttttagtagagacagggtttcaccttgtgggtcaggctgatctcgaactcctgaccaaaggtgatccgcccgcctggcctcccgaagtgctgggattacaggcgttagccactgcacccagccggaacaagtcttttatccattgtacatcttcagggcttttccattgttctgctgagctgtggttcaggctcagttgtgcgagtgattgattacctggctactgtaatgcttgtactttttttttttaaaaattattccatttcagctcacattggagaaccatggttttcgtatcctagctgattatattcttagcatttcagtcctttgcaacttggtttgttggggaaggcggttatagtcatctaatttttcttggggacagtactactgtggctacagtcatgagagagtttactttttcaatgtcttgtttccaaccaagtccacgctttcatgcttgctttttaaaaacaaaaacaaaaaaaccttttactattaggtattatatatctcaattttcttctccttggcaagttttttacaacgtttttatttgattgcattttcttctaaaagctatatccct

SEQ ID NO: 33975 - DNA, 1080 bp, Homo sapiens
aactctcctctacccggaaagtgtccatcatagcaacatcttccagggattcttaaatataacgatgctgttgacatgtctggttatccctttaccttttcagaatttgtgggaggtgagaagtctgggagaggttatctgggttattatgaaacctacacacttactgaattaaaaaaaaactatgtaacacaattctagtctaaaaatgggcgcacactttctttgccttttagaaatactttttgaaatgtaaaattcgaagtctaataaaggagtctgtccaattaatttaactgtttgaagaaaaaaaccagtccaggcatggtggcttacgcctgtaatcccatcactttgggaggctgaggcgagcagatcacttgaagtcaggagttcgagactagcctggccaacaaagttaaaccctgtctctactaaaaatacaaaaattagctgagcatggtgacacatgcctgcagtcccagctattcaggagactgaggtggaagaattgcttgaacccaggaggcggaggatgcagtgagccaagatcacaccactacactgcagcctggccaacagagcaagactccttctcaaaaaaaaaaaaaaaaagaacaaaccagctggttgtggtggtggtggttgacatcctcaacagaacagcttttgctaattgttgaagtcagggaagacaacttgtgctgatggcagagttcaagacattacacaaccagagacaatcataaacccagaaatgccagccctgagagatgcaactgatgtatgacttttttcctctctggatcaaaccatgacaaccgtaaaaggcaggccttgctgttaaggcgctgcagcctctgaagcacagttggcctcagggagctctgactcagtctacttattctggggatctgaagaaagtcagaaatcatgtgtggtagatagtttgcataactttgggattttccagagagaggatgaaaacggtggccctccttgtaatgtctaggcacatgggacatccagtggaactgttgagggaggagatgggagggagaccagtcaccagaccagttg

SEQ ID NO: 33976 - DNA, 1276 bp, Homo sapiens
ggaaagccttaggaaagtggcaaagaagaagtttgcagaaaaccttaaggtaatttcttattatcgatgtcttcaagacaagtcctctgactgctttacatttgcagggcaatgggggatttctggctttctttctttctttttttttttttttttcagtttgttagtgtaaaactcatttttccataactttaaaccaatataataacataattactaaacattcagggggtactgattacaaaacaggagaagtaaataaccattttgttgggtgggatttgaggttgagaagaaagcttgtacatacaggtggtgaactcattctagaagaacatgagaatttggaattgaagaacacttgttttgctaaaaggatggaagaagaagaaacaggaagataatttttatactacaagttaagaagagaatgatataataaatatggtatttatagaaactaagagtgaatcattctacttgccaggagcagaagagatagaagaatttgaggaactctgtggaggctgggaatacaacagcatggtgggatgagaaggagttggtgactaagggccatgctgtttttcagcgcactttcacttaggagtttgcatttaattagaaatacagcacaaatcacccaaacaaattttaatttaccttttgtcatcttgttaaagttgcttaagattgatttccttggggcttggatagaatttctcgctgtatgcagccagagaaaagtacacataaggcatttgttgtttctcacttcaagtatccaaggtggtatatctagatgcttttaaaaatttttttattatggtagaatatataacataaaatttgccattttaaactatacaattcagtagcattaattacactcgcacattcatacttcatgtaagtggaatcatacaatatttgtcctgtgtctagcttatttcacttagcataaagttttcaaggttcatctatgttgtaacatgtgtcacaacttcattctttttttttttttttttttctgagacagagtctcactctgtcaccaggctggagtgcagtggcacaatctcagctcaccgcaacctccacctcctgggttcaagcagttctccttcagcctcccaagtagctgggattacaggcgcacgccaccacgtccagctaatttttgtagttttagtagagatggggtttcaccatgttggccaggatggtttcaatctcttgaccttgttatccacccacctcggtctcccaaagtgct

SEQ ID NO: 33977 - DNA, 1027 bp, Homo sapiens
tatatcgaataaaaaaaccctaaaagtaaaaaaataaaaccagcttctgatagccttgagcctcctgaccataaacctggaaggtggagcggggaggcagggagggcttccccagcatcctgtttggaatgcttggagactccaatatgttggagttggagtcacagtaggcaatttgcacctgaaatgggacaacttgccttttacagggtcctaattacagggtctgaggagcagccgctattaaagtagcatttgttctgaggttgaggagttattgccctgcgaagtgtgggggacgctgatgctgccatgtgggtgatgtggggccaggcaaacctacacacactggctgtggcctctctgggagtgtgtatcgtctgttttcttcattattgccttttccaactaccttttccttcctttatcctcctcattccctcaccactactcagcataagcatttttaataagtcataataatgaccattttttttagcattttctctcaagtgacaactttgaccatcttgcaatgggactttttctgtcttactaacattgcttctcagcttcctcctattttctcctatcccctaaggctgattttttgaagaaattgaagaatgaaggggagggatttggggaacagaagaaacagcatttaacagctcttatctcatgcagattaagagcaaagaagtggcatgcatttccaacatttcagtacttagggactagttgatttctttagttattatattgtatatataagtgttttggagataggcacattctgtagatttactttaataatgttttcaactgcatttatctggtaatgtatgcttttgtctttggaaatgtagtgtgttggttgttaacagctgatgtttagcaaatgctactattttttagaaagtattttgtaaaagtgttcttctctattcagtttttattgtttaactttagctcttccttgtgttgctggtggtgtacaccaaaataacttgtataataagctaag

SEQ ID NO: 33978 - DNA, 1050 bp, Homo sapiens
cgattcttgaaagggaattgggaggaaagaggaggaataaagggatgggtgtagggctgtgtgtacagcattttatgtgttttctgatttatcttcacaactttgagacaaactgtcacccccagttcacagatgatgaaacagattcagagtgacagaaggaccaagagagtattcaagattgaacccaaatctgtctctcccaaagccatgctcttccaggtcacacctgtgccttgatctgtctttatgtcaggatctgtgcagtggggcatctgggtttgaatgtttttttaagtactatgattgttggataaattgtcatatgagatagaaataaggccatgctgcaaattttgaaaatgtacagcttgataaatgggggcaaacatgatccagggtaagaaggggcaatttggtgacttcacaaaagataccatttaatgaaaatttactagttttttgtttttctgtctcccaaaacaggacactcctgggtttattgtgaaccgcctcctggttccatacctcatggaagcaatcaggctgtatgaacgaggtatccttctgacccaggccaggagcagcagacctcagctcctggcgccactgtctggaattctcagtgtctctaggaggggtcgggccgtgcacaatggaggaagcagtgtctgttttctagctttgtgagctcagctgcaccctgagccctggtacctttttcactgttttcccagggcctcctggcttccctgtgggcctctgagaaaggtttctggaactcccaccacccccactacagtcccagccagagcaattgcatggccggcccagattgatatcctggatctctgcttttgattaaaaggtttactgcttttaaaaataatcataatgtaaaaatcactaggctaggagatcttgaaagttccttaaggttctaaaacttgtgactgacaggtgattagaaatatgtgacaaggccgatatgtggtaaggacagtttttagtagtctgtccttactgagtgatgtcatgatgtactttttg

SEQ ID NO: 33979 - DNA, 1034 bp, Homo sapiens
gcagtgtgagtaaatctctccatctttactcacacagagctgtgtgagtcatgaatcttcaggtcttattatgttgaagtttttggcttacacatctgagttctcccattatgtcatgagtaccttgagtgcttgtctggtttatctttgtctcattctacatctctggtgcctgctacataatgaatagaagttgaatgaatgaatgaatgaatgacgctgcctatatgattatttttgtttctttgctttcttatggcctaacactcaaatcatgatttctcaggcgtctctaatcctaattagtgtagttattagtaatgtcaaccataataaataattgtggtgtattttagtcaccttaaaatgccttgaaatcctttggaattactttagtaatttatttgcttttaaaaatatatcttctttatcgatgtttaagtagtttctctctgagtgtcttaacatttttccctcttttctttagctttgatctgattgacttcttaatgctttggaacaaaattctagatagccacctgttgcagactattctacttttctgatttcaaagaaagggaacagattgttctccataaaggcctcttggggccaaaggacatagtaaatttccaagggaaaagcacattgatccttgtcgtagtctactcaacagacttccaaacgtgtggtgattctaactcgggtttgggcttttctttaaaaggtatcttgactaaaaggtttgtgtgaaatgtgatgccaggggaatactccttacttgtaaaacccaaaaaactgggggaaagaatacatacaataactatacatacaaaagcagaaagcttagttttctttttaagaaagtttatttataaatcaaaaatatgctgtagcattaaattatactttaataaatgattccagagttggaaaatcccaatgtatttgaaagtagctgaagtttcaggcatggagacttctgtctccatgaacagggtatcagtactccaaaattcacctcagtggtgcgt

SEQ ID NO: 33980 - DNA, 1041 bp, Homo sapiens
tcaccacgcccagctaatttttatatttttagtagagacggggtttcaccacgttggtcaggctggtctcaaactcctgacctcgtgacccacccacctcagcctcctgaagtgctgggattacaggcgtgggctactgcacccggccagtgatatttttatttacctataatacaagtgaaagtttgagattaagaagaaaaccaggcaacttatgagatgacttgctgaaaaagatggtgagcctctgatagccatcacctagacttcaattctgtttagtaaaatggagttctctgaaggatcgttttaactcaagatatctttgtaaaatgaaaatcatggccctttcatgttcttaagattcactgttaatagtagtttttctggggaaaatggttaactttttctgacatcaattgtaaagcgtatttccactttgggaacttcaatgacacagcgtgggggtaggtggaaccatgtcttggaactcggaaactactatgaacaaatccggtgttagaaaatactctcagctgggtgcagtggctcatgcctgtaatcccagcactttgggaggccgaggggggcagatcatgaggtcaggagtttgagaccagcctggtcaacatagtgaaaccctgtctctactgaaaatacaaaaaattagccaggcgttgtggcgggcacctgtaatcccagctactcagaaggctgaggcaggagaatcgcttgaacccaggaggcagaggttgcagtgagctgagatggcaccatggcactccagcctggacaacagagcaagactctgtctcaaaaataagaaaaaaaaaaaaaaaaaaagaaaatgactctccactgggttccgttaatagtaagtgttttgactaacacatcagctttcagaaacccatttgagattcaactagtcatcattggagaggttacagccactatgttagtcacagcttatacaacaacatacactaattatgctttctttgtgagttataccgttcacatatttgaaacaagcttttg

SEQ ID NO: 33981 - DNA, 1063 bp, Homo sapiens
gttaaggaagtgccacgtttgattaccatcaggaaagctaacattcttggcctcttgtttatcagtcacctttaaatacaagtagttttaaaatgtggaataatacatcttaatttaagggtgttacatacaaggatatgtatgtgaatgaaatagaccacatgatactgttttgagattttatttacttttacaatggaaagatttgatgttactctattcttaatttaggcactcagaatggtccagcgtttgacataccgacgtaggctttcctacaatacagcctctaacaaaactaggctgtaagtatttctgaaaattttaagtatatattgtcatttactctacaaaatgctgacctactgactgtttcactttctaggtcccgaacccctggtaatagaattgtttacctttataccaagaaggttgggaaagcaccaaaatctgcatgtggtgtgtgcccaggcagacttcgaggggtaagtgtaccttttactgtgtgcagcctaacaagtcttgaacttactgagctttcatcccttgacgatggaatgaatcaaggagaggttaccactaagagggttcagaattactaaacattcatgagccaaatctgccacgaacatagactttttaaaccaatctgagaaatgcagtgaaatgcctttcagataaatgagtacaccatttccctttgtaacctactttaaacttgcccttaacacttaacaaaatttagggaaatttctgttaaagcatcacaaaaatcttaatatttttcttatgcaggttcgtgctgtaagacctaaagttcttatgagattgtccaaaacaaagaaacatgtcagcagggcctatggtggttccatgtgtgctaaatgtgttcgtgacaggtaagttaaatgcttaaatgggctttccttagcaaattattgtgtgtgttatactgtctgctgatcagtacaatggtgaagcaactcattttaaaccagttgcatgctttagaaccctttctttgctatggataattgatgctgcacaaagcaggaaatgatat

SEQ ID NO: 33982 - DNA, 1120 bp, Homo sapiens
tgttagccaggatggtctctatctgacctcatgatctgtcagcctcgacctcccaaagtgctgggaatacaggtataagccaccgcacccagtcctagctgagtttttaaaccaaaccttttgacaccaaatgcaggcttcattctgcattttaggaggtagattgtaagagaacagtaggagatactacattaatacaaataggggataaatatagcttctgtgatacacagcaaagcttaactatgattgaagtttaaaggagaaattacttgcaaataactaggaatggcatttgagttggaacctaaatgatgggcaaattttggacaaaaggcagaaagggcattccaggcaaggaaagtacggactgatctggcacattgtgggtgagaaatggaagtgtacattggagataagtcatgagttttaagctgaagaagtttggctttttttcccccagtctttggttctaaaactttgctgaacacaaaatcagatgggcacatttattaaaaatacaaattctcgggccttatctcctgaagatttgaatttaggtttacaggatagcctagaaattagcattgttagctgtgatgctgagcaggtctgcatgtggtctgtgctttgagtaagttaagggaatttttaagtgattcagttgtatgtgtctctgataggatcacatgggggagatttgaagaaattagaaaacccagagttttgagggtagggtttgataaccaggtttaccaatgggaaatggggtgggggaaggtttaagttgaagcaagaggagtgctttaaactctggtggtaactctgatttaacaaatgctaggaagacctgctttttgctaggtcctgtgcaacactgtaatgatagtgatccataaaatgcactcctagatggaggctcaaagtctagaaaatctttccaaatttaatcctcataaactccctgttaaatacgtgtgaaactattttgtgccttaatatagagaaggtaacttgtccagtgtgcagctagtgtgtggtggagttggccgtaaacaggttctaaaatccttgctcttggtgaggtgtctcttgctaatatccctttaccttttaattt

SEQ ID NO: 33983 - DNA, 1019 bp, Homo sapiens
ggcatgtgccaccatgcctggctaattttgtatattttagtagagacgaggtttctccatgttggtcaggctggtctcaaactcccgacctcaggtgatctgcccacctcggcctcccaaagtgctggtgttaaggtgcgagccgcagcacccagccagtgggttactttttctgaagaaacagttggtggtcactgatggccagaatttttttggtgacagctctaccgctgcattggagcataatgtccttctctttgtgggctgagacttcagggtggtttgggaggaatggcccttctatttgaaactttaatatccctttgatccttactatggtatctcctttacgtcagcaagtttcataggatagaaaccttggtattctagttccttggaatggaacctttttaagattgtttttaaaccctctgttcttttaggtcacttcagttcaaaaatggtatcttggagagctcagaactccttatttaacaaatgagtgagctactatatataaaaccttgggtcaagggtatagtttctgatctacattggatttattatccaggccagaatgttaaaatacagacctcatttttcttgggaactatgtagtgtttctgccagctcagacaaggtttcactcctgctgcccagcctggagtgcaatcttggcttgctgcaacctccacctcctggactcaagtgattctctgcctcagcctcccaagtagctgggactacaggtaggcaccaccatgcctggctcatttttggttttttgagaaacagtttcaccatgttcctaggctggtctcaaaactcctgggctcaagcagtctgcctgcctcagcctcccagcgtgccaggattacaggcatgagccattcttctgcccaacctgttggctgacaacctttttttttttttttttttttgaaatggagccttgctcttgcccaggctggagcgtactggctcgatttcggctcactgcaacctccacctcctgggtt

SEQ ID NO: 33984 - DNA, 1033 bp, Homo sapiens
ctttgcatttttaaaattatttgtactctttgaatttataactccaaacatgtcatcttattttttaaaaaaaggaatcgtctgtataatggtgttgtagaccattttggttattaattctctttaaatttctgaattgaaaaatgaaatctagtaagtatacttttgaaagcttagctagaaattatttatttttaagattcaattaccaaaacgtgccaaatatacttttttcttttttagtttacaagcctgtatgtaaaatatttgtaagacaactagatataaaaaataccctgggtttgatattttattcatctgaaaatgatgctttcacaagattttttctttcatcattaaagaagtaaatcatttgcattttaaagatatgctcgaatgctgtgggatgcagcttttcccatttatgtaatgtttaattgcatttacttgatcacagcattgaggcaagtttctttaaaataagtttgccttttcataatgcttgcgactatagtttgttaatctcaaagtatcaagaatgcactttgatgaggataaaattatgcaggactatgattcctatgaaagagaactcctgccctactctggccacagaaaagaattacatgtgggcagctgtgagaaaaatgctgttgttatttagttgaattgcaacagctttgcaagtgaggtaaaaaacgtgtagatctacagttatttttctttaacacattttaatatctatgtgcctgtgtgagtgtttttttgttttaacctgggtccctaatgttgcaaaacaatttattcttcacagaggacagctcccaactctttacctctcttcctaatgcaacactcactctcactctcagcagccttataatatctgtaaatgtagaaactatcagttatgaacttctgtaactcccttttcatctttggcacctcaaaactttaatgtatgtaaaagcatgggctttgaaattggtaaactggagctctatcaatctctggctgtgtcaacttgagcatg

SEQ ID NO: 33985 - DNA, 1664 bp, Homo sapiens
ccagcctgggcaacatggcgaaaccctgtctctactgaaaatacaaaaaattaaccaggcgtggtggtacacgcctgtagtcccagctacttgtgaggctgaggcaggagaattgcttgtacccgggaggtgaaggttgcagtgagccgagatggtgccactgcactccagcctgggcaacagagcaaggccctgtttcagaaacaaaaaacaaaccccaaaattagctgagcctggtggcgcacgcctgtagtcccaagtagctgggactatggtgcaggagtttgaagtgggaggatcgcctgagcctgggaagctgaggctgcagtaagctgtgatggcaccactgcactccagccagggtgacagagcaagacccgaccctctctcaaaaaataaaaacaaacaaacaatggttataaatacagtgaaagaaaagaacaagaggtttttgagaaactaaagggagttggaagcatcatctggattggattcgatatgattcctgaggaaatgatatgtaagccaaaatctgaagagttcggggaaaggatatgctaggcagagggaaacgtagggcaaatgtgagaccaaaagaccaattaggtggcctttgtagttgacttagactatacaaggtttatggtagtggagattaggataatataatgaaagatatgttggaagtagattcagtaggtcttgaattcactgggtgtaggggaagaatgaagtgggaaggaatcttacaggtttctggtttgagctcctgaatagatggaagtatcatttcctgagattgagaaaacaaagtttttggtggaaaatggtgcaccagaggttgttttggggtaaaattagttggatatgtcacatgtgcagatgggagtctagacctgagaaaagaggcctgtgttgaagttggtcaactaacagacatttctggaactcccatgagacattgaagagtataggcaaagtccaaagtctctgttcttgaggagcttacatgtaattctaatggtactggcattatttgagaggccttggcacatcacattgagagtctttagcacatgaaattgaaagccctgggagttcattttggagaaaagtagaagaggacagtggaccaatccctgagggcctccaacatttagttcttttataaaagaagaggcccaatagagaggtagcaagaaaacatgaagaggagtatcacaaaagccataagaagaggtgtttttcaagaaattggtttagtaaactggattgagtgcttctgagaagtcccctaagatgagaactgaaaagtgtctattgaatttgacaacatggagatcattggtgaccttagaaagagcagtatcaatggttgcagaagccagattggattgagttgaagaatgaagggtaagtaagaaaggggagatggcaagtttgcctaagtcttccagaagaaagtctgactccctttcagaaagcaaagatagaaataggatgttagctaagaggatctgaagtcaaggagggttgatgtagggaaggagagcttgaaaatacaggagagaggagagatatccaaaggaataaagtccctgagagtccaagtgggaatggactcctggtaattgcaaaagggatcccacattataggaggtggg

SEQ ID NO: 33986 - DNA, 1050 bp, Homo sapiens
ttgtgcttataattatatttctgcaggggctatctgatgggttagagtgcctttgagaagaaatcagtggatactggatttgctcctgtcaatgaagttttaaaggctgtaccaatcctctaatatgaaatgtggaaaagaatgaagagcagcagtaaaagaaatatctagtgaaaaaacaggaagcgtattgaagcttggactagaatttcttcttggtattaaagagacaagtttatcacagaattttttttcctgctggcctattgctataccaatgatgttgagtggcattttctttttagtttttcattaaaatatattccatatctacaactataatatcaaataaagtgattattttttacaaccctcttaacattttttggagatgacatttctgattttcagaaattaacataaaatccagaagcaagattccgtaagctgagaactctggacagttgatcagctttacctatggtgctttgcctttaactagagtgtgtgatggtagattatttcagatatgtatgtaaaactgtttcctgaacaataagatgtatgaacggagcagaaataaatactttttctaattaataccttttatatttgttttttaactgacagtgttaagtttttggtctattaatcattcattcccacccatcttatgactttctttagctacttttggtagcctaagatttcaaaatatggttggcaggatgccttgagagttagcatctttatatccttgtaaatattcaagcacaggctgcatatctatgtcagagttgtcaatgtgaatgtgctagatgagcacatgtagaaacatctctggggccgggcgtggtggctcacacctgtaatcccagcactttgggaggccgaggcgggcggatcatgaggtcaggagatcgagaccatcctggccaacacggtgaaaccctgtctctactaaaaatacgaacaaacaaaaacatctctggaccaatctggtcttaatttcttctatccaggccttttggttctccctggctggccatg

SEQ ID NO: 33987 - DNA, 1030 bp, Homo sapiens
actactcagctgagtccagtcagcctgcaggaccttgggaaataggaataaactgttttcagccactaaatgttcggcttgcttttaatgagcaatcaagaactgggatgaatgtgtggctttaggaccaaacagtggattgaaacttccagggtcttgaagagatgaaaaataaaagccagaaaggcctggagaagacaatgaaagtggagctgttggccgggcacggtggctcacgcctgtaatcccagctctttgggaggccgaggcaggcggatagaggtcaggagatcgagaccatcctggctaacacggtgaaaccccgtctctactaaaaatacaaaaaattagctgggcacggtggcggacgcctgtagtcccggctacttgggaggctgaggcaggagaatggcgtgaacctgggaggcggagcttgcagtgagccgagatcgcgccactgcactccagcctgggcgacagagcgagactccgtctcaaaaaaaaaaaaaaagaaagtggagctgttgatgcttcaagacagtgaggtcaatgaccttagaggctgaagagaagggacctttgttaggtaaaggcgaaatttgctaatgctctaaccatgtgaggcaggggtggtgggagggcatagaaagggcacctaatgaactcattgatccagctagggaggaagtagaaagtgccaagtcaactgtcttgtactgtatattgtgaaatataagaagagacagatgaactaaggtttgttctgtttctaagctgaatttagaggaaacagagcccagaacaatctttccaggcagcaaatgaaagcttgtgtttttaaaacagcttatccaagaaatgctacttatttattattattatttttttttttttttttttttttgagatggagtctcgctctgttacccaggctggagtgcagtggtgtgatctcggcttactgcaacctccgcctcccgggttcaagtgattctcctacctcagcctcccaagtagctgagattacagg

SEQ ID NO: 33988 - DNA, 1033 bp, Homo sapiens
tgtaactgtaaccctgacccagttcggcctcaagaactgtcattgccgctgcggctgctgctcaagcttttggagtttgcttgtagtgtttgaaagggagcagatgtaaacggatttaaacgaacatctttagatctgggtgtttttcctagctccactttcagagatgaaaaaacgtgccagagttggccctgctttgaggcagggccttcatacaggcagcagccaaatgcagcacgaaagccgctttcatattaaggtcgtgggcttttagtaggctgcaaaatgatggatatgcattccctaatgctgagatttggaatgttcgcggataggggccaagggtggaggaattctccttacagacttcttagtatgtcagatgagaaccttggaaagtaattgactgaatttagaaaaatacctctgtcctgtgttggtacgagaaccaaactgcattagtactctccagatgattgacctgttttatctaatttcctaatgaaaatctgctggactttatgaattagtttaatcaacatctaagttttacaactgatgcttttcaaacatgaagtgtatcgtttgtcctgaggatcagaagttgagtgatactttagccttaatattctttggatcagccttacctatcagtattacatgctgtactctcagtagtcattgtttactataatcgcttttggatataaacctgttctgaacaaatgtaaaaatactatttgtgagcagtgtttgttcttgtaaccttaatataagttcttgtttttgtttgtttttaaaatagctttatgaaggaactagaacacgataatttagtaaaagagcccaagtcttttagaacattgtagactcatgtttaccagtgattcaaggattgtgtctttccttgattttctgaatatgcattatcatcttagtgaacagtttttaaagtggcaaatgtttattacagccttataaattttgtgaacactcaagaatgccaggatatgtactcagccaagtgtaatca

SEQ ID NO: 33989 - DNA, 1059 bp, Homo sapiens
gatatgaaatacgtttggcctttgtcctgggttcctgtaacagctcctaaaacccttgtaatttcctgagtgataggagtgtcgcttgctactcataaggagtcttttgatcacatttgagtttgtgctaatgagatgacttaggatgggtctcctagacagcctcaggctggagctggtaaccagaaagaccaagtaattagagagttgggactttgagtccccacccatcatcccctttgaaggggagtggataggctggagatgaagctttataaaaactctggaacagtaagatttggtgaccttctgggttgctgaacatgtggagatgctgggagggtggcggcacctgcccccatcctttgccctgtacatctctttcatttggctgttcatctgtatcctttgtaatatcctttataataaacaataaatttaaatgttttcctgacttccacaagcccttctaccaaagtaattgaacctaaggagggggtagtagaaactccagtttgtaactggttcctcagaagtacagatggcaacctgctacttgtgatacttatgataggcatctgaagtggggagccatcttgtgggactgaacccttaatctgtgggatccgagtctaacttcaggtaggtagtgtcagaattgaattgagttggaggacccccagttggtgtctgttggggaaaaataaaaacaaaaattcacacatctggtcacagaagtggtctgtgcagaatgagagtagagtgaaagaagttttttgttttttattgtttgttttagagacagggtgtcactctgccacccaggctggagtcagtgactccatcatagctaactgcagcctcaacctcctgggctcaagtgatcctcctgcctcagcttcccaagtagctaggactataggcatgcactaccactcctggctaattatttttatttttatttttgtagagactgagtctcaccatgttgcccaggctgttctctaactcctggcctcaagtgatcgtcctggctagacctaccaaagtcttgcgatt

SEQ ID NO: 33990 - DNA, 1037 bp, Homo sapiens
aatatattttgaaagtagaagaagctgccatttattgagcacatacaatatatcagatactttatatctcattaattcacatattaatcttatgacatagatattcttccttttttacagatgagaaaagtgagattgacagaggttaggtaacttgcccaagactacaagttaataagtagcaaagcaaaagattttttaactcagatctctctatcttgtattctttctataaaataaagctgaatttttgttgtcattggctgttgacaaactaactcttggtttacctaagataagtttcttgcttaagtaacagaaaatatcatactggggacatctgaattgtagtttttattgttcctttttcataagtaggagaatggcctcttagtgacttctttgtctttggagagatctgagctatacaacctaattgagtcagggctaccacatatggtggtgcgaattgtcatttgcatgaatggagcttcttcgaattgtgcagtgtatcatctgcatagggtttactgtgggcctgatatgaactactaaagtgattatacttaaaaagagattagcttttttcttccaaattcaaagacaccgttgcttagttgttctcccaagactaagcattttttttctgtttttaggggagacatcaaatttttgtttgggtagcccctaaaattttttttataaactacctacttgaacattttttagattgatatctaaaatttttcatcaaaaatttaaatacttgtagttatgcagtttttaacatatatgctggctgacttttaaaactgagatgttacattattctttcaaatgtaccctttggaatgatacctaccatcgtccttttgcaaaacacacaaataccccttctttaacatttgggaagtttacatttttcatttttctatttgatggcatatcccctttccttaatgtaataataaaatatatgcttacactagaaactcttttatcactctattgtgcttttccatgaccataatatataa

SEQ ID NO: 33991 - DNA, 1050 bp, Homo sapiens
aggatgaagtttaattgaagttggaatgttctatacttaaaaaaaaaaaaaacccatgctatcttgctatcactattctatgaatcagtagaaaactaatcttttcagctcagtatggaattcccttgtaatattttaaaaatacttgaataaacgactcagttttttgtagttaaggatttttcccctaggaattttgtgtgtgtgtgtctgtgtgtgtaagaagttgtaaaccattccaaaaacaatctcttatcaagatcttctagaagagttgcttcatttactaaaagatgaacaaccatatagtatcccatgagctctagattaatgtgaaatgaaatgtctagtgtagtatagttgaaagattctggccctgcagtcagactttggtttctttgtattcattcagtcaacgaattctaatcttataatgaactatgtgttgagagtatttcagtaaccttggacaagttttctttctatttatactacaccaaaattaaagaactacgtgagcatctgtagcagtaatgttaaatgaattgtaggcctactatatgtcaggtactagaatagatctatagaaacctagaaatattattctttcctgaagaaggggagaagatttagaccttcatgtttattggagtgcagtggcatgatcgtggttcactgcagcctggtactactgggctcaagccatcctcccttttcagcctcccaagtagctgggactacaggtgcacaccaccatatccagcttttttttttttttttcttttcataaagatggggtctcactttgttgtccaggctggtatcaaacatctggctacaaacagtccttccaccttggccttccaaagtgttgggataataggcttgagcctttgcacccagcgccattgtttttttttatttcttatgctgataacttgtcatgttaagagaactttctgcctatgtttccatcaccatgaggagggacaagcaggagatctaaggattatgacagcatgttgaaggtcttatccttttaagaagtct

SEQ ID NO: 33992 - DNA, 1015 bp, Homo sapiens
gaatacgagaggaggctcagtgaaccaaacagttcctgctcttaagaaggttggtgggaggtcaggattaataagacaataaataagtaaacaaataaagaattaatttcaggtagttacaagtgctatgaagtaagacaagttgaagtagtttctggggtgaaaatgtggagtaggtggtcagataagcagccttcattgtagaagttaggtttgagttaacatatggaagaaagaaaaagcatggaaggatctgtggttaaagcatttcaggctgagtaaactgatatgcaaagacttaaggcaggaacaagtttgacatgtttgaggaataaagtcccagtgttgtgggaattcagccatgggaagagtaatagggatgagatcgaagagctaaaggaccacagtcagaagcttagattttatccgaggtgcataagagaggtatcagagattttatgtaataggatgacatctaatttacatatttagaaaatcatttggctgctgtgtgaggaatggattagagataggagtatttgaaaagacaaaatggaaacagagagacaaattgaagttctgccctaattcggaaattgatggttgttctttgtgctaaggtagtatcatggaggttgtaaaaagtgaatagataagagataactttttatatgccagtggattggatgtggtgggtgagagaaaggaaggtgtcaagagtaactcctaggtttttggcataacacctgggtagaggttagcgtatttactaagataatgaagacaaaggtctaggaatgggaattgagttggccatgttaaattaaaatacctaatggagatgtcaaacagtatttgatcagtggttgttggtcaagtatggagaaataatgtaccaatgtatacttcaagcaagaatgtatttaattgcccctttctctatattgtgaagtaccccagtaattattttgtataagcaaaaaatttttttataattattggtcatatgtatttc

SEQ ID NO: 33993 - DNA, 1106 bp, Homo sapiens
ccaccacgcccggccaattttaaaaattttttttttttttttaagcaatggggatctttctatcttgcccaggctggtcttaaacttctgggctcaagcagtcctcccaccttagcctcttaaagtgctgagattacaggtgtgagctgccagcccagtaatttttaaaatatatactatttttagaaatatgcacttttattttatttgtataaatttacaggatacaagtgtaattttatgagctagattgcaaagtggtgaaatcagggcttttaaatacgtttagacaaatgcccttttctttcttccagagatgagagtcctgccaaagcagaattttttcagcatttgattgaagaccggacagaggctgcattttcttactatgaatttttgcttcatgttcagcagcagatttgtaagtgaagtagaataaaattgaataagaaaaagatctataacctaggtaaagcataatctgtcagagaagcgcgtgagaaatttgaaatgaaggcatttgttaatacaagatgcaacgcacagcactctgtctgaggctttggtaaaaagtaaaggggaagaaagaacttgacagatctttttcaactcaaattaatggtaacgatgatgctgtttcaccaagtatattttgaattggtttctacacatttccagtagtatggcagtacagtgctctgttcattgcaagctggcaaatttatgtagctatgtggaatgatatgtcataatgtaaaattagataaattcttttttcttataattaatataacatttctggacttgaactctggcaagagatgccaaaaggcattggtaccgtgttatttgtttatatgaattactttttaacaaggaatgtttcttattcattaaatgaattcaacattttctctgtaaaaacaatagagtttcagtacatgaactatagaaaaaaatctatatataatgtacataaatgttacatttgtaaagaaaatgtaaaaatgtaactatagcatatgaattgcttaaactgtgctgcattgttggatgacaactctttttgtcacagttagagaatgaggttgactaatgcatattat

SEQ ID NO: 33994 - DNA, 1051 bp, Homo sapiens
gcctcccaagaagctaggattacaggcgcgccaccaccatgcccggctaatttttgcgtttttagtacaatcagagttttaccgtgttggccagactggtgttgaactcctggctctgcctcccaaagtgccaggattataggtgtcagccactgtgcccgactggggctgcatatttttaatctagtgaaaaagaagctgaggaaaagcaagatatttgcattcaaatatctgagatggtatcatgtgaaagaaggttgtcattctgtgttgcttccaagcaaggaaattactcccaagatagagcagaataggtaggcagagttcagctcagttcaagaaaatttttgtatccattctggctgttccctaatagactgcttcttgaagtgtaggactcccaagtttctaaaataactcaggcagaagctaaagaagcactggaaaaactgccaacacagctagagcctggtgctggagaagccatctatatctatgcaataggagcctgtgaagtgaacacacccgaaccaggaagcaaaatcttttcctccgtcagtggctctctagtgtcctctactgaaaaaacttcagtgccagtcagcaaaggaaaaatatttaaaggtcccagatctattttcacagagcagtcaaaaagggagaatttgagggcatatacaagacgttaataaccatcatatgaggaatgagacagcagctgttgtgcagtacttgaaggtggcagctgcactcatgagcactgccacgctggtcaggccaaggagggatgggagacagagccggactggtcaagcactgataacgaagtgctcattttaaatacagtgttagtgcctagaatagaaatcagggaagcagcacttgttccagggacagagaatccaacccagagatggattgggtaagacagagatccaaaaaaagtatgagacttaacaattgcatgagaagttagactgagtagaaagaaagatgggtagattattgagaagccaaaaagttagcttaaataggagcatttgagacccag

SEQ ID NO: 33995 - DNA, 1038 bp, Homo sapiens
gagactctgattaaacctcactttttttttttttgagacggagtctcgctctgtcaccaggctggagtgcagtggcgtgatctcagttcactgcaacctcctgctcctgggttcaagcgattctcctgcctcagcctcctgagtagctgggactacaggcgcatgccaccacgcccagctaatttttgtatttttagtagagacggggtttcaacatgttggccaagatggtctcaatctcttgaccttgtgatccacgcgcctcggcctcccaaagtgtaaacctcacatttaaagcaaagcaggaccaccacatagcattaggcaggttttgcacttaatctagggtgctacatgtaagacgtggcatttgcattgtggataggtaaatttattatgtttttctggcaaatgaccatgaatgtatcgaggaagggaagccaacttttaaattcactaaaggcacctaaggatcagtgcaaaaatcctgaccactgccatgtagaaaagagctgtgtgttattgccaactttaaatttatccagagaatgagtcaaaataaaaatgatatttaaagtctgactgaaaatagcaattatattagagaagaaataatgaaccaaatccccaaaaatgaacataaaactttttattatttttttattatactttaagttctagggtacatgtgcacaacgtgcagtttgttacataggtattcatgtgccatgttggtttgctacacccattaactcgtcatttacattaggtatttctaatgctatccctccccttgccccccaccccacaacaggccccaaggtgtggtgttccccgccctgtttccacgtgttctcattgttcagttcccaattgtgagtgagaacatgcggtgtttggttttctgtccttgcaatagtttgctcggagtgatggtttccagctgcatccatgtccctgcaaaggacatgaactcatccttttttatggctgcatagtattccatggtgtatatgtgccacattttcttaatccagt

SEQ ID NO: 33996 - DNA, 1049 bp, Homo sapiens
ggggaatgggctttggactttctctctggctgttgtccagtgcttgccctcaattcacttccacttggtcctcttcaacatggaagcttgtttcatcaaagtatgcaagctgatagacaacagagcgaatctagcagacagaagtaattcatttgttatgtaatcatggaagacgcatcccatcattttttccataccatttaatagaagtacatcactgggtcctgcccacattcaagaggaagagattacacttacataagggtcagaataccaggaggcaggatcactgagtgccatattcttaaaaaaattaaagtatttattgagataactgcagactcacaggcagtttgtgagaaataatacagagaaatcaggtatatactctccattttcccccaaaggtaacatttggcaaaactgtggtataatatcacaacccagatattgactgatattgaagttgatataatccaccaatcttatttatattgccccagttttacttgtgcttgtgtgcatgagtttacatctgtatacttttatcatgtgtaggttcatgtatccaccaccacaaccagatattcctaatgttagaggactgtatttgaaagttgcatgcaacagtctacccagtggttcacaatgcaaaataatactggttcataatgcagaaatacattaaccccctcccagtgccccaaaattgtcagcccaaagtccagaacattacagcgtcagctcaaagtccagaattgtgtcatttgaatcagcattgagtacagctccaaatacagagtctctttccatctataaacccatgctgtaggattgagtgaatgtttgtgtcaccataaattcatatgtggaaaccttaagcctcaatggaggcttttggagatgggatccttgagaagtaattaggtcatgaggatagagctctcatggttggattagtgtctttacaagaagaaacagggcagagttgcttcctctttctgcactccgctatgtgaggacatagaataagatagccatttgccaac

SEQ ID NO: 33997 - DNA, 1030 bp, Homo sapiens
aatgatttatgcaaattaatagacccaatttgcctcaactctggcacagatgcttgcacaattggcctgttggctgttataggatcattctaagtgtttattcccttagctcattggtttgacttgtggcactcttcacattttgatagggcaattttttggtaagttctgtttagtgcattgcagaatgtttagtgtctctgaccttgtatactacacgtttttagcacccatcagtcaatgtgacagccaaataaggctccccacacatttccacatttagtgtgtcgggggtgggagggaggaccatggctgggtaactgatgcattgaagtccaaatttcatgtaaaggtggcttagaagtgaaaatgtgtaattatcaaagtgctggttttgaaatgtaagaaatttgaagaccacaattgcaataacattatgtatagtttggggtctaaagtttttcaaagtatcattgtcatgaatcttttcttgtatcattaatattttcttgaaagcaattgtaatgaatgcataatcatcatatgttacagattcataattaacctgtctattattattggacaattgaattgttttcaattttttgctgttataaataatgttacagttaacatctttatagataaaatctaattaggtatttattaaacccacaataagaaatatgcaaaaattttattttctcttttgatctctttttatacctactttaggtaaagatgttctcagagctatttagggaagatcagaataagagtagcttctctttatttcttggaaaggcctgggaagtcttgttttcacatgtaacttcttgtatttgtaggagatgcctttggtccttgcatgcatccatttttgcccacctctgatttcatttgtaactggtggatagtttcttacaaattcagactcaccttccattgctggtgtttcatctcaaacccaagctatacccagtctttctgtattctgctcaatgccttcttcagcagcacaggaactcgg

SEQ ID NO: 33998 - DNA, 1060 bp, Homo sapiens
ggcatttgctccggctgttgaagtgaatgaatctggctgaatgctcctagagttctggaaaagttttaacattctaaatgctatccagaatatcactggagcatggaaagaagtcacacagcaatgcatgaatggcatttggaaaaaagttttgaagacatgtgaacacattcaaaggccttagcaaggttctgctgttgatgaaacagtaacaagatactagtgcttggagaatagctagaattgatgaagaggatatttattaacttcttggcattgaatctgaagagctttccaatgaggagataatcaaactggaggaagaaagaagttgagaaagaggaagaagttatacctgaggcaccaagaaagttaacggcaaagaaactggcagagatatttgccactatcagcagtgccattcagaagttagaagaaagggatgtcattattcacaggagctgacacacagtacaggatgctcttgcttgctacagagaaatatataatgaaaaggagaacaaactgtatagtccaaacctgatgtcggccaggctggtggctcacacctgtaatcccagcattttgggaggccaaggtgggtggatcatttgaggtcaggagttcaagaccagcctagccaacatggtgaacccccgcctctactaaaaatacaaaaattagccaggtgtggtggagcatgcctgtagtctcagctactcaagaggctgaggcaggagaatcatttgaaccggggaggtggaggttgcagtgagctgagatcgcaccactgcactccagcctgggtgaaagagcaagactctgtctcaaaaaacaaaaaatttaaaatttaaaaattaaaaaaacttgatgtcttcctgaagaacactatgcctgctaaaccattaacaagtatcgatgccccagtgccttctcccagctactctcaggcctcatcagaagagaaattaatgaccctgttgcagtagcatccccatcatccagcaattaattttagttcaatgcttcaaacattcttcaggcccagtatgcattcacc

SEQ ID NO: 33999 - DNA, 1075 bp, Homo sapiens
tgaatatattgaatggtatctagaatggtgaaccctttctagaaaggtctcaatgtactttgccaagattcattagaggaatcactatctatggcagttatagccttacaaaatgcagttcttaaagaagacttgaaagtgtaaattactccttgatccatgggcttcaaaatggatgttgtgttaccaggcatgaaaacattaatctccttttacatttccatcagagctcttggatgaacagatacgtgagcagtaatattttgaaaggaatccttttttttttttccccctgagcagtaggtctcaacagtgggcttaaaatagtaaactggcctggcacagggtctcacacctataatcccagcactttgggaggccgagacgggtggatcaccaggtcaggagtctgagactagcctggccaacgtggtaaaatcctgtctctactaaaaatacaaaaattagccaggcatgatggcaggtgcctgtaatccagctactcaggaggctgaggcaggagaatcgcttgaacctgggaggtagaacttgcagggagccgagatcatgccgttgcactacagcctgggcaacaagagtgaaactccatctcaaaaaaagaaaaaaatattcagtaaaccatgctgtaaacagatatgctgtcatctaggctttgtggttgcgtgtatagaacacaggtagagtagctttagtgtaattcttaagggccttaggattttcggaatggttaatgagcattggcttcaccttaaagtcaccagatgcattattagcccctatcagccccaacacagcgttattagcctgtcctttgaagctttgaagccttgaagtcaggtgtcacgtgcgtttgtatgaagagagtccaccaaacaggctttgtgtgagtaacaaggctgtttatttcacctgggtgcaggcgggctgagtcagaaaagggtggtgagattatcgttagttcttataggtttgggataggcggtagaattaggagcagtttgtgggcagggggtggatctcacaaggtacattctcaagggcagggagaatatta

SEQ ID NO: 34000 - DNA, 1081 bp, Homo sapiens
acatatttaataagacatagatggagaaagaaaggccaggaagtagatcaagaagggtctgttgaagagattgcacggaagtcacggaagacaagaaggaaaatgtttcaagagtgaaggagaaatcaacatcaagtgctacttagtgtttagactgactgtgaaatgggacttaactaaaatctaacaactaggtgatcttttgtatactcattagaagacctacagctgtggaaacaaggcagtgtgcttggtacagctgcagagagaatagagaaaagggctaaactgtttagttcataacccccattatttctaagactcccagaattatagttcctttattctggttgcgtacttggtaggcagcaatttactgcactgtttttatctaactttaaaaagtcattgaatttgtagctagcccagaaagagtcttcatttcattaaattcttcggagtatatcttgtatacatgctacaatcctagatgctaaaaatagggccaaagaatcatcaaatttgctgtcattgtgtgctaattatcttgaaggaatgatagaaattaagcaatatgggttttagttgtagcccacttattaaataaatctgctgtatgtcacgtattcaaaaaccacagaaatcatgaggagcctgaaatccacatgaaaagacaaggaaaagtaacagttaaattatatagtgttacataagactcagttaatcataagcaagtagtttggaaatttagggaggagaggatagtgtgggtaggataaggcttaggggcttgaactgaagtttgaaggatggatggcatttggataggaaaagagaaggagcagggtgctccaagtgggagaaatatgagtcaagcatggtgtatctgggcaaaaactagaatggagagttcacttgacaagtgtagaaatttgcttctagagagtgacaacagatgaggcaaagagcctggaatatcaggttgggaaatttggattgttatcccacagccagtgggaaatactacaagttttcgggaggagaagaaccatggttaagtctatgttatagcaagctgatt

SEQ ID NO: 34001 - DNA, 1048 bp, Homo sapiens
atcaccaagtaattcttttcttgatggggaactcaactctattcctgcttgttgcacaaccctcctttagtctctaacaatccagtaatgattctagcttcttggatgaaatctactcacaccccaccccctcacacccctttaggatctagtatgcccatatctggcttatgccctttacagcatgtaggggatgttgaacatgcacatccagtacactcgacagtatttctcagtgtaaaataaaacagtggcattctggttaataagtttagttatctgtctacctcagtgcaaccaatctggggcactgacaacactgaggttctggaaacttgatttccagaaacttgattaaggtggtatcagctgtgaggcttctctatggaccaaaaagctggctcaacttcctctctggatagtcaagtcttgtagtatgcattcttctattggggtagtgtgtgtgtgtgtgtgtgtgtgtgtgtgtgtgtgtgttggaatgaagaatttggacatgttgagtttcaagaaatactggaatagtcatatgagcttacatatggtagatgcttagtaaacgacaatgagttcaatgaaaaaagaagatatggaactggagcttgtgtcatggctgaaaatagtgacaaaagtgctgtgaggatagaatgataattgaagcttgagaaaggcaactatcgaaaaagaagagccccaggccccaggaaggaagaggaggaagttaagctgacaaaaagagggcatggtcagtcatatatttgtcctaaaaatcagtaggaatggtatgaaagccaatgaaggagtttcaaggacagaacactcaatagcaatgacattaaaaccaacgttcagtgctgccttgtgcaattaccagattctttgtgttttaattttctcatttctgtttcacagaagggatgtgaagatgtcacatacagttttaagaacagcaggagctcttcaaataaatgaactaaaatagatctgttatgtttttaaaggggcttaaatatttaattttgagtctact

SEQ ID NO: 34002 - DNA, 1016 bp, Homo sapiens
tgactccagcggggacggcgggccgggcactgcgccagctccttcccacctgccttcttccacggccagcccctcaggtcctcctgcccaggaccaggacatctgcccggccagtgaggatgagagcggacagtggaaaaactttcgactgccggacttcgtcaacccagtccactacgacctgcacgtgaagcccctgttggaggaggacacctacacgggcaccgtgagcatctccatcaacctgagcgctcccacccggtacctgtggctgcacctccgggagaccaggatcacccggctcccggagctgaagaggccctctggggaccaggtgcaagtccggaggtgtttcgagtacaaaaagcaggagtacgtggtggtcgaggcggaggaagagcttacccccagcagtggagatggcctgtatctcctgaccatggagttcgccggctggctgaacggctccctcgtgggattttatagaaccacctacacggagaacggacaagtcaagtaaatattaatttttgctttacctcccttaagctcacatatctgctttccatttcttttcctttccttttcactttccgcttttaattattttgttggtctgatattgatcggctcttggtttcaattctggctgtccatctgggaagccaaaattgttgccctattgtatttccaaaccctgtcataaaacttgaaagtagtgaatgagcttcgtagagtcaaaagtcagtgtaagtcttttattccatcaggagaaatcataatatactgcaccctatcttgaagatttccataaattatctcaggtttgagaactgcctttggtaaatttcactagtgatattcccaggctatgtagcaatatatatacagcaatatatatgaacttttaaagtggtattacactaaatttacgtgaaacatcagtaaatttcagttattattttgtccattttttttttgtccaatgtctcttttttggagaagagagacattga

SEQ ID NO: 34003 - DNA, 1061 bp, Homo sapiens
atgtgccattagggacagggactggggactctggaataacctccactctgtgacagaagacagctgttcacttcccataagggcagttagacacaagcttttaagtttggctttgtgtttatctacttgttgctcaatgggcttggggtggagagagtactagctcataattggatttatttttgctcctccacagagttttagttatggcaccaaaatagctgttaggttgatgcaaaagtaactgtggtttttgacaaataaatatgtgaatgaaatatctgaagcaatctgactcagaattttttaaaaatttgttaagctaaaaattccaggaaaacctttgacaaatatttgatagtcttctagatggaacctcatttttagaaatgtaatagttataattgcatagctgatttttttttcccctaggaatagagacataggggttgtcagaagaggcagcatgcatttcgtttgtttgtttgtttgtttctaaggagcatagtggccaccgatcatgaaccaacagatgccaggaaatcttttccttgttttgatgagcccaacaaaaaggcaacttatacaatatctatcacccatcccaaagaatacggagcactttcaaatatgccagtggcggtaagtattttttaaatgttttgtttatgcagagagtctgttgacaacattaggccagttacctgattttctgtgaaagagaacccattgaattctaaaactaaatgtgcactaatagtttatttagctgagtgaaatacattttggcaatctttttctttgagtcctagaagtctgtaaggtatcacagtccagtaagaaagccagattggtgtttctgtgcaagagacaatgccatagacacacacatcagcttgggctctgcttagctgccaggatccctgagtcgtgacagattacagtaatggcaaactaatggaattacagacttgaaaatatttgagggctactcactatttagttttcaggtgaatataaatccagtttttgttttgtttttttgaaaaagataaagctac

SEQ ID NO: 34004 - DNA, 1026 bp, Homo sapiens
ctgagtataataattgggatactactgatatgtagtaaattgttacttattgtacataatacttttatttcaggaatacttccaaggtcaagtgaagcctattgcagattctctgggatggaatgatgctggagaccatgtcacaaagttattctcactttttaacaactaaaattcatttaacatttgttttttgttttaagacttgttgaaaagtgcttaaggccctggatttgtgtttgtttgttttttaaggttactccgttcctccgtgttagggtttgcgtgcaagatgggagacagagaagccttgaacaatgcttcctcgttatttgagcagtggctaaatgggactgtaaggtgattactcacattgttatgcttagaagacacatttgagaaaagagtagttgaaatctctgaaacactgtttcttcttctagccttcccgtaaatctcaggcttctggtgtatcggtatgggatgcagaactctggcaatgagatttcatggaactacactcttgagcaataccagaaaacttcattagctcaagaaaaagaaaaactgctgtatggattagcatcagtgaagaacgttactcttttgtcaaggtaagttgggcttttatttcacatatataaatagtatttaatagtttatgtgtcacagtctctttaagagtctgattaaagtatgatgttttgtttccaaaaaaatccattaaaagttattttccctgcaagaaacaaaatatccatgtaagactggcctaaacaataaggaaatgtaatctcatatgaacacattctggaggtaggtagcttccagttgtgtgcagcggctcaacattttcacccaggacccaggctcttctctttctgattttcaatgatcgacatgttggatgtctcatgacttccagagcttgaaacattttgtttttacacaaacatgtgtaatggaggtaggacaggagcaaaagagtttcctgacaaggctctgtctcttatgccaacaggacaa

SEQ ID NO: 34005 - DNA, 1060 bp, Homo sapiens
gtagattcttgaaaaagtataaaatgtagaaatgtcttaacctgcagtttgaaatcagaaagaggcttgagcagggtgtggtgggtcatgcctgtaatcccagcactttgggaggctgaggtgggcgggtcacctgaggccaggagttcgagaccagcctggccaacatggcgaaaccccgcctctccaaaaagatacaaaaatcagccgggtatggtggggaatacctgtaatcccagctactcaggaggctgaggtagaagaatcgcttgaacccaggaggcagaggttgcagtgagccaagatcgcaaactgcactccagcctgggcgacagagcaaaactccgtctgcgcccaccaccctcccccgccacaaaaaaagaggcttgagttaggcatattcttgagttcgtggcccacagttatatatcattagttcatgaaaagcccttctcttatttaattatttttccattgcataaccatttctttctctacaataggcagctgttccaatacgtctgttagatattactgaaattgagtgtatctttttgactacctggtggtttcatttgtgtgtctgcaattatgacttataattttaaaaatattgaagcccggtagttaaaatgaaaaatgaatgcaaattttggtatttttctgtttataatcatttcaaagactaagttctagttgatattctcattgtttttatccatcccctcaaaaaaatcttttttcttttattgggtctatgtagtttagtgggaggtaagtataaaacaatgctataatttttcatttactgataagtgacaaacaagttataatgataagttataaattatataatataatataatgctattattagatgaagccttatataggtagtacatttttacatttaatttatatcattttttaacgttttgtaggaaatgaaaactgcaacttcatgtagagtccaataaatagaaaaatatgtccagcctcactataaagaaaagaaatgcaaattaaaacaattaggaatgattttttacctatcaagttg

SEQ ID NO: 34006 - DNA, 2749 bp, Homo sapiens
ctaaaaactcttaataaattaggtattgatgggacgtatctcacaataataagagctatttatgacagacccacagccaatatcatactgaatggacaaaaactggaagcattccctttgaaaactggcgcaggacagggatgccctctctcaccactcctattcaacatactgttggaagttctggccagggcagtcaggcaggagaaagaaataaagggtattcaattaggaaaagaggaagtcaaattgtccctgtttgcagatggcatgattatatatttagaaaactccatcgtctcagtccaaaatctccttaagctgataagcaacttcagcaaagtctcaggatacaaaatcaatgtgcaaaaatcacaagcattcctccacaccaataacagacaaacagagagccaaatcgtgagtgaactcccattcacagttgcttcaaagagaataaaatacctaggaatccaacttaaagggatgtgaaggacctcttcaaggagaactacaaaccactgctcaacgaaataaaagaggacacaaccaaatggaagaacattccatgctcatgggtaggaagaatcaatatcatgaaaatggccatactgcccaaggtaatttatagattcagtgccatccccatcaagctaccaatgactttcttcacagaattggaagacactactttaaagttcatatggaaccaaaaaaagagcccgcattgccaagacaatcctaagccaaaagaacaaagctggaggcatcacactacctgacttcaaactgtattacaaggctacagtaaccaaaacagcatggtactgctacgaaaacagagatagaccaatggaacagaacagagccctcagaaataataccacacatctacaaccatctgatctttgacaaacctgagaaaaacaagcaatggggaaaggatttcctattgaataaatggtgctgggaaaactggctagccatatgtagaaagctgaaactagatcccttccttacaccttgtacaaaaattaattcaaaatggattaaagacttaaatattagacctaaaaccataaaaaccctagaagaaaacctaggtaataccattcagaacataggcatgggcaaggacttcatgactaaaacaccagaagcaatggcaacaaaagccaaaattgacaaatgggatctaattaaactaaagagcttctgcacagcaaaagaaactaccatcagagtgaacaggcaacctacagaatgggagaaaaattttacaatctacccatctgacaaagggctaatatacagaatctacaaagaactcagacaaacttacaagaaaaaaatcaaacaaccccatcaaaaagtgggcaaaggatatgaacagacacttctcaaaagaagacatttatacagccaaaagacacatgaaaaaatgctcaccatcactggtcatcagagaaatgcaaatcaaaaccacaatgagataccatctcacaccagttagaatgacgattattaaaaagttaggaaacaactggtgctggagaggatgtggaaaaataggaacacttttccgctgttggttggattgtaagctagttcaaccattgtggaagacagtgtggcgattcctcaaggatctagaactagaaataccatttgacccagccatcccattactgggtctatacccagaggattataaatcatgctgctataaagacttggtgccaacccaagtgtccatcagtgatagactggattaagaaaatgtggcacatgtacaccatggaatactatgcagccataaaaaatgatgagttcatctcctttgtagggacatggatgaagctggaaaccatcattcggagcaaactgttgcaaggacagaaaaccaaacaccgcatgttctcactcataggtgggaattgaacaatgagaacccttggacacagggtggggaacatcacacactggggcctgttgtggggtggggggaaggggaagggatagcattaggggatatacctaatgtaaatgactagttaatcggtgcagcacaccaacatggcacatgtatacatgtgtaacaaacctacacattttgcacatgtatcctagaacttaaaatataatttttttaaaaaaaggatgagttcatgtcctttgtgaggacatggatgaagctggatatcatcattctgagcaaacgatcgcaaggacagaaaaccaaacactgcatgttctcactcataggtggaaactgaacaatgagaacacttggacacaaggtggggaacatcacacaccgggacctattgtggggtggggaagaggggagggatagcattaggagatacacctaatgtaaatgacaagttaatgggtgcagcacaccaacatggcacatgtatacatatgtaacaaacctgcacgttgtgcacatgtaccctagaacttaaagtataataattttaaaaaataaaataaaatgaaaaaaaagcttctgcacagcaaaagaaacaatcaagtgaagatacaacccatagaatgggagaaaatatttgtaaactaccctgacaagcgattaataaccagaatatataaggagctcaaacaactctataggaaaaatgtctaataattcaattttaacatgggcaaaatatttaaatagacattcctcaaaagaagacatacaggccaggtgccgtggctcacgcctataatcccagcactt

SEQ ID NO: 34007 - DNA, 1024 bp, Homo sapiens
ggaatgaaaaggtatatgttacagtataaaatctatttttatacttgcgtgcatgaataagaggatttgggattatgagtaaatgctaatcttaaaaagaaatagcaacacctctaagaaagagacaacaaaagagtgagaaagatccaaaacaatcctcaggaattggatggacaattatcaagaggtgactgaaagaatttgggagtatggaaggagtgccaggaacattgagacacataattttatagtgaagcatctcagcacaatttttaccaataatacttagcagcctaaaagaaacagggaaattggagactgtaggaagtcagggcatggggagaaaacgtagctatgaattcgtagttgaaatggtagacactatgtattctcaactgcaaggagaaaatagaagccaaaaagactaaatatataactaatccagaggcttttaaaattctgcttctttcttagtatgtattgtcatgtatttgtttatcttccctttctgtatgatactatgtcttacttgtgtttcacaaatgtgagattcctgaccttttataagaaggtaacaaggcatttttcaaaaagcctttttttggagaggttaagtgggatggtagagtggattaagtggaacaaaattccagttttttggcgagaaaatattttttagtctaaaatccctctgagactcactacaaactaatttctttctgtcattcttcttccttcttttggtttctctataactaaatttagtttaaaattaagttatctataaaggcagcctttccatgatcgttggagcacattctgctcatgttagaagttcattgttctttgtttttagttattaagcacatacagtagtccccccttatccacaggggatacattctaagacccccagtggatgcctgaaattgatgatagtactgaaccctatatatactgtttttcctgtgtgtacatacctatgataacatttcatttataagttaaagacacagtaagagat

SEQ ID NO: 34008 - DNA, 1024 bp, Homo sapiens
gaaaagcatggtcaccagatcagcatcataagcatcacctagaaacttcctagaaatgcaaattctcagactccaacttcacccctgacttactgaatcagaaactctagtagtaggcccagcaagctgtgctttaacaagccctccagcggattctaacgcatgctaaagtttaaaaaccactgcactaaaatatcaccaagacaaccactcataggactgggcagaaagaaaaagagatggatggacttactgaaactgagaagcttcaaaaaggcccccatggaactgaaattcagacttttgagaacaggtcactgcttgcctggtactgatttctctgagttcagaggagggagcctatagacctgggaaccaggtatctgaggaagaagcacccagtaattggagctggcatctcaagaaggcacattgagattggttctacaagtgttggaaaacccccaaattgcaatcagctgctactactagcaggcactattgctgtcggagtgaagaattgttgctagagtgagacttaacaggattaagaaacccatccgaaggaaacagcaaattccttcttccttctctacctgtgaagtgtcacgctggtccctctattggcagagcctaacagggagacagaaatgcttgcagaattccaaagagtgggtttgaagccaagagacagtagcttactgtcatggccttaattataatacaagtggaagataatagaaataatactttaggtatgtataattgggtgcatgtagacattttctgggatactaactactgggtagacatttggccttattgtaaaaaaaaaaaatttgtattaaaactatttgtttctcctgatgaaattaataagaggcatttagggcatctatataatgaacaggaaactatgcaagggcctgcgctgaagtctgcttagctgagcctaagacaaagatcacagcagtagtggctgaggattgctcaataataacagcaaacatgctttggtcatctg

SEQ ID NO: 34009 - DNA, 1059 bp, Homo sapiens
tgcatattttttcctagagagacattttcagtgtatttttttttagaaatttataattttatagttctttcataacacttattctgagttttgaaacaatgtatttcctatcttgacatggattttttcacaaaaaatttgtattttactgttgttttcaggaaaaaaatcagatcatttttctttgatatctatatcagaaaggtacaatattaacagtataaaaccaaatgcttaaatttggaacttagccaattttgataatctttttctaaggctaaagtcacatcagtaattggctagccatgttattaaggtgtcttaattcagcattttcaggttttatattgaaatacgcatttctttaaatattctttgaaaatggagaatggctttagtgatattttgggttttgttagagaacctaaaatctttacactttcatctcaaagattataaaggaaaggggggtagttaagatttagaattcaagttaaatttcagaaattggggcagtcaggcatttgtatctttggtagggcaacaagtaaaacatgtagagtgcttgctatcccacttcataaagcttttacccaatcttatttctaaacctctgtgcattcttagtgtcttctcattctgaaacagaaaataaggaaaaacatttaacttagttttctaaaatcagataatcctaaacaaaaatgttagtcagggtcactaaaaagtattgcacatttatataaatacagtccttttaaaatttgacttttaaaaaacaaaagactttgtacgatattgtgtttttattgcttttgcaatatttttatagtagcctttatgaactcagtataagtgcaagttgtttgaaaaggtgtttttattagtgcacaatagaattgtgaggttttcaatagatgtcatgagattttgtatatctacataaaatatcagtacatttttttctaatgctactggaaattttacttttcctttgcaacacataaatgatatgatgtacaaaataacagctctggttccaccagtacctaatgttga

SEQ ID NO: 34010 - DNA, 1078 bp, Homo sapiens
cctggtctgggagatagattctcgagatgactaatttcaatatgaggtagggaaagcaattaaatagtgattatagaacattctagggaaccttagagaagaggctgtttgcccaaaacaaaatccaagaagacatttttaaggggataacacctggtgttgattgttgaaaggttggttaatgctaactatccaggcagagcaggaggacattagaaatttcataagcaaagtgagagaattgattgtaaaggggcacaaggaaagtatgtgaggtgatggaagtgttatgtatcttgcttccagtggaagttacatgagtgtatacaattatcaaaacaactttatgaactgaacacttaaaatctatatttcattttatttaagttatacttcaaagaaaaaattttaaagccctaatatataactagggctagcagaagttagagctgaagggacagaagtaggagataatacctataaatggctagttaaccatgatagttaccaagatcacctaactgaggtgggggtttggggagaggtggagcatggtgagagagcaaggatctgaggattgactaggcggacactagaagaggattctgaagatgaccaagaagtagtaggcaaaaagaagaaccaggagagcttgggaagccgagggaggggagacagacagacagatgggaatggttaacactgtcccatgaaactgaggtagtaagataaggacttaaaattgtgtattgtatttggcaacatagaagccattgattacctttgctagagttattggagttatgggagcagaggtagactgcagcgagttgacaagtgaatgggaggtaaggacatgaaggcaagagaagaacagtagttaagaacaagagctacactacctggggttcagattctggctttgccacatactatatgacttacttagccatactcttaatctgtcttcgtttcacttccctcatatgtataatccttatatctaccttagagggttgttgtgaggattacaatttgctaatatatgtgaagcattgagaagagagccaggcacata

SEQ ID NO: 34011 - DNA, 1049 bp, Homo sapiens
cctagtaaatgctggaaaagtacatgttatcattagagtgattgtcattctctgggaaatgaaattatgtgggtaggaaaagactttggcagacatactaacttggctatatgagactaacagcagttgaaatcctccatccattctgttttatttatgagtcttcaggaatttcatcttatcggataatcgatgcatcaaaactgccctttggtgactgttaatatttatttttatctgaggcatacttcagggttagaacccaacaatttcccttaagaaggcctccatgggactgggtctttaagttaattcacacatcaagtctgatagttaaataaaaactacattgctaaatttgggagtttttaaatatagctttattatctgttctgagatttttgaaaactctgttcaaatcataggaatgaatagaatgcttccaatgagagaacgttccaaaacagaggaagacattctacgggcagcacttaagtatagcaacaagaagactggaagtaatcctacatcagcctctgatgattccaatgggctggagtgggaaaatgattttgttagtgccgaaatggatgataatggaaattccgagtattctggatttgtaaatcctgtattagaactgtctgattctggcataaggcattctgacacagatcaacagactcgatagggtaaaattgtgtgaccttgtttatcagttatgaccaaatgttaaaaaccaactagaatgtataagtgattgtgcttagcctttttgtaagggagatgtgtaagaaaccatgttgtaaatgcttattttattacaaaggagtagggatgataggatctgaattgatacagaattaagtgcaatttcatcatctgccttctgcttttcaagaccaatttaatggtcctgtcatgttactgattaaatttactttgtcttgtctttatagcatttctgtttactatggtagatttccactttcaatttttaaaattaattttactttgaatgatttatgaagcctatttcattgtctaac

SEQ ID NO: 34012 - DNA, 1016 bp, Homo sapiens
catgcctgtaatcccagctactcagaggctgaggcacaagaatcgcttgaacccaggaggcagagggttgcagtgagccgagattgcaccactccactccagcctgggtgacagagtgatactcggtctcaaaaagaaaaagaaaagaaaatttgttttataataattattcatgtacatatgaattaaataggctctgtgggcttgcttatgaatctaaccaagggttaattgaattccaacatagataatttaaattgagcttgcagagtacaattgtgtattatatgccctgtatatttatctagtttaccttttagtatatttgcatcttatccttctaattatattgtaaattccttgacagtaaagatcatcgctcatatttctttacctttctccacatcttctagcttggggattctgactagttggctagtgggttataatagcagtggcaaccagtagacaatggaatatctctggagtcattttattttccttgacatattccctaataggggtactaattgtccagtgaaaaagactcaaacacagatgctaaaagaaatggagctttgaataatccactggtttggttactttttataatagctgatttgtcaattatcccataactaagccactcaactaaattctaagttaccaatagaactgaagaatttgtatatcaaaatcacatacagcatgtataaacacatgaccccttagctgtgagtgtgcacatgtgccttaaagtgtatcactctaacttttttgggtatttattccagaattatctgtttttatggtctgattgcttttcctggaccctttctatttgatttttaaggaaaaaaaaaatacaggggagggatgttaaaagagaaaaagtaattcattgattaccaaacatactggggaattcccattgtttaaatgtaaaaacaatatacagctcacagaatgccacagttcaggggaggaaaaactgatatgtgttgagattgaaaatg

SEQ ID NO: 34013 - DNA, 1026 bp, Homo sapiens
aactactttcttcctttttttttttttttcttttgagatggagtcttgctctgtcgctcaggctggagtgcagtggcgtgatcttggttcactgcaggctccacctcccaggttcatgccattctcctgcctcagcctcccaatagctgtgactacaggcgccagccaccacacccggctaattttttgtatttttagtaaagaccgggtttctccgtagccaggatggtctcaatctcctgacttcatggtccacctgcattggcctcccaaagtgctgggattacaggcgtgagccaccacgcctggcctactttcttttttaattttattttaattgacagattaaattatatatctttatggtcatacattatagaatggttaaatcaaactaattaacattatctcacataccattatttgtggtgagaacacttaaaatctactctcttagcaatttgcaggtatataatatattgtttttaactatcatcaccgtgacatcccatagatctcttgaactttttcctcctgtctaactgaaattttgtatcctttgaccaacaccctccctaattccccccatcctgcagtctctggtaaccacaaccctactctctgcttctatgagttcaacaaaagaccactttctaccttaagggaatgatacagcactaagaaaacataagcctttagacaaaaggatgatgtgctactaaaattatatgatattgtggttttatttctttgtgcacgagctcttcctatttctttattacacctctctttctcgatgtagttctacaaaagaatgctaggaaacagaactcccttcttgctttaattttggacttgaagaaaaatgagtctccaacttatctgcagctcacgccaagcaaagtttgttcttaatcttctaaaccaccaaatgtatattttaatctcaatgctaacctcccattttagccaatgtctccctctgtcaaggaatgatgggaatgagatatcatttcttcattgctt

SEQ ID NO: 34014 - DNA, 1036 bp, Homo sapiens
ttacaactatttttcagaagggtttgaatctgcattttctattggtaaaaatgaaagaaaggccaatgaaatgtttacaggccctgggcataaaccttaagaaaggtcagctttttcttctcacctccttatcacatttagtgggtggacaaatatggagcatgctatgtttggtcttccattgacttgagtccaccagtttgatctgtaccactttcactctgcttttactattgatggataactatgcaggcgtcaatcacttttcgtgtgtttattctgctaattcctcatctcaggacttccccacctcccttccatatttccctgccttttaccaatctcccaatttgttatgcagcaataatttccctttacactgctcctgccaattgcagtgccagatggcttcagttctgagccccttcacccagcccctccttgagaacagctgccattgtcattgctgtgaacacatcacagctttgaacccatagctgggacctaaacttgatgctcagcatcgggaggggctggcgctaatgcaaggaaccatgaaaacagcacacacttttccttgctgctgtttagcaagagcccttagaaaaggctcttcagcattttttcaatcatctgtgtatcgaaatctcattgtggagtttaattcctttaccacctgactcagcttcctagccatgaagttccctttgtgccttaaacacaattagaaccccgttatttcccatcctgaaaacagatgtgaaaaaacaactgcgtgtgtgtctatgcgtgtgtctgtgtacatgtgtttgtgagcctctctcttcagaaatccagcacattctctcatccatatccacatatttttatgtaaacatgatcacataacaggaaaaatacaatttggttgctatttggacaatcttcccctaagccagctccgaggaaaaataaaggattagaatccctgtaagtttttgatcttgagctatactatgttcatcccaacactaaaactgttactgtgacactacct

SEQ ID NO: 34015 - DNA, 1044 bp, Homo sapiens
ggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggtatgctccctcctgctggccgcccccgcgtcctcagtgtcttctggtccccttccctcccgagctacttgacctctgtgggacacccggagcacccgggccctgcgtgccatctttccgagcccggggctcccctcccccgcccctgtgcccttccacccgcctctttgccagcacaaaggccctggcataaagggtttcagagccaaaagcagtagagaaaattgtgaaagggtgtggaaaatactaattggagcttttgtcttctaacaaatctgtcctgctgctttcaaacaggggtatctgaattgctatacttctgaccaagagtctttaaaaagcagattagaattctactattttctcttcgctctcctgtctcctttctgtaggaccacttgactaagctgacaatagagctgacaaacccactgaagtaatttgagggttttttttcatcattcagaacaccggtacagtacctgattaggtcttaaagtatctttttttttcctgtcactttgaatgaaatgaaaaaggaggctgacattctaacttaagatgtggtgtggaagagggctggggggaggggggcctgctatgcgttactgcaaagtccacttccatagaattcttgaattatttaaattgctgatagccattagatttagaaacgtgtagcctgttattcctgtttccaagactgaaaaagtaaaggatgaaaagagaaggcaagttacccctcccagaaatgggactggttcattttctgattggttttagctgttgctattattttaataactctggtctttaagaggttaaaatctctttacttcatttcctttgaaaaggaactgtactaactatgctaaataggacaattgct

SEQ ID NO: 34016 - DNA, 1034 bp, Homo sapiens
ctcctttaatgttttaaaataactgcaactgtcatttcacagttattatagaagctaatacacaattgtatcacattatctactgtagttaaattataattatcttgtgtattatttatctattgctgcatgacaaattaaccccaaaacatagaggattaaaacaacatttattaattcttacagtttctatagatcagaaaagggtggggaggggtggcttaactgggtagttctgactcagtctctcttaagctgacagtcaggatgtcagctgcagctccagtcctctgaaggcttccccaggactggggaatctgctcccaagctctctcatatagctgttggcaaggagacctcttccttgttggctgtgggtcagaggcttctgttcctcaccatgtggcctgtccatagaacaacatggcagtgggaaaaatcgaagggagagagaggtggaagccacaatgtcttttacaacctaatcttgcctccgaagtaacatatcatcacatttgtactcttttggtcactggtcacacagaccaacccttgtacaatgtgggagggcaccttggaaattcatgcccaaaagggcatgaataccagcaggtggggatcaccgagggcaccttggagatggctctgtctatctcaccagcctgactgaactcggccttgtgcctcttgctactccctagccctggcttattatagttttgcataataatatgaaataccaataagaattgtttgcatcttaaatgatcaataagggctgattagcttactaactcttgctacataggatgagaggcataagaaaagaatgtctgagctctccaggcttcagaaaaccattctacaacaaggaagggtgtgggcagataagtggatggatggaagaattaaaagttggaaagaaaaaaaaaatggcattttctcagtccttcctctaatttatcaagaaacttattttgcttccttttgtttaaacttttctgatttttctccctccattctttaatatttat

SEQ ID NO: 34017 - DNA, 1047 bp, Homo sapiens
gtggcaatgttgtttatataagtataccacattataagtctactggagatccaaagggatttgcgtttgtggaatttgaaacaaaagaacaagcagcaaaagcaattgaggtaagtccagatcctaaaaaaaaaaaaagaaagaaaagaaaacaagtattaaaatagtaacttttgcaatcatttcagtttcttaacaacccaccagaagaagcaccaagaaaacctggcatatttcctaaaacagtgaaaaataagcccattccagccttaagagttgtgggtgagtatttttcaatatttaaataggtgtagttgaagtaagatgaactaataatgatggcacttttacagaagagaagaaaaagaaaaagaagaagaaaggccgaatgaaaaaggaagacaatatccaagccaaagaagaaaacatggacacaagcaacaccagcatcagtaaaatgaaaagatccagacccacatctgagggctctgacattgagtccactgaaccccaaaagcagtgctcaaagaaaaagaaaaaacgggacagagttgaagcatctagcttacctgaagtcagaacagggaagaggaagagaagcagctctgaagatgcagaatccctagctccccgatcaaaagtaaagaaaattattcagaaagacatcattaaggaagcatcagaagcttccaaggaaaatagaggtaaaactacaaggttttaattagataaaactaattaattttaattaattagtttttaattaattaggttttaattggcttctgtttcacccatttcacagccccatgtcttaacggagagcttttttatttatttcaagatatagaaatctctactgaagaggaaaaggatactggagatctaaaagatagctctctcttgaaaacaaaaaggaaacataagaaaaaacataaagagagacataaaatgggagaagaagttataccattaagagtgctatcaaagtaagtctgtggtttaaattctgtcattggcttaacaatccatcaccattgctaaagt

SEQ ID NO: 34018 - DNA, 1059 bp, Homo sapiens
aaaaaaactaacttaaaaagcaagtgtttttcatcaaccttcttctaccattgcccagaatttatcgtgatttgtggggaggtgtgaattttgtttccttgaaaggagactgaacttgctgtggtggggaagcctcctgtgcttcccaaggattctttcagggatatgaggtgttaatttcaaagccagtttgagattattcaaatgttaaaatcactaatccagaactggtaactgaagtgaagtcactttgttaaataatacccttctaattggtgtgaaatttcatttagattttatatatttttaaaactaggaataaaccttttatttttcattttaaaaatttagagctcatctttgactaggaagttcttaaattgagttggaacacaactcagttatgacgtcaggattgtcgttaacgcaatttgttaagtagctatggaagtagccagttgactcttgtcgtgaaatgaaacggaggttaacacagaaagtaagtgctgtgcaaagcttgttggaaaaaaggagtagaccataattagtttagccaacttgtttgctagttaattcagctaatgatttttgagtgccttgtgttaggcaccattcttggaacctggggtaaagccatgaatcacaaagtcccctactttcatgaagctaacagataaacaatatagtttaggtgatgaccagtgctagacagaaaaataaagtgtattgcaggagagcattgtaacagctgaggttgtctggaaaactctctgcaaaggttatgttacagccaagacccataaggaagtgagcgagtaagccccagtaaagtttagaagtatagcttttcaggcagaagcaaagaaaatgcagagaccggaagggaagactgtcagggactagaagaccagtgtagttggagtactaggagcatcttagtaagtaatggaaattgcttagaaaaaaaactagtagaacatcagtgaatctgccaaaaggttacataaataccttactgacctgacagcccaatatttctacaatagtgttgtatttggc

SEQ ID NO: 34019 - DNA, 1088 bp, Homo sapiens
agctccgcctcccgggttcacgccattcccctgcctcagcctcccaagtggctaggactacaggcgcctgccaccatgcccagctaattttttgtatatttagtagagatggggtttcaccgtgttagccaggatggtctcgatcttctgacctcatgatccgcccaccttggcctcccaaagtgctgggattacaggcatgagccactgcgcccggccaagatgttatatttttaatttttattttataaaaagtatttgagttacagcacaggaaaatttattttagacagtgaagggatgacagtcacaggcaataaataaatatagttatgtattgacattattaatttaggtttttaaattttgttttttaatagacatatagtaaaattcactttttatatagtttaatgagtactgacaaatacttaagagtcgtgtaaccatcaccacaatctaggtagagaatagttctatctccctgaaaatttccctcatgctaatcctactgtagtcaaacaaaggcttctcctaccttcaattcctgatagccactgatctgttctctgtccatatagttttgcctttccaagaatgtcagataaatgaaattacctagaataaaaccatttaaaattgatttttttcaatcagcatagtgcctgtaaacaggtccctctaagtgtcttgcatgtgtaaacattttgttcctttttattgctgagtagtattccatcgtatgggtgcaccactgcccggccattcaccagatgaagaacatttgggttgtttccaggttggggcagtgatgaatgaagttgctatataaaacactttggaaggccgaggtgggcagatcaccggaggtcgggcattcgagagcagcctgaccaacatggagaaaccctgtctctactaaaaatacaaaattagctgggcgtggtggcgcatgcctgtaatcctagctactcgggaagcagaggcaggagaatcgcttgaaccctggaggcggaggttgcggtgagctgagatcgcgccattgcactttagcctgggcaataagagtgaaacaccgtctcaaaaac

SEQ ID NO: 34020 - DNA, 1031 bp, Homo sapiens
catagaggggaggggggctgaaaattgagtcagtctccaatggccaaagatttaatcaaccatacctctgtaatgggacctccataaaaagaaaccattaacaataggattcagagagcttccaagttggtgaatgtatccacatgttgggaccacatcaaacaccacggggacagaagctcctgcactctggacacttggagacctcaccttacatgccttttcatctggctgttcatttgtgtactttataatattctttataacaaactggtaataataagtaaagtgtttccctgagttctgtgagctattataacaaattatcaaacctaaggacggagtcagtcgtgggaacccccaatttgtagccaagctggacaaaagtgtgggtaacctgggtacccactacttgtgatttttatttgaagttgggggcagtcttgtggaactgagcccttaacctgtggtgtctgcgttaactctgggtagtcagtgtcagaattgaattaaattgtagggcacttggtgtctgcagaaaattgggaaatttcttgatgtgaaaaacccacatatctggtgtcagagatgttctgtttcagtagaaacagtagtagacttgaacagttttactctttatatagcttatttccaatagagaacaaatggaaacaagtgctcttggaatctcatattgaattccacagtcacaagcatcctggtcaactcaggggaaaatatcacacacttggtacaaagcaaatagatgagttaaatattatatattaaatgacaaatttattatgatattagtaatttataattattagattgaattatttccataaaaatatgcaaatactattatattgattacaatatcaaataatgatattatagccttaattaacatataagaaaatggcacaattcactttaaatataagggacaaagacaaaataatgaaaaccaagggtttgcatattttgtgattattttataggaaacagctaattattaaactaaggaa

SEQ ID NO: 34021 - DNA, 1031 bp, Homo sapiens
ctggtactgtgagaatgagaggaggttaaatccacatgacttagtgactaaatggctgtctgaatgaggaagaggtagtatgctaagaaggcattaagggttctagcttaagggagtgtgatagatgattgaccaacattggaactgcaggaggaagattggctttaggaggaaaacattataatgagttcatagtggatatgtagtttcagggtttggctgaggactggtagtccagaggtgggagctggggtgaagaaagggaatgggagaaacactgttccagagagagagctcagtgtgggaggaatggagtagaatgggagggagggtggtatgatttaatttgggttatttaaatctttgtatttttttcttttgactgggtgttacagaattaagttgaggacatatatagtcagaccacaaaacagtttagtttattatttctaaacattaagctccaatgacacaatgcaatattagcatcctaatattctttctctcgatgtagaccttggaaagagaaattgcactgttaataggagtattttttgttgtttttgtgacaattaaatgcttggagctagggctatgtatttacagaaggactcacctctggccttgtgcagtttatgattcctggtgggtggcactgcctgctgggatcacctcgacagcagcactgctggcccagagctgtgttcttctgtaatctctcactgtccaccagtctgctcatactgaagtgttgccaacacttctgctctattgtctttgttcgttgtccacatctgctgaaacaactttcagttatgctaaattgcctgcctgggcagcctaatctatagctattgattatggtagtacactgacaacaggttgcataggtttttgagaggtaaatttatttctcttccctgcacctcctcaattggccctatatttttagagcacaattttgtagaatacagtctttttccccctgaatgtatatatcaagttatagcagaaatacctgtaatgatagt

SEQ ID NO: 34022 - DNA, 1051 bp, Homo sapiens
tttaaagatgttatagcattaacaattttttaattataagaaatgtaatatactataagacttttctttctgtagtctaggcaattatcattggtatcatttgggaatgaaaaggtaaatagattgtctcttcctcaagatattcattgctggaaaaagggaggtggaggaaagaaatctgaatacaatagacataataaacacattgggatttgttcaccaaagtcatctattttctctaagggcttatgaatttgttttctgtgatcagaacattatcttcataattacttataaaattgattgctataaggttgtcaataaagttatttgattctaaataattcaaatagattgcatccatgtggagaattctccagattctacatttaaatcaaggggaaggagggaagaaggaaatattagacttaaatgatagaatgtaaaaattcttagtctatttatatcgcacacatgatttggggaaatctgcttgtatttttaagtcgtgaatctcatctagaagaatccgtttcttttctagaaggaatctacgaaatattgtgaaaatcatctcatttggttacagaggaaacaattacatggtgaactattagatgagttgtatgacaccattaacattgacaatcatgcaaatatccatgatgtttcaggtgcaataaataacatatggtgcctttgtactagattagtaatttaatccaagaacagaagatatgccagaatgccaaaagaggagaaatcaacttagctttttaataaaattgcaatttttaaagcatttctcattttgcttagaaatttcctcaaggccttacaaaattcaggtcatgtactattgaagataagataaaaggagtggggaataacttaaaattttatcctctttgaatgataattatttaacatacattttctatacttcatggctattcttttgagtgctaaaggagaaatagacaattttattaatgttggtaatgagataacattaatcagcttaggctattttctttttgtttttgttttg

SEQ ID NO: 34023 - DNA, 1050 bp, Homo sapiens
gatggaaccccgtctctattaaaaatacaaaaaaattagccgggcgtggtggcacaagcccgtaatcccagctacccgggaggctgaggtagaagaatcacttgaacccagaggaggatggcgccactgcactccagcctaggtgacagagcaagactctgtctcaaaaagaaaagaaaagaaaagaaaaaaatagtgaactaaaatctgatttttcccttatttgcttacttttctttctgtgatctgaggaaaacaaaaggacccagcccatgtggcttcatattgggaagaagaggcacccactgtttcctaaaatttagagctagaaggggttggaaagagccgatcctacccctgtttttttagaatcaaattcctgtatcacagttgaaatgattgtcaaaggtaagagcataatgtttgtctgttgggggaaaagtctgttggggatacctgaaggaatacatgaatttgaagatgggaattctatttttggaaagcttaatgcagcaaaggctgatataatagcaagtgacggctgcctctggggctgagtccccatgactactgctttctcctgaataattactggaaaatacatctaaactaaagtttatgactaaatttagggcctatatgttctgattttccccagataataaggctatgagttctactgaattgaactgagttacagaaattagattttcatgcctttcctagttgttactgttctttatacagcttacatattttttagagcagggatcttcttaacttcaagatcctcagggactcaaagttcatgatgggagctcagcaaatgtactgggatagacagataaacggtatttgtgtacgtcaaacttgatctaaagaccactttaccaagaacatgaggcccaacagaaaaataagactttaaatagatgtttttaaaggataagttccaaagaaaaatataaaatggggtctattttaaattttaaagactggtagcaagatagtatgaattattttttcatttggccaggtgcagtggctcat

SEQ ID NO: 34024 - DNA, 1070 bp, Homo sapiens
aggttatgaaagcacccgaaagaacataagtgggaaagtgacatcaacaagttttcatttagtgaaaaaaaaagatgatcaagtcaccttcccagatttgccgcacccactctcactctgaaagtaagctatttgacagtagcggggagacgtggcggaaacatccaagtccggacactagttttctttgatcgccctcaccatggctgctgcatttgttgtctgagtgaatattatttttcctgtttgaagaatagagaggggaatgatgccacactctaacaaataaaactaaaaagcatggcagtaatattaattatgtgatctactgtcttcttaagtgttttgaatgttatttggcatatcaacagaatgaatagttttggattgcaaatgattttttgtatcctttaattttcatgctgtttgctttctgtttttgaaaatttgttgaagattgtccttgacagtttgtttttctaaattcccacttgtttgtttgcttggctgttgtttatttggctacttcttgaacgtggaattcatgtttgcatatgattatatctgcataattatttgagtttatatatagctaatcaggggtggtaatatgctctgctttaattgacccctgattacttctgctttctatggaatttctattttctttcactttttagttaataaagagttatttatcattttccacatggaaatacccttttaggcctgagtaaagtagaccttttctcagcttagaagaaatctcttagtatactggaatatgcatactaatattgtcttccagctttagctccatattgacaattggcaatagcatcttttgtattagatggatttataggtgatagtgaagacttgtagcagttatatggagcagggtatagcattaaagcaatttattattttataatttgtaactccattagcgttactcagcttttatctctttatcacagttatttttatttataaatgttaactattttttaatgtatgtaaaaacaagcattattttaaattaaaaactatggaaactcactcgttga

SEQ ID NO: 34025 - DNA, 1022 bp, Homo sapiens
tcctgtgtttaaatgtttgttatcatggctgctaagaaaagtttattactttttcattgtcaaatgtcaaatagcatgatcttctgtggatactacttagaatttataataattaggctttaattcatttgtctttgaatatgtttttctgggaactgacaactgacaggtaccagatggaataaaactctggtctgaaagaagtttctgatgctggtaaccagctccagtgctgtttagcattatggcctcgaacaactgactaacatctttggacctatttcctgagttgttaaatgaagaagtagaactggataacttctaaagttccttttgattcaaatattgtaattcttgaaattgtagggctactctaactcgtcttaggtgtgcccacatacaccagtttctagaacctttggtttcctttcactgcagatttagagaggggagactggctctttctttaagagtttttaggacagaaagcattttttgagtatatctgtattgagctgcactttacttttcctcacactaacctctctaattttcttaagtggttgttcaattctccttttcatgtagcccaagggtcctatatatggctcatggtgttgcattcaatctgtgactgggtttttttactatccacatgggccgcatttaacaaaataattgacaaggaatatttaccaacgatgaaatcctgttcatctgatttagcccaactaggctgaatgttgagaaacttttaccttcagcaatgttctcaagactgtagaaaaatgatacaaagaagtaaaagacaggggatttgatttaaagatactacagtgcatattcaataatgtagttctgctaggaaatatttgtgatagtagcatagactgtttagccttgtgtgacagagtcaaagatggggtaagtcagttattttgagcaaagatttcatatagagcttatttgaatatgaaaaggaaggtcctagaagcttgatgtaataatcagtgtagacaatt

SEQ ID NO: 34026 - DNA, 1063 bp, Homo sapiens
tccatgatttacactactatacttctcttattggcttgaaaatgattgacatcttattaattcattaagtaaatatctgttctaaaaagggattacaatgagaaaggcaaattgccttcagaattatgaacaagtgaagaaatgaaaagatctttatggcagggaagctcctgaacttgttggcttgttgtgaccaatcttcatccattttgaggattcattgtgttattgtgttcatgggcagcactgcattaatctttcttctgtgcttctgttgtggccagcataggcactagccagctggccaggcttagtttttcctaagaaatcttctatttcttgacctcagatgactggtctctaggtgaattcagagataaatgaggtctggattacaatgagtgattgttcttgcatccagagtcaggcgcctccatggtagttctcactctcacaatctgcactgaagactcagccttagttctctctctctctgaggaccacaatcctaatgacgcccctctctgcatgaggacaggcatggtgacttgttctgtcttcttcctagaaagtagtagcctatacagatgttgaaagaaaaattatcctatgcccaggttacgagtagacattacccagttaggagactgtgataggatctgtgattcataaagtacagtctctttgagtgattgtcttgtcacttgtgaaataatgaactttttgcttccaatgtcacataatggagttggtgaatagggtgtgctgaaagggtagaggaatggaaggaggaagatctgatcagaaatgaaagctccctttttttttttaacagccattttcctgctcattgaatatgtttaggctgtgtctggtggctcacgtctgtaagcccagcactttttgggggctgaggcgggcagattgtttgagccaaggagtttcagactagcctgggcaacatggtgagacccagtctctaaaaaaaatacaaaaattagccaggtttggtgtgcacacacacctgtagtcccagctacttgggaggctgaggtgggaggat

SEQ ID NO: 34027 - DNA, 1050 bp, Homo sapiens
attagcattcgtaacaattaaaaagtttcacatggcatgcacacaacacaaaagacaaattttatagtggagaaataatttgcaaaaagggttactattctcaatatataatgagatatcattaagaaaaatataaatatgagaaaaatgaaggaatttagaagtaggcaactcaaaagagaagaaatgcagttgatcaataaacataattagatgttcagtcttgcaaataattcacttttttggtctgcttggaatgctttccccttttcttcacaatttttgtaaacctgattccttttcacaagggtcttcagtctaatgtccctcatctctgtaactccatgcttcacttcttacctgcctctctctatttgaatataagctttttgaggtcagatacctaatctatgccttttttcccccagtgcctatttagtgcttggccatagtagactctcaaatgtttgttgagtaaatgtgtaaataaatgaaggaactgatagaacgtaaatggaaacaattacatacagtattttcctattgtattaagaaaggttaaaaagtaaggctgggtgcggtggctcacgcccgtaatcccagcactttgggaggctgaggtgggcggatcatgaggtcaggagatcgagaccatcctggctaacacagtgaaaccctgtctctactaaaaatacaaaaaattagcctggcatggtggcatgcacctgtagccccagctactcaggaggctgaggcaggagaatcacttgaacctgggaggtggaggttgcagtgagccgagatcatgccactgcactccagcctgggtgacagagcgagactctgtctcaaaaagaaaaaaaaaaaaaagaaaaaaagaaaggttaaaaaataaaaatacctagcatgagtgaaataacgtattatcattcttggaggtaaaaattagcacagtatttcggtaggaaaatttggcaagttgaatcaaattttaaaatgtgtgcctcggccgggcgcggtggctcacgcctgtaatcccagcactttggg

SEQ ID NO: 34028 - DNA, 1031 bp, Homo sapiens
acctatcaaccaatcatctaggttttaagccctgcatgcattaggtatttgtcctaatgctctccctccctttgcccctcacccctcaacaggccccggtgtgtgatgttcccttccctgtgtccatgtgatcactgcaattactactgttattatgtaaaattttctgtgcttcttagacatctacgtttggatgtcaggtagactgaagtttagaggagaccctgggcctggtggtaagtgtttgggagttgtcagtgtacaggtgttatgttaagctgcgggagggcctgggtgagaaggtttaagaggtgcccacgtacacgggacgttacatatagcaaatatggggtgtgatagtaatctaacacccttccacaaatataatttcctcaacaagactttttccagaaaaagaagtcattatttgaaaaagacacatgcacacacatgtttatagcagcacaatttgcaactgcaaagatatggaaccaacttgagtgtccattgaccaacgagtggataaagaaaacatggtatatatataccatggaatactactcagccataaaaataaatgaaacaatgtcttttgcagcaacttggatggagctggaggccattattctaagtgaagccattcaggaatggaaaaccaaatagtgtatgttctcacttatgagtgggagctaagctatgaggatgcaaaggcataagagtgacataatgggctttaggggcttgaggggtaaggctgggaggggagcgagggataaaagactacttactgggaacagtgtacactgcttgggtgataggtgctttcaaaatctcagaaatcaccaccaaagaacttatctgtgtaaccaaaacccacctgtactccaaaaactattgaaataaatcatttgcattgtaaaaaaaaaaaaaaaagactttttccagggaaagtaaccttaacctcagagattgaaatgcatgtctttcatgattttattttgaaaattaagaagatgcagtttaattttcac

SEQ ID NO: 34029 - DNA, 1676 bp, Homo sapiens
ttaattatgtgcatgaagacaggtagatggactagcagaaggagtttagagtctttattctactcatggcttttaaccagagctcaatatgtaagcgttttctgggtaacccaaatggtaaaaaaattctgatggtctcctaatagtttcatgggaggacacagattttcggggtgtttcaggtccaatgggaatgattctgttttctctgtgtagacaaatgctgctttaattttgtgtagatatatctctaagttgtgttcttcttgaaacagataaaaaccaatgctaggacagaggtaattctacacttgatcttagccaaaaggctgagaagcaattcagaggtaattctagagatcttgttctgctcatattttaaacgagaaaactgagacacaaagaggttattggtttaccaagttaaaaattcttaatatagaattttaataataataatgtaatatagctgaaactcatataattacttcaataggacaatttaataatatagcagaaactcaactgataacttcaacaggacaattatgttgtaaaattgatgaaaatgaagtctgtagacacaaacatacgataaaacatgtgctcttactgattcattgacttctcttagccataatatttatctaccaaatttccctttatttttagtggtgttttatatttattgcagctaattgattctgcagagaaaaataagccctggtgcctctgacaggtgcagcagcctcgtgcagtatgttctcattatgcttatgtaaagtaagtctctactatcaaatgttaagaaacaacacagtggggcaaattttaaattaatggtttcagaaaatatcctgcagcctcatagtgtatcttgtcagctctctcaaattgtggacattcatcagaggtcttaaaagagaatggcaggaagtcagggaactgaaggtttagtagtaataaatggtatgtaagccaatatatagttggcttagtgttgttctgtgggataagaaatgcttctaaaccaagaaattacagaaaacatgcacaaacatattttttgactttggacagttcatgacggtatccttccaagattaaattaagaaaactaacacttaatttcatagctcaataggaattgttgaaattgtgatactgtagcaaactaaattaataattttttaaaaaataattcaggtattgtctgggcacagtgacttatgcctgtaatcctaatgctttgggagcctgaggcaggaagattgattgaggccaggagttcaagaccagcctgagaaagtagtgagaccccgtctctacaaaaaaattaaaattacctgggcatagtggcacattcctgtagtctcagctactcaggaggctgaggtggtaggacagcttgagcccaagactttgaggctctagtgagccatgattgtgccactgaactccagcctgggtgacagagtgagaccctgtctcaatagcaataaaataataataataatgcaggcattgagctaaaacaataacttggagtccgttaaaaggctgacatgatcagagtctctcactaatagtcaaggtataaaagtcccacctcttagatattattatagatgacacccattctgagtctattctctgattaaacccaggcacttctt

SEQ ID NO: 34030 - DNA, 1050 bp, Homo sapiens
cttttaacatcttgttgcaaacattacatatatctatagttgctaaataaagagacataaaacatatatgtgtttccttggcagtggcttttcttaaaggtaactttacattatattttcaaactgttttaaaactgtctttatgtttggtctattgtggttttgaacattttttttcccctcaaacatacactcaaaacattgaaatggtcaggagttagtcttaaagtcaaaagcctcgtgtttactaaatatctgctttgtcctattccaaaagtatttaaaatatttagcttaaggatttcataaatcaccatcttagtggaacttaaaatcagcattttttttttctagttttaggccctaaacttttgagtgagggaaaaaaggttgtgcaactgtttcattccaatcttgtatgtggaatttgattcaatttaaggaattaaaataactacatatttttaacaggttgagcactagagcccagagagttggttttaggttggctggatatgggtttgcatcaggcatggactataagtagcattccctgtctgttgcatgttattttatggagaccccaaaatgaaatgaaaaataaaatggaaatgaaaaataaaagagaaaatatttgaaggttccctaggatggctgggtaatcaataaatatcaagctgctcatagtctaaaagataaaaaagccaacatattttgataattaagtatgtactaggcactgttgtaagagtttcactattaactcacttaagctttatgataaccgtatgaaggttctatgacttgcgataaccctaggaggattctattattattcccattctacaggttaggacactgaggcagagtgaggttgaaaaactcacccaaggttgcatgactaccatgtctattaagtctcagagccaaaattcaaacccggatctacctacagagccagctcttaaaacaactgtgctttattctaaaggatactggttggtttgtttggggtaagttagatgtattcacggcctatgatttcatcca

SEQ ID NO: 34031 - DNA, 1020 bp, Homo sapiens
gatccagaggtatgctgcttttccaggaggttggacacaaaggaagaagggctggggtgagagtggaggaatccatctgtttcagtgaagatggcgtgctggatatggggaatacctgtgcatgcttgaagttggatggtgatacatcctcttcattgtccttggtatcttggaaagtaagtgattgtctccttttgacttgcttatcttgcatatgcgaacccctctatggtgtgtgaataaactattttgatagtttttgggtgggatgattaataaagttatgactcattatttgtgtatattcagaagttcagtaccatcgctaactcacagattacagaatatacgctatctctcctgtgtctgaaaatcactctagtctgtaagcacctccagatcccaggaatgaatccttaaaggcaggttatgcttcaataaagttactgtggggtcagtctgagccaagagtgttctgtgattatttttgctgattgttcagaacctgatctctgcctgtttacctgcagcccttctactgagttcagtgtctgtcttcttcctggggccaccattattggagcggaaccatatgcttctgccctggagactgcagcattatatcaggatgccaagagctaaggaagagctcatgtccccaggtgtcttacagccatttccttttatccctattgaatgttatggcacacttccatgttcacaaatttaaatattcctgctggcctattatttgcagaaaattaaacgtaactgctgattgggaagtatataaataaatataaataaatagaaatctatctatttgttgaaattttctcaaaaacaaagctcacatagaggaaggagactagtggctttatttagaaatggtgattttggatgaaatgattgatttttttgtttacagtacactatcaggttatgtaacatggtgacataattttgtttacgttaaaaatagcaaaataagatggtgtaaaatgtgcattcccctgactt

SEQ ID NO: 34032 - DNA, 1056 bp, Homo sapiens
ctctcagagacttttcttgttctttcagactaggtttggtgcccctgttttatgcttctgtaataccttatctcctacagagggtgttactgtatttctggttctatgaccatcactagctttagattgtaagctctgtaaggaaaaagattatctagttcatgccaaagccccagtaactagcatggggtccagcatatagtagtcagtgaccccccaaatatctgttggatgaataaaggaataaataaatttagaggagaaagacataggtgagaggaacaaaaggatctcaaggagggagaagaagtacttcttgctgatgctgatggtgtaactactaagaactgggagaaataaataaaaaaggcctcttgcctggcccatgatcctcactttagcttccaaggaggtggaactactaaatagagtccttccaggtcttctatggaaaagaagaagtatagactaacactaggacagacacttggcaattcagggagggcactggaggagagcagtccccaggcccagaagtagatctgaccccaactctgtgtacattccaacaaataccaggggctttaaaaaaaaaaaagagacagggtctcactatgttgctcaggctggtcttgaattcctgggcttaagtggtcttcctgctttgccctccccaaagcactgggattacaggcatgagccactgtgcctggttgaccagtggctttttcattgtgaattttgggaagctggattttctctttgttatctttatattccatatcttttccccactgataacaaaagtataaaaaagagagaaaaaagaattcttagggaatgtcaaaaaagtcatgtgtttgtttgtaagacaggcaggcattctgtgtttacattctcagtgagtcaagaagggagactaccatggtcagaacaatgacttttggcaacaaaaggacacaaaggatttattgaggaagagaggcaggaggaaaaggaaagtggacagaagctgctctgggattgtgattctatagatctggcaggcattccttt

SEQ ID NO: 34033 - DNA, 1050 bp, Homo sapiens
ttatgtaacccataaacatatacacttattatgtacccacacaaattaaaaattaaaaaaattttgaaaagcaactaaaaaaaaattgctgttgccatagaaagttttttattatacactgtcttcattctaaaaacctaaggccatgccctgtacagggtttggattcttgtctaaagcagaattattaatttagaagccataaattaaatttccaaacattcaaacaggcttctttctccccagggtagatttttaactctctatgtcaggatctattggcagttttttgttccaactcaggtgtcaagggtcatgtggagaccatcatgatatggcctaatctataatttaagtatcatgtacatttcagtttaatattttaaaatgaaagtaataataatgtgcattttagaatttttactgcttgaattggtgtctcaagtttatttcaaggtgaccaatgaacaatgattttggatctcattaaattcttaaattttctggctgtatagctctttgtatatttctgtatgactacatatcactcttttatagtatattcatataagattttctgcacttttttgtaccatccagaagagccatattgtaggtagaggttattatatactttatgaattgcagaagtaaacagttttgaataattcaatacactaagaatatatggttccacatggacctcctagaacatttttgacaccaataattacatcacaggagtgattaatacttacgcagatatggctggctaggtctttcagtatactgaatgtttactgtatgtgagaatgatcccttgcaccttttcaagcacagctgtctagtaaacatttattgactatttgtccaataggctatgtagctctgatatttgataataggattaatattttgccttttctgtctacattactgtactaatttgattattttccctgggcctatcatgatgacaaggaattatgtctgttgaccttaaaatgaccttgaggaaatgaggtgctaatatcaatttaggtgacagat

SEQ ID NO: 34034 - DNA, 1088 bp, Homo sapiens
aaaatccaggcccatcactgttgggtataaggagtgagagagaggggttactatttattccactcagtgtgtaatctattaagccctctgagccaatcaaaatcatgtgggcattgaagttcaaaaccacaacatagatgcattcatttatagtgacattgttgcttaggcaacaagaaatctgaatctcctattaaactagccaacagcaagaatttaaaatattttattttatatatctggtattttgaatcaattaatagagttttttttctgagaatgactaatagatacttagttttcatacaaagtttaggtgacataagagttacggctgatagctgccataacatagaagcataaaatttcatggtttagcacaaaacatgcttaaattttgttcacataaaatctagtggaatcgttgtggggtgagggggtgaggatcttgtatctctgatttgcgattgttcggggactcaagtttataaagatgtgtttacacggtcatcttgatagagactgcttctaaccattggcttctgaggtctcgttagcagttgacatccagctggtccactgaggaactgagaatgtgcaggatggtgcaggagattgtcacaggccaggcctgaaagtggcgtgcatctcttttgcttacattctgtaacctgttgtatggtcaaagcacatgcagaaggggtaggaaaatgaagtcttccatggagtagtcattttccaaaaacaacgcttctctgtgaaaaagcagcatgaatttttggtggtcagctagcttcctctgctgtgggaagagagtgactatgattgctgtattcaagcaccaactgaaaatcgtcagtgtaatggtattgaaaataaggctatttttaaaaatggaaacgaaacgcgattaaatccataattgaatacatttaggactttgctttagaactagaggagatgttatagcatcaagtagagtcccatttagatgattaaggagatattttggatttctgaaattaaaaatagtttttcctgtttttccctctggaaagtaaaaaatagtttttcccaagggtaaaagg

SEQ ID NO: 34035 - DNA, 1050 bp, Homo sapiens
ccatgttcttaaatacaaattttgatacttatctgaaggggatatttgattatggattcaaaacaatacatccagcactaagaggaccagaaggaatttatgtgatggaaaagagggtgcagcacgtgtgtgtgtgtgtgtgtgtgcatgcatgtgtgtgcgcgtgtgtgtataaacattgaagctgcagtgtattacagttatcttcttgttagcagcttttaaaagatgtaattgacatagatatttagtgtacatatttagtgtggggtacaatttgataaattctgacttatgtataaaccataaagccatcactgcaatcaagataaaaaacacatttagttactaaacatatttagttattggaatgtcagaaccagatttcatcaccagtaaaaattttactttatgttgcatttcaaaaattaagttagatttgtgtatattcatttgtgtttagtcacaaagcattgtttttgtaactaattaatggtttttgtcttgttttttaaaaaatttagggtgtggctggaatgcatgctgtagcatgactggcctccagtggtgtctttgaagaatagcatcactgggaaagtcaaagcaacaggtgaaatttaaaagataagagcaatttgcacatcagctaagatgctgtggcacagtctaattggcaggggctggtgaaatagaacattagatcttcaaaaatggaaggtgagaactaccctcttccaatgttgggattcctcagtggcaagaagtgctctgatgctgagtgatgcttgactgcagttattactcaggaatttttcacagaggaaacatcaaggtttatattgattttctttttctagaagagacttttttaggctgcatttttttctactgtgttgatgcttcagaatatatctttattatttaccttttttccttttgtgcctttttcttcttacagcttttaatttggttatatactccaagaactctaaaactgtacctatatgagtaaaaattgttacacataaaatgcgtttttgatttggagtc

SEQ ID NO: 34036 - DNA, 1034 bp, Homo sapiens
gatcagttaataaaaaagatggttaaagtggagaaaaaactgatatatgcgtagtttaaacattttatttcaacttgaaacacgtaagttggacattcgtttaccaatgatctgatgtccagtcaagaccttttatttaagtatattttatttaagaagtttccagaatttggggtttagctttgtgtttttaaaaataaacaatacctatttgtaggcattgtctcactggtttgttatctgttaaaggcagtcagtaattaaagacacttgcaaaacaatctgattgtagaacttctaaatattttcgaagcttcctccccaatctttttgatttgtttcagacatacccataattcaatagcaatattgtagaaattcctttttattaagttcttacaaagcatgcatcgtaattttcataaagcaataatttttggaactcatttttattagataatctaagatttatttaaattatgtaattgcaatagcaactacaataggatcaaaaggtttgggataaacatacttgactcttgctgagcatataactttactagtgggagaagaatgtacacatattatagaatggctagtaagctacaagcttttaatgtatggtgggcatcagtcagcatttatagagaaaatggaaacattttcttaagtaaagtttcgctgagagagcttctactctgtttttcaagaaattaggggagagagagaatttactccttgtctgtgaagacatgggatttaagctatgtgtatcacaggacttgaaacagaaaaaaaaactctacagatgtttttattttacaaagttagttgggttaaatattgcccaaagtttctacctgaaccatcaagtttggttttcataaaaagcttttaatttgtgagaaaaatgttatttgaattctttcaattacatcttatcagattttggtgatgcttttgaattctcaaatgtttcaagttgcaattctctgttaagatttattacatcattatcaaaactttgtattaag

SEQ ID NO: 34037 - DNA, 1065 bp, Homo sapiens
tagctgggatgaaaaatatatatcaccaagttacacaaaaatatttctaacctttcaaggaacagacaaacaaaatagcagggggagtctctgaagaattatgatgtgatttacactacagcaaggtccctaataataagattacaggaagaaggacagaagagctagagttatcaagtgctgaaaccatctatactactagcacctccaatgatcaaaatagcatcaaggccgatttctaagtcttggatgtcatcaacaggaatctcttgttagagtagaagagaggtgaggtaggttctggcccaaagtatcatatgactggctagtttggagttagtttattaaactgcaatggaagtagctctaaaatttcctgaaagttgtcttttttttttttttttttttttttctcactgcaaccacagagagaacccaaggacaaaattcaaagtaaaatgaaaaaggagggctactgaggtattactcacaacaaatacgaaaagttggggagtgcatagagatctctgaatgcctcttgtgctctgctgaacaatgaggccaaggatctggaagacatctttataccataggaaaattgatccccccttatcttagtatggaataataataaactgaactatgttctccttgttccagagcaaggacaaaaaaactaccttctaccttatcagagatgtttttttaacacttgatctccaggtcagctaaaatcaaatgttattaaaatagaaaaggcatatttcagtaaaattgacattttaaaatgtcagtggttaatgaaagccatagtctcttttattgataattctttttttaggaagaatttaggacaaaattaaactgtcatgacatacttcttggtctactaaatattatatgacctttgtatttagtaaaacttgacaaaatcagattagaactttgccatgtagtttaagttatcaaaatatgaagtcagatcaattttatgaccatagaaacttaaaaattggaaattctaattttagacattagaagtggcatgactaaagttttatggtg

SEQ ID NO: 34038 - DNA, 1037 bp, Homo sapiens
tttatagtgacactgatggatatcctgaaatatccatgatgtgatcaacagtcttactcttacctcatgaaccatcttgtggttcatggctactgatgcttttgtggccattggcatttttgttcttttcattcctcctcatgttcagatggccaccaacagatttggtgcctggaccaaaatcaaacatctgaaaatataattatacaagaactgacagaatagtaatgtgaccaaaacaaaatcatttttaatggtaattggataaatgactgcagattgctattctcggagattcattaaagcatttctgtgagtacatcagtaataatatgcatttgtctctttttatttaaatgttgtgtttgggcctgcgtatagtgctgaatgaatatttgtgagaagaatgaaataaatgtttgcataaaccactcatattttaagtatgtgaaggaagttttttttattgctcatttagtcagtaatcaattatgagtgcctgctatataggggcactatcaggagtactagggacaaacagacaaataaaatacagtgtctgttcataaaaagacaattaaaatacagggtaacaatcatcctgatggctctgtgtccacagcaggctcctaatcttgttggccaggcagggcttccaagaggagtcttgcagatgctgagagggagggaggtgatccaggggaatagttattaataaaagtccagaggaaatttcaagggagagaatgcaaagatgagattatgaaaactggaatacgctaggaatggtggttcgcacctgtaatcccagcacttgggaggaatgcttgagtccaggagtttgagaccatcctgggcaacatggcgaaaccctgtctctaccaaaaatacaaaaattagccaggtgtggtggtgcatgcttgtaatcccagctacttgggaggctgaggtggtagaatcgcttgagccgggggaggtggaggttgcaatgagcgccactgcactccagcttgggtggcagagccagaccctgtctc

SEQ ID NO: 34039 - DNA, 1035 bp, Homo sapiens
gtgtgttgccggggcggggggtgagggggagcggtgggggagtgggagggggtgcttatattctagaattatggatttattctaaaataaatatttttatgtattgaactgaataactagctgagctagaagaggtgaatatattattaaaatgtaaatctgtgacatgacccaggtattgctttgtttcaacaatcactgctgcacctgtggttgataacacattagcatggctttccccaaacaaccccaattagcctatgtgtagttggagaagatagaaaaaatattctgatgcctaaaatatgcatagatatggaagaatacaaatacatacaatttaatgtacattaaatacaaatacaaccaagttatgattagttggattttgcatctgttttattttattgtagcttacaaattaaaaatgctttccaaattcaatgtaaaatactaaataataatgaaccacagaagcttcttcatatcttaaagcaaatttattgaaaattgtggatttctactcgttaagtttgccactccattaattgaatgtttaataaatattacagtttaccaagatagtaattattatacttttcaataaaattacactttcataccacctattatgtgtccataaagcagttgtaccgtagtaaaataaaaaatataaactaagaccataacaaaacccctagtacatcccctagatgaacagcaagtaaaactttacacttctatggctatgttattatacatttattaactgaatagcagaaccattgacttcatgaaaaattggcaactgtattggaaaatatttaaacttgtttttaatgtcttaaatcagagtgaacaatttctgatccaagggcttaaattattccagacctttgtcatgctggttatattattttagtgagaataattctttagttattattattttagagggaatattcttttagagcgaataacttctctggtgttggaatagtccatctttatttcatttaagtagattatacgaca

SEQ ID NO: 34040 - DNA, 1864 bp, Homo sapiens
aggcttaccctcatgttaaagcattattcagatctagaatgtttgagattctggatgttttcattggtttatataattgaacaaatttgtattggtataaattattttaataaatttatatgtgtaaattcacatactgtatcttctcaacaaatacagattctcccaagagaaggcacttttgtttatatgacatatcacattgccctcactgattcctttttttaagtgattttactttattctcccactttcttcttcagaactactccatttatttaaatggcctcttactttgctctcctgatacaaactagtaagaattaaaaattaattcatccatatggctcagttgttaaaaaaaaaagaaaaaaaaatgttaccatgttgctatgatgccatggattttcctgaaggatttctaggtgttttgagtgtttcagaagttttaaatacagactcaagtttgcttttgatttaaagataatcattaaataatcttcatctaggtataaactaatctctaaagaagtgctctgtggaagggactcttacctgaagtctttttatcagtacattttagaagagtttactgagttttcttccttaaccttaatgggtgtaagcccccacaacctaagcctcaatataccaccttcagcagcttatgcatggactcatagggaaataagtacacttcgccacagtaatgttttacatatctgttctaaattcccgccatcctcctgcccatacgtttcagcaaggccgcctctcccagccgttttactccacctttgctttgcatggaaataacttggcttacataaactgtgtgtgtgtcccgtgtgactgtctctgacttgggttgccatgcatcacattttaactttggactcacttataagtttaatcacaattgttgtttctgttgtttttctttcctttcctttatttccctccttggtctgtccattctgtgtctaaacaaggaggttgctccaaggaaaggaccatgcctcgtagcaccagactgtttgtttcattgttaggtgtgaatttcccttagatgaaatgccggtttgcagctgattcagatgtattttatatagtctttgtatattggtagaactaaacatactgaatttcagacttttatatgattaaaaatgtatatacatcattagatgttattctgagcttgctactactggctttctcctagaggaaatcaactttctgcaatttctaatgctttttttcttattttttcctcatggttggttttcttttttttttcaacattgatctgtaacatctgaacaatcttgagatacctctgtgtaatttcactgcgttctttgttttgatatgtagtgtttttttgtgtgtgtatgtgcgtcttgttttagctttgttgtatgtgtggatgtgctacaagtgagaaaaattaagcaagttatttcctgctcatttttccttttcagttgttttttttttcgttagccttgctttgctcttgtaccctgaggccttgtggatctaccattcccagcccattttgttgcccctcccaccaccaccaccacaggaaaagacgctgtgtcgtttcagtcctgattacatttgccaatatcttttttgatttccattttactttcaatgtttttcattcacatcaaagatgatgagacagaatctacagaaacatctgtcctgaaaagtcacctggttaatgaagttcctgtcctagcaagtccggacttgctctctgaagtttctgagatgaaacaagatttgatcaaaatgaccgccatcttgaccacagatgtgtctgataaggcaggttctattaaagtgaagg

SEQ ID NO: 34041 - DNA, 1050 bp, Homo sapiens
tagttcagaagaaagctataagcatgaaggcctagcagagacccctgagacgagcccagaaagcctttctttctcaccaaagaaaagtgaggagcaaactggggaaacaaaggaaagcaccaagacagaaaccaccacagaaattcgttcagaaaaagagcatcccacgaccaaagacattactggtggctctgaagagcgaggtgccacagtcactgaggactcagagacctctactgagagttttcagaaagaggccactctaggctctcccaaagacacaagccctaaaagacaagatgattgcacaggcagctgtagtgtagcattagctaaagagacacctacaggactgactgaggaggcagcctgtgatgaaggtcaacgtacctttggtagttcagcccacaagacacaaactgatagtgaggttcaagaatccacagccacctcagacgagacaaaggccttgccgctgcctgaggcttctgtaaagacagatacaggaactgaatcaaaacctcagggagtcattagaagtccccaagggttagaacttgcactccctagccgagatagcgaagtcctcagcgctgtggctgatgactcattagcagtgagccacaaagactctctggaagccagccctgtgctagaagataactcttcacacaaaacccctgattctctggagccaagtcctctgaaagaatccccttgccgtgactctctggaaagcagccctgttgaaccaaagatgaaggctggaatttttccaagtcactttcctcttcctgcagctgttgccaaaacagaactcttgacggaagtggcctctgtgcggtcccggctactccgagaccctgatggcagtgctgaggatgacagtcttgagcagacatcgctcatggagagctcagggaagagccccctttctcctgacacccccagctctgaagaagtcagctatgaggttacacccaaaaccacagatgtaagtacaccaaaaccagctgtgattcatgaatgtgcagaggaggatgattcaga

SEQ ID NO: 34042 - DNA, 1068 bp, Homo sapiens
ttttccacactcaccaggtctgtttattcagataggggtgatgattctcccgattcttccccagaagaacagaaatcagtaatcgagattcctactgcacccatggagaatgtgccttttactgaaagcaaatccaaaattcctgtaaggactatgcccacttccaccccagcacctccatctgcagagtatgagagttcagtttctgaagattttctatccagtgtagatgaggaaaataaggcggatgaagcaaaaccaaagtccaaactccctgtcaaagtacccctccaaagagttgaacagcagctctcagatctagacacctctgtccagaagacagtggctcctcagggacaggacatggcaagcatcgcaccagataatagaagcaaatctgaatctgatgctagttctttggattcaaagaccaaatgcccagtaaaaacccgaagttacactgagacagaaacagagagcagagagagggccgaggaacttgagttagaatcagaagaaggggccacaagaccaaagatacttacatcccgattgccagttaagagcagaagcactacatcttcctgcagggggggcacgagccccacaaaagaaagtaaggagcatttctttgacctttacagaaattccatagaattctttgaggagattagtgatgaggcttccaaattagtggataggctgacacagtcagagagggagcaggaaatagtttcagacgatgaaagtagtagtgccctggaagtatcagtaattgaaaatctgccacctgttgagaccgagcactcagttcctgaggacatctttgacacaaggcccatttgggatgagtctattgagactctgattgaacgcatccctgatgaaaatggccatgaccatgctgaaggtatttgccagccaccgggattccctgtgctacgcatgtcataaaattgatatagtttttttgtatgtttgttttatttgatgatttgtgtctcattttctttaagctttctgtagtggctaatgtgtttgtgtaagccctttgtgttttgtgctttc

SEQ ID NO: 34043 - DNA, 1045 bp, Homo sapiens
cctgcctcagcctcccaggtagctgggactacagactagtgctaccatacccagctaatttttcgtatttttagtagagatggagtttcaccgtgttagccaggatggtctcgatctcctgaccttgtgatctgcccgtctcggcctcccaaagtgctgggattacaggtgtgagccaccgcgcctggccaaatagatcctttaaatattaaatgtgaatgaaataatgacatctaattggaaagtgattttaatttttattaattttattagcagataatccaccaaagaatagtacatgtttacttagggaatctaatagttattaaaaataaatgtttcaagtgatactttttagatgatttcccattggctgaaatggcctacgctgccaggcagttgctctctgccacttttcaacttctacagccttgaactcttatagcacctaatagcactttaactactgtttgctgttgttgtactgtttttgttgttgtttgtttgttttacatggctctcttaactagaatgtgagtacctcaaaaggttgatactctataacctgagtgcctgaaaaatggttggtactcaataaaactttaatatttaatgaactgtatcaaatagaaatagttgccaaaaataggtgattcagttagtgcaacaatgttaatattataactatcatctgtttgttctaaatttgtgtctgtatactgtcctagccattaagcaacccaaaaatccatgctaagttgttgagttttttttttaatttttattttttgagatggagtctcactctgtcacccaggctgaagtgcagtggcatgatcttggctcactgtagcctctgcctcttgggttcaagcaattctcctgcctcaccctcccaagtagctgggattagaggtgtatgtcaccacgcctagttaatttttatattttcagtagagacagggtttcgatatgttggccaggatggtctcaaactcctgacctcaagtgattcagccaccttggcttctcaaagtgctgggat

SEQ ID NO: 34044 - DNA, 1050 bp, Homo sapiens
aagttttgtaggtctgttgtggcccatttatactcaggcctgactggtatttttacatatctcttactgcagaagattttctagcttccattccaagctcactgaggatttctcacagactttcctaatatggtggggatcttagtagagaatatttatccttgtaaaagaaaatgcccagcccttcatacctatatcgttggcttattctattacttattggaaaatatttattgagtacctgtcaactgcaagagactccattagatgctggagatacaaaataaaatgccgtaaaccttaaagccctcaaagatctttcaggcaatctataagttttctagctcactgtgattccaatgtcctttccatttgtgaaagaacacccaaatggaaataaagaatagcagtctctgactctcttccacactcattatcagactccattcactcagtcattcatcaattctctcagcaaatatatattcagtatcaggacctattccagtcagatactcgaagaacctgccactacaagcctcatcttctaggtgttctgatgtccctggttctcttgtttaacataagaacattcacattctcattaaacctaggtgtagttgaagccaagagttggaatgggattatgtatccagaaagtggtgccatgaaaggtagccttactggcctttagttaatttgtaatgaagaatctgtgttttgtaatctttcccattactttgctttgccttttcttcttttattgtctcttgacttttccataacaactgagcatggtgccttttggaaaccatctttgagatgacctaaggaggttggttggtactagaatgagcacaggttttaacacaaggcaaacctgtgttgtaatcctgggtttactattactagttttaagtcattgggaaaatgatttaatttctcagaacttcaacttatccatgaaatgtaaaacaataaacaaaataaattgtgttaagtacttggcacacagtaaacctacttctccttagttgcctagtgttgtct

SEQ ID NO: 34045 - DNA, 1043 bp, Homo sapiens
tcaggaatggtttcatttttcttaataatgtgtgtgtgtgtatgtgtgtgtgtgtgtgtgtgtgtttgtgtgtgtgtgtgtgtgtcctaattaagagaatttttactggctgcttgttacatttgttgagggtacaacacactcaagaataaagtaaaaggatagtcaggatccagatgtttcttttctagcatttaatgtgtgtgaactcagaacactaccatgaaagaacacttccccccaaaactggatgcagaggaagaaaaaaaaaaaagaaatggcacagttttttgtatttttttttttagttattttttgttgttgttgtttgtattgtttttcttttctgatagagtatggccacttctgggggaaaaacatgtaattaagtaaatgtatacattggttttcacgttttacttttgttttcccactaccaataattttcctctggaagaattttatagttttttctatttcattttaatgagtaacaatatgttaaatgcataattaagacaaagcaatgaaattctgactttattcaaagtactgaagattattgcttctagggcatttttaaacagcaccattgtattgttgaatgtttatgtaactgatggcttttctataatgtaatttttgaatgttcaggtgttacatttccaaagtttaacttttaaaaaaccatcttctgatcccttttattgtctgggccatacaatctatattacataggtgccaacatttaattcttttaaatggaacatttgcagttttccatattggtacctgctttttctggagaggtttgagatcttgttaacaaatcagactttacactatatacagatgtgacagataaattgaaccacttgtttgtgaaaatgagttcctgtcatcttcctcattcactcagccctcaccccagcagccttttccggtcattgtagctgacatggagcagtgacagtattcatttgagaacagggatgcaagtcacagacatcataaaatcagggtctccctgctgaagcattcac

SEQ ID NO: 34046 - DNA, 1053 bp, Homo sapiens
acatctattttgaagtcttactatgtgtaaataaaccttaaaattcattttattcactattcagtcagttcagtagagattattatattttcaaattaaccattatccaattaattttgaatgataaacagcacagttggaatactgttctttttcatttacttcattaaagattcattttaggtaatcagagaattttgtatcagctgttttttaccttaaaggtttgtttctgacactttaataaattgttctgtagtctgtgctggaaggtaactgaattttttttgctcaacagccctctctttgacacatgttcatttattactatttcttccatcagctgactcacttgaggctaattctgatgaagtgctttcaaacaaggaccactattggtttacattaacgaggaagtggtggaacggcagcttcagaacaggagaaattagaaaaagaaaaatgatgaaccttgggatcaatttttctatgagtcataacataattaactataaaatacgaagctgaaaagtattattctcagtagactgatattttgcctcatttaggaattctatattaaaaaaacaagggagaaagattgaaaagaaagatagacttagtcatatttagaaagaaaaattgtgcagaaaagcttgagttaggaagaaacagatttaatcatatatctggagttggatgataaaagtcccttctagttttatgtttgcactctaatttttctatcatgttatcttctctagcggcatttttttttgttatgaaaggagatattcgggggagattattccatagataagcattctctagtaacatactgttcactaagaatgtaatcttcaaacttccatgctgtaaacataaagttttggttaacccattctgtctctctagttcagttaatttcgcaggcctaccaccaactcaaaatatataaaatattttacttctcaaatttccctatatttattgaagaacgataaaaccatgaaccatcttttttacctctctggttttaggtctttcagtttt

SEQ ID NO: 34047 - DNA, 1098 bp, Homo sapiens
ggcggggctaggcggggcggggagtgaaacagcataggctccgcccctcgcggcgcttcccccggaatagcgtcatcagttctataagagagcgtgtgccgaaggcctcggcctttcacattcgggaagcgtcgggattaggtgaaagtacgtagttgtctttcgtaagttaaaatgataattgggccgaaacttactgccttacctaaaaggcagcgcagtcaggatattggtaggtcgggggcggctttggaaacccttaagtttacaagcatgcgcggacttgagtgctcattaggtcgccgggcgtccacgtgcagccctggaccctgaaccccggcgtgcgtgggccgtgggccctcggggaaaggttccgtgcactcggggactccggtgaagcctgttcagccgtctgtgtcatgtggccatcttgagtctactctgtcgctcttgtgccctagcaccccgagaaccgtcagtttgagccagatggtgagtaataacctgtagcagtttggttgctggttaattctggattgtgaatctccatgtatctttgggacctgtcagccgtggcagtctcccttcctagccatggaagagcatatccttgtttattggcaaagctgtcaccatttaattggtatcagattctgacttgcacaagtaacattcactgttaaaaacctagagggtgccgggttattgggcaaaatttctaaaccgttgttcaatgtttctaggaagctgagctgaacacattacgatggatgatggaaacataaggtacatttcttttttgatatttctgagttaatctgaaacgccttagcggcaggacgttggaaagctaaagttggcccgttttgctggcttttgtagtttgagttaacaaccaactgaattagctgataagatctcaaaacagtgaggtaagtacacagctcggagttttataatgctttttttctcttgcagactatcaagaaatccaagtggtaatgggcgaagtttattcagcatccggcaatggacttatcgtagttggggaaacgggtgttccgaataatatcctggaagttatcaggacacctattt

SEQ ID NO: 34048 - DNA, 1056 bp, Homo sapiens
ttaaaccatacaaaaatttaaggcagttatacaaggtggaaaattatgtatttatttacacaaatatgcacagaacacttgtatctttcaaaagtcacacttaagacatagtaaaagcatgttgtatgaaccatgtattcttaaggattgagcaaactgcaggctgcttgctgccttttaggtttgctagtccctgatctacttgaaacagatgttgcttgccccaacactagtttaattataagggcagcctgtgagaaagtttcaatagacatttttctcacctatattgcacgtttttctgaagcccttgtgcaagtgtgtgtgccatgtgtagttctatttacatataaacgctactttaaaagtttatcaaaatcatgagtttttacaaaagtttttaatgctcttctgcattatatgcagcattgcaaatctgcaaagtagtaaaactataaagcacctttaggtttgcaccagttattacagaaatggggatttgtgaaaaggatgtaatttgatgtagaagggcaaagtcctttaatgactggcattcaagaggattacttaaaacaatttgtaagttcatgctaacctcttccctatatttatactactgggacctggggaaggatccatgacatggaagtatcttgagtgtgccttttaaatttgagcattactgctaagaatgttctgtaaaggtgcatagttaagcagctatcccttaactcttggagaaatagccatagggaaaccaatcatttaggtaggagaaccatggggaaaaaaatcagcattttttctggagtttggaatcagtttcaccaactggtctcactttgaggcaagcctgttttcccccatttgaaaacaagggctactaccataagatttactggccttttgcaaattgtcagtgatgtgcaaagctgcctaatgcagtgcctggcatatgttataactgctgtatgtattagaacttttcaatgtgtaggccaggaaagcattttgactagtatattttaagattggattgtatcaggttgggcttgg

SEQ ID NO: 34049 - DNA, 1049 bp, Homo sapiens
ctaatcagtgttttaaaacatatattaatcggggtgggcgcggtggctcacacctgtaatcccagcacttagggagacccaggcgggtggatcacctgaggtcaagagttcaagaccagccttgccaacatggcgaaactccttctctactaagaaaatacaataattagctggacgtggtagtgggcgcctgtaatcccagctacttgggaggcggaggtaggagaatcgcttgaacctgcggggcggaggttgcaatgagctgagattgcgccacttcactcccacctgggcgaaagaacaagactttgtctcaaagaaaaaaaaaagtattatatcaacatgtcatggttttattattaatatgtaatgaatattaaatatttttaaaatcttgtattatatcaacatgtaatggctttaatatgtgatgaataatatttaaaaaattgtttcttattttctagttttaatataattatctacagaaagaaatagtcttagagatcttcaataaagttaaaaaatgtcaagggatgttagaccccaaaagattgagaatttctagtttagaaatattcagagtaagccacatacaacttgctacttgaactattttttttctttgttttttattttaggagatggggtctcaccctgtcacccaggcttgagtacagtagtgctatcacagctcactgcagccttgaactcctgggctaaggatcctcctacctgagcctcctgagtagctagaactgtaggtacacatgacgatacttggctaatttttaaattgttttgtagacatggggtctcactttgttggccaggctggtgtcaaactaatggcctcaagtgacccttccacccctgcctcccatcctagaggtatgtgccaccacaaggagcacttgttcaattttctaaagaaaaaatttctaaagtaaggctgtgggatgatggcaggaagataaaagaaaaacagaagaataagttacaatgacttattcacacatattcttttgacagcaagaagaacttttagt

SEQ ID NO: 34050 - DNA, 1051 bp, Homo sapiens
agctgggcatggtggcacacgcctgtaatcccagctacttaggtggctgaggcaggagaatcgcttgaacctgggaggcagaggttgcagtgagctgagaccatgccactgcactccagcctgggcaacagagtgactctgtctcaaaaaaaaaaaaaaaaaacacaaaactttgggtaattgattggatcagattttgagaagctgcagtagctttggatcagattttgagaagcttttttgaggagttgttattccatgttaacaatattggatagtataatcaagatatttttaggatttatggcctggactacattgtagaaatatttctgaaagaggctcaagaaaaacccaacttctaacttgtaattgcaatatttagttgaaatagttgaaagtattatggtccaaaaaacttacttttgttttttcaagttaattgtatataatagagataagaatgtatagtttcaataaaatctctagaaagttcagtgaaataatacctaatctcgtgaatattgtcttatatgttgcagttctgataatatgtaacttaaatgtttgtgacttttttttttattaattaaaatgttagtgattattttaggtggaactatatgcagttgctgatattctaacctttttgacctttaagcatagcagtttcatattgcaacattggtggtcgtatctttcatgactcaaactagactctaacacttatagtattgtatatgagataaatagttttagacaaatcaatcagcaaaatagtagttacagtaattatttatgataggaaatttttttatgaaaataatcagctagctagatctaataatgggaaagcaaagacttcaatgtttgattttaatgctaatttaaaacatttattaaatcttaaggaaataaaatatgttgagttttaatcaggatgtgatagagaaataacccctatttgtaaaatatttacttaatcttatgtttttcaaggatgaactagaaatgcaacaggatgaagaaaatttgccatatgaagaagaga

SEQ ID NO: 34051 - DNA, 1029 bp, Homo sapiens
agtaattctgtgagtttggacaaatgtataatgacatctatccaccattataggatcatactcaatagtttcacggccctaaaaatcctctgtgctccacttattcatccctacccacaactcttgacaaccacttatctttttactgtctccgtaatttgcctttgtcagaatgttacatagttggaatcgtatagtatgtagcctttttagattggcttctttcatttggtaattggcatttaagatttctccattccttttcatggtttgataggtcatttctttttagtgccgaataatattccattggatgtaccgcagtttttatatccatttacctactgaaggacatcttccaagttttggcaattatgaataagctacaatggaaatctgtgtacaggtttttgtgtggtcgtaagttttcagctcctttgggtaaataccaaggagcacaaatgctggattgtatggtaagaatgtttaattttgtaggaaactgccaagactgtcttctgaagtgcctgtaccattttacatttccaccggcagtgagagttcctgttgctctgcatcctcaccagcatttggtgttgtcagtgttcaggattttggcaattttagtgtgtgtgtagtggtatcataatgttgttttaatttgcatttttctgatgacatatgatgtagaacctcttttcatatgcttatttactatctgtatgccttttttggtgagatgtcttttaaggtctttggcccattttttatttggctgtttgttttcttattgttgaggtttaagagttacttgtatattttggagaatagtactttatcagatttgttttttgcaaatattttctcttattcggtgactgtcttctcactgccttgttgcatgtttatttttatttaattactttctgcttttttattttctttctagtttctttggatttacttgctgtctttctatctgaagtatttttagattgatattcaggttaggggtacaggtttaatttt

SEQ ID NO: 34052 - DNA, 1035 bp, Homo sapiens
ctagtgttgagaagttaccaaaaccttaatcaaatcaagaaattatttaagcagttaatataatctgttcacgaggtcattaacactgtaggatttctagattggtcatagctgctttttgctgttgttgttgtttttttttttttttttggacagtaaccttgcaaggagaaaaaaaggattgagtttatacatgtaggatgaaaagtttctataaaactgctttagatctttaaattcttattaatttttcagttgcaatgctagttaacatggtttattctgaaagagatactgatggttatagagaccagttttttggataaactaggatttacgtgattcagagatcagttttagcgagatctcttgattgctgtgtagacccttgtatgcagactgcagttggtctcttttcactttctgagaatgggatactactttacacataattggataagaatcaggaataatttatttgcatgtgtgaaaaatacacttaaacagcttaaatcaaaaggagactccactgacccgtgtaatcgaaaagtccattgggacacctggcttcgaaaaggctggatctactagtctcgtgatgtgatcaggtccaggtctttctctcttcaattctttgcttggtttccttgttgctgacttcattctaggcaagatctctcctgtggttctaagatgactaccagttactgtagagactacatacttctcaatgcataactcatgggaagaaagcatattagtcccagaattctcaagacatcagaactggattaaattacatgctcaccccaacccaatcactgtagccagagaaatgaaatgcaccaaatacttagcctagcttcaaaccccttcccaccactccacaatgcaatgccagtgaactacacaagtcatcaaatggaaatttatggcttttagagtggtgagaatggatactggagacataatcaactctacaatggaatcttagaaatagaatgagactttagaatcttcagccaaatgcttact

SEQ ID NO: 34053 - DNA, 1083 bp, Homo sapiens
gctctgtatggttgtcccatacacagcagagcaaaggagagagggggatgattttgaaatcaaacatggacataaactgcattgcactgaaaacttaccacaatatacaatagcaccttgtgcttctctttccttctagtgccaccctgaagaagcaaacactttcaagtctttcagctgattattctatagttttatttatatttctaaatatgaattctgtattgctatttggtgatttttcaagcttaaattaacattaattttctatgatggtggatataggtttagtttttttattttcttccttattcttgcaatagaattgtatctttttttaattttaaattttatggatatgtaatagttgcacatctttatggggtacatgtgatattgtgatataagcatacagtgtataatgatcaaatcagggttgttgggatgtccatcgccttaagcgtttgtttctttgagttagtaacattctaatactacccttgtagttattttgaaatatacaatacattactgtttagtcactgtgttgtgctactgaacaccagaacttattccttctaattgtatttttgtacattgaccaacctctctttatcccttctctccacttcctttcccagcctctagtaattgttattttactctctatatccatgagattatttatttattttttagctcccacatatgagtgagtacatgggatatttgtctttccgtgcctgtcttatatcacttaatatccttcacttccatccatgtcgttgcaactgactggatttcattcttttttatggctgaataatattccattatgtatacataccacattttctttatccattcatccattggcggacttaagacacttagggtgattccatatcttggctattgtgaataatgccacaataaacatgggagtatagacatctctttgattttctttcttttgggtatataccactagggattgctggattttgcattgctcttttttctcctggaacacatgtaatacaaaaaataataaatatattcccactatttttataattattt

SEQ ID NO: 34054 - DNA, 1021 bp, Homo sapiens
attcctatggtgatgtattttttttaagaatgaacattctgctgacatttaccatgaagactgtttacttatacatatctgcatatttgccatttctggtgctcatcacttttttgcatagatccacattccatctgatatccttttctattgcttgaaggatctttcttgtaatacaggtttattggtgatgaattctttcagcttttgtatgtctgaaaaagatctgtatttcacctttatttttgaaagatattttcactcattaaagatggtccaagttgacattttttctttcagtactttaaagattttgcttctctgttttagcttgcattattctaatgaaaaatctaatattctgatctttgtttctctgtatgtaatttgttctttttctctgggtgcttttaagattttctccttatcattggcttgaagcaatttaatgatgtttcttgatataggtttcttcatgtttcttgtgtttgggtttgttgagtgtcttgggtctgtgcgttttggatttaaatcaaatttggaaacactttgttatttcttcaaataatttttctgtctcttccctcctttggggttttccagttacatatgtagtgagttgcctgaagttttccagttgttccacagcttactgatgctctctttattttctttctcagtctttttttctctttgtgttttactttgtgtggtttctgttactccattttcaagttcattaatcttttcctttgcattgcctatctgctattaatcccatccagtgtattttttgtcttagacattgtagttttcactttgagaagttttatcttggtcttcttaaaatctctttcatgtctttacttagcatttgctagtctgttgaacatgtgaagtatagttgtaataattgtttttatgtacttgtctgctaattctgttatttgtataaatactgggtacatttcagttactttttttgttgttgttgttggatgtcagacaaggtttaccttgt

SEQ ID NO: 34055 - DNA, 1068 bp, Homo sapiens
taatttaatccttacaacagccctaagaggtaagtactacatttgtctttattttactgttgagaaaactgagtcccagaaaatattttgcctgagtcagtccaggatttggtaaatagtaaacccagaattagaaaccagacacctgccttcagatgttttttattaacctcagtggtacattgcttctaaagttgtgctgtcattaatcatcttctttcttggtaaaatggatttccgtgtattttttaaaatatgctaggatatgatactcaagaaagttattaaacatcatcaagtgctttgcaaaaacactgagttatctgtgacagaaaaatggatcctattcattatgctttaataaaaggcaacgtttaaagagaaattttgaaatgacctttagttgtggagtagttgaaaatataggaaatattaaagccagtttgtttttattaactttttgtttttatttgggagaaaggagagatcatgaatagattttcttagttacgttatctgaggacacgactaaaagagaaatttgaagatcttatttgtttgttgtaatagtagtaacagccacaaatagcagctggtactcattgcatgccagttgagtaccataccctgctctagaaacattacatattatttaatccttacaagaactctatgagacacaagtactattcttatcctcattgtctagaattcaggtttttcagaatgattttaagtattggactgatttgttttgacagttgccgtctttgggtttggtttgtctttgtctttgctttgtctttgtcttttagtagcagaagataagtggataattgcatcaagtatatacttaggtaatttattaatggctgctgcttactatgctgtacccccattaccacacaggccccctttcttgttccatgtacagtgaccacatacacctctgctcacccctttttcttgccataatgtgcagaccccaatttagtacactctggctttaaagtctaattatatttcctttcaaaatttcagtttgttccaagtattataatcacttcc

SEQ ID NO: 34056 - DNA, 1035 bp, Homo sapiens
tttgtgaacttgggcaaatttctaatttctctctgcctcagtttccttacccaaaatagagacagtaattgtacctcaaagaagtaaatgagtaagacaactggcaaatagtgaccattcagttacctttagctcttattattttaatggcagatctctttctttttttatacttgttttaggggctatacaaggagttttaaaatacaacatgcatctccagtgtcaagaaaaatcacatctagtttttaatcataaaaataccattgtatactatatatctacatatctatgctctttttaaatatatcttaacatttttatatagatcaatttttatttttattgggcaatttgaaaaatgatctgtatcatagtaagaatgatttcttttacagctaagttaagtcacattgatcaaagggaaaagataaaagacatttccagagaatgtgctctgaaagctattgaacagaaaaacttactttcttcacaaaggaaagatttagagaagggacaaagaaaagatttaggacgacatagaggtaagttaagatcttgtactattgattttaaaaggaacttctaaaaatcttattttaaaactgaattttataactttaatttctgtatatgttaaataatatatattaaaaatacataaatatataagttaaatatatatacctatatctaatatagaaatatataaattacatatatttctgtatatgtataaatatataaattatatataatttatatagtttatatatagaaattaaattatattaaagttatttttaataactttattttgaagaggtgagagttcactcttgtccagcctagagtgcagtgacacaatcatagctctctgcagtcttgaactcctgggttcaagctctcctcacgtcttagcctcctgagtagctaggactacaggcacatgccaccacacctggctaaattttaaaaagttatttgtagagatagggtcttgccatgttgctcagagtggtcttgaactgctgg

SEQ ID NO: 34057 - DNA, 1049 bp, Homo sapiens
gttggtggggagatgttttagagtactgtttgactgttaacactttcctcaagttctatatattgttacaaataaatgtaattttagtgttttgagttgaagtgagtttttaaaattatatttctaattattagaaatgggattctggtaatgatgggtgtttctggtaaacactcacatattctgacataaagagtttggatttggagagagttgaaaatgttaatggttgcaaatatctttccatttttgtggttttgttgtaaaaataatataaactgtattttgggaaaatcaaactacaaaacaaatgtttattttcccctagtttcatatatttgcatagggtgttctagctttgtttttattttcatatttcagatcacatgtacatgaagacaatggaaagttatttccttcatccagtctacaaatacccaaggaccataatgcaagagaacatatccaccagtcagatgaacagaaacttgaaaaaccgaatgaatgcaaattttctgagtggcttaatatagaaaattctgagagaacaggtttgccttttcacgttgataactctgcttctgggaagagagtgaacagtaatgaaccatcttcattatggtcttcacacctaagaactgttgggttaaagccagaaactgctcctctcatccagcaacaaaatatcatggatcaatgttactttgagaactctctatccacagaatgtataattcggtcagccagcagatctgatgggtgtcagatgccaaaacttttttgccagaatctaccaccccctttgccaccaaagaaatatgctataaccagtgtgccacagtcagagaaaagcgaatctacacctgatgtcaaacttacagaggtgtttaaagctacctctcatcttccgaagcacagtttaagtacagcttcagaaccaagtttagaagtgagtacacatatgaatgatgaaagacataaagaaacatttcaagtgagagaatgttttggcaacacaccaaactgtccatccagctcctcaactaacg

SEQ ID NO: 34058 - DNA, 1048 bp, Homo sapiens
ggatttacactagtagtgcttatgaagaccactgaacttctttcttaagatcaggcagaaggttttttcaaggtgatccagagaaggaaattcactttatgttgcatttctgtagtgttctaccaaatccaaatgcatttactctttatgatgaggtagtttgagtttttaatttatatttattgagtgcctactatggccagattttggggatatctcagaaaacaaagttccttttcctatgattgaaactaatagcaaacaaatatgtaatattgttagtagtattacagtaaacaaaaatgaagcaggataaaagggtagagaataataagaataataattcagatagggtcagggtgtctttgacgaggtgatattttagcacaatccagagggggaatagcattccagctagagagaatagtaagcacaaaggcattcttgaattcttcccctgatgagataattgctgcagtgagtgggtccgtaactttttgtgtgttacgcactgtactttcttacattttggactattggcatttgctaaaatattcctttgaccagttccattctctgattttaccttgaaaaacaagcccctgctttttatgatagctctttttcttgttttccttctctgatttttaggttgctaaatgtgatttgcatactttatcacttaatctcgcttagtcttgtcaacaaccttatagtggtaggtgtcttatttatcagatgaagaagtagagtttaagttactttctcaagcttatcaagtattagaaaaactgggattctaatctctctgttgtatcacttttttctgtcttgcatgacttctcttctatcactgtttgtgggcagtatttcctcacggaagtaggccttggccagttcttttcaatcaactgttaatctctgagctctagctccatctatatcttaagtctgggctctaggtctgtgctttggtgtggaattttgaacttctcacatctctactcttagctcatgcctctaaacccaatacatccaaaactgatgt

SEQ ID NO: 34059 - DNA, 1188 bp, Homo sapiens
aattggaatttgagttaactataattaaaaaagctttcatagcccatggtatatgaactctgaaaccccaaataccaaaatcctactatataaaaatgatccacatactaaaaaaaaaaaaaaaaaaccagacacacaaatcgagtttaatttcgtatcatgctattttcctaaaatatagtttctaaagttattgcaaattagttcctgctgcttggtaaaataccatatttaaacttaattacaactgccttcctgcaatgaagggccaactttttcaaataatgtgttacagcccagtgactctagggagtctatggtcccattgctgcaaatgagcagatcggtgaaaacaaaaacatattaagaagtccacatttctaacaaacaccttgcaaagaataaaatggtaatttaaggaatatgtccacttaatatacatttcatgtatataggacacataatacaataaataccctttttactacccccaatttaagaagtagactagtataatagaaggcatatctccttggtactcagtatttctaaaaggcagtaatggctgtctcctctaagcacctgagatgatatgcctctgtgcactctagccttagaaatatgcttatctcctgcaggcagagcatgctggaagtgccagggagttaaggttaccaggaacagccctcaactaataatgaggaaaagcttgtggataaatatccaagccccctgccttcaggtaggaacactgatattttattagattggtgcaaaaataattgcggttatatagtctcaaagaggaaacagtctccacgtgaaatcgagccccagttgtccacagtaataacccgcttattaacttagcctatatggatttactttcttctcatctgtcttctctgctttcgcagggaaataagtagttcactagtgtttcctgtgataacctcctgaataaactacttatgctcaaatccttatgttggggttttcttctggaggaattgccaaactgttgaagttccctgtgttcatccccaatctcagctctgtccgtctccccaccaagagttactgttttgattttttgtgtttcttgttcctttcctgtttgtaataattatactaatatattaaaaatattagtaactacactggtttgctataataaggtatatcttc

SEQ ID NO: 34060 - DNA, 1037 bp, Homo sapiens
aaaaatcagaatatgtagaaaagcaaaaacaactccaacaaaatcacaaaaaattttctccattcagagatagccattattagcaacttgtctatccaatcatatcctttttttaattaaaaaagttctatataataggattttgtaatctgtttttttcactaaatactgtcatctcaatagagcttatttttacatgattttgaaatatgcctgcatggtattcttctataggaatgtattgtaatttatttaattagtcctctaagggatgggcatttatatcatttgaaacttccattattataactttgtacaggttttttttaatccacatctttaattatttactgatgagaaactcttagagttgatttgttggagaaatagccatggtacagtcagctctctcacagatgagggtgagtgttcctacctctaggatgtgtcagaacaccctggctgcctacaagtgctctcctcctatttcatttcagattgtttgctctgccctggcatgcaataccctgggttaatgttgcctaggaactctgctctgtaggactggattctatcaccaaattgttttgcaaatagcttataaaaagaaagataaaattgtagttgacaaatacaaagtgaggtattctgtaatggttaaataaacccccaatggggaataatagatacatattctaggaagaaaggagtttgtttccacaagggattagtttggctcacttgaaaatgattaaacaaacttcacagaaaatcattctcctgatttagaccatcacaaatgaatgattaactggctgaactatcactgaggttatatatcaagcttgtatatatatcaactctgttatgtatcaagcttgttcagggcaaaggaaagagcacttagaggattatactgaagcaagcagattgctctctgattacctctgtaaaatcagattacctctgattatactgaagcaagcagcaagtgctctctgattacctctgtaaaagggttcaccttagtctttttt

SEQ ID NO: 34061 - DNA, 1004 bp, Homo sapiens
tgtgtcaacataggtacattaattataacaaatataccactctggtgcccagtgttaatactgggggaactgatgtgtgtagaggacaatggtatatgggaactttctgtaattttgggaactgaaaactgctcttaaaagaataaagtgtattaaaaaggatcacaccaaaaaatgaattgcaaaattcatgacctcatgtgaaagatagtgactgtggtagatagaataatggcccctaaagatgaccacatcctagtccttggaacctgtgaatctgctactttacttggtaaaaggggctctacagatatgattaagttaaggattttgagatgggaaggtcatcctggattatctgagtgggtgcagtgtaatcacaagggtcctttaaagatggaggcagactgtcagaggaattggcacaaaagcagaggtcacacacacacacggggggatagagagagagagagagagagaggaagatgttacactgctggctttaaagatggaggaagtggctattaagtcaagcaaggcatgcaacctcaaaagctccaaaaaacaaggaaatgaccttcagaaggaattcaaccttatattccttgctgacccattttagacttttgactatctgaactttaagttaataaagtgctgttgttttaagccaataaattggtggttatttgttacatcagcaataggaaactggtataatgatttttcaatgaaaatttagacaagattagaaaaaaaaaagaataaaaaggaacaaacaaagcctccgagaactatgggactgtgtaaatagaccaaacctatgactaattggagtacctgaaagagatagggagaatggatcaaagttggaaaacacactgtaggatatccttcaggagaacttccccaacctagcaagacagacaattttcaaatttgggaaatccagagaaccccaataagatactccttgaaaagatctaccccaagacacataatca

SEQ ID NO: 34062 - DNA, 1152 bp, Homo sapiens
ggttttattttgaacaaatggtttgtgaactggaaacatgtttttctgagctataatctgaatacagcttaaaactgtgaagaatattttcttcaagttttaagtatttcttctaatttaatgttatgtgccttaagaatagaaaatcataggctgacatttccatatatcaaatgtaagaatccctgtttgctaagaatgctacagaactaagagcaacaaagcaggttcaagagttgtcaaatgtgtcccttttccataggaagggtagatgtctacccaaatggaatattgagtatcagagacttcaaatgataacttttgtttgtttggagaaaatcttgaggacgtgatcactgtacaaaaggtaataagcaagtcttaaacaattttcccccctaccttttattttctctattgatttttttccatttatttttatttagccactaaaaatcttaaaaaaaaacacacagttttattagttctttatggtcaggaaggaagattacttctttaaatataactaaaactctggcactctctagtggtcagagaatctaaaatattgttctacatgagcttatactttacttcttcctttagctttatgaattagacataacctagatattctgccccacatgaagaaggcttgtctaatggcaaaataatgaaatcagaaattctgcatttactcataatttcacacctctagactagaagcactgagatacagtggtgtgggagtctgtgaaggcattttcttagctattaccagatgaactaaattaagaaatgttaactgtaaaaactcagacaaaccaaacctgctgggtgagggaattcctgtctctaatgcttccagatagcccatttggcttgtaagagtggatttgagacctttataaatttaaattcaaaaagagaactaaggaatagaccccttgctttgcaactagacagatctgggctcaaatccagctcatgccatttggccaagtattcagctccaagcctcagctcctcatggagcatcaggctggtaataatcaccctccaaagagtcattattgacttgaagtgagaaggagatggaaaacattgcccccaaattggcaacaaagagtattaataaaaggaagactatta

SEQ ID NO: 34063 - DNA, 1085 bp, Homo sapiens
tcttggctcactgcaaccccctcctcccctattcaagcaattcttctgcctcagtcttctaagtggctgggactacaagcgcgtgccaccacacccgcgcttataatagaaaataatttttctgtttttttgtagggatggggtttcaccatgttggccaggctggcctcgaactcctgagctcaagtgatcaacctgcctctgcctcccaaagtgctgggattacaggtgtaagccaccatgcccggcctctgatttttctatagtgagaacataactatttctgtaataatattaaaaatacttgtcagtatcacatagaattttcaacagcagattcaaataaaatgaatccttgtgtgtgtgtatatatatatatataaatgtagaaggataacatctataataggtgattactatgttgactgtatttacagggatggagaaaactcaaaagagccattagtatttttaatggagaaactcttaatccaatcaataaggaaagcaactgttatggaaagaatgagatgtccaagtgtttgaaacaatgctctgaacacacttcatacttctgaggaagagctttgaacaaaggagtaaacaagtagaatgctgagaaaaatagggagacgacagtggcacatgacacctagtttttttttttttttttctccatggttcttttggtatctctccttcctttccctgtcagccacagttctttatattaaattcttttgatggcgagaatcctggagtaggagtgagaactggactgtagatgcacctctcccactaaccacctgtttggggcaaatagtctgtctcgttgggagatgaactttacaagttcaattactaaatctgaaatatctggattagaatatttctaggttttttttctgctcttgacattctatgataactccatgacaaatgttctttttccaaataattaaaacttaaaacatttccgtttaaaccttcaaagacaaagacaacttcttctttctgcatttgagtcataaacatctaaactaataagttagatgttttagggagaatctatttgcctacaataa

SEQ ID NO: 34064 - DNA, 1032 bp, Homo sapiens
gctttaaagcacgacaagcacaatcctccacctcatgtttctcatgacccttcacacgtgaatattaagcatagttttcactatttcttcataagaaaaagatgaagtttctgaaagcctctgttcataaaatttataggaaaggggtttgtgaattgtaaagctccatatacaagtgttggataatacaactgatttgttatttcttcctattactatctgaacgattattttactttgcatttaatttgttgaagatagagaagctacctaagactgaagaaatgtaatgtgggggaaaaaatgggtaaagtgagagaaatctgagggaaaaagaaaatagtaaagtgaaaataaaggtaataggacagataatctcatctattcttattgtttaaagtgttgtttatatttactgttgtcctaacctttcccaaattaattcttgcccttcttgtcttctttgctccttccatatttagtgagttggactatggatcaggtactgtgctcagcatcagaaaatgggatgacaatgaacagagtaacaggactatatttctgaaaaaggatgaacttactggaaacaggattgcgtatgtatcgagactatgggagttagttaggagactactgggaaacttctagtaatctaagtcagagagagcctggattagagtggtagcagcccaaaggaagagaagcagacatctgagagctgtttaagagtagatcagataggaactggtaatgactcctgactaggagtgggatgagggagataaggggatgagggagataaagggaaaaagtatgaatgttaaactttctgccttgggatgctgacctcatttactgacacaggaaaagggagaagatgattaaagatgggggatgaagcaggggaacctgactagctgaatgttggatctgttcattttaaggtgcctgaaatatatccaaatggatataaatgtcaactcagttctgggctggagatatagatttggaatgcaccaacaatgcagatgg

SEQ ID NO: 34065 - DNA, 1052 bp, Homo sapiens
gagaagtaagcatgagcagtgaactcttctctcatatatgccactggcatacctgtagaactcctctacgagggtagtttcctaatcaaagaaggcatcaaataatcaaatgatgactcaaggggcaactttctattggagaaatatcttcttccaaggtaatttcagggtaattttctgaaaagatgttcaagaatgaatgaggaaaatctcagtttctaattttgccaccacatgaccatttttctctttttgataaattactttcatctctgtgcattgttttattttttgattttctctaaatattagtttgaatatctgatgagggctggacacagtatacctttttagaagatagtactttacatgggaatatttatggtactcatagtttcctgggtctcctggctaagaaaattctactttaagtatcactcatttaccaacaaggaaagaaaaaaaaagaaaaatccctggaaaattcttggtttcctctactgaaaccacagggatgtaggaagaaataaaaatctttgaaactgctttaactttttttttttttttaaagttgaagtctgctttgtggtgtgtgtgtgaaagcaagattctgcagtcaatgactttttcccaggatgttttctttttctttttctttcttttttttttttggagaagatgacgtttctccagatgtttttggggtaattatttttaaataaacaaaggaaaaaatagttgagtgttttttttttcactctaaagcagggcaatatagcatcttagagcaatccatacactaataatacacatactaataatattatgttcagtgtagcacatgcttattctgatcttttggttgtgctgactgtggagaggcgtactatgtggcttgactctgtactatacatcttttcatatcagtgtcccctttcataattattctgtgtctgtgtgaggctcaggattgcaatcacatgacaaagcacaggggacaaaggacatgtcacccagtcagttctccaaaacatgagatttttcaagaggaa

SEQ ID NO: 34066 - DNA, 1032 bp, Homo sapiens
tcattttgttattcctcacagagaactaggacagttttcagtgttgataatccttgtgaccttccctaccccaaaataagtttacatgatttcttacactggttgagtatccctaatctgaaatccaaaatgcttccaaatctgaagctcttggagcaccaataagtctcaaaggaaatactcattggaatattttggatcttcagattaggtatattcaaccagtaagtataatgcaaatattccaaagtctgaaaaaaatctgaagtccaaaacacttcttgtcccatttcggataagggatactcaacctacacgtgtttgctaaggtaggaaaatactactattgtatttaattgcacctcacttctttaataacaatcacttcttttagatttagccagttaaaatgtgcaccctatgaaagtagagacagagaataacattttaagaatttatttacaaaaagaaaaaggcagggaagctctgaattaaaaacagttatatgatggatgcctggaatcacttacctagaataactagtcgattcccactgaagttagaatctaaggacagagatatggataaaatttggcctggaaaggaacgaattacttgaacgttttctgcattgatcttccttttaaacagtctctggtcaatgtatatgaaaccaaaaccctttctatgaaacagtacttacaaaatttactgagtgctccagagaaaatgcgatacagacccctaacttatcaatgaagcaagttcaggaactaggtggtttttgaggaattctactatggagcaggttgaatgtgaacaagagaaatgtgatactttttcttactttttcttaataaggcagtgttttcctcagaaggaaatatttatttgcccaaagactatttacgtgcaacatgaagttattttgaaggttttctaatatgccatatatatcatatatggaagaaaattagcaacgaagtagttttgccagattagtcctctttaattaacgaaatataacttatt

SEQ ID NO: 34067 - DNA, 1029 bp, Homo sapiens
ttggttagaatttctttgggcaatagtttttttttttttttttttaaataacaaattctttctcagttactcccatgaacaattctaaaatcctcttgagttagtattggttattaccaatttttatagaaattccccatttcaccaaatgttaattcctatttgctacactgtaatatcaagtatcttttaaaatgtctttgatatctgtacttacattccctctctcattactatttgtgtttctctcttaatatcctcattatccgttggaggttcatctattattattgtgtttgcccattatctcttatttcttctcatttcataagtttattttttcaattttttcttctactttctttcttctcatgtatatacttatttggggaaggcaacagagtgagaaagagaaaggtgctgtttttctaatttctacggttgaatgcttagttaaaattttttcattatttcttaataataataaaatatttaaagctacataatttcctctgagtatagctttgaccatgtaccttcagtttttatgttatgttaatagaacaattacttttctaaaatgctgtaatttaattatgacttttgatttcttctttgtcatttaggagaatgcgtttcaggttctaagtgagttttttccttccaatttatcttttaattatatattaacagttttaatgcactgtgatctatgaaagtggccaacaattctgcttttcagaaacgactgactttatgttgcatatcaccaatatttgatttctgacatatattttagaataatttatatttttaaattctgaaacatgaaagtaaagctatatatgtcaattaaatccacttaatttttatcaattctaatgtttattttttcctataatttaacactgacaagtatatttcaggcccactgtgatgatcactttgtccatttctccgtgtattttttttttttttttttttttgagacggagtcccgctctttagcccaggccggattgcagtggc

SEQ ID NO: 34068 - DNA, 1023 bp, Homo sapiens
atttgtttctcacactaatatagagatcttgagcatcttgtcattaagtgtacatcctgctttctttttcctgagtgacatgaaaattaggttttcagatattcatttgaaagttgtgaggctatttggtcacataatggtggtgaactatgccatgtgaaaacctttaagaaatctcaggttttcatgccatcttgtatcaataaatacttgctttagaggtaaaggtcactgatttttaaaacaatctgtggaatagtaaacattgtaataagaagagaggtgttttttctgtcgtgtttttagttgtaccaatttatgttttatttctgtgtatattatactttacatataatttttatctcctatgatttatttggctgagtatgatattactcacattaagattgaaacttgttatctgtttcagttttttgttttggaaggagagtctatttggttaatactttgtaactttatctttgcagagttcttggacaggtttcctgtgaacttgtgtctccaaaactcaatcgggcaacagaaggtattcttttttttaaccttgaactctctcagatggccgctccagctttcgaacctggcaggtatttaaatctttttcttaagttgctttagtcataggagaacctaacagcagtgagcttttgttttaatacctggtgttatatttcatgacattagcccattcctattttctccttataggcagtcagatctcttggtgaagttgaatcgactcatggaaagatgtctaagaaattcgaagtgtatagacactgagtctctctgtgttgttgctggtgaaaaggtggggaatatgcccataattcttaatcttaggatgaatactgttgatcatggatcccggtatctatccttttattctcagaactttagttaactcagtattgtactggtttgcttcacttcagatgttcttgagtgatacccttagaactttgtgctacctctctctctctgaagggacaaaaagggtgt

SEQ ID NO: 34069 - DNA, 1032 bp, Homo sapiens
agccgcaaactctgtgcatcaactttgatgatgctttcttaacttatactacaaaaccaccttcaagtcatcttgaccaattcatgcatattgtgaaaggaaagcttgaaaatgttcgagtcatgcttgttcctagtccaagatatgttggtcttcaaaatgatgagtaagaaaatcttataaaaataataaaaaacttcttataggtaatacagatacagctagaaactttaacatccttttactttttttgctacaagttgtacaaaaattaggtatatttctctattaaagcagttaacaatgtagtccttctttataggataaatggatatgctatccagtgataaactctaattttaaatatttttctgcatgattataactataatttttttatccttttctccttctaattgtattttggaaacttactttgtgcaattagttcctgtttgtatgttaggagatacacattacaggtaggtttttgtttctagaagatgtgactaaagagtaaattgaacagattcattgcagtggaataccactttgagttattgaaagtcgaaaattgaatcgaaattactcttggaaaatttggtgaagttaagatggtatagttttgagacccacttgacatttctttaagttccaaactgtcagttttccatctagctttccatttttttttttttccttcagtgaagtagctgcttgtatttataagactcattataggaatgatgtacactagactcagtgtgatgggatgctgagtgggagatgggctcttgtgatttttatgttttttctcaatttttgtgtgtgtaaaggatactctggttgaatttaagtgttcatatggagagttttcagtacagtgtctcagcttttatctttgtgtgtaggtaccttatgaggttttatgtgaaacatgattattcctttttagttgtaactcttggctggcctggtattcgattttccaggatttggctagaatgatagaaagagggtttttcctttttg

SEQ ID NO: 34070 - DNA, 1048 bp, Homo sapiens
gaagagagatgaaagtgagactgattattttagttaactatttatttaatatatattggcatttcatgtgatagagtagaagagtgaaaaaaagaaatttgaaaatattcctagccaaaaaggggccaattatcagaaaccaagtttgttttcaagccagaagagtttagtgatcttaaaaaatgcctgtaattactgtaccattttttctgtctgcttctctgtaggctgatttcaatttaatgtgtattacttttctcaaccatgatgctaccagtctttttcctagcttatcgaaagtttggattttaaggtgggatataaaactagaacgcagctggcacatagataggcatagaggggcagcgtgaataagtgagttgctgttgtggatgatgtggaagttatgaaaagcttgtgaaataatttcacttacgatctttttagttatcttccaaacaagacattagaggaacaaaaactgagcagtctacaataggaacgactaaccaaggacaagcacagacaaatcttacaatgaagcaagataatgtaacaattaaaggtcttcagactaatgttagcataccaaaggtaacaatttaatatttaaaaattttttcctgaaagaggagagcattttgatggtgtttgtccttttcagttaccaacgtgaataatggtagaacagtgtgtaatattaaaaaaatatgttttatttctatgatctaatgtagatctaatggaatgtaaatagtttacttaagcagaatattaggtaatagtagaatgttccacatccatccagtaaaaatttaattatgattattttatgagaatctgtattcataagctttgtcttcactgtcaaatacatagatatgccattcttaacagtagtttttcatttttgtgcatattttatgtttaagtggtaatttttcacttgtcagttctgaaattttgtgtgtgtgttaggtaaacttatgtttgttacaagcctcagtggaagaatctccaactacggctcctagtaggagtgtgactc

SEQ ID NO: 34071 - DNA, 1056 bp, Homo sapiens
gtgaactcaccaacccacaatatagcctaagaattggcacattaccaatactttgaagccttctttggccgggcgcagtggctcacacctgtaatcccagtactttgggaggctgaggcgggtggatcacccgaggtcaggacttcaagaccagtctggaaaacatagcaaaaccccatctctgttaaaaatacaaaaattagctgggcatgatggcaggcacctgtaatcccagctactcaggaagctgaggcaggagaatcgcttgaatccgggaggcggaggttgcagtgagctgagagtgtgccactgcactccagccttggcgacagagtgagacttcatctcaaaaaaaaaggcagtcttcacttttcatggaattactgctatcatgaattttgtcttacccattcttttgctttcccatatagttttaccatatatgtatatactcataaatgatttaaagtttgcttttagctgttttgaactttgtttatatggaatctcacattttttaactaggaatttttttatttgactaagagctccttacgagtttatatatataaaatgccagttgatggttctttttttttgctcactttaccattgagtcatttgtatttttcttgattcgcaataattcttcataaattctgtatattaactctttgatatcatgtttatatgttgtcacctagttggaggcttatcatttaactttttcttttgatcagcagacattcttcattttcatgtaattgaatttaccattatttttcctgtatgatgtgtatttttatgtcctgaagaaatgcttctcttcctaggataataaaaatattttgttacattttttcttgaatgttttgagttttgctattcatatttaagtttttaatctatcttaatcaattattattgttcttagatttggcatgggatagtatataaccagtgatcattgtatataaccagtgatcattgtatataaccaatgatctcagcatcacttattgattattctttttttccagtggcatataatccaga

SEQ ID NO: 34072 - DNA, 1026 bp, Homo sapiens
gagagatagaagagaatccataaacttaagtataagttgtattaggggcaacagaggagacaagaatgcctcaaacttttagcttagatgactgaaggagcagtgaagccattaacttagaaaataaagaaggaaatgtctataggacatttaggtggaaggttctggtagacaactgacttagcgggtatcgctatgtaggtatgggctcagacaaaaacagaaattttagctgtgggagtcattggcatgtaaaccctatagaaactatggtagaagaatagaagagcacatacaacaggagtagaagaatgctccagagcagaactctggaagaaggccatcaaaatgttttttgtctaaagtcactgctattagtctgataggaaaatagtagtccctgccacacagctatttggtttacaattccttttgagaaaatttgtataccagctcatcctgatgattcattttccataatagaaaagactgctgtgttaaaattgaaagctggctatcagactgatctttagaacttctctgaggatttcatgataaagtgataatagaattccaacttgccatcacctcaaaaaagggaagtggtactaacagtgttagaatgtgctgtttttgtaatttgtggaagaatgtaacactaatcataatatgtaacttaagtataattcagctgtgtaataaccctgtcttatacctaccatgtgaaaacattaaaggttttagaaatctgtactaacaaatgttatttatgtatcagctgtttgtgatatagggtctgcctcctttaaatatgatatgcgccgactcagtgaaattctggcatttccaagagcatggtatagaagaagtattgcaagacgtctattccttggagaccaaactataaatttgccaagtaagcttgttatgtaattttaattttggttactgtagcagcaagacctacaattgataacacaaacgtgatcttacttggcagggtgtaccatgtgatgcgttcagtca

SEQ ID NO: 34073 - DNA, 1032 bp, Homo sapiens
agagagaagtgctaagcaaaagaacaaaacgggaagaatatagagaatgattaaatgtgaggatagctattttagaaagggtgatcatttaggccttttctgaagtgacattttagtggaaatgtgaatgaaagaacaaggctaagatgtgggggaagagagttccaggcatcgggggatactgagtccaaagttcccctagtaggaacaaacttggcttgaggatcattaaggttgccactgtggctggaacagaaatgagcaaggacgaaaatgccggacatgaattcacagaggtctactacaggtaagatttttaatatgatggttagctatcagagagttttaaacagatttgatatcggatttatcttttcaaaaaatactcccttttaaagttcactctggctactgtgtgaagaacagactataggcagttaagaatggaaggaaaccattgcaataattaccattatcattgttatgtacatagttacatcattattgtaaggaagccattgcaagagtccaggcaagaaatggtggctttcactaggatgatagaggtgtaagtggtgagaaacagtcagaatgaggatagctttttaataactttattatcacagaagtaatacgtatacattgaaaaaaactagaaaacacaagagaagcaaaaaataaaaccatcacattccactcagaaatcactgtgaacaccttagagcatacacctccagatatttttctgtgtatctgtatatatgcgtacattttaagaaaatatcaaaattcataccattttgtaggtcaacaatctccaactttccattttgctaattatctcctttagctttcaaaacacattcaaatttccatgattgatctaaaaatgtcctctataatggttttgtccaaaccagtttatccaatccaaagtcacaggttaaatatggttatgttcctttgccttcttttaatttagcacagttcattttttatatgaactgacttattgaagagatgtagccaact

SEQ ID NO: 34074 - DNA, 1050 bp, Homo sapiens
tctccacgtataaggaaatagcaagaatagggaaaaaatggttctcccttcaaatatgtttagcacatagcactcagtaaattttagcctttttctcccattatgccacatgcttatgaaatctactaaaattaaccagatgtccttttatatgtttaagataactgtataacaggcctaaaatattcaggatgaaatatagtaaacactattgctgtgtttaggttgtcaaagagatttataatcatacatatattattttttgaatgctattattatggtgaatccaggaattatgggctcatttatacaaatgtacctactgaaaatattttgtcttgagtatattatagaggcttagtgatgttcttttcctaccattagaaccatgctttagggcattacactccttaataataactgtaatttttattttagattaatttcttggactggaagaaagattgatccagtaggtgttgattatattcttcaaaaattgggctttcatcatgctaggactactattcctaaatggcttcaaagaggagtcatggatccactggacaaggttctgtcagttcttatcaaaaagctcggtactgcactacaggatgaaaaggaaaagaaaggcaaagacaaagaagaacactaaaaaagtaatttgatctgtgaacaaattatgattgtgtctgttttattacactggagtgtttttttagtataataatttgaaatataactttaaaataattctaaatttgtggctataattaaaagtttgtaagttaacctgttctagttccatcattctgtgtacagtgaagtattgcatgataatgtaaattttgtgaaaaactagattaaaatatataactgcttgttatggtttataattatataatgtgcaatacaattcctgcatctttaaaatgtctgcagaataactgtgaatttttttgttattggattggccgtaacttttagaaaaaaatcttgttgatgataatgtgattttggggaggtcattaattgctttttcttttttaa

SEQ ID NO: 34075 - DNA, 1034 bp, Homo sapiens
tcctgaatgagcttcttaccacctggtcccttgccttctcttcctgccatccctcagcctcagtgcgctcttcattccaccatagagtgtgccctgctggaccccactttggttaggcttcctccatttcagggtagtgagctgctagcccctttgaagagttcttactagtttacgggtgcctcaggttgatttcctggggttttggataaagccacctttccatctcttcactactgcctttggggtaaatagaaccattgatttaataatacacgtactagattctctccccccacctctctttggtaatatctggcaagtggatagcaataattttacttaatgaacgtgatatttactgtaataaatattgggtgcagtaaacaaatgaagtcagaatctaatagctcatttaatcttggaaatcatgtaatcagtacagcaatgaaaggacaattcatgagtcatagatattaccacaccttaggagccttttaagatgagtttgatgccaagtgacttcagcctagaaaaggcaatatcccctcatgacatgccctgaggggtttcatttgtttataaaatgaccgttatgtaattagactttgacaatggtgtaacaattgggttttaagtattctcattttgatttatgatgccattttatgtggaaggacataattttaaagtttaattagaaaataaaatgttacagatgtaatgaacaaaacaagaacggttctttaaatatcataagcataaaattgactttcttcatctatacactgattctgagaactcatcatcagtgatgttgaaaagacaatttaaggtctcacattattggaactactattttaaaaccacgagatgcctgtacaagctggtaattacacatgtgctgtagtctttgcttgtttttccaattctagtgtttgttgattttccagataccctacttgggcccctatgtcccgtagcacacgtctgtaagaaggctggcatgggataaaagtctatgaccatgaaac

SEQ ID NO: 34076 - DNA, 1048 bp, Homo sapiens
agacagccaatattcagtgtttatgtctcatccagctgtcttctgtcactcttcctgcacaaggtgacttttgacttgaccggtgtatctttgatacttactcatttacagaaatgtataatggatgtgtgtgtgtgtgtgtgtgtgtatgtgtgtatttgtatttttatagagctattgacttctgcaatttaacctctaagatgaattatccaatagaattctgaaatgaaaagttcacagattttcaaggtattttggagatttaaaaattgaagagaagctatgtgaatattaagtgtatgttccagatataattgaacaattgaaaggaatgatcctggtttaatttataattaagctatacattaatttataatgaaaacttgtaattaaatgataactcaaattagccaagaaaaaagtattttttaaaagaaatttgtacagagtagtaatgatctggctgcattctgtgaacagattattctctgttcataatttaggcaccttaagatgctggcaccttaaggtaggaaccatgacttctttatataaataaacatcataaaaagctcagtactttttactcagagagtgctcactaaatgtcagctgatgaggaaaacattctctgtggaacttgctgtgaaataactactcatgaggcatatgctgtataaagcttggtcaaagtttacagttttcttggtgtcttgacatctgtgtttagatacttggtcaatctttaaatgaagataattatatatagcaaagttatatttgggaaacatttcggaattttggagactggctattagtttttcttagaataatctagagaaagatgaatcatttttcaggaaaaattgtttagaacttttattgggaattctgatttccttaaaagtatttaagatttttatcatgtactattgttgtaggaaaatcctggttcttgtcacacgcccaggaaagattaggctcacagacactttggagggtgaggggttatggaatttattggtcagaaagaaaaaaggaaaaa

SEQ ID NO: 34077 - DNA, 1035 bp, Homo sapiens
ttgtggcaggaactgtgcccgatgcatggccaagtacaaggctattaagaagtttgtcatttgaaacatagtagaggctgcagctatcaggtacgtttccaaagcgagtgtctttgacacctccgtgcttctcaagttgtatgtgaagctacattgctgtgtcagttgtgccattcatagcaaggtagtcaggaattgatcttgtgaagcccacacgaaccaaataccccgatcccgatttagacctgtgggtgctgccccacgacctccactaaagcccaggtaaggagctgagtccttaaggtctgaagaaaaactatcttctggaaaaaaataaaatgaaaattgtatttaaaaaaagagaaaaacatcgtggacttgaaagacttcaatctcctggtacgcacattgcccccagagctcacagatgtttcaagtctgtaaaaatcagaaaacataggaaagttaccagcagatgtgtggttgtcatagatataaaaaagtgggatacagggtgtttttggaaactctaggtaagtagtaagcttgatacagatctctgaaaaaaactccaagaggtttgagaatactgaaaaagaagataacagagtaagtagtaactagggtgctacaatgggagagtcataatatatacatagccttcgtgtgttaatttccatggaatatttgaccgaatttctcatagcaaccttctgtaaaagatgtgtattttcttcaagagagtctagagtttttcgtatttaggattcttaggccaggctccaacagctaaataagttttattggcacacagccaccctctttgtttaaacattgtctgtggccactttcacactacaatggcagatacccctcaaggtgtaaaatatttacttcctggccctttaccccagaaaatgtgctgacccctggcttaggccatatttttcatgaggagtggacactccttagtcatggcatttctgctattccgcactattacatttaatactaatttcctgacacttgatgtca

SEQ ID NO: 34078 - DNA, 1771 bp, Homo sapiens
ttcaggccttcaactgatttgatgtgggccccccacaatatggagggcaatctactctactcaaagtccactgattcaaatgtaaatttcattctaaaacacccttacagaatcatccagaataatgtttgacctaatagctgggcactatggcccagccaagctgacacataaaattaaccatcacaaggcatttgttgacataaaccctagactggcctgactgtccaaagagggtggtgaataagccctggcttgggtaagaccaacttattcactatgatgccccaaggacacgggtcagagacttcctaacagaggtactagactggcctcctgttgacactgagaggttcagttttgctttgagcctcagctcaacactgagaccctaaggagtctccttcttccatggctagtgccttccaggggcacatggagtccaggttctttcttctggtttctcttgtctttcccctgaggtgtgtgggttagtttttcttcttcaggatttctgaaaataggaataataatcttattccagaagaaaggacataattatgttaaacaaaaagggaacattcccaacttgatcacagtgatcgtgatgtggagatgttgtgggctgctgttgcctgtattctggagacttgtggtcacagcagtaaacaattgctgctgggcctgttgtctgtcagctgccatctgctccaaagcaccccctactcttcgcttgtccctttagttgacctgggcctcagagcctgtttctgaggatatgggccacagaggggaattgaggctgcaggctgattacatagcactggtggtagtttcttttaaagtcatgttctgatctgtggttgcaaatgtctgctgcttctgtcagagcattattcccctttcatgtggaagaaaactgccattgattagaagcaggagtatcatcgtcagtagaagcacttgtgctttaggttctttgagcctcatgagaggtccaagatgacactgaagtaaaggaaggtggataccagatgccttggctactttttagaatacatcactggcactgctaggagagagctgggattcatgagagtgggattaggtgctgggccaggagcagagagtgttctttgtactgtggatctcccttacttgcttcctggacaactggctcttccggactgggtctcttggtctatccttgtgtccttaggggcaaggtgcttctccactttgaagctaaaacaccatatcagaatcctaccaaatacatagacattttaacatgcagcaaaacaataaaatctctttggtggcttagttgctatagaaaaagacaaatgttcccaaccaaagtgcccatcaatgatagactagataaagaaaatgtggcacatacataccatggaatactatgcagccacaaaaaggatgagttcatgtcctttgcagggaaatggatgaagctggaaaccatcattctcagcaaactaacacaagaacagaaaaccaaacaccacatgttctcagtcatgagtgggagttgaacaatgagaacacatggacacagggaagggaacatcacacaccagggcctgtcagggggtggggggctaggggagggatagcattaggagaaatacctaatgtagatgacgggttgatgggtgcagcaaaccaccatggcacgtgtatacctgtgtaacaaacctgcacgttctgcacatgtatcccagaacttaaagtaaaataaaaaaaaaaagac

SEQ ID NO: 34079 - DNA, 1025 bp, Homo sapiens
agtctcctagcacctgtaaaaaactccagtatgacaccaatcacatggctgcaattctttctttttctaaaaatatatatgtttagagatgtattggaaggagttggcttacaccatagtgggggctggtgaggcaagtctgagatccataggcaggctggcagaactggcaggctagaattctctggcataggctgaagtggctgtccacaggcagaatttctgctgggaagcttcagctctgctcataaggcctttcaactgattgaaacaggcctgcaacattttcaagaataatgttctttactcgaagtcaattgttgaaacaggcctgcaacattttcaagaataatcttctttactggaagtcaattgattatggactttaatcacatttacaaagtaccttcacagcaacacatagattagtgtttcattgaattactggggactgcagcctagccaagttgatacattaaaaaaaaatcacactgcatcttttgattttctttctgaatctctgcttttctttttcctaattttggcctctgtaaacctttcatttttttcatgctttagcattgtgagggacttaatactgggatattttttcacaatatcttgttcaccatcttacctgtcactcttttccctgaggtactttgatccaacagacattcactcgattctgttgtgtgtcgggcagtgtgccactgctagggatacagaaatggataaggtatagttccctaccctcaaaaagctcaccgtcagttggtgggggacagacaggtatggtataaaattactgtgagtggtataaaattacctgaaggcataaaatatccagctagtgttaaaattttcctgatggtctcatattttctttacagttggtttattctccatcagaagttgaacaaggttcacatatcccttttgggtgatacgtctccaaactccctttataattgagaaattctctctttttccttgaactcatgaatgtgcgtattttcagtcat

SEQ ID NO: 34080 - DNA, 1034 bp, Homo sapiens
ctgatctcaagcaatccacccatctcccaaagtactgagattataggcatgaaccaccacgcctggccttctctgtgttttatttggaaatgcattgcctaatttccaaatatttggggattttccagatatcatattgctaacatttctactttaatacatcatatgatttcagtcatttcaaatgtattgaggcttgttttatggtcaagcatataatttattcttgggaacgttctatgtgcccttgaaaagaatgtagattctgcagatgttgggtgtagtgatctttaagtgtcattttgggcatatctgcatgcaaaagaatgaagttgtgccacataccacatacaaaaattaactcaaaatgtattaaaacctaaatagaaggggtaaaactaaaacttggaggaatgcataggtgtaaaccttcatgaccctagattaggcagtgattttttagatatgacaccaaaagtacaagcaacaaaagaagaacattgataaattggacttcatgaaaatttaaagtgtttatgcttcaaaggacaacatcaagaaagtgaaaagaggccgggcgcggtggctcatgcctgtaatcccagcactttgggaggccgaggcgggcggatcacgaggtcaggagatcgagaccatcctggctaacacatgaaaccccgactctactaaaaatacaaaaaattagccgggcgtggtggcgggcgcctgtagtcccaactactcgggaggctgaggcaggagaatggcgtgaacccaggaggcggagcttgcagtgagccgagattgcgccactgcactcccgcctgggtgaaagagcgagactccgtctcaaaaaaaaaaaaaataaataaaagtaagtgaaaagataccccacaggatgggagaaaatattctcacatcatatgtctgaacgggatttgtgtctagaacatataatgaactctttcaactcaataataaaaagacaatctaaaaatgaatcaaagatctaagtagacagttcttcaaagaag

SEQ ID NO: 34081 - DNA, 1291 bp, Homo sapiens
gctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgtt

SEQ ID NO: 34082 - DNA, 1090 bp, Homo sapiens
gaacctatcttctttcacagatgccgttacagctgtttcaaagactgctggttttgaaaacgctcagtccctcccaccacgctgtgcactgctgcgctccactcaggggattacggcgcaggggcggaccctcgctgacttctgccccggaagtttttctctcagttgaagcgcgcacattgagtcggcttttctactgcttcggctagggtaccttgtgaccatgtcttccaagaagaatagaaagcggttgaaccaaagcgcggaaaatggttcgtccttgccctctgctgcttcctcttgtgcggaggcacgggctccttctgctggatcagacttcgcggcaacctccgggactctgacggtgaccaacttattagaaaagggtaaagaattccgggtgggagactagaggccgagggggcgcaacctgaggggcgggagactcagtgatactgacttggggtgcagagacttttgaaagttgggcgtggcatgggtctgagagcggcacagaagcgtgtaagacttctgtatgtaagaagcatgcaaacgtagccgcgcctgcactggagaagttaggctgaaatggtttatccgtgtccaaggtttctcttttgtaaattattttgaatttttaagttgcacttgaaacgctttgtctcatttaacattaacgacacatttaattgcaaaattgttcataactagcgaacatgggatacttatcctaaaaaactaaataaccaattcagtaaaaatgtggatcactctgcctttaggagtgatgatagcattttcttccagtactacgcaggttatgatatttaataactgctagtaactgcacactagtgttagcagtatatatagctcatctaatttctacagaagccgtgaccgatgggtatagtaatgacagttttatagagggaggaaagttaacgtgattccattcaggctacacaggtgctaagtggcagagccgatatttgagtccagatgtgtttgacttaaaagccattcctagatgacagctcctttgatttgggagaacgtatttatactgaaaagtcttataaattgaatt

SEQ ID NO: 34083 - DNA, 1041 bp, Homo sapiens
gttattaattagagtctttctccaagctaggcaactttataaagggaattattagtttaggtcagcattttaaaaatgtttttgcctatgacaataaaaaatggatttttcatcagattctttgtatatacacatccatagataatagtgctcatatgtgtgcatgtgtgtatgtatgtgttagaagttaatgttttacaaagcagtatttaccctttctatattcagtgtaccctgcatttcttattctattaacaaagtgctgaatgaggctgactgaaatgatttcattacccttgtgttttgaagaacattgatttaggccactaaggcaccagattccaaatgatattttcatggctatatgtttctgaaaaatgcccatcatttcaaaattgtatacattatttattttaaggttgcaggtggattattcttttgattaagtctatattataaccatatacatgtaattttacatcacagtttagtttctggtgtacctaatgctgatttctgttcccttcttatccttttacagtgacaaagatatggaaattaatgaagaagaactgactggttgtatcctgagaaaactaggtgagacaaatattttaaattgttttcttaagttttaagctgcaaggcatcagcaaataaagtgtctttgagggcttatatatgcatagtagttttcttcaaaatagctttgagaatattcccctcaatgaatgaatatacttttaagatagggatgtgctacttttcctggttaattggcagttgagcagtggaaagaatatatgacttgtctgtggaaagagtcagtggtagaattgagacttttaacctttgcattcttgccctttccagtgacagatgctatcttggagtgttggtttgggtgtgccattttcatttagtttattattgaatatggaatgcctggctatttgttgatgtgattgatagaatctgagatctactgagtgtggaggatttcagagaatcatttccttctgtctccagatggtgttatag

SEQ ID NO: 34084 - DNA, 1026 bp, Homo sapiens
agtgaaggacaagtgttggttcttggggccacaaatcgccctcatgccttggatgctgctctccgaagacctgggcgatttgataaagagattgagattggagttcccaatgctcaggaccggctagatattctccagaaactgcttcgaagggtaccccatttgctcactgaggctgagctgctgcagctggcaaatagtgctcatggatacgttggagcagacttgaaagtcttgtgtaatgaagcaggtgagtgtggtttgctatggtgagtctctattgatgcacttatctccagtttacttacatacaaataatttatattttacagatttcttaatggaagtagctttgtttctaattataaaatgtgtaatttttatttgaaaaaatttttattggaaaaacctagatgattcagaagactataaaaaaaaataaaaatcactcaatcctacctctaaaggataaccaccattatagtgtatacagtcagccctccatatccttgggctcagcatctgaggagtcaaccaactgtggtctgaaaatattcaggaaaaaaaagttaaaacagtaaaaaataataaaaacttaaaaaatatagtatcacaactacagttgacccttgaactatgagggcttgaactgcatgggtccacttatatatgaatatttttcaataaatatattggaaaattttttggagatttgcaacaatttgaaaaagcttgctttttctttagcttactttattgtaagaatacagcatataatgcatataaaaaatatggttaatcagctgtttatattattggcaaggcttcaggtcaacaataggctattagtagttagtttttgggggagtcagaagttatgcatagttttttgactgcacagggattggtgtccctgacccccaagttgttgaggggtcaactgtatttacatagcatttacatgggatcaggtaaaagtaatctagagattatttaaattatacgggaggatgtgtgtagtctata

SEQ ID NO: 34085 - DNA, 1075 bp, Homo sapiens
agtggagtgacccttcaattggttgaggctttatactatattttcacattttcaaacaaagtatcaagaatgtttacctgtatgttggatatttattaataaaccatattaatctttctattgataccaagatattgacattgtacttagcagagaaaaaaatcatgaaatgaccataatcttgtactttctaacattaatgcctaggttatcttcatcatctacagagaacaatgaccatttttccaggttctctaatctctttccttcagttaagccagataattaaaaagcagtatatatacattcagttacattgcctgaataaagaaatctcttcactggattattattttatgccatatccttggcttttgcagacaattgctgtaagaacaacagcaataatgtagagttggcatgatggtaattgcaataaaaacagtgaccccagcaatttcctttctgattattgtcaggccacagtttgcctaggtagttgctctaaactgaataaaatctgcatacaaatttcttaccacccctaacccctcaacaaaaacacactctgctgtttatctaaagcttgttttattgggtgggccctgatccttgttttagtgttcactttcttaattccttgtccacagtcccccttgtgtaaaacttaatttaccacatgtaaatgaaaagtactagttttgtttatttgactttatattatgttatgaataggcatttcttgctttgtactacaatcgtttttacagccctatactacaggcatttcttgctttgcagtctagtacaaagcaagtatagggctgtagtatagggctgtaaaaatgattgtgcaaggtgaaattatgcagaatgatcttaatcagtgggaaaaattacaagtgttacataacttttaaacattttgtcaaaacattaagaacgttcattcttggttataaatgttgaggcagtgcattttggctgtataacagatcccttgctagtttccctacctcttaacttatttctttgactagcccttcattcacacactgacagcctagtactccat

SEQ ID NO: 34086 - DNA, 1029 bp, Homo sapiens
accagtccttttaaactattactaccactttttccctaggtcataatttaataaaggagttcagtaatttaagttcctcatctatatctaatatgtaatattttataaggatttaagttgagtaaacatttgctctcagagcgtgaaccagtttctcttttttgttgttgctggcattattgccttgtgtatgactttatgagctactttcttcctgtgtacatatacacattctttcagttttaaaagatgtgatttttaaaaaagacccctttgaatgtaactattatgtggcaagaaagccttgctttggttaggtattttgctgtgtgataaagatcctttggtaaaattcaggaaagctttggaccttaaaaaatcattcccttcctgatgcagtattttattagaagataggtgagttctgagtatttatagaatctgggttggtgttaaggcatctctgaagtctatacaaagtataagactgtatcttaacaaggactgtagaaactgctgaaagagcccttaaagtttacctaattctgcctctggtttcacaaataaagggtgctgaatccagaaaaatctttctcctggtaagaattcattgtatttttatgatatttatttcctggtttccctgtggttaataagctctaaaatgtcttaggatttttgtcactacggcttaatctaatagtagccttctttggcttcctaatgttgggtgtcctcgatattagatatatttcttgaagtaggatgtaaggcttacagtaaacttaactgcatttttctaaatcaagctgtctgacttggcctgtttagtgcttgtattgttgttttctttctgtgtaacaaattaccacaaatttagcagcttcgcacccatttgttagttcacatttcttaggttagaatgtgggcacagcatgactagtttgtctgctcaggatttaaactaaagactgaaaacacagtgttggctagactgcattcgcattaggagctcatgtttctaaactc

SEQ ID NO: 34087 - DNA, 1029 bp, Homo sapiens
tttagtgatctggatagaagatcaaaccaactacagcattctcttaagccaaagcctaatccagagcaaagccctaatgctcttcaattctgtgaaggcggagaaaggtcaggaagctgcagaagaaaagttggcagctagcagaacttgggtcattaagtttaaggaaagaagctatctgcataacataaaaatgtaaagtgaagcagcaagtgctgatgtagaagccgtagccagttatacagaaaatctagctaagataattaatgaaggtggttaactaaacaacagatttttaatgtagcaaaaacagccttatattagaagaagatggtaatctaggactttcatagctagagaagagaaattaatgcctggcttcacgcttcaaaggatagggtgactctgttgttaggggctaatgcagctggtgactacgtggaagccagtgctcatttaccattctgaaaatcctagggttctgaacagttatgttaagtctactctgcctgtgctcgatcaatggaaaaacaaagcctggttgacagcacatctgtttacggcacagttttctcaatatttgaagctcactgtcgatacctattgctgaggaaaaaaaaagattccttttgagatgttactgttcattgacaatgcacatggttactcaaggctctgatggaaatgcacaaggagaattaatgtttttgtgtctgctaaaacagtatctattctgcagcctatggatgaaggagtaatattgactttcaagtcttatgatataagaaatacgtttcttaaggctattgctgctgtaatagtagatatgggcaaagtaaacctccttgaaaggagtcaccattctagatgccatgaagatcattcatgatttatgggaggaggtgaaaatacgtcaactttaacaggagtctagaagaagttgattccagccctcagggataattttgagggcttcaagacatcagtggaggaagtaactacagataaggtagatacagcaaaagagct

SEQ ID NO: 34088 - DNA, 1070 bp, Homo sapiens
agaggctgtaaaataaatatattctctattttgaggggctgggatttaaatttggctttaactcaggggtttcattactaaagagaaaaactaacagtctctgcgattacctgttagcaccatcagctgtcattgtccactccttcctctttgaaacattcctctttgttttacgtgacacagtaatacctaatttttcttctatttctttgtcctccttgactcctttacatatttattctggtctgcctagccacagaatgttgcagtttgtcaaggctgggcacgggacccatcttctctcatccacatccatggcttcagttgtcagctgtgattcagtgcctaattcagctcagatctttgctctgaccgattcaaccatctacttacatgtctcaaaggcacttgcagttcaacatgtttttaaattttgttctaaattatatatataattatataatcttaattttatgaagtaaattctattaccatccttgatcatacacgtgagaaactgaaacacagatggttaagaaacttgaccaacatagctggtaactgttatgtgaggttttttgttgttgttttgtttttgaggtagggtcttactctgttgcccagactgaagagcagtggtgcaatcatagctcattgcaacctcaaactcctgggctcaaaccatcccccacctcagtctcccaagtagcagggactataggtgcaggccacagttcccagctaatatatatatattttttaatttatgtagatatgaggtctctctatgttgctgaggctggtttcaaactcctggcctcaagcagtcctttcacctcagcttcccaaagtactgagatgacaggcgtgagacacgatgccaggttcagttctgtcagttttgataaatgcatagaattgggtaaccaccaacacaatcacaatgcaaaacaatttatttactccaaaaatttattcttgcagccaccactggtgggatgtcttctttccaccactgacccctggcaactactgatctgtcctgtagttttgcccatttcccaaatgtc

SEQ ID NO: 34089 - DNA, 1032 bp, Homo sapiens
cctttctactttgtttctatgaatttgactgctctggatacctcatataagtggaattgtgcagtatgtgtcttttgtaactggcttattttaatttagcataacgtcctcaagattattttatgttatataatgtatcagaatttcttttttgaggctgaatattttattatatgtatataccacatcttgttatccattcatctgtagatggacagttaggttgtatccacctcttggctattatgaatagtggtattacaaacatggtgtgtgaatatctatttgagatctgctttcaattttttgatatgtactcagaagtgaaattgctagatcatatagtatttctatttttaatgttttgaataactgccatactattttccacagcagctgcaccattttatattcattccaatagtgggaacaaggttttaaatttctgattcttttcttttttcttttttgatagtatgtatcctaatgggtatgaggcgacatgcattgtgattgtgatctgtacttccctaatgattagtgattttcactatattttcatgtgcttcttggccttttcccccccagatttattgaagtatgattgacaaacaaaaattgcatatctttagagtgtacaacatgatgtttatatacacagacacatatacattgttattaactgtagtcaccaccatgctctacattaggtctttaatacttattcatcttgtggctgagggtttgtatcctttgactaatatcgcacttttcccaacccttaggtcccaaccattctattctctgttaataggagttcagctgttttttagattccacatataagtgagatcatgtagtacttgtccttctgtgtttggcttatttcacttagcgtgatgttttcagagttcatccatgttgtcgcaaatggcaagatttccttcttttttatggctgaattatatttgtgtgtgtgtgtgtgtgtatacatatatgtacattcacaatagccaagctatggaaacaacc

SEQ ID NO: 34090 - DNA, 1130 bp, Homo sapiens
ccagtttttaatagggttatgtgttctcttgatattgagtagtttgagttccttgtatattttagatattagctctttattagatgtatgatttgcatatgtttctcccaatctggggtttttctcttcactctattgtttctttggtgtgcagaagctttttagtttaatgcagttccattggtttatttttgctttcattgcctgtgcttttgaggttatatccaagaaatctctgtctgtggagctttttctcttaggttttcttctagtagttttattttcaggtcttctgcttaagtcttcaatttattttgacttgattcatgtataaggggtgagaaaagggtccatttttattctatatgtggatattcagtttgctcgtcatcacttattgtagagactgtcctttccccattgtatgttcttggcatcatcatcaaaaatcaattgactatagacatgtggatttatttctgctctctctgtcctattccattcgttgatgtgtctgttttgatgctaggtatggctttgcagtatattttataatctgtttgtgtgatgcttccagctttgttctttttggtcaagattattttgactattctgggcctttgtgattccatatgaattttaggatttttttttttttttttgcaaaggatcataagaaactactatgaacaattatatgtcaacaaatcatgtaacctagaaaaatggatagaaacatttaacataacaaaactgaatcaagagattggaaatctgaacagaccaataattagtaaggagattgactcagtaagtagaagtctgtcatcagtggaaagcccagaaccacatgactttatggctgaattctaccacacgtttaaagaagggctaatactaatcctcctcaaactcttctgaaaaattgaagaggagggaatacctccagactcattttatgaggccagaatcaccctcttaccaaagccagacaaagacattacaaaacaaaactataggccagtattcctgatgatcattgatgtaaaaattctcaacaaaatactagcaaaccatagtcaatagtacattataaggatcatttaccagtagatcaagtgggatttatt

SEQ ID NO: 34091 - DNA, 1049 bp, Homo sapiens
tgagctgggttgtttgttttttgtttgttgttgttgggttttaggtattccctatatattctggatattaatcccttatcagatagatgatttgcaaacattttctttcattctgtgggttgcctttttactcacttgccacttttttgtagcaaacgtgacccctcctaaaaggggggatatatgtattttaagaccattccttggcagtattgtccttagagctttaggttgactatttgaattcgtatggtctttgactcatctcatcatctaaaactccttgatgttttcctcctttctttaatgttatatagacacaactgggacagctgacagtgaatataggttatatttttgcgaagaatttagcaagagaggttggctgtttggcattaaatatctgtatcactgtgaagtttttaattgtttttggatactaattatcactgaacatgacctagaacaataccttattacatagagttactcatttgtcaaatgtaggaatgaatgtatgtatgcatgcatgtaagtacacatgcatatagccttggtagttactacagtgctatcatagatgtaaagtctttcacaggcctgggtagacagcagtcatgttttattcatggcctagtctagcatggttcctggtactcttaagttttggtgaatgttcgtcatataaataaatatatttaatttagaaagcatcagaaaaactaacatttggataaagcagatataattttgtattatatatgtgagtaattttctttcatctttaaattgtcatatttccaaggaatctattcattgttgatttcatgtccctcttaaacaacttgagatacgttaactttggtaatctgtcatagacttcacttcattctgtggcctttaatttaagagaatggtagttctttagatgctctctcagggttaatctcccaacagctggaaaaccaagaatggctgtgaaaagtacttctttacctaatacaggattgcataactacttgcttttcccttaaaaataatctgcagta

SEQ ID NO: 34092 - DNA, 1028 bp, Homo sapiens
gttatcttactctaacacttaaatgctgtatgatcaaagttaactaatttcttaaatttaatgaatctctttaaaccaggagatgtcatgtcttggttgtgcatggtatacataggaatgatagtttaaggaaacccatttctagatctttagtgcctaaaactgatctgcttgagaattcacttgtgatgggggtggaagtttctcttctccaaactcctctttacctctgaagcatcaaacaagtgggcagtgggaaatacaggtattacgtttgagagaatagatggcactaaagccatctattattaaactggtactcagtaccagtttactgagtgtggtctgaagatcataataattaccatttgcctttttcattcttattttctcagtagttacaattaaaaaagattttcagttgttatctgtcatcattcctgatatataatatagacagatttcaaatacttgaggaatatgattagaacagaattacttctcgcttatttgtatgaacaaggtttctctgtactttattccacaaattttttttagaaattgaaatagaatctaaaaaattgaattgtagcaataagtaatagtttacaatgtctataaaaattcactggggagggagactaataagaggattccagctgtctcattaagaaacgaactttctataaccttaatgtttaattatattttccaaaaatcattaatacatttatgtaattgtacatgaatcattgtaatgctcattcaatccagaagaaacgtaatacttagaaccttatgttcatatgagtgaacactttttaaaatttcaaaatatgtgcatatttttctaagaattattacaagatgatcagagaaagaaggaaattctattgggatagtagagtagaagtacaaattcaaggagaaaaaaagagcagtgtaaaatttctcaaagatatcttttaaatagatggtagtgttaaatcactgtatatttaaatctgttgaatatgttgaaagagttg

SEQ ID NO: 34093 - DNA, 1034 bp, Homo sapiens
taccccctactttgtatggtttacattggtttctatgtgaatcatttgattattgcattcatgttttatctcccaaatactgctagctcccttaggatgaggttattgttttatataaaagatccctttcaaaaaagtagtctcaaaaaaaaattgtaactcttgatttacatagcaaagtattaattaacagcatcttccaagatcagacgagattgagcgtgttcggggtggtatggcagtagacaagtaacagcatcttaattagttcacgtaaaacaaatctctagccacattcactccaactttcaatatcacaaaatgtgtggtatttcctaaaaacatagctttctatgtcatcatcaagtgaaagtaaatacctcccccctctataaaagaacaaaacctattcaacttaaataatgaaatatgttattgttaaaagaatcctagagtcacagaaactggatactgaaaaggaagtttgaactaagtcgatagcattgggagtgggtgtaaagagtggctaggaatgacatcttccttgttccccatacgcacatataccactctattttgccagatacaccaggcagctttttcaaatacacacacacacacccacctttacaccttaacctctcactgtggcattactagggtagtgagcctctgtgaatgatgaaagtgagtagtgtctttggtgtgttgagccaaaaaatagattgaaatcactgacaataccaatcctcatttgacacatatgaccattacagctttgagaagataaaatgacttgttccaaattacttttggcagagaaaataacctgaatctcaggtcaagttgtgctctatttcttttgtacatttaaaagtgtggggatcctcttggaattagcctgtgaaatgtatttgcattgaaaggtcaatctcaggaatttcagagcaaaggttttttttgtatgtatgggtgaaaggacacttacagttttagtatcaatgcaatttgatataaactcattagaaagtcta

SEQ ID NO: 34094 - DNA, 1052 bp, Homo sapiens
aaagtgaaaataaacagtgaaaagccattagtaagttgccaataatgttgattctttggttagcgtgataaatcaaatttcccagaggcagtcacataaattatagcattatgttgctaagatgaatttggccaaattatgcttcatttgtagcagagtcaatcttaaaactcaggtctcgtaactgcctgccaagactatccctttattttgtaggtgaaacctaggcaaagccaatttggtgctcactcaccccttcccagaaatgaagttggttgatggctcttttgaaagtattaagttcaggtatctgaaaaattggaggaatattagtaatagttaacctttatttagctactgagttggtgctgtacctgtttatctcgtttaatttttattctatctcatatgaggtagatgttgttatgcccattttactgtgttttattatctatctagtattcaaaggttcataacatcaaaaaagtcataataactgttacaatagctactgtagatccttatttttgacactaccctttactctgttttacatatcattttatttgtcatgcaactctgtgagagtctaagtatgaatgtctacattttaaatatgtaccaccttacactaaataggttgaagtaattttgcccaaactcacacagctaatagctgaaataagtgaagttttaactcaggtctgatttcaaatttcatttctttcctgctactttatcttacttcacatatataattttacctcttaccaaaataagactagtgttacctaggaagtggggtaggcatgatagatatgtttttttcttatacatgaaggagttcttatgattctcacgctctgattttctaaactaaaaatatgttcctgttccattgttatcaaaatgtaaaaatcagttaagtaccacaatatatgggggctttaaaaagttacttagaaaatatgcattgtacagtgagccgagatcgcgccactgcactccagcctgagcaacagagcgagactccgtctaaaaaaaaaaaagaa

SEQ ID NO: 34095 - DNA, 1064 bp, Homo sapiens
gccagagcaaagagattggacacaaaagatcattatattcaaagggctgcacatttgataagacattgcagaggttgaagagagcatagtatgttcttattctaaagacagtgggaaacaaatgaagctttttaaggatgtgggtggagggttgctggcaataatcatgttagccttaaaaaatcatttcatcattccagcaacctctaagaacagtctttgaggaatgtggcaagagtagacacgaggataaatgtgaggaagtggttcaaacagtgggaacagaacaaagtggacaaagctacttacatggaatatacaaaatttggcaattttggatgtaggaaaggagaaagaagatgcacagttcttaggtttctgggatgatggaaatgccgtttcctgagaatggaaatatcgcaagttttgagagaaaattattagatatctttatttggatatacctgtatgctgtgtcagttagagagatatcaagtaggcagtttgacacactggtgctctgaggagaaatttggacccaatatctagattttgggaatcatttatatgcatactttagagatatcgtatgttcggttccagatcagcaaaataaagtgagtttctcaatctattaaatgtgcaaaagaattatgtctaaaaaaacaattttttttattgtttcagaatactttattgctaaaaaaatgctagcaatcatctgagccttcagcaaatcatagtctttgctggtgggtcttgcctccataaagatgactgctgactgatcagggtggtggttgctgaaggttgaagtggctatggcagtttcttaagattaacagtgaagtttgccacatccattgactcttgttttcaggaaagatttctccatagcatgtgatgctgcttggcaacattttacccacaatataacttttaaaactggagtcaattctctctgccactgctttatcaactaagtttatgtaatatcctgaattatttgttgacatttcagtaaggttcacagcgtcttcaccaggagtagatttcatcgcaag

SEQ ID NO: 34096 - DNA, 1209 bp, Homo sapiens
cctgggcaccgtagggagacccgtctgtccaaaaaaataaaatttaaatgttagccagatgtggtagcacacacctgtggtcccacctattcgggaggctgaggtgggaggaccgcttggaccctggaggtcaagtctgtagtgagccatgatcgcgctactgcagtccagcatgggcaacagagcaagaccccatctcaaataaataaataaaactcagtaagtaatagagccagaattttgaactatgaataggtaagattaaaaaaaaagacattattttgtaatgtcttgtattatcagacaaggtaccagagacaaggaaaaagaaaggtgcactgaacagccaaagcaggactgacggaactcagaaatgggctgggaccagcctgggagaaagaaaacgcaaggcaaagaaaaggataaaacagccctgctgcactctggtgggactgataagaaatagcttctgtatcttggtattttgtaccttaaaaaaaattgaggagtggcaggaatagaaaacagaaacaatgtctctttggggtgagagacagaaacacgctgttcctctcagaggatgtggaaacattgatgacctctgcaagtgcaggcaggcagtatccacagctctgcatcaccactcggcgtcaccactgtgcaacccatcagtcctgtggtgcccgttcaagttacattgtataaatctgtcctacggcatctgtatcctcaccatctaataactttagcacagaatattgtttaagaatgatggagagggaaaagaagactttgagtcaacaaaacctttgtttgtttacatttaccatatcatccattctttgtagtatatatcagaagactttcattttaggtttttaaaaatcgtttatatgtaatgagttaaaaaccttagttatccagaaacatattctgagcaacatgtttttggtaccacctgctgtcttatatatttcttgtctgcatgcttctgtatacctagtaggtgtctgtaggcagatcaccttacattgtgatttcttttaaattgggaaaaaatatatgtcctttgaatatcttatggttcagcaggggcattagaaaatataaacaactgttgtgtgatatgtgcaaaagaaatgtgaacaatgtttaggagtaatatagagaagaaaatgacagtttctttgtatagaaatgatttgaaag

SEQ ID NO: 34097 - DNA, 1021 bp, Homo sapiens
acctgaatatttgtccctaatattagaaagcaaatggctcgcaaaaattctcaaagatagtgtgaatcatattcttttataacactggataaagggggaaaaaagtgacatttggggtattaaacctgagatgaacatcctaatccagagagtagctgatctttagacctacaggctgccagtgaggtgttgtcagatgttggagtttaggcatagacaaatgcactgggaagagaacagtgccactggctagtcacttcacttctgggcctcagttttctcatacctattttgtggattatgtgggttgctaattaagacacccatctacctttgatgttctttaaagtagaagaaagaaatttaaacaaatgaatgacactaaaaacagaacagaaaccaccaagatgtccttcaacaggtgaatggatgaataaactttgggaagtccagacaatggaagattatccagtgctaaaaagaaaatgagctataaggccatgacagtgcatggaagaaccttaaatatatatgactaaatggaagtagccaatccaaaaaggctacatactctgtaattccaaatatatgatattctggaaaaaacaaaactatggagactaaaaaagatcagtggttgtcagggattaggggaagggagggatgaataggcagagcacagaggatttttagggcagtgtaactactgtattcactacagtgctgggtacatctcactatatacttgacaatgtaacaatgtaggttcatcacttataacaaatgtaccactctgatgtgagttattgagtatagtgggcaggctgtgtgtatgtgagggcaaggagtatctgggaactctgtactttatgcccagttttactgtgaacctcaaactaccctaaaaattaagtctattttaaaaattaaacagggtgggaggaaatggaaggggagaaaataaaaaggctactcactgagcctttcctcatctccactgcctgtttcacacacttggcct

SEQ ID NO: 34098 - DNA, 1032 bp, Homo sapiens
atctccccctctgccctcccttgaccgttggctcccgcctccctccaccacatagagacatgcatcctttgccatcccttgttaaaagtatgtgcgtgcacagctacctacccttacagttaagagcaaatgcccttaaaagcaaatgccacttcttagatatcttttggcactcctggttctgagtacttaatacgttgctttgggatgaaggaaagaacagaatgctctgtatatgattaccttttatccttttgaaaacttgagtggactaattcttgcagataaattttagcaatgggcatttagttgtagaaggtaccacagatgaatatttggaatattatgtttctaaaagagtactgattgttttctacctccttttatttacttattttttaaaatttcagattgtagctgtctgcagagaggcagctcttctggctctggaagaagacattcaagccaatctcatcatgaaaagacatttcactcaggccttgagcactgtgacacctagaattcctgagtcattgagacgtttttatgaagattatcaagagaagagtgggctgcatacactctgagaaaatatatatattcaagatgctgaaaatcctttccagagaaaatttgtttctttttaaaattttttgagagtgttaaaaaaaattttactaggcaaaatgtttgaagtatgttcagtagaatttaggggctttggttcttacagattttcaagtcatgtaagtacagtgaaaatatctctgagcataagtttcaatcagttttacctggaaatttgtggtgtggtttaaaaaacaaatgtttagctttttcatttgcgacctagtctgttcatcccatgaagcgatttctttttccagaatctgtttgagtgtctttctaaaatgccaaacatgttggcatcaattttatacagggatataaaaaagtatatgtggataaattttttgtaatctttagggatataaaaaagtgtatgtggataaattttttgtaatctttatt

SEQ ID NO: 34099 - DNA, 1046 bp, Homo sapiens
tgttgttgtcttactctggagatgccaagtgtattttttctttctatgtaattttagattcgccttacaatgtaaatcttcacattggagataatattggttggaccttgcccatcttcactctagccttcgtatttgtgaaggactcagccaccttccttcttcaccccatgcttctcaccaaatttttgttgtcattgagggcacttggataactcaagttgatatttatagctgatcaatctatatgtgtcacagaactatgctgcctaaagtgatcttggctccttaatggtccttttggccccttggatagttaacagctgagtaattctaatctcttctgtgttttccttgccttaaccacaaattgtggtgctttttgtatattttatgtataaatcacaaagttgaattctgactatttttaagacaaaagtctgttaaacttttttattgtaaagaatatttattatgcgaatctctattattttatggtatttattgcaaaagactgttgaaatgtactcatgtttgaatataacaaaatatcaatacttaacggaaaataaggtgacacgaagaaagtacatatgttaactataatgcagaaaatatattaattaatgaaactgtctctcgatttcttcatttattagcctgtactattatgatgatttttgcttatttgctttgactttttcttcttacacacccattttacttctttccctatagatgttgaatctagacataggtgagcccaaattatgaactggataattaggttggtgcaaaagtaattgcagttttgggtcatttttaatggcaaaaacacagttacttttgcaccaacctagtatttcctggaaagtgcattaatcaaaattttgtaatccaaattatcttttaacaaatgctcaagtgagttattttgtacagtaaaaattttttgtaatactctctccctactttgactattttgtaagcatgaggttttgtgtatattatagtttcttgaaatggggcatatctacagtagaagc

SEQ ID NO: 34100 - DNA, 1072 bp, Homo sapiens
ttcagcaattacctttaacagaatagtttttatttatttttacatttattatacatttagaaagaagatgagagcaatagttttttattagtataaggcaaacttaactgattaaaccttcttaggaaaagcaatagttctgaaagatatgcaagaaaaaaaatgacaaaagtgaaagaactctagtgtttcaagaacaaggaatggctctatgagctatccctaggaaagcatatttaaaatgaactaaaataaggatcttttgcttagcacagaatgtatgaggtgtttttaaaagaggtggcctgaggcagtggttatatgggaattcatacaaatgttagagatttgttagtttttacattatacttctattaactgtagaattactattagtatagagacctcaagtgtttcttatttctgaagtcttcttagtagtgaaatgatgaggggtatagtaatgtccatttgtaataaaaatgattaatgaaaaatagaattttttattttttaacttttaggattcatcatatgctgaacatctttttaaagttctgactgtattgtgcaatgtcttttaattcatgtgtgttcttccttatctaaaaatcatttacatttacaaataagaatatttttacctgcaccaatcaagatacaattagtagctataaatgtaacattctatatgtaacagaataagaaaacaagagaaaaaaattgtaacttagcataattgaaacatgtgcctagccatctggagcacttctgcataatataaagacatttgacattttaaataaaggattttgaaataaacaagaattcttttgtgtcttccaaagacattgatttattgagactatgtgtggcttttcatcatatacaaaagattaatgatttcctaaaagtccttgcatttcttcattttataaaatgtatacacacagttaagaaaaatgaatccttgaagtcctgtgaagaaaggtgacaggaaatagttcaaagtatttcattttaaataacatcaaatattataaaatataaattttctcaaagtaaaaaaatg

SEQ ID NO: 34101 - DNA, 1016 bp, Homo sapiens
taaatacccatcagatacttgatatagatattctgtggttggagggcttaagtgagatgcagtttcaggtaaataacataaaatcagcagacctctaatctgaattgaatgtgttaaatcttatcaacctagagttttaaggaagagggaacaactgtcttcagtgagtaatggcgcgtgcattaataccagttactcaggaggctgaggcaggagaatcactttaacccaggagatggaggttgcagtgagctgagattgcctcattgcactccatcctgcctgggtgatacagtgagactccatctcacaaaacaagcaaacaaataaataaaaaaacaaaagaaatggccaagaagaaaaatgcctagctttcctgcaacaatttgggagattaccatcatctgtattaattcattcattctgttgtttaatgaaaatggctaaagtctggccttgccattgaggtttttaaaaattctggtaaaatatgcataacatataatttgccattttaatatttttaagtgtattattctgagtcattgaataatttcaaattgctctgcaactgtagccgtcatctatctccagaatgtttttgtttcccaaactgaaactctctacccattaaacactaactttccatttcctccaatcggcaagctccaggccaccactgttctgctttctgttcccatgaagttgactacttttgctaactgatataaatggaatcatacatatttgtttttctgtgtctggcttattttacttagcataatgtcctccaggtagatccaagttgtagtaaatgtcagaatttcctttttttttaaagaccgaatagtattccattgtatgtatatactacattttgtttatcaaaaatggacacttgggttcctttctcctttttccattgggcgtattgggttttaatattacacgtttgttataaaggcagatatagggtgatagaattcatactagatttggaaataatcaaactaggc

SEQ ID NO: 34102 - DNA, 1057 bp, Homo sapiens
ttcagaagtggagtatttcatttctaatgataaccatttaggaaaatttaagttggacaatgatacggggtggatttcagtagcatcctccctgatttctgacttgaaccaaaacttttttatcacagtcactgcaaaggataagggaaaccctccactttcttcccaagcaactgttcacataactgtcactgaggaaaactaccatacacctgaattctctcaaagccacatgagtgcaaccatccctgagagccatagcattgggtccattgtcagaactgtttctgcaagagatagagatgcagcgatgaatggcttgattaagtacagcatttcttcaggaaatgaagaaggcatttttgcaatcaattcttctacaggtatattaacactagccaaagctcttgattatgagctatgccagaaacacgaaatgacgattagtgctatagatggaggatgggttgcaagaactggttactgcagtgtgaccgtaaatgtgattgatgtgaatgataattctccagtattcctctctgatgactatttccctactgttttggaaaatgccccaagtggaacaacagttatccacctaaatgcaacagatgctgactctggaacaaatgctgtgattgcgtatactgtacagtcatctgacagtgacctctttgtcattgaccctaacacaggagtcataaccactcaaggcttcttggattttgaaaccaagcagagctaccatcttactgtgaaagccttcaatgtccccgatgaggaaaggtgtagctttgccactgttaatatacaattaaaagggacaaatgaatatgtgccccgttttgtttccaaactttactattttgaaatctcagaagcagctcctaaaggtactattgttggagaagtgtttgctagcgaccgtgatttgggcactgatggggaggtacactatttgatttttggtaatagtcgaaagaagggtttccagatcaataagaagactggacagatttatgtttctggaattcttgatcgagaaaaagaagaaagg

SEQ ID NO: 34103 - DNA, 1054 bp, Homo sapiens
tattttggagggcaaaccaaaaagatctgttgatggattagataaaagctatgaaggaaagaaaaggatcaaggatcactccactgtttgccctgaaacttataagaagcctttatagtccaaatgagtcattgttttgctaatgctttaatcagtatgaaatttagagattatgggtcaaaggaagacaaaatactgttttaaatatatattttttcaatttattacagaattatctgttcatttagaacacatttattaagcacctactatgaaccaggcactgctggttttaaaacacacaaagaagattgcatattgtctcttccctggggaaaaaagcttataattttctatcttccactgtggaagacagatctataaactgctaatataatataatatacatactaataatataggcctgtgaacaaagtgttccctagaaaagtcaagggacactttatccatgaagtctcctttaggatatggtatttaagttttgaggaagagtagaaattttcctgcagataagaagaatgtcattgcaggcactgaagtatttggatcagccaattcagattactctgtgaaaacattttaaagtaacactggtaataccagttaatactaacaatacctattaatttacagaaaaagaaaggactaaatagtggagaccattcagattctgcaaagtcagtgtcttctcttaaccctgttaaagaacatggtgtgttgtttgaatgttcacctggaaactggactgatcagaaaaaagcaccaccagttatggcttactgggtagtagggtaagtgagaaaaaaaagtatttgaaagtaaagtgttagaaaagtgaaagaaaagtggtaaaggagattaacattttaaaatgtaagcatggaattttttatctagctatactattttaatatatttcattttatttgctaagtatctcctttaaatccctcccaagtatttttctattgaaaattatcttacaaaattaaatttcagtaatacactgaaagaataattccagtttttctct

SEQ ID NO: 34104 - DNA, 1060 bp, Homo sapiens
aatagctaggactacaggtgcatgccaccatgccacactaattttatttttttccaacagagacaaggtcttgccatattgcctaggctagtctcgaactcctggcctcaagccatcttcccatcttggcctcccaaagtgctgggattataggcgtgaaccaacgtgcctggccagtaattcttttaagttatgttaaggacatgtaaaaatcttactttgtttttaaaattcataaaaaatacatacaaaacatattagtgtaaacatttggagaaaaagtagtgtggaagacaataaactactattaataatggatagatacttctcagaggtagaattatggaggaggtgcttttaatttatagtctgtaattaatactttgtaatagggaatatggattttctttaaatgaaactgtgtcaagatttttgttaggaatattttatcatcaaaattctttatgattcttcaatattcagttctctggttttctatcttattttttcctatttctttactagcatatgaataatctggaaatatgggaaaatgctgtttaaacactgtttcagatgagtgagacccctcttaaatgcatgaaaatagaaatcactttggtgcactgaaaacaacagcacatagaaaatgccaaatcggggggttaactgtggctataatagatgggcattttctggtgatggcagtttgggatgaagaagaggcttttacctttttttgttaaatattctttttactacatgagttggttttatatgttttactatttgagcttatattttatttaaaatattttaaatgctgaagaattacacaaagtaagtctcccccttcatcccttcccaaccacatcctaaagtttgatttatgtttctagctatacaagtatgtgattatatgtacataactgggattttttaacaaaagcagaattacattacattctgctttcattaaaaaatagtttttaagtattttgcaaattgctttcttttcacctcaaaatattgtggacatctcaaacttatggctctaatt

SEQ ID NO: 34105 - DNA, 1060 bp, Homo sapiens
tcatataatttttcaggacaaaatgagttaatgtgtacaaaattcttggaaagcctggcatagggtagctgctataatatatattagctatttttattgttgtttctattgttaggttgttaagtcatctatcaggaagcataaattatttatccataaatgtaattacaggaagcattttctaaaatgattcccattgattttagaaacctttctatccaagcgttctaatcgtaattttacttctgtgtgcttcttacaaattaggtttataatcatttttacattgattcttttgtccagacttatgatctctctccagtatgcacagagtagagtttacttaggagataaactgcaacactgcaagagtattctgtcttaatttatattactataatagcatctttgtaatcaaaaaattaaagggaaatgactcagactgaatatagggtaattttcagtatagattgacttaatccttggcctttagtcttacatattaacttactttaaaaagaacgtttttttccttcctttttagtaggtaactttgtagtgaaatacgatttttagatcacagacccgtttgaaaatctgatcaaggctatagcccttcttccaaaatacacacctgtactagttatataccaagataattttgcatttgattttgggtaatactagacttcatgagaggtctatacatggattctccatgctagtctgtggggcgacattccacgcagattgtactcatatcctcctgtgatatttaccaccatactaccaccccaccacccaccttataatgaaagagctgcaaaaccaccccaacagtaggattctttattagtgactgttgtaagtagtcatttaaccctagggagagagcctagatgtttggtcctatgttttcaagaactgtagtgttgaatttctatgactctcttctgctgggaagcctgttgctcaaccagcttgttacattgttacctggtttttttgttggttggttttttggttgtgttttttgtttttttgtgtgttttgtttttgt

SEQ ID NO: 34106 - DNA, 1030 bp, Homo sapiens
gggcccatatggggaaggttcttatttttacaagttgcagaagtatggtgaaaaacatatttttgaataagaagttagaaaattttgaaatttaatattttatacttgaaaaacattctgtccttccatgatttttaattttttttttatttatttatttgagacagcatctagctctgtcgcccaggctggagtgcagtggcacgatttcagctcactgcaacttctacttcccgggctcaagcagtcctctcacctcaccctcataagtagatgggaatacaggcacatgccatcatgcctggctaattttttaatttgttgtagaaatatgattttgccatattgcccaggctggtctcttagttctgggctcaagcgatcctcccaccttggcctttcaaagtgttgggattacaggcatgaggcactgcactgcactgagcccaatgatgacttttatttctaaggaaagtatttttaattagtgtctctcaaatatattactaggacttgagtaaactgtctgcagtattggaagacacagaaaattggctttatgaagacggagaggaccaacctaaacaagtttatgtggataagcttcaagaactaaaggtacatttttttaaagtccatgttagtataaaccagtaactttttctaaaaattagggtgtaagagcacagtttatgttctattaatttttaattttttaattgagaggaaaattgtatatatttgtggtgtacgacatgttttgattatgcacacattgtggaatggctaagtcaaactatttaacaaatgcattacctcacatacatttctttctttgggggggagaacacttaaaatctactctctcaaccaattttcaaatatacagtatattgttaagtatatatggtaactgtggttaccatgatgtacaatagatctcttggacttactcctcttgtctaattcaaatgttgtgtcctttgaccagtagctctccatcataccatcccctgataaccaccaattc

SEQ ID NO: 34107 - DNA, 1055 bp, Homo sapiens
ctcctgacctcaggtaatccacccacctcagactcccaaagtgctgggattacaggcgtgagccaccatacccggccaaaaatttttgcttttaaagttaatgttattttgtggttaaacttctaaagttttgaactgtaagcagaattttgttttgtgatattttattgtataaactgttaatgagaggcacagctaattgtacatatcaatatacatttaaaatctggtaacactggttaaatagcccttgatgacttttcatgtggcatgagagggatatgcttataaagcttaattctgatattatcctcttactacctacagtatgttttgcaaaaatcagtccacttagcaaactaatctttgtaaagcagtcagtttcagaagatactttttatcaaaaaagatggcaggtttaacattataccttttggtttttgcccaacatttgatttaatctaaagcaagaatataaaataattttaagaagcatataatttcttttgataaaaagtaacaaaaatttaatgcagatcaaagaccaaggcttgtaaccaaaacaagcaaaaagaaactttagctgtttaactatcacctctctaatttaaaatgcatgaaaattaatactttgtttttgttttttttttggaaacagtctcactctgtcacccaggctggagggcacaatctctgctcactgcaacctccacctcctgggctcaagcctcaagcaattctcctgcctcagcctcccaagtagctgggattacaggaacccaccaccacgcccagctaatttttgtatttttagtagatggggtttcatcatgttggccaggctggttttgaactcctgacttcaaatgatccacccacatccacctgccagagtgctgagattacaggcgtgagccaccgcacctggccaatgttcttttatatactcatgttttctaacaaaacagctttggatttataatgctgccagatgtcattacaattttttttctaaattcaaaggtaattattctaaacaataaaagggcacctgg

SEQ ID NO: 34108 - DNA, 1036 bp, Homo sapiens
tgacaatttaccaggtatgtgaatttaccagggaataaattttgatagtagatttatatgtatatacgtataaactctatatatagatataataaattataaatagcttcagtcaaactttaggtcatatcatattcttgtactttgtttctggtgagagttgtatgcctttaatgcaatgtttattattaatattctgtgttataatggtactatattctatttaaaaactaactctagaacattagtcatatgtctcacaaatgtaatttgtatacttgtttagaatgtggctatagttatgttaaaaaaaattcaacattgtgcttgcttcagagcacatatactaaagttggaatgttacagagaacatggcccctgtgactcacaaatttgtgaagcattctgcatttaaaaaataattcaccatgtatgtggcttttgagctttgaaatcagtgctgctacataaatgattatttataattatagttaaccaaatttgactcccagtttggtttctggatattatggactatggacataagtactgaatagtaagccttcattgaggtaactcttagaaaagaataagaaaacctgtctaatgtaaccctattagaaatcacaataaatagataaaactgtatgtcaggtcaacactttcttccctaatgttaagtattttttttccttagaaaaatactggcgaaaatatcaatatgcttccaggtttgtacagcttgtaagatctaaatctcccaaaatcacttattttacaagatatgctaaatgcattttgatggagaattctcctggtgctgattttgaggtttggttttatgatggtaagtaccatttggaaatggtaatttgttcctttagtttgtaatttagtagttacgtatatgtgggtttttaaaattcaacacagtcagttttaaagatgtgtatgtatataactatacatataaattgcacagcggagtatacatgtcaaatcatattaatcaaaatttatctagccttcctttaaa

SEQ ID NO: 34109 - DNA, 1032 bp, Homo sapiens
attttgattaaaaataaacctacagaagtgtactgtatagaaagaccttttaagttccaacaatttttaaatgcttttaatgttattgccagggctgtgtgcgttagtgatgtgacatttactcttttttttttttttttttttttgagatggagtttcgcttttgttgcccaggctggagtgcaatagcgccatctcggctcactgcaacctccacctcccaggttcaagcgattctcctgcgtcagcctcctgagtagctgggattacaggcatgtgccaccacgcccggctaattttgtatttttagtagagatagggtttctccgtgttggtcaggccagtcgacacttcactctttaaagtatttcagtatgagccaaagtagtaaatgactacactgcatttattgcagtagacaaaccttgctgagccaaggaaatgtgaaaagtaggagtaataatggctttagtatagaccctagtagaacaagagactaattttaccttgaataagatgtgcatttagcttaactatggcttaatagcaactgagatgccataatttccttataatttatagattttaatctaagatttttcagagaacttgacttcctaatagttgtactgtcataattaggaagtgactcacattgatatttttgagaagtttacatgaatgtagtggtctgtgtaagacttggtgacatgctttaattattcagtggcttcacttttgagtaaatcttatgagcccttcaggtttgaaaatcactggaaagcttacagttgagactgatcatgtttttgtgaaaaaatatcaagccccagttaaggaaaaaatgaagtgtattttgtaagtaagaaaagccattatcattttaactatagaactaacttaaaattttagagtctgccccaaattctccaagaattggaagcccattgagcccaaagaaaaacagtgaaacaagtattcttcaagcaatgtctagaggtttgtctaccagtttgcctgacttggactcag

SEQ ID NO: 34110 - DNA, 1029 bp, Homo sapiens
ttttggttgctttttgaatgctttcttaatatctggcgatttttggttgatagttcatattaatattagtaaatatgcatggttttcttgtttgatctaatctgctcatctagtgggctgttttgtttaatgtgaggtatgattccacagtctttttttttttttgagacagagtttcgctcttgttgcccaggctggagtgcaatggcagtgtgatctcggctcactgtaacctccgcctcccaggttcaagcaattcttctgcctcagcctcccgagtagctgggattacaggcacccgccgccatgcccagctaatttttttgtgtatttttaatagagatggggtttcaccatgttggccaggctggtctcgaactcctgacctcaggtgatccacctgcctcggcctcccaaagtgctgggattacaggcgtgagccactgtgcccagctgattgcacgttcttggtaagtgaaaacgtcctatggacttggacacctaggcagagaatagggatgctggctctttttctccaaaattgctaaaacaaaaaaagcagtacttttctctgggatgtagaatttcttagtgtatctcattcattggtgaaattaccttttcttttcctccccccagctctattttagaggttcagaataatgctaggatgtgttcaacttctgttcagccccagtacacaaaacatgagccctctcttgtcaaatcttattttgtttagaaagtaattcttgggcttttagttgggagcgatctttatatagttttatattctgagataaagggattggattgactgttccagctgtgttctatagttggttttccaaatacctattttgattgccatccaatagtccattcctactccttgtaactgccatctcaaaactttctagaaccctggcgggatcaatggcttttgcttcccctttaacctttgtatcagttctaggttgctgttttctctgcttttgtttattatcaatacaatcccatttattttct

SEQ ID NO: 34111 - DNA, 1417 bp, Homo sapiens
tatggatggaagaagatgaaaacaaacacacagccataaaggtaattgtttctggccaacatctttctactgatgctttgttttgattgtatgttgctgtttatattttctcaaacttgaggctctattttatgaaatgttgaatataaatacattgtatttaacttgaaaaattcctggaaatatacctgataattaccacctgaggaatcgttttattttatgaaagtaacagcgtgatgaatactgtaattacaaaagaaaattagtactcactgacttatacccttgtttttttttttttttgttttgtttttttttgtttttgttttaggtgacaatactgagaacgccctttctcgtatgaaagaataaaaacaagttactgtggacaggcttaatttatatgctcattgcttacctggctctcaccgcagctgtatgagccagtggctttagagagcactcttcttgcctctttctgttttccccacttagtctatggtgcatgatctaaggtagtggaaatggttgtggacaaactataaatgactaaactggatgattatctctcttggtctagtcattactgtggtgctagggttactttttacaatcttgttctaattttttttaacttcttgcatttcatcccagatcctggttcctatcctagttattaaggtaaaatagagaaccagaatagtttatcaggtatctgcattccttcaatatgaattataatggtacagatatggggataaaaggaatctttttctgctattaagtttatcagaaaagccccaatagttaaatatttgttttcagtagagggtataataagggaaaattatataacattatatgccaaataggaaactgatcttggttggaaataaagttgtaggaagaaaagctagccaattagtggctgagtagaggggactgcctgtcggtggggcttcatatcatcaacaagaagtgtgctagccttcttggctcctcatttcttttcttcctggaatccccagtactgcttttagccttctgtaaccactgccttcttggaggacctgcctcaggctatgatagcttgttacgtgacttagagccttagcagttctctgcctgtcctactgctgtgggaaaggaagtgtgtttttataatgcttctcagttgaaagtctttcctagtgtaagcattgctattttatttgtaatacttaggttcggtaagtaatacctatcttaaatccttttagaacagagatactagtacattctactaataatcagttaaaattatccttcccccattctctatccctttacccagctttgtttttcaccatagcatatatcattatctataattctatatattttacttacttttattctcttggagaaaaaacta

SEQ ID NO: 34112 - DNA, 1144 bp, Homo sapiens
gcctgtagtttgctgacctctgctgtagagccacaaactgtggttacatgcacgtacatggatcagtctcataaacataattttgcatgaaagaaaccatgtggtgtaattcaatttttataaagttcagaaacatgcaaaacacctactgtattgaaggtgtatgagctattttgggggagaaagaggagatcctgaccagaagggacatgaaaaggaagcttctagggtgctaataattgctttacctgaatggtgattaagtctgtttaccttcgattattcattgagatatatacttatgatttgtacacttcttgtgtgtgtgtgtgtgtgtatgttatacattaatgaattagttaaaaataaaaataaacaaaaacatacacaacttgtgtttccatcagggtagaattgtgttatttatctctggcatgtagtaaacatacaataattatttatagaattgggagttgctaatagcaagctctgtagcaagataaaggacaagaggagtgagcaatgattctgatttagcctgaagagcttattgaaaacttttgaggaagaaatgttgataaatatacattttgatgtaattaaaggtactttagtgaaaaaagatcataatctaaaaggctaacattgggatttaataaatggtttgagctgacaagtgacttcatctttgaagacagaaggaaaagattcttttgttattaagagcaagctacaactattttgtaatgatatttaatttccttcctgttttaaatttgcttcaacccgaaaaattctttcttatgttttttacttgcttaaacccgctttggatgttgccctgtaaagattcatgtacccattagtaccatgtggagtagatgtgatatagggttttattgggaaaaacttagaagaaatagtggagtgtaagcagtccctcaaactccttttttatctcacagtttaggccagacatagagggtctttatggttcacctgggtgaaccatagggttcaacctttagggttcaacctttaagttcacctgtggccaagtgaacttccagtagagaatgacctctaccctctgtaatgctccacacatttgtaggtcagggccggaaacacttaagtgactatg

SEQ ID NO: 34113 - DNA, 1037 bp, Homo sapiens
ctcaaatctctgtaagaatatgtcatatgtagtattgaatactattaggagatacataatgctctattgtctctttttgtaatgttagcagtcattgatgatcagtgagtgaagcttttattttactaggggttgcaaaatagtgatgattctatttttaatcattacgtcttaccttaataggtagaatacttttataaagagaactttccccagaatatttatttattctgagatagagttcttacaggaaagtgagtcagtgctgaattatttccctttgtttactagtttcaaagtactagctggttccttaacattcttcgctggtgactaatgaagtttttgtttgtttgtttttaaatgatcattgtgaactcataaatacatgagatgggtttcattctattacagttattattattattattgatacctatgccagttatcagtttattgacttttagctctaaagccacctttcattttcttgctcagtaataatggagttggactgttaactttaatgtttcccaccccacagaaggttgagcccccaccaaggttgagctttgtcagtaccggatctgctactcagttggtccttgtttctaggccttttgaatagaaagagctaggaaattttttaaggagaaaaatatattacgtattcatgttgatattttctgtctaaatttaagattataggttttaattttaatttctttgattttgtagttgtattgctttttacttatatataaaaaatctttcttcctaaccacagtaacataattatttatttgctaatcctatgatataatagttccagaataacaataacattaaataataatattataaatactgaaaggtaacttcttttagagttctttaaactgtaaacttttaaaaacttcatactttaaagctttctttaaagttcttagtgtgtcccactagggctgttcagttaaattgctggattttttgccttgttaaatttgaatactttaaaattgagaatgtatattcct

SEQ ID NO: 34114 - DNA, 1964 bp, Homo sapiens
attcatatatgttgtccttgtttgctttgaaatttagtttgtctgattttaatatagccattccagctttctttcatttctttctcatggtatgtgatgtatcttttgccaactttttacttttaacgtacccatatcattatatttgaagtcagtttattatagatagcatatagttagttcatgttttttattcagtctgacagtatatcttttaattggtatgttttgactaatgtaattattggtatgtttggatttaggtcaacctttttattattcattttctttttcttttctttttttttttttttttggcttctattgcccattttgtgcattctttgtgttgtttgtaactttttccattacattttaatttatgtactatgaatttggacatatatatctttttttgtataattgtttttagtgattgctctaggggttgcaaaacacatacttttcagtttatttggaatcagtattttaccatttcaataagaatgtagaaacctaacctccatagagattttttttttttcctttctctccccaccggccccaccccaagagatagggtctcactctgttgccaaggctggagtgcagtggtctagtcatggctcactgcagcctcatactgctgggttcaagcaatcctaccacctcagcctcccgagtaggtcggactacaggtgcacgccacaaagcccaactaatttttttattttttgtggagacagggtctcactacattgaccagattggtctagtactgctggctggcctcaagagattctcctacctcagcctcccaaagtgctgggattataggcatgaatcaccacactcagctgaaatttctttatgtaataattgtcttatatatcttcatatgttaaaaagcccatcagacaatgtttgattgtctttcaagcgtgttttactttcaagcgtgttttaaataacttaaaaggagaatagtctattatatttatctggacctttaccgtttatcttgctgttcctctatttgtgatgtttcaggtttcctttgttatcattttcttctgtctgaaatactcaggttagcaattcttttagagcagttcagttggctatgatttatagttttctttcttctgagaatgtctttatttcacctcattgccaaggatattttcactggataaagaattctgaactgacaattgttttctgttagtgattcaaaactgttgtaccactcctttctgtcctccatggtttttggtataataatttatagtcattcaaattgtttccctacaagtaatgcatctctagctactttcaagattttttttttttttcatctgacatttacagcaaatagagtgtgatgtgccttggtatggagttctttgggtttatcctggatgggattctctgtttcttaaatctgtaggtttgactttagacaaatttgggaagttctcagctattatttcctcaaaaaaaatttttagccctgcatttcttctctcctagaccttttgttgtctcacaggttcttaaggattggctgattattttttttcaatttctttttttttctgttgttgaggttgcttttctgttttcggttcaatttctgttgattctggctgcttttaatgtttcctctgtcacctattttaagcaccttaattacgattgctttggtgtacttttcatgtttcttgtgcttgaactcactggatttttaaaatatgtgtgtttatacatttttaatcaaatttggaaagtgttcagctgttcctttaaatttaaaattttaattaaaaaattaataggctgggtgtggcagctcatgcctataatcccagcactttgggaggccaaggcgggtgtatcacctgaggtcaggagttcgagaccagcctggccaacatggtgaaaccccatctctactaaaaata

SEQ ID NO: 34115 - DNA, 1043 bp, Homo sapiens
gtcaccaagaacaaagtggaaaatgacaacagatgaggcaaaatcagcaaaatctcatatgccagggtaaagagcctaggcttattctagaggcaaatgggaaacactgaaggatgttaagcagaaatatgaaatgatctaatttgctcctcagaataatcattctggtaacagtgaagaaaatggattgggagaggaaatggcaaatgtgtaagttcacttttgactttacaaattcgtgcctagaatagtgcttggcaaatagcgggcacttagtatttgttgagtgaaaaaacaaaaagttgttatatgaatcaaaaaaagtcgataagtctgaagaaaaaccacacagaaatagtgcctatttttttttgttgctactgcttgattcatctgctggcttgtttgttatcttaccataagattttcatgaacaaatcagtaagtaaaataaccgaataaaaaaaacagtcaaaggatttgaatagcaggcttacaaaagaggaagtctgaagggtaactagaaatatgaaaacatgctcaatttcactagcaacaactagatcatttaaatcccatgagatggaagaatatttaagagtttgcacaaaacccagtcttcaccagaatgttgaattggaattctcacatgctgctggtgagagtgtaagttggtgaaatcattatggaaagtggtttggctgtcagtagtcattaagttagaagatgcttatctcttttgactcagcatttccactcagatataaaccctagagaaatgcttgtacctgtacagagacatgttcagcaatgttgatcacagcattgttgattaaacaaaaaactttgaaataacataaatgtctatctgcaggagaatggataaattgtgatatatttgtacaccacatactattcagcaatgaaaatgaacaaattagagctatgtaaataaaacatgaaaaaagtttacaaagtgatatatatatatatatatatatatagcattatgttacataaagttaattatgcaaaataatatt

SEQ ID NO: 34116 - DNA, 1024 bp, Homo sapiens
ttgagaccatcctggctaacacggtgaaaccccgtctctgctaaaaatacacaaaaattagccgggcatggtggcgggcgcctgtagtcccagctactcgggaggctgaggcaggagaatggcgtgaacccgggaggcggagcttgcagtgagccaagatctcgccactgcactccagcctgggcgacagagcaagactctgtctcaaaaaaaaaaaaaaaaaaaaaaaaaaaaagttttcttggctggatgtggtggcgctcactggtaatcccaactacttaggaggctgaggcaggagaatcgcttgaacctaggaggtggaaattgcagtgagctgggatggggccactgcactccaacctgggcaactgagtgagactccatcgcaaaaaaaaaaaagttttctttttttctgctgaaattctccatctcttcatgaatgttcatcttttacattagagtcttcaacatattaatcatggttattttaaagttcatttgtgattatgctagtactgagttatctgtaagtctggttctattcattgtctcctgaattttattttttctttttgtgtgtcttatacattttgattgaattctagattattacttctagacttttttttgttgttgaaatcttgccaaatcccagtctgaataaatccagctttctattatatttgctcctagtctactgaatgttgctaaagtaagtcctaggcttattgatagtaatatagattcatgtgctgtaattatagttagagcttcgatgttatctgcatttcttttactaatctaagtattcgatattaattttatcttcgttctttccttttgattgaggaattctttatctctcattgttccatcttttgaaaactgttttcaaatttctatttgttagtcttcattttgatctacctctttgcttccttctggctccctgtgataagtatgccagtaaggtatatttattcattgtggagaatttatttaatgatagctaccactttta

SEQ ID NO: 34117 - DNA, 1070 bp, Homo sapiens
tgaaagttctttgtccttgaagtcaacatttacatcagtatttatttggggaaaatcttctggtgtttaattgtgataataagaaagaagaaaaagaaagaaaagtggtagcattttttctaacaagataaattctaaaaatgttttccctgatttcacaaacaaggatagtcttggtgaccttttatagagatcttctagtaatgtattttgatctcagatttctttttcaaagccatggttttacaaaaacagcattccttaaatatatttaaaaaacaatacaaggaatgcctaacatttcagctcatacttcttaaagaagatatagtatgttgtattctcttcttagagctttcttaaagaatccacaatccaattaccccactgtcaattcatatttgaacttaccaaaacaaaggaggattacgtatatgttttttaaattcaaaaaagaatatgaaattatacctttagtatccctttgagacatatagtttaaagaaaactttttttaaaacaaaagtaggaatatatagtaagattgtagttacaatgagtatatgcacttttgatgctaggttttgcttttctccccccagtcatatctcatgatttccacagttgttgtattggtgtggagttttctgaattggctataagctgattacatattagaggtttatttttatgattctatataaacgtgcacgagtaatttaaaacctgcattgggattgattggaatattgtcctaaattaattaaatcttgcactgttttgaatgcatctgctatttatacatctgcaagtgggtatgtcataaggagtcagattatctttaatttaaaatgaatacttagttttacctttttgtttattttttgtttaattttgtttttataaatgttttcaagagttatagcaaattgatttctaatttttattgctattacaactgatgtaaatggtagtttcagtttttgtgagatttaaaaaaataaagcacttattctgaattttttgaattgatttttaattatttttatttagaatatagttgaaaagct

SEQ ID NO: 34118 - DNA, 1059 bp, Homo sapiens
cttcagctatacagaagccatatgttgaaaacaacagagccctgaggagtagccctgaatcactacctagtccttttggggactctatattaaatcaagaaatagcttttaattatattaagccacaagattttgaactttatctgttacagtagctaatattaacttaagtgataataacaaatttactacttatgtttaataattaccaaaatgtgtatatattgttgttgtctcgatcaattctatattaatatttgtaataactcaagaaaagtttttatcaactagaaccacttatagtcagagtaaagtaaaattttaaattatgtacttatttttgttttaatacatttacatatctggtcaataatattttcaaacataaaaacattatgataaaaatctggaaaaaatgggatagaatacaagctcaaggagaaaaaggaaagatgtaagctttctaaaagttaaagaataacttgctcatatatttaaaaaaatagatccaaatgttatatatttggatttcgttggattcgcttaaaatgaaatttataatatgctggaaattatgacctatgcaattatttaaaattataaaaagcttagatgtcagcttaaagcttcatgagggatatatagcttatgaaaattattttagggggttttcaagcaaaaaagtgtaaatgcactgacaaaagggggaaggtgcatgctttggagttaagtagccctgcatccaaactctgcttttgctatatgactgggcaagttagattaacccattggcccttattctgctcaataaattaaatgaaaatacatgtaaagtgctatctggcactaacctgctcttgctattaaaaatcttaagtacttctaggaaggaaaaattagccactcaggtgaaaattaattaatcagagcccatatttctgagagtagattaaaaaattaggtacagaggggaaagaacttatttgggagagaaaggataattttagaacatgtagtataagccaagagaagaagctctgttacatggcagaatgatac

SEQ ID NO: 34119 - DNA, 1046 bp, Homo sapiens
gtgagcacttcccatttgccagcaggggctaatggtgtaggccaaccatggaagaacgtgaagctcatctcagtttagctgactggatgcagcctgcagcaagcatgtgttgttgtttcatacattcctgtctttgctctgtgtgcacatttgggtttcatcttttcctcctagcggcacacgttcccatagactttgtgcttgcatgtattaaggaacattgcgttgtcaaaaggtaataataagagcagctaaaaattattgagaacacgtgatgttgtaggcactcttttaaacatttttatatgcatttaatccttgcaacaatactgtaaggtagttattatcccattttatggatgaagaaaataaagtactgagaggttatgttactttcccagggccacatggctagtaaattctaaagcccaagctattgaccttgagcctatgctcactccaggctttggagttgtaggagatgtgcaaggcttaatgaacactgagtgaacttatgaggcagttcagtcatctgacatcctcattaaatctgatttgaagaaatgacagagagaaagttgatagagcttagaaatttggttctaggtgagaccttaaaagtcatgtcaccaaggaataagagaccctcaagaggttagataagtcctctgtgcatcatttcctcctgacctgtatctcaacgtcaaagctgtcaacaaaaatgaacagggagcagcacttagtttgtatgatgtattcataatgtttggggtgccaaacagaagtcttatgacatggtatttttgcccggctaggtttttctatactagggcatggccatggttttaatgctttatttattaaagttattagaagataaatatgtgcaatcattgaaacttttcttattttcaaataagaaagggaaacttaaaaaatttagatttagcaactaacttttatttagaactgccatatgatctaacataaagttttcttacaatctgaatttgaaacattcaggattattttactaagatctgaaa

SEQ ID NO: 34120 - DNA, 1046 bp, Homo sapiens
ttgtttgttggttccgcgccgccttcctcgccggatggcttcctgtgacagaggtgatacacagtttccagaactgtctgggggcgggagcgggagcgggagccgagcccgctcggagctcctcgccgccgctgccgctcccatcttaaaaccgtttctcgccggcgcgcccgccccagcccgaaggtgccgccccggagggactcggggagggggacggcgcggccgtttccagcggcgcaagtggcttctggacgcgagggagcgtttgatttgcaactggggccgagcggattggtgcagctggcggcggcggggcgggaggagctgccgcggcggggggtggccactttcaaatggagagggcggcggcggcggggacgccgctgcggagggagcggggcttggttgcgccacgagaaggtgtcatcactgcaccggggctaattccggcggaggtgccgggagttactttcccctcctcccgcgctgttgtttctgtcgcctcgggaggaggaggaggaggaggattgggagagagggaggggtcggcgccgcgcggaaccgcggccctgcgcattccccggcgggcggcgggagccgcgcggagcgttcgccgctgcggggcggcggccgagctcccccacaaccccggggtgccccccttgctgggatccttagccttctcacgtcccctctcactccgccaccctcccactagagctccttattctcgagtcctcaaccccggcttggcgcgtcccgggtctcccctcgccccaggattcctcccgcgccaggctccgctggccccaggtttcccaccccaagcgggtgggggcggccgcagtcccggcgccggtgaatgctgagagcaaacaaaaaagcgggcgatttaaacatgccttcgaaacccgttaggaatgcgtcgtcatccggagaccgtttaaaaggagctttagcttgccttctagtaacgagagggctggcgccctgccttacttcggcaggggcgaggggctgtcgccctctatttgccccggcca

SEQ ID NO: 34121 - DNA, 1067 bp, Homo sapiens
aatctgtgttgtgagacttgtaggcagagtctacgttgtgagactgagacttcagcctcagagagtgctttctagaccttgcttctaggtttgagaccaacttaggtttccatgatcataataacgaggcttgtacaattgtgatgaaacgtttgttttcatatgtaacttggatgattgtgtaaatgttgtttttgtcaagtgtgtcatctaggttttcaaatatacaacattgggagtctctctcttttttttttttaaaacagtactttaaaaatttttggtgacttaacattgttagtggtaacggatagtttctgacaaccgggtataatcaaggaacaaagttcctgaaaaacagctgcatttcaatctgtgcacagtgtaattgtcattagctggtggagtctggtttctgcagaagctgatttgtatatcctgtataagaacatctggtttgagcatttaaaaatcttttaaaattaccctgtagacatttagcatttattggcttactccaccaaggatggaataatgggttgtagaatcctttctcatgcttattcttaccttcgttcattcagaagcacttggttttcctaaagtgtctaatgagcttttagagtttgatatgaagtgtgtaggtttgtattatagaaattagtacctggttcagagacccccaaggcagaatggaacacaaactcctgatttcagtgaaatgctttaaaaaataaacatttcatttttgtatattctgaagagattaatctgaccctagctttccctgataaattgtcagaaaactgagacgcggaataagacatatagggcaaatgggctttatctctcttggtgatagcactgtgttaaggaggattctgaagatatgtgcctgggggtgtggaaaagaatgacctaatttgtcaaccatgccttgccataggtggaaggaatggcataattgccagctacctcttgaacatagcctttttaaattttttccaaagtagtactactgtgataatggataaggagttgaaatggcttcttcttttttttttttt

SEQ ID NO: 34122 - DNA, 1058 bp, Homo sapiens
gccttacctcttttaaaacatgacaggatcttgcagggttaatccacgtacaactttcctgtcatggcacatgcttgaagcatggctcttctctgtgcatgtgtacatggggtgcctagcactgcaggccttctgccatcattgctctataatggtctattctcatgttctttgtgtgttcttgacagtgctctgtgaagaactgccgcacagccttccatgtgacctgtgcttttgaccggggcctggagatgaagaccatcttagcagagaatgatgaagtcaagttcaagtcctattgcccaaagcacagctcacataggaaacccgaggagagtcttggcaagggggctgcacaggagaatggggcccctgagtgttccccccggaatccgctggagccctttgccagccttgagcagaaccgggaggaggcccaccgggtgagtgtccgtaagcagaagctgcagcagttggaggatgagttctacaccttcgtcaacctgctggatgttgccagggctctgcggctgcctgaggaagtagtggatttcctgtaccagtactggaagttgaagaggaaggtcaacttcaacaagcccctgatcaccccaaagaaagatgaagaggacaatctagccaagcgggagcaggatgtcttatttaggaggctgcagctgttcacgcacctgcggcaggacctggagagggtaatgattgacactgacaccttatagtgacttagagaagaagatgcaaagaggcgaacgctcgcccagagcaagaaatgatagccagtcatatactctcagacccttgtacacaccacagcatgaggttgtgttggttaaaaatatttatgggctggtaaactcattgtacatatgtgcaaaactgctactgagtggggagcttctttgtggtttttttttttttaaaaacactttcccattaatctttactgttttgtaagatcaaatggggtgtgtcttccccacccccattccttcattctagagctagagtgaatgagccccaagaaaatgacccaaggagtt

SEQ ID NO: 34123 - DNA, 1027 bp, Homo sapiens
cagctacctaaaaaccttctcaggatccttttcctctcaaggtaagttttgtccttcttaatatgatctctgtataagactttccatgacctggccccttattctctgtagcaccaccagcttctcctacattgaaaggtttgcctggtaagactgaactgttcatagttctttaaataagctacaatatttcctaattgtgtacccttgattttactgttttcttgccctagaatgctgtttctatcattcttcacctagttccaaatcatctttcaagacagagcttaaatagcaacttctcctggaatccttcactaaaccacttttttgagctaaacatctgtttctattttttcctgtagcaatgcatgcatcctccattttggaacttttattaaaattttccactttagtatctgattagattgtaagccaataaaggtatttccagaatctgatatagtgtttaatacagagaagctgcaaaagtatttgtaaggtgatgatggaaagtagaaagcagaagatatatatgtgcatctgagtgtgtgtgtgtgtgtgtgtgtgtgatatatatacacacatgtatgtatagtgagagagagagtatgtgtgcttatgtatgtatgtatgtacctatctattttatatatatggagagaaagagagagatctattttaagaaattagttcacacaattgtggcagctagcaagtccactcttccctgggtcttcagtcaactggctggaaaacccactcttccctgggtcttcagtcagccagctggagagtctatgttgcagttcaaatctgaaggctgtctgctggtagaattcctctcttgagggaggtcagtctttttttctatgaagaccttaaactgattggataagccccagccacattatagagggaaacctgctctactaaaagtctactgattttaatgttaatctcatctttaaaaaatggcttcacagaaacaactagaataatatgttacaaaatatctggataccat

SEQ ID NO: 34124 - DNA, 1526 bp, Homo sapiens
ctggagctgttccaggtggagatcgaggtgctggacattaatgacaaccccccctctttcccggagccagacctgacggtggaaatctctgagagcgccacgccaggcactcgcttccccttggagagcgcattcgacccagacgtgggcaccaactccttgcgcgactacgagatcacccccaacagctacttctccctggacgtgcagacccagggggatggcaaccgattcgctgagctggtgctggagaagccactggaccgagagcagcaagcggtgcaccgctacgtgctgaccgcggtggacggaggaggtgggggaggagtaggagaaggagggggaggtggcgggggagcaggcctgcccccccagcagcagcgcaccggcacggccctactcaccatccgagtgctggactccaatgacaatgtgcccgctttcgaccaacccgtctacactgtgtccctaccagagaactctcccccaggcactctcgtgatccagctcaacgccaccgacccggacgagggccagaacggtgaggtcgtgtactccttcagcagccacatttcgccccgggcgcgggagcttttcggactctcgccgcgcactggcagactggaggtaagcggcgagttggactatgaagagagcccagtgtaccaagtgtacgtgcaagccaaggacctgggccccaacgccgtgcctgcgcactgcaaggtgctagtgcgagtactggatgctaatgacaacgcgccagagatcagcttcagcaccgtgaaggaagcggtgagtgagggcgcggcgcccggcactgtggtggcccttttcagcgtgactgaccgcgactcagaggagaatgggcaggtgcagtgcgagctactgggagacgtgcctttccgcctcaagtcttcctttaagaattactacaccatcgttaccgaagcccccctggaccgagaggcgggggactcctacaccctgactgtagtggctcgggaccggggcgagcctgcgctctccaccagtaagtcgatccaggtacaagtgtcggatgtgaacgacaacgcgccgcgtttcagccagccggtctacgacgtgtatgtgactgaaaacaacgtgcctggcgcctacatctacgcggtgagcgccaccgaccgggatgagggcgccaacgcccagcttgcctactctatcctcgagtgccagatccagggcatgagcgtcttcacctacgtttctatcaactctgagaacggctacttgtacgccctgcgctccttcgactatgagcagctgaaggacttcagttttcaggtggaagcccgggacgctggcagcccccaggcgctggctggtaacgccactgtcaacatcctcatagtggatcaaaatgacaacgcccctgccatcgtggcgcctctaccagggcgcaacgggactccagcgcgtgaggtgctgccccgctcggcggagccgggttacctgctcacccgcgtggccgccgtggacgcggacgacgg

SEQ ID NO: 34125 - DNA, 1052 bp, Homo sapiens
ttaattttttagagtttcaaaaatagatctttagaatactgacgattcttgtatctaaatggaaaagttaaaaatgattactctgtgtttttagatatcttcctcaaatcaattcaaataataatattcaaatgttttgtctataggagctaatacactatcactagtttttgtcatagttgaaagcactcttcattcatataattaattagaagtattattaaatcaaacaaaattgagttactataacttcatctattctcttaataatatgagaggtagttgacatagttgcagtaatccactggaaagatatttcctggtgaaacagttgtaaatgtactgttaccttatgagaaggtagttttgatttacacatacacatacatgcatgcacacacacatacatagaaatttctcagtgcctactgatcttccatctagaaaaaaatctgtaatgtttcagtggattcactttgtcatacaaagctatgtgagggtaattgtataccattgtatttgtggagtacacttttggacaaataaaagctcctatttttaaagctgttaagtcttttgcatagcaatgaaatttggtttaaaaataagcactgatcaatactaatttttgaaattctcttggtagtaaacttagggcctttcacagtatatcagctctacttgatttggaaggtatctcccagataatgaagtaaatttattcattgcacacactctgctaggtgagaaaattaggatggatccatttctaattcatagcttgaagttgtaaatagtctctttcacaatggtaacattagaattttaggagagatggccaactatttaagggtgccagggttgctagaacgagaatgtctatgagacaattattatgctcaacatgcttctctcttctatttgaaattatacattttattcattcattgatgtatatttctgtttcacaaaactgtttgccgatttcttatttttaaatatccctggatttaaattttaatttaataactattaattgcaaactatgttgt

SEQ ID NO: 34126 - DNA, 1050 bp, Homo sapiens
agagagcccagtggagaaactggaggccctcagtgccagcctggcccgcgcggtggtgcctatcacagaggaagaggccgaggtggatgagtttcccgccaatggggagttggcggtgcaggaggaggaccacaggaaggagctggaggcgcaggagaagcacaagaagctttttgagggcttgaagttcttcgttaactgacaggtgtcccctgaagccctagccttcgtcatcaggagttttgcggggggggacatatcctgggaaaagcctttgtgcatgggtcccacctatgcagcacccaccagattgtcgactggcctgggcagcagacctcagttattggcagacactacgtggagccccagtggttgtttgactccgtgaacgctagactgcacttccctggagcagagtacttccctgcaatgcagctacccctacattcttcaccctttgtgactgaggaggaaggagattacatcccatctgagaagctgaagcttctggctctgcagcggggagaggacccaggaaacttgaatgagtcagaagaggaggaggaggaagacaaccaaggtgatggtgatgaagggggagaaaatgaaggggagagtggttcggaaacggaggaaaaggcctggctggcagcaccggaggagcagagaacggaggggaagaagcccagggtgatagcaggacacgagaagctggagaagcagcagcagctggcccaggaggaggagagcgaggccaggcgcctggccactatgatgatgaagaagccggagaagtacctgtaccagaagatcatgtttgacaaaaggcgaaaaagccaagaggccaaaaagctaccagagtagcagaaagcccatgatgaggcagtgagatctgagaaggccgaaaaatcaaggccgatttgagtgccagtggcccctcagagggccgaggccagctccccagcagccggatgtggcagaggcaggccagagcaccgaagtgtggtgacagatcagagtcgcttcttttctcctcttccttcctccagc

SEQ ID NO: 34127 - DNA, 1489 bp, Homo sapiens
tgttggtggtgtgtgcctgtaatcccagctattcgggaggctgaggcaggagaattgcttgaaccagggaggtggaggttgcagctagctgagatcgtaccactgtactacagcctgggcaacacagcaagactccatctcaaaaaaaaaaaagaagttatgatgcatccaaagtgacaataagaattgttccggaaggatatctgggaaattccttggtcttgatgcatcctttctagctgtcttcctttcccttttctatctttcctccaactctgaggttccagtacttaaacagctctgtttgccgatctgcaaatatgcttgtgactgcaaatatcttgtctagtacagggtgcaaagtaagttacactgcagattctaataatacctgggatataatacttttctatttcctcttgtgtgttttgcttttatggatgctaattatcattgaaggtctgctgaaggaaaatgtttatctttcaaatcttgtaggtcaaatagactctctgagacttagttctagaattagtttaatattttatttttttgagatggagtcttgctctgttcctcaagctggagtacgatggcgcgatgtcagctcactgcaacctccgtctcccgggttcaagcgattctcctgcctcagcctcccgagtagctggggattacaggcccctgccaccatgccctgctaattttttgtatttttagtagagacggggttttgccatgttggtcaggctgttctcgaactcctgacctcaggtgatacacccgcctcggcctctcaaagtgctgggattacaggcaccatgcccggccttgcctctgaacttttaaagaccattgtgagtattgattatctgtagaagcttacaagatttccttatctttggtattcaaaagatccatcaggttgaatgtctcagcatctgatgcgcccatccaatctaaagacatgccttagcacattaaaagtttgtatcggttgtctactgtattgtctcttgttctcatgttcttgaactcctgttagattgttggccatatggatctatcctccgtgtctattcatcctttttttttttttttttttttaaattattttagagacagagtctccactttgtcacccaggctggagtgcactggtgtgatcatagctcactgtaacctccaactcctgggctgaagtgatcctcccacttcagcctctgaagtagctgggactataggtgtgctccaccatgcctacctacttttatttttttgtagagacacgggtctcagctcagactggtctcaaactcctgggctcaagcagtccatctgcttctgcctcccaaagtactggattacaagcatgaggcacctagccaggcctccattcatattttagtgtttttatctcttctctgttgcatgagattttctgaaaatttttgttctgcagtcattttaaattcctagacatttctag

SEQ ID NO: 34128 - DNA, 1055 bp, Homo sapiens
gtctgcttctctttcaggtccattcacctttgcaagccattctaaggctatcacccattttctttggggtattctttggttctatggagcaaccaaaagccacccttcccggctttgtctgtgagagaggggacacatgtaactagtgccaccgttcactttcattcttgaacgaattgccctaacagttaccccctcagcttctcctgccctttctatttcttgattcagcttggagtttcttcaaggtgctcttgggaaaaccacatttacctttggtaacttgtactgccctttccttctggtttctctgttaattcaaacttgtttctgtcttcttggaattcctccaaatatttgctccattgatgtcatgcatcccttcttgttttccaatgttattgatgcattctttaaaaaattttaaagaggccaggcgcggtggctcacgcctgtaatcccagcactttgggaggccaaggcgggcagattgggagttccagaccaacctggccagcatagtgaaaccctgtctctactaaaaatacaaaaattagccatgcgtggtggcgggtgcctgtaatcccatcagcgactcagaaagctgagggaggagaattgcttgaacctgggaggcagaggtttcagtgagccgagatggcgccattgcactccagactaggcaacagagcgagactccgtctcaaaaaaaaaaaaaaaatttaaatataggcactttatttcttcaagatcttaggaaggagagaaagtaaatgtattttctactttgctgtcttggcctagaaccaacctgcccaatgatatgcaacatattctttttttaatatgtgccttaactattcaagcaatgcactgggaatttgtatatgaaaattgtttcccctcctttttaagtgactaaacatcttttattggttttatgatatatatacaaatagactagtggtgagcatagctgccttccaaatggactatacaattttattttttatttatttttttagatgagtcttgctctgtcacccaggctggag

SEQ ID NO: 34129 - DNA, 1057 bp, Homo sapiens
cagcctcccgagtagctgggactacaggcgcccaccactaagcccggctaatttttgtatttttagtagagacagcatttcactgtgttagccaggatgatctcgatctcctgacctcgtgatccgcccgcctcggcctcccaaagtgctgggattacaggcttgagccaacgcgcctggcctatttatgaacattaaaatttgaatttcatatcattttcacatgtcatgaaatattactgttcttaaggttccccccctccccctaccatttaaaaatataaaagcctttcttagcttgcaggcagcacaaagacaggatgctgccagagttagctcatgggtcacagtcggtagatccctgatctagagaggactctgtacagtcagcagaaggcgccttatagtttcatatttccactcacactgtaaaaacacgtcatttttccaagtgtcccagaaatgttagtgatgggagatcaccagatttttaggttttgctttttcacatttttatttcagaggattgtgctagaaaagcccagcttgtggaaatgatttgtcagccaatagacaattgagcaccagtcgaacatgttaaactaagcatttatcatggaggggattcccttctctttagagagcttttccatatgagtctgtcctggctgaaggtatggttcagtcttgtctggatgacgcttcagctttcttgtctggtctgtgactgccacctggcaaagagaggttgtttggattgtcacactcagtctaggtgcttgtatttttagacacgttaggttgagagttctgaccttcacttgatatctctggtaatgccaagcgggtcgtggcactgctttgtacactctgtgctgtggcagtgtgtgtgtgctgtgacgacagtgacgtcgacagatggaggaggtgcaactcgacctctgtttctttctggcctgaagaatgggctgctgtgtgcgcctggggctaggcaggacagctgcatcgctgttgccctgaggcagtatcagcacagctggagatgctgacgagcagc

SEQ ID NO: 34130 - DNA, 1050 bp, Homo sapiens
cccaggctggagtgcagtggcacaatcttggctcactgcaacctccacctcccaggttcaagcaattctcctgcctcggcctcccgagtagctgggattacaggcacattccaccacacccggctaatttttgtatttttggtagagacagggtttcaccatgttggccaggctggtcttgaactcctgacctcaggtgatccgcctgcctcagcctcccaaaatgctgggattacaggcgtgagccactgtgtccggcctgtttctacttttaaaaaaatggtatcccctatgtatgcttacagttatgatgctaaaatacaggttctggcttttatactattacatatcacactatcctagattttgagttcagtaaaggcaaaggcataattgcttaggcaaagttaacctgaattaaacagaatcaaatttattagtttatacagatttaaactgaataaatttatttacacctttatcatatgataagcctaaattccatgatcaaaattcaccaaaagggacttagtaattttattggatacacaagcaaaatacaacgaaatgtgtaaaacttttaggcatcagacctagggtctttttgtaagaaacttacttttctttgattcacctacaggcatgaactctgaggtatatgtattattaagtgcaaactaccctcaaccctttaaggattttcttatcattttcctctgtactaccagtcaattaagacttgatagcaaagaacattactgttggcggggtgtggtggctcacacctgtaatcccagcactttgggaggccaggaggcgggcatatcacgtgaggtcaggagttcgagaccagcctggccaacatggtgaaaccccatctctactaaaaatataaaatttagctgcgcatggtggcgtgcacctgtaatcccagttacttgggaggctgaggcatgagaatcgcttgaacccaggaagcagaggttacagtgagctgagatcgcaccactgcactccagcctgggcgacagagtgaaaccctgtcacagg

SEQ ID NO: 34131 - DNA, 1056 bp, Homo sapiens
tcatgcaatcctcccacctcagcctccccagtagctgagactacaggtatgtaccaccaggcccagctaatttttgtattttttgtagagacagggtttcaccatgtttcccagggttgtctggaactcctgctcaagcaatctgcccacctccacctcccaaagtgctgcagttacaggcatgagtccagcccagtttgttttaattatatcctggtttgcttctttgcttcattgtttctatagcagagtgttaaaattttaaatgttaattcctgttgaaaaacaatagcctgcattattcttctagtatttttgaaagtattatgttagattttgaactaacatatgcaggtgttacaggtaggaggacaaatagatactctggcatttcttccatagcaagggaaatccttattcacagttttgaaatttcaagaactccccaaacacaagagtttcagatgagggaatgtagacctgtatttctgtttaatgcaatgattcttctgtggagaactgaaaatgtctgtctactgtgtcactttataaaacctgttttaagtgaattgaatgtaaaacatatgttgaaagtataccatatgtagtattttgcatttcactttccgtaaataaaagcaaagtaagttccctaaaaagttagtttagggccgggcgcagtggctcacgcctgtaatcccagcacttcaggaggccgaggcagggggatcaccagaggttggagttcaagaccagcctggccaacatccaaattggatattttttgttactttttcctttctattctcctttgtaataagtgacctattatagaagtagtgcatttcgtgaaaaaaattgagatctatttacttaaatgcacgttggttcttgttgaggagaaatgaattagtagtagttatttggaggggcctgccattctgaattatttttacagctcacattgacaggagataattgaattaatggcattgaatataatttcaataaggacatagctgaatttcattaattgagaacataatcattaggatc

SEQ ID NO: 34132 - DNA, 1050 bp, Homo sapiens
acccgtctcagcctcccaaagttccaggattacaggtgttctagaagctttttcattttaacttacacatttagatctgcagtgtttttagatgttttttattatgaagaaaggtcactgtagttccactaattatatttttctacattatcttttctctctctttcattgaggtggtttctgttgctatgtctgtcttctagcccactgattttttttttcttcttctgaagtgtcataaaatctgctttactcttatctgggaaaggttccattttaaaaaaattgaaattaaaattttattttattagttttttcagatggagtctcgctctgttgcccatgctggagtgcagtggcacgatcttggctaacttcaatctccacctcccaggttcaagcagttctcctgcttcagcctcccaagtagctgggattacaggtgtccgccaccacgcctggctaacttttgtattttcagtagagacggaggtttcaccatgttgtccagactggttttgaactcctcacctcaagtgatctgcctgctgtggccttccaaagtgctgggattacaggcgtgagccaccacacctggctggtttcatgttaaattctgtattttcttttttccttttccttttctttttctttttctttcttttctttttttttttttgagatggagtctcactctgtcgccaggctggagtgcagtggcgtgatctcggctcactgtaacctccaccccccgggttcaagtgattctcctgcctcagcctcccgagtagctgggactacaggcacgtgccaccacacccagctaatttttgtaatattagtagagatggggtttcaccatgttggccaggatggtctcaatctcttgatctcgtgatccgcttgcctctgcctcccagcgtgttgggattgcaggcgtgagccactgtgcccggccttctttttttttttcctcagacagagtcttgctctgttgtccaggctggagtgcagtggtatgatcttgactcaactcactgaaacctccac

SEQ ID NO: 34133 - DNA, 1061 bp, Homo sapiens
cttgcgccacctgttagcaccacctgttgaacctgttatttcatatattttgtccagttttctttatgatgaaagaaaaagttcagcttcacctactccatcatgccaaaagtgaaagtcacctaactacatttttatacatgtaaaatttcagaaagctgaaggttttatgaacagtgacacttaaccctcttccttataggtatgaattttcataaacagcaagaaatcaagaatattccttttaattatgttagtctttacatcatagcttcctttagtgctttcttattataagaaaaacaagctacttttaggctttctgctaagtaaatgggaacactaaatttagttacttagtcttactatgtttctttggctacatatgatgaatgatagctctcaagtaactgcttctgctttctcctcctcttatccctgaaatcactgtgcctgctgaatgcatagttgattgtgggagacaaagaaaatattcaaccagttaggaagctattgccaagaaaccgggtctgataggacctaccagaggacagaagtataagggaaggagaagcaccaaagatgattggttttttttgcataatcgtctggttgagttgaagagggggaatcaactctatcttcaggatggtgaagacttggtgcagaatacattttgggcgagaaaaatcagttgtatttggatatattaggtttcagatgcaaaacaacagcattggaaggctgaggcaggaggattgctggagcctgtgattgagacactgtactccagtctgggccacagagtgagatcctgtctcaaagcaacaacaaagtggagatgatgggtatatagttggttgtaaagcaactctagtttgctgtagtgtgaacttaattgatttcttcatgctaaaatgtgaaattttacatttttatttttctgtttctacacattttctaccatgatttttgtcatcacttgcattaacttctttcccagattttaaatatattgcctcaaaaattatgagcaaaattgtttaaaatttatatcaatg

SEQ ID NO: 34134 - DNA, 1041 bp, Homo sapiens
cattgattatgattcttgcctgaatcagtattactatgatagtcgcaaaatggtgattctcttaactctagtcattccttgtaggtttattatttggcattctactcctgagtaagagctttcccttcttccccatatttattgtgtgtaaggacttatggattattattttattcaacctgttatatcctaatattgtcattatttactcagttgctctgtagatacttaagaattttttaaaaattagttttatcaaccggatgttatcctttgacttcttacatgtttttgagtattgtgaacaattttctgatatgaaaataaaattcttactgtcagtattccttatatccatatacagacatcccctgacaaggtggattatgaatatagtgaactactcttatatcagaatcaagttcttcgggaagcaggtctctatagagaagctttggaacatctttgtacctatgaaaagcagatttgtgataaacttgctgtagaagaaaccaaaggtatttttaaaagaattgtcatttattctaatattgaaatatgacagagcaaggctgaaaaatctagttgctgctgacagtttcatataattcagctttttgatgataggaaatctatttcttactcgtgtacttttaatagtttatgatgtgggaaaatgtacatttaaacaatattgtagatagaggagaaagttgattgtgaacaatgaaaagtagttgaatgaaatgactcataacattctttaaataaagtatctttgtattaaaaatattatggaatttgatcaaaacacaagagacaattagttttataagacagaggatgacatttcttagaaacagtttattaataaactatagtgtatgtagtatgtgccagatttattgctaataatatatattgatgaatcagtctttactaaaatacatataggatatttctgagagtctttatggttaatctgaatgtcttcgatgacacagaaagaatatgagttctggaagaaagggagaccagaga

SEQ ID NO: 34135 - DNA, 1026 bp, Homo sapiens
gaattagttaacgcatgtgaagcgtttaaaagtcactggtggccgggcacggtgactcacgactataatcccagcactttgggaggccaaggtgggtggatcacttgagtctaggagctcaagaccagcctgggcaaaatggcgaaaacccatctctacaaaacatacaaaaattatccaggcatggtggcacatgcctgtagttccagctactagggaggctgaggtggtaggatcgctttaggaggtcgaggctgcagtgagccatgatcgatcgcaccactgcactccagctggggtgacagagcaagactgtatcacaaaaaaaaaaaaaaaaaagtcactggcacatggtaagtactcagtaagtgttcatttttattatcaaatgagagcgaaagatataacagagagtgaaggatgcaagggtgaagtagtggcttaaaaataataccttggatgaagggaagcacattaaggatagagaaaaggaatcctgaatatttgaagcttatatggctttggagctcatatataatagtgaaaccactgtctctctctcttcatctggcttgtttccttccataagaaaatgtggagcaaataaacagttgggatgatctgggctttaaaattagtaaacaaaagagcctaggttttaagattgatttttgataattggggctgctaatatcattcagggatgatgtgattggtcatgcagtccagggaaggcaacagtgagtcgacaagttgctgataggttgatagttttttctctgaagttgaatagtaggattagtgagacagaaagaaaagacagttaagcttaaaataggatgcttaattgcttcttggaagacattaaaaggtaaagtctagatagtttttaatgtagccagattaagggctgctatggcagaattgttttgtagctgattaagggatcataaggttaggatattgaattgagtcattaattttgatgctgaagttgttccatatgatatcaggaataattgagga

SEQ ID NO: 34136 - DNA, 1053 bp, Homo sapiens
agatggcttggtgacagtgtgttgagtgaatgtgagaatctggccgggcattggacagattttctgaataaattgaggatgtgaagaggatggcatttctaaataatgtgaacttcaaaaaaggaaggagaccataacataacttggtaaatgatcttaagggaactggaaccaggtccatccacttagcagcactgatttataatgagattttaagagaaattttgaggaaaagttaaaattctaattggaaggttttctcagatattaaaattttttttttttctgtttttaatcaggggaacttctgttgcaactatgtcgtttggaagatgctgcagatgtttatagaggattgcaagagagaaatcctgaaaactgggcctattacaaaggcttggaaaaagcactcaagccaggtagtattgtttaaaacttactaagttttattgtttcttttgttaatatatattttatttactcattgaaaagcacaactagaataatagtggttaagaattggttcgaaatctgaatacaggccaagcgcagtggctcgtgcctgtaatcccagcactttgggaggccgaggtggatggattgcctgagctcaggagttcgagaccagcctggacaacatggtgaaaccctgtctctactaaaatacaaaaaattagcctggcatggtgatgtgtgccttgtagtctcagctactccggaggctgaggcacgagaattgcttgaacccaggaggcagaggttgcagtgagccagcatagtgccactgcattccaccctgggcaacagagcgagactgtgtctcaaaaaaaaaaatctgaatacaaaagtacatttgcaaacttctatttaatatgacagattgagcatgttctgaaacctctcttttatagatttatagaatggttgagaaaataattttagagacaactttagaaaaaaattcacaaatgcatagtagcatcaaaaacatgaaaggaagccaggtgtaggggctcacacttgtgatcccagcactttgggaggctggggcgg

SEQ ID NO: 34137 - DNA, 1041 bp, Homo sapiens
tattagtattactagttatttttttgagatggagtctcgctctgtttcccatgctggagtgcagtgcatgatctcggatcactgcaacctcccaggttcaagcgattctcctgccgcagccttctgagtagctgggattacaggtgcccaccaccacgcctggctaattttgtgtttttagtggagacggggtttcaccatgttgtccaggctggtctcgaacccctgacctcaagtgatctgcccacctcggcctcccagagtgctgggattggcctcctaaagtgctgggattacaggcatgagccactattcccagcctattcctctttttaatagtaatttataattaacctactaaaaatgaatattgcttgaacattaaaaaccagcttgggataaagctaggaaaattgcacagtgacttatcatttgactcatttttaatgtaccgtttttatagtagggtatcggaatgactagggagaagtctttcttagacagttatttgggacagaacctgagaatgagtgatctcatacgtacaaaaatatgaattttgtgccttactcatggcaaaaatgttgtaggaattggggcataaaaagtgtgtttaatttttttttcttttaagcctatttcttttttgaggatatgattggctactttctatatccttcttcctgctaaacagcttttgaattattttgctaatttgtcgttaagttttacttcctgttgcctaaggacagtttagaaatttctaaggtcacatactgaagcctttgtacagatatcacttgaatctctttctacctgttggtgttgcttcaacttagaagaaaacaccagtaagaagaatctgctggacaatttactgttaaagttgagagctatgaccctctggcttcttttgtttttctttctattcttctgcctccctccttctcttcttcaaattatacaaataatacacaattaacttttcaaagctgagactattaatacagaagtatacttagcaaatatgaagatcccctt

SEQ ID NO: 34138 - DNA, 1047 bp, Homo sapiens
taatggaagtttggtaggatcaaataatacttaaaattactaatctgattaacatgcttgttaattttattaattaacttattgcctgcagcaaacatgtctgacaaagagctaaagaagctacgtaataaacaaagaagagctcaaaagaaagcccagatagaagaagagaaaaaaaatgcagaaaaagaaaagcagcagagaaatcagaaaaagaagaaggatgatgatgatgaggagataggaggtccaaaagaagaacttattccagagaaactggccaaggtacttaataatagtgtttagcacaattgagtgacattttatgaccagctcttgtcatttttatactgtcttatttgacagtatataaccttatgtgatataggttttagagccaaaaattattttattttttagtattctttctttaatattttgtttctgatcgtgtttcatgtttaaaacttgaaataatgatcctgttccaaagtcatatagtatagtatggtggaaaaaattttggcttttgagtcattcagatctgggtccagatattagctcttatattttcactgtgtgcccttggacactttgtctaacctctctgatggttttctcatctataaaatggaactaagaaaatccttatttaggactggagaaaatacatatgtaaagcatctaatgtctgttacagtggtaacatgcaagtttttatgtctaggctaaattgagtttgttataaactgaggactatacgtgtatctcccatttacctctgttgtcagtttacattatttcttttctagcctaaggctgtaaatattttccctaggccaaaatctgacctgctggttttaaccattaagctgaaaccaagatactcattgtcacatgaaccattttgattaataacattcctttgtcctttcttttgaccctagacatcttcctgctttgtatgaaaataattgcataatttgttatgttaaagcaatataggaagcagtcgccccagactttaattttagcctcactagtaag

SEQ ID NO: 34139 - DNA, 1043 bp, Homo sapiens
ccaatgatcaaaatatatcttactttctctttttatagaaaagtttcttttgatgctacaatcagtaaagagggcatttgctattgattctagtcatccctggcttcatgagtgtatgattcgtctctttaatactggtatgtttttgttttccattacttaagtatttgatacagtggttgatggtgacggtataagtggtctgtacaagtttatcataaaccaaatgattttaaagctgtcacatactaaattagctaagggaaaagcagggcttttttctttatgatgaaggtttttattttaaggatacaagtattacctgattttgacatagaattattcagtccagatatttgagaatcatctttgtttctgtttctaaaaagttacatgtaagttgaaattttgaaccatattttgttatgtaaaacttcttagtaaattgttttgaaattgaagaatctctttgaaattgactgttttctccttatttatctgtattgtagatctgaatttgcatgaattatgttttcttagcacaattcgagtcataaaattttttgttactttaaaacaattatctgtatcttcaaatattttgacaatcagatcagttttatattagttttaatgtaaagtagaactacagaattttagaccctgaaaggtagaatgttacagtaattgtctctcatttcatagtgggaaaaatctgagaccttaaaagatgacttattctaggtaacagatagaaacttagtaacgcaacagtgactagagcccacatcttcatattgttctttctactgtaagaactgtacatttataataaagtactcctgtagtcaggttgtattgttgtttggatttttaagtgactggtgggggagaaatagaacctttaacagaataatctatagaatttggaaatactattaactatcacattgccaactccatacatttaaaactgaggaaattaaatcaggcatcccaatcaccaaaaaaatgctaaattgtcccaattgagaacatcattt

SEQ ID NO: 34140 - DNA, 1055 bp, Homo sapiens
caagtgatcctcccactttagcctctagagtagctgggactacaggtacacgccaccatgcctggctaattttttgcattttttgtagagacagggtttcactccaggctggtctcaaactcctggcctcaagcgatctgcccactttagcctcccaaagtgctgggattataggcttgagccaccacacctggcctaattctagttatcttgcaatttctaccacatctgcagttacttcctccattgaagtcttgaacccttaaaagtcatctctgaggacaggaaacaacttctaaactccagtaaatgatattttgccctcatcccatgaatcatgaatgttcttattgatatctagaatagtgaatcctttccagaaagttttcaatttactttgcacagatccatcagagaaatcactatttatggcagcaatagccttacaacatgtatttcttaaatcataagacttgaaagttgaaattgctccatggtctatgggctatagagtggacattgtgttagcaggcttgaaaacagcatgaatctcgttgtccatctccgtctgagctcttgggatacgagatgattgttaatgagcagcaatattttgaaaggaatctttttgtgcagtagatctcaatggtgggcttaaaatattcagtaaatcatgctgtaaacagatgtgctgtcttccaggctttgtcccatttatagagtacaggcagagtagatttagcataattgttaagggccctaggattttcagaatggcaaatgagcattggcttcaatataaagtcaccagcagcattagcttttaacaagtcagccggttcttggaagatttgaagccaggcactgacttctctgtagcggtgaaagtctaaggtggcttcttccaataaaaggcttgttacatctacattgaaaatctgttactgagtatagccacctttaacaatggtcttagctggatctggataaactcctgcagcttctacatcagcactttctgcttcaccttgcacttttatttatggagatgactt

SEQ ID NO: 34141 - DNA, 1028 bp, Homo sapiens
cgaactggccggctgggcgcgcgctcttgcggtggcgtaatctctcagcctttctgtgtctcctttcctccgcctcagtttggggcgggtcgggggaatggctgaggagatggagtcgtcgctcgaggcaagcttttcgtccagcggggcagtgtcaggggcctcagggtttttgcctcctgcccgctcccgcatcttcaagataatcgtgatcggcgactccaatgtgggcaagacatgcctgacctaccgcttctgcgctggccgcttccccgaccgcaccgaggccacgataggggtggatttccgagaacgagcggtggagattgatggggagcgcatcaaggtgagcggatggggaactgttggggaggacagggtgacaggtgtcccaaccccaccgtgggctggtcgctggccgtgtgcacggtgtgtgtgcgctccatttttttctcacgctgatgagattggagttggggattggaaggattgcaatactgcaaacttctaaggcagcgtttctcagacttcattgtgcatgcgatttacctggggatcttgtttttgaaaatgcaggctatgatttaataatctcgctgatgatgcaggtgcagctagtccgtggaccacactttgagttcaggagtgtagggcttatctaccgacccatttactgtgtgtgtcgtgtgctgggagtcagtcaaatatgaacggaggaaaaacagtgaaattgcgcgagaatggaaaattcatttaatcagtaatagttattaaacattcattcgagcagtgccttagatgttgtggaagtaaagcctattgcctttgaggaagtacttaggtattctcttgcatacagttttgctgtagtagtttctttatgatactgattttagaaaaatctattttcctgcagaaacattctatatgtgatagttcctactcaggttgccaaaagcatttctcatgatgccacctcagacacacgcccaattctttattccctttaagtcgttatttttggtccc

SEQ ID NO: 34142 - DNA, 1032 bp, Homo sapiens
tgcgcccactgctactaggtcatgatttaggattcccgcaaacggctacaggatcagttcaatcagcctcaaggccctatttgtcttctacattcaaaagagactagtggttgttgcaagccagattcttccacttcagctttagaggtaagggctttggtcaggtgacctgctgggataagcaaaaaagatgtggcacaagatttttgcccctgtagtcactaagatgacgatctaaacataaacaaaattgatatgcagccaacaggcaccagtatatctttactggttgttaaactattacaatactatgtacctttggtaaagaacagctgttctagtcccaactccgacagctaccctgacccttccctgtgccttctagaacctctctgtgactcagtgaccaaaaggttaatgcctggcacaacaggaggcctctaggaatccattctgattggttagtactcttaacctaccagtagttacatattttgagtatttcctggacacaaatacagccagtaaggcaatgcctctggctacacattcacttacgcttcaccactggaaggtataaaatgagagaggttgcactggcctcaccttgaaactgattgacctgctgcactgggtatggattccgctgtggctggaggtgctgccggggtagatgtgattgctgcaactgctagaacaacagaacacaagaggggtggagaggtgagatagggagcaagcacacaattcaatatcccagcagttccgaggaaggtagtgttttccccaaaactaaactttgtgttgaagaatcatatgcatacaggcaagtgcacaaagtctaaggatagagtcaggtaggttttcacaaaacgaacacactcagggccaccagcccccacatcaagaaacagaacgctgccaggagcccctcgtgccccttccagtcatcactctcccttgacccatgggcatcactgtcctaacttttaacaacatagagcagttatgtctgcttttgtactttgcaga

SEQ ID NO: 34143 - DNA, 1054 bp, Homo sapiens
gctggacgcggccctgcgcaccgggggcccgggaggagcggtctcgggcctgggcatttggtgggcggcggaggcctggctcccggcagaacccttgcgcgacctctttttctcctgttttcgttgtcaggcccaggcgttctttgggagagggacctctcgcggtccctgacgcagacatcgtgtagctttctccccgcagctcctgggtcgggagccgctttgcagctctcggctctggaattggactgcgggaggggcgtttgggtggaatgggacctggcacgcctggaccttcccgtggctgctctgcgagagcctgagagatgggaggggaggctgaggtggggagggagcctagagagccgtaaaataaggattggaccatttttccaggcggcgaaagcggcacctgggtttgtttcctgatcgtcttctcccccagagtcctgctgaacaagttttgggaagaaaggtttggaaaggagaaagaggatacattcctgaaaggcagggcttctgttatacagtgtgtcaacctcacactattacgcaacaataaggacagatgccattccaggttgccaacacgttttctatgcccgaggacccaaagctgtgcccatgtattctggtacctctattcctgattaaaatcagtgtagctagccattctctgagagtatagcttccatttaaatcctcatttggccaaacagttccttgatcttgtggaatttgaaactggatttatttaaccaggacaagtcaaagcagaacttgaacagatctgaacagacattatattgaagttccgtagcttgaagggaatggagtttattttcagttgcttagtaaagattccagaggagtttgacatcagtggtagcaaaatgtttggcaaacttaagattagggccatattaaagttttttccattgcataatggaaaaagcatggactgtgaagttagacctgggttcaaattcttggtagagacattggctgtgaaacctctgaaacagcttttctgaaagatatatagactttctga

SEQ ID NO: 34144 - DNA, 1332 bp, Homo sapiens
acttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaat

SEQ ID NO: 34145 - DNA, 1035 bp, Homo sapiens
taaaggcccaactacacaaatatattttaagtctctttgtgtcatgtctgttagcaacctgttagttaaaacaagttacatggccaagcccaagtcaaggggtggagaaatatgatatgcccaccgtaaggctatggtagggagtaggttgtataattcaattacaaggtaatgaagaattgggaccaataattcagtctaccacatgctgttacttccctattgtagttcacaattttgtctacatgtagattatttggtgtggcaaggatagaatacgggtcatctagaccattgtttgaaatcccataatagaacacaaccagtattaaacaataataggaatagaacagaaaatatttagaaaccattggtcataatatggttaaatatattttaggaattttttatactattataattattttaaatatttctgtgtacatctgtgtgtattttggacatccacatgaatgtttgttattgatcatgatgtaaaatgtggctcaaggtcaaaaatgttgatttgctactgtctagtattatgaatcgtgccagaaataaaatagaccttcttgagagttgcaagcatatctgttatgttctgaagagtaacctttaaaataggtactttaatgatttagttgtactctttaagaatggtctatttaagaataactcatatatataagtgaatatttgggggaagagtccagagttacactcctttgttcagaattgttagagagtgattaatatattttttaaaatgaggatgtggaggtcctgaaagctaacaggttgctggttctcaaaatttatttataccttatttatttgtatagttcctttatttgaaacataggatgcagtttcccaaagtaacaatattacaaattttagcagatgcacttggggaggtgttatatttcaggtccattacaagagtagtccttaaacttaaggaagaatcaaaatcttctggaggcctattaaaacacagattattgggccccatccccggaatttctggtc

SEQ ID NO: 34146 - DNA, 1048 bp, Homo sapiens
atgagcagagtagtggctggagaaatgagtgaaatgctagattgatacattgcagagtcttgtatgccatactgaaggatgtagatgttgtcctctggtttttaagcaaacaagctacatttttagatatgtattttaggaagatggagagtagatttgataatgtgggaggctggcagaaggaataaagaataggaaatttgagttattcaggtaagaaatgacaaaggcataaatacagtaggagaaagagtgctatgaggattgctttgaaggacatttcagagatagaaaggtttagcgtatggggatcttttgatacattgtgatggagagaggcaggtcagaacttggagtgttgtagcttggggaactaatgggtagcgatgtcattaatagatctagacactaaagaaagagcatgtttctttagggaagagaagcagttttatttagagctgagataacctgttgtggagctatttgttttatatatactcggaaaattaagtctactggtgatatctggcaataaagatttaggaatgtataggattgcccagagaaaacatgaagagaaaatccttcacaaatccttacagttgtgaagtttgccattcctaccatgtcttgccctctttctaggccttgtatcctatatagtactttacataatgttttgtatttaaggtggcctttggtgggtcttatattaaactgaaagccaggaaatgctttctaaatagacatatgaaccacaagctatgaaagactttattgtgataagagggtatgctttttaaaaataattttatcatttttagttttaaaatatgcatgaagatgtgcttactgcagataactggttataaacagctgtatttggatgtagaaagtgtgaggaaaaggccatatgattctgataacctacagcatgaagagctactcatgaaggtaaatttctgttttctttatgtggagttgttgaacgctagaaaaataaatcaggcttcagctaagtaaagtctgcaaattctagaggcttata

SEQ ID NO: 34147 - DNA, 1113 bp, Homo sapiens
tctttccaggtgatgccttctcgccttccaaatctcagtttagacgtgctcttctctgggaagtttattcatttactgtgtgttagatgttgttctaggccctggggatgtagcagagaagaagacaaagtcactgcatttggtgaggagctgtcatcttcagaatcaaaacttccccctagtgcagtgtccacctccagatactgcttcatttctctgctctctttgttcatgaaactttttcaataattgctttttcatttcttcatctccagtttttatctaattccaatttagtttctctctccatgactctgctcacactgatttttctcagacaccaacttttttttgccgcctaatacaatcgccatgttttttcttcatgttatttgatccttttagtggcactgggcataaatgaccacacgtttcttttcgaaacattatcatgacttttctgatgccacattctcctggcttttcttttgccccacaggaattcctgtagacatccactgccttactagatatagggagcacctcagggcccagccctgtgcccactcctctctttagccctcatacttttcctaagtggtaccatctggtcccttgcttgaaatgccaaatgtgcattaaatgccaaaatgtatatcttcagcccaacctctgctttaatcccagcaactgtatgtccagatcctttttctcccttaatggataaggataaagaatcatatgaggatgcttaaacaaagtaggagccaatgcaacatgtctttaaatggagggaacagatttcaggttcctaaggacagcattgatgattctacccaagtgtactgaagatttctagcaggcgtgagatgctttcctttaccattccaaagtgttgttgctgggactttgctaacttgcctctaattttttttttaaatgaatatatcccttgttcattagctacctattgaacataaataacataaatgagatatcatgtcacaccagttagaatggcgatcattaaaaagtcaggaaacaacaagtgctggagaggatgtggagaaataggaacacttttacactgttgatgggactgtaaactagttc

SEQ ID NO: 34148 - DNA, 1035 bp, Homo sapiens
tttcatatttatacacctctctacaaaagcaatttttaatgaaggttagtggaattgttaaaaatctgagaggaatgatgactggaggtgtttggggtttttttctgtattcattttttaatgagaaaagttttaaatgtagtacaggttagacccaactactaccttactattataggacgattctatgtttctgttaaagtattcaagtagctttctctgggggaaaaagtaccacttggacacttaaaggaattgggatttttgtctactttggataaggcagttgacttcttaagtaaaagcaatagtgtaaaatgtcattttgtttggaatgttaagtgagcaaataaaaaacatgttgaaattgttgtaagccttcctgttgatacttctttttttccatattccctcatttagtcattcatgctcattaaacatttttcttatttttcttatcgtgttgctgtaggtaaatcagaatatacagaaaaaagttttgattttcttgacttgttaactgctgattacctatttacagtgttgaatgagaaacaagtggttatgagactgaaaatttcctttatttaaaaagatgccaccacctccacctgccccttcttacaaagagtaggaataattcatgctaaactgcgctgttttattcttaactttacgtaaaagttctattatccatcataaagtggatctatttacatgttaatacatcatttttttacagctgcatagcatttctgtgtgcgtgtgtgtgtgtgtatgtgtgtatatcttactttgaaataaaaataggtggatctggttggataaggctacgttaatatgttagtactaactttattaaagttagtgctaattataggtttaaatatacgtatatattcgaaaataggctggaaattaaagacaaaacatccatcttaaggagtttgatgaagaacacaataaacgtaaagaaaatagacaaagaaatattaaagaattaaagataagtgcttaaaatgcatagaatagaaa

SEQ ID NO: 34149 - DNA, 1050 bp, Homo sapiens
gatgttttgtttacatattacataggaaaaattaaacttgttatacttaaggtgttggcagcgtcaggtcatctgaatatatagctcaaaaaagtgatataaactggctaaataatgctcttattaatgatttttttgtttttgctaatgatacatgattcatttgttttaatgaggtgcagaatactttatcattggagaaacttttttcttagtgggaaaagaagactagtttgtcttttagggtaaatttttttgacgtttacatttttagaatcgttagtgccaataaatgcgttaaggatcacccgcttcatttggaataatatgtgcttaacgtttcataaggcttagaatgtgcttaactatcgaaaggatagagtttaacatttaacaagaaaaaggacactttgttatactatttcttagtttattaaaatagtaaatgcagtcagtcaattatatcttttctgttctcttgtgtcaaaataggggaaaatgcctaaaaaaaagactggtgcgaggaagaaggctgagaaccgccgagaacgtgaaaaacaactaagagcatcaagaagcactatagatttagctaaacatccatgtaatgcctcaatggtatcagctttttttgatatcagttggtagttggaaaaactatatactattttatctgacgtatacctgaataaaattttagtgaagacagtgtttttgcatatagtttgttgctgaatttagtatctctggcacgtctgttgatttcactgagtggcagtgattgttgttggattttatattattataaaacctagcatattactttacatactgttggtgataaaggtagatattggacaagaatagataatagaaactttcatcttccagtttctttaatgccttagtcttattgggttttcatcatattttcttagcaattctttcatttctcttttctgaacttcctacttaacatctgttggcttcccattctattaccttatctacctgtgctaagtgggttagtcctgataatttctgggctgc

SEQ ID NO: 34150 - DNA, 1040 bp, Homo sapiens
aaggctggacttcacccagtgcctgtcccagggctaacatttattggggttggttgggtgaggacagattacatagcgcagatgtgacagtgaggctgtcttctgtgtttaagagtcctttccagagaagagaggttctgaatgactggcatgcctaaatatatataatgacagctagattttggaagtgcttcaataaaggtacaatgtatttattaggactaagaggtgataaagttggctgtgtgtggaaggggtacacttcacagaagaggtgggattttcaccagaactttcaacaggtaggaggcacttttcagggaaaagtgttcgaataagtaaagacatggagaagagagaatataagacatatttggagaatggctgaccattagtgacttgagtctaaaaagaataggccaagaaggtttggaaagtgattaggggccagattgtggagagcttttaaaaccatgtttaggaatctggattttctgtgaactttattattttgtattctctttggaacggtgccttagataaatgcattattttaagggtcacccacttcatttggaataatatgtgcttaacgtttcataaggcttagaatgtacttaactatcaaaaggatagttcttgtgttcattctgtggtattttattccttacaaacaattgaaaaagaaactaccaatgtatttagcctcctttgtgataatgccacttcttcagggaatcatatacccggagtatcactctcgcatacctttgttattttaagcatgggtaggtgcttgtatacatgggtggagttggggctttggtgtagtgtcacttaaattttaacctgaaaagcaggttattctttgtaatacaagtaaatttgcagttttcagtcagcagaaaaattaatgtgatatttttatatgttacaggaatgtgacaagtgtcagaggtaaattttatttctttttctatctacctttaataaaattgtccctctgactttttatctgacattgaccataatttaaaatt

SEQ ID NO: 34151 - DNA, 1050 bp, Homo sapiens
atctgtttaattaatgctttttgatagtgattgaaactaagatgtccaaatcttactgctacctctgtccctggcagctcaaaaaatatttatatagattattgtttgctttggaaacatttcaatataattaaccaatttgtcttattttaagcattccaaagaacttaaaggtgtttcattaaaaaagatacatatatttatatacctttgtatgaagtagttacctaatcatttttttttgttttgataagctgaaatttataggccttataaacatattgtgtagccttataagagaattaataccaacctcaggtcttatatttgtatgaatgaatttttaaaaatcattatagtaacccaagttattatagtttgtattggggcttatttagccttgatattgaatacagattaagtttgaggacatttcttatttgaaaatctcatattggtgtcaatttaaaacagtttgaaagcaattgctgaaaatgtcttagtgcgattaatgataggaagattggagatgtttaaagatatcactttctcagctgtacttaaattaggactgaagagatctgtagcggtcaaaagctggcaaaccaactgtttatttatcaaaaccgactagttatttatcaaagcaggtggttggtgattcaaatccatcaaccacctgtttttataaataaagttgtattggaacacagccatacccatttgtttatgtgttgtctatagctgctcttacactacagtggatgagttaatcactggcaacaaagtctacaagacttgcaaagcataaaacattatctggccctctacacaaagtgttaaccagttgctgctttaaacaacggtgacagttttgtggagtcttactgaccactactttcatactgttaggaaaatggctcacagtcatctgaaaacacactatacttggttgcatatggccttgcttgggttctgccttctgcctcaatgctgtttttctcctttcactcatgcctagaatatatccaaccttcaaggtatgattca

SEQ ID NO: 34152 - DNA, 1043 bp, Homo sapiens
aaactttgttaaattaagttttaaatgtcttaaaaagacatggaactttttgttagcaagtgttttacattttgattacatcttgttcagactcgggagtttataattaaagattaaatgattagatgttttccaggtgtttggagaaagagaagatttaaataggtgaagtacaaggaattttttgggggtagtgaaactctgtatatggtagatacatgacactacatttgtcaaaacccttataaggctgggcacggtggctcatacctgtaatcccagcactttgggaggctgaggcaggcagttacttgcggtcaggagttctagaccagtgtggccaacatggtgaaacacctctttactaaaaatacaaaaattatcctggcgtggtggctcgtgcctgtaattccagctactcaggaggctgaggcagaagaactgcttaagcccaggaggcagaggttgtcatgagccgagttcatgccactgcactccagcctgggctttctcaaaaaaaaaaaaaaaaaaaaaaaaaaaaaaaaaaatatatatatatatatatatatatatataattataacacaaataatggaccttatatgccttatatgtgcaaattttaaaaatcttaggaggtcagtggaatctcacaataaaatatagaatgtgacaaaaccatctagctgtattatggtgtacgaaacaacctcactaaagaagttgggcggaggggatatgttgacctaagtaagtttggaaattattggcgtctgtaaaatgaaagccaaaagaaactgtaagcattgtactctagttgtcaatgttgtttgccaaagaagtagagattaataattctgatatgcctatccatgtataatgaaattaattaattaattagatgccaggtagtaaaagccaatttctcggtgttggagtgaaagattacagataaggaagggcaggaggctagcaggatctgcatggtgatgaatcagagttgaagacatccgtatgaactcatgtttagcttaacatgataa

SEQ ID NO: 34153 - DNA, 1048 bp, Homo sapiens
cattgtggtagagatctaactttagggagtgtctctatcagatcccatattactttttttttttttttttttttcattaaattggtcaagcagatttggtgtctggtgagggcctgttcctttagatggagctttctgtgtgtcctcacttggcagaaagagcaggggtgcccccttcagcctctaatcccactcactagtcacctgacaaaggccccacctcttaatgccaacacactggggattagattttaacatacgaattttggagggacacaaacattcagaccacagcaccttctgatttgtgtaacatctgatatgaagtttatttataggtggtcaggagattggcatacatgaaataaggtaaagaatggaagcttttgagatggaaaggcagaaatggaaaggatgagaaaaaggctgactgagtaatgaaggataatgaaaagccatggccaagtggaattttctactctctgctctcgtcctctctcagtactctctttagactggccttgagacctgtattctggtgagccctgtctggttctgctctgacagtgtgacttcccatgatgcaaagaatccacagagccaagatgtgctcacacataccctgcctttagattacatcttttttatgtccatatttacatatatattcacatgattttcttttaaactaaaattgttttttaaaaaaactgcagtggttttttttttccttgttaattcaacaatttctcagctctttccattttagattcctcatggatagattcatgtacatctatcttattatttaaaactctatatactgttgcatagtatcagtaccatagtagccatttccttattgacaatcatttaggttgtttgcagttcttctataccataaacagtgctacagtgaataccctctgtacacatatgcaagtgtgtctctgctttgctactctgtataagtagaatggccacaaaattttatgagaatcaccccaacaatagttggaagacgtggaatagctgtcaaggactatgt

SEQ ID NO: 34154 - DNA, 1042 bp, Homo sapiens
aaagttgataagaaaaatccatatgttgtaataattttctatatgggtaacatgagattaagttttatttttcttaaaggtcattgtgcatagatgctttcatttctcatttcttaattactttgggattttatttctaagggttaatactgagtaaatattagtatttaatgaaaaggagacatttttattacaaaatttgaaaacaaattgtttacttatgtttaactgtgtgctaaaatttaagtcttcattctactgcctttgaatagcactgcagtgtattctctgaccccaaagttttattttataaacattttgctggcatatagagaacataaagagttcaaatgtgacttgaatttccagcttttgagtattccttaacttgataaaatctgttattagacaatatttatttttgccatacagtgaaatttgatattttcatgactagccaagtactgccagttacttcaaaactaagtgggggaaaagaaagttcaaatgtcggtgtaagaatcttcttaatggtgttaattaatttaacaacaaaaataatttttactttacttttaaactgtttttcttctttatgacctataggattttcctaagcccagtgaagagaagattaagttaattctcaatcaaagtgcctggacttctcaatccaattctttggcgtcttgcttgtctagactttctggaaaatctgaaactgggaaaactggtcttattaacctaggaaatacatgttatatgaacagtgttatacaagccttgtttatggccacagagtaagtttaaacttgaatcttttcattttaactgtagaagttgatgcatgctgatgaaatataagatgatagaattgtctacacattattccttataaatggcataaatgttaactttgattgccttattcagaaatgaaactgcttttagtgctcagaaactatgaaaatgttaacattaggctgggtgtggtggctcacgcctgtaatcccagcactttgggaggccaagacgggtggat

SEQ ID NO: 34155 - DNA, 1308 bp, Homo sapiens
gctcttaacacctagttaaatgccctgaattatatgttgataatttgagtactctttctcagcccatttctcattccagatctatggctctaatggtttaaatccaaaactgcttatatagcccacagcaactcagagtcagaatgcccacagcagatcttatcatcctttcccttaaacctggtcctcttggctgttccttgtacagtggctcagccagaaggttttctttgacttttctctctctctcattctccacacccagtgaccaaaccctgtcggttttaccttccaagtatcttgatttattggccactcttgcctaggcgatatttgcctttcttctggattgctgcaatagccagttgcagttgctgctctctgcctcctcttgggcccctcttagctgtcttatcaaggcagccagagtgacttttctgaaataccaatctgataatgccattccatagctcgaagctgttctgccgcgctcttttgctcttcggagtgcctctgcctcttcccttggcttgcatggccctttatgtggcagcagcacatccatccagtagtgtttgttgcttccttctccactcagtctctccccttcagctatactgaactttcatggtccagatcagctctgagatctctctctccgggcctttgcacatgctctcctctcctccaggagtccttgacactctcttttctgtctcacaaccaggctaactttgggaaccttctctgaactccaccaccactgccacatgtacacacagacatactgtgctgggagcatctgttttgtcctcctgtcatgctctgttattctcatagcatagcacttgccacacttgatatttgcttgtttacttgcttatttcccctcccatggtggggccatgttgtgacttttgtgagccccaggtacatttgccttcataggtcccccccttcctagattaaaatattctaacctggagtagttatatattatttttcattttttattttgatttttttttcacgcttaattcactttatttttcttgtataaaaaccctacgttgtagccacagctggagcctgagtccgctgcatggagactctggtgtgggtcttgactaggtggtcagtgaagtcctgatagggagacttggtaaatacagtctctttccagaggtcaggggtcagatagctgtaggtcttagaaatggcatcaaaggtggccttggcgaagttgcccagggtggcagtgcagccctgggctggggtgtagcagtcatcgataccagccatcatgag

SEQ ID NO: 34156 - DNA, 1049 bp, Homo sapiens
ctcccgccaacgagttcgtcaggatgtccagccgcttgtgtctgccacctagggtctggggggtttttataggcacaggatgggggcgtggccggccagggtggtcttggaaaggtgacctttcggcggcaaggctggagtgcctatcctcacctaggttcgtggggatggatccctagtcagggaccacgccttcctctaccaggcacttcccttccccacttccatatcatttaaagggaccaggctcttcccgtcccagcacttccataacaatttgacaatttctggagacattttggttgctacagctggagggaggaatgcttctggtatctagtgggtagaagcagggatgctactaaacactctattgcacagatttatctggctcagaatatcagtgtgctgaagttgagaaatcctcatatagaggggttcataaagcttggttcttacatttattttattcatttagtatatttccctatgttgccagttggattgtgtcatagcaccggaagcaaacatttatttttctgactgaagtaatgtttgagaaaaacagtcattgagatggctgagcctttgatcactagagggtttaggtgataggcaaattctctctccaaggatctgttgtcatttaaatcattaccaaaatactcatttttactttgctctcctagcttagagtacagccaattgttgtctggtagggggatgctgagtcatttattcatgcattttattacctcttggctgcaatatcaccattcattgttcacaagccacccagcttgtttactttttataaattacatgtaatcaagtcctcttgcaggtctggctactgtaattggcagcagccacagagcagggctgacaagtctgcatttatgctgatgtctcatattcagcccactctccaagctttctttcctcttccatgtgtattttagaaggaaggcaaatagaaggaatgcaaagagagaactgttaaggagttttctcttttcagatgatcttaagatacttatagcttggca

SEQ ID NO: 34157 - DNA, 1068 bp, Homo sapiens
tgttttgtaaatctctcctttagtggaagggaaagaggatgcaactatgctgagaaatgtgtctgttatataaattgctattttaaaaaaccacttttaaaaactaagaacctaggaaagaactccggtacgttaaaccaagccctaaattttcaacagacattttaatgattatatattttatacgttgtgtgtacgtgtgtgtatgccttaaagtttttagattgaagttattaaatttcacctgtcttttgttgctcttaaatgatttacatgtaattttgtcagtgattcttacatgatcaccatctactcataattaattgtatagacacaattttaagtttcatagctttttttccagttgaattgtaacagcctgtttaaaagacaaatttataggcgattgtaatcttcatgaagcaatgtgagttgatgaatacctttgaatgttgtttcggtatttttcttttttattataaaatgttaaatatttcatttgtagagcttctctcatgtcaatttgttgtatttgacacaataggaatactcatgcagtgttaccagtttcgtgatatgcgttcaacatctctgaaggtggtgaatataaaatctgtttttcaaacaagtacacacatgaaactaaaacaatttattcaagtcctaaaacaacgttagtgaaacttcagttctgccactgtgcccacatttaagctgacagcatgtgtgtgtgagaagaagatacacattactgataatctctttagaatgcattaatattttcaggcccaaatatgagtattcagtaggttcatcagattaaaaaagctaaatgaaatttaaatattgacttgtatgtttcctttaattaattttggtgacttactaattggtatttgtggggatacgtagaattttttgaattggtgtttgtattctccatgttttagttataaagcactatgaagagaaagtgaatgaagaggctgccttcaggtgtagtaaggtttaacttctatcccggttccaacttgtcctgctgtcagcttgctccttagctccctggct

SEQ ID NO: 34158 - DNA, 1052 bp, Homo sapiens
aaaaacacagaaaaactaatgtgcagcactactaaaaaagaattcaaggtgtatgttgaacatttttcagattaaaaagaactcactggaatgtggctggattgctagtatcgccctgtggagctatctgggcttcatatgaggctattctaagtacatgcatcaaaaaagagatatagaagagtatttaaagtaatgataattggcctttttcaaaaaatgacttgctttctaaacctgaaaaatagccatcatgatactagagaaatagctgagatattaatatttcctctgtagattgttttgttttataagggcattttgtgtcttactaagaaatctcacataaaagtaagaacaccaaattaaatattagctcttgtggttattttaagactcatctcaataaccaagagaatttggttctcacactttgtaccttttgattgtaaacagctttaaacaggtttatgttgtacttcatcaaaaattatagaggatctgcagactgagacgcattgggactgaaattaggcaattcagagtttctcatgcatgtaagctgcttttattttgatccctatcattcttagtctgtcttttcaaatattctactggaaggactgttgtgagttgagggcaaaggagaaaatggcagggtctcgagccaccaggcctcataatacctgctctttgaggtagagtaaaagctaactgatgaatgttttccagaataatatttagatttagtctggtggtttttttttttttcttgttttgtttgctttggtttaagctcaatacagtcacatctgaatttacacaacaaaaatgtttccgaaaagttgtggatgaatccatttttaataagccaagtactataaaaagcatcagaagaacttgttaactgaacttatcctaatgttctgatcacctgtttcttttaatagacatagtggttgcaacaatgctttgattagttcctttttggaagctggcttttgttggggggagggtttttgtttcttgtatcttaaacttgacaccttgat

SEQ ID NO: 34159 - DNA, 1031 bp, Homo sapiens
ggagactttacagagcgtagtgccacatgttactaagaagtcagggaaggtaagccctttaaaaaaaaatcatagttatttaaagaaatattgtttaaattcctacaggactttggacaacatgcagaagtagttcaggtatcttgtttagcattaaggaagtgagagtgtgcttgtgttgttagcttcatcttgtcgtatacccaaattttgtgatacctcaaaatgcagagaccgaaaatgttcataaatgtactttaatgagatttctcaaagtgagttattgtttggagttggttaactctgtatcacgtatttcgatcctctttataatgttggctaaatgtttgttaaagaaaagtagtggaaaggaagatatatgaaaacaattagatgttaccttcttgtaagtcacattgaccttattcaataccaagtaatcattagacttttaattttacggaacaacaaatttgccgtggggaggtttaagaccaatggatcaactatataaactgtactagcactaggtttttgcatgctcttcagaggaaatgcttttccttgtgtctatgcattaatcatttacctttcccagagttttgtaatgtttaattccagtgcttcagggattgtgtttttatgtgcagatttaataggtggagttgggggtgtgggcagatataggacagaattagagagaatgcttttcttggttttgtggtggcggttttgttgtctgatgtataatcataaaggctaaagaacatttgtgctttaaatcctatggatcacacaaaaaatctaatgagaaaagccctatcttttgattgcttagcgataaacatgtttataaaaaatgtattcttagtctccaccttgtttattctgtcattaacaatttttatttagaacgcatgctgattctgcaaaatccacctcttctgaaacagactgcaatgataacgtcccttctcataaaaatcctgcttcctcccagagcaaacatggaatgaatggcttttttcagc

SEQ ID NO: 34160 - DNA, 1044 bp, Homo sapiens
aaagcaagaccatcttaaaaaaaaaaaatcatactgggaagaagacattagaaatggtagaaagctgtaagactgtagtttgtttctctcccttttgggagtggttgtataaaatcattggttgtgctctcattagaagttattttcttgtttttaaaagatattttgaaatgtgagttggttggaaatttaaggagccacatttttagatgaatgtgtgtagtggtaatagtcacagaattagagtttttaaagacgggttgagtcatatatagtaatttggtgatttattatgatatttaacaaaataagttaaaatttcgatcagttgacaacatccttgtgggaagaagagatggaaataatgacattagtatataaagctcagatttggaaatttattcagactctactgaatagctgtgtacttgttttttatttcctcttcatttacctgtgagtgataagtctatatttttctctccctttctagttatgttggatattttaagttatcaatttttgtttgtttgtttgggagcccaaagagtggtaattacttaaccagtctttgcttcagtttccttacctttaaaataatactattaggaatgtgttaatacatttataaacctgaaaggaatgcagatgcctactactgctaactatctttccaccctcttcctttctttatgttaaaacctccctcttttttgtctaaacctgcctcctaagaatttcccgatctagtggaattgcagaaagacattttaagtgtctattgaatttttcactggttaactttgtcagttttttaaaacttaatggttctgacatttaaatgattaatgacgttactttagtcttaggaaagctggttctaaacgtttgcataatatagctagctactctactcctttttagtattcccacctctttttatatactagattacttgtcatcagtaaatgtaatgcgtagtttatttctacgtgatgtaatttttttctcttgttacacaggctgcttttgtcagagacgttt

SEQ ID NO: 34161 - DNA, 1071 bp, Homo sapiens
ggagtagtgttaaagcatatttatgatgggaaaaaggataaaggtttaaattagtagattattttcctgttaataaaaaacacaatggcttaagaatcagatctgcttgaattctgacacttaactcttacatcttacaatcagtgtagggggtgatgtgtggttgtttcagtgttagaacctagaatggaatcctgacttaagggagaaagtattctcttacagttatacaaaatacagtggggggaagaagaattgcataataattaatatagacaagtttttgttgttgtttttgagacagtctcactttgtcgtccaggctggagtgcagtggcatgatcttggctcactgaaacctctgcctcccaggctcaagcagtctctccccattcagcgtctagagtagctggggctacaggctctggccaccatgcccagctaatttttgtattttttgtagagatagtgtttcaccatgttgcccaggctaatctcgaacttctgaactcaagttatcaacctgcctgccttggcctcccagagtgttgggattacaggcatgagccaccacgcccggccttaatagacaagtttttaaagcttagttcaatttacattccatggaagaatctaacaggttcacttttgaaagggctaaagatccatctgttttttcttaaatctagctacattgtgtataaacaactgctaatattgcattatgagcacagttggtatgtttttgcttgctgtatagctttgtttctacatacagcttcctgtgacggttcacaagtaaaagttggtaggtagagaaacttctctaacagacaccagattaaaataccctgctaagcaggttaaagcaggagcttgtaagaatgttatataaagcccttaatgacctaactcaggaattctcagcctcttttgacattttggtctgggtatatctgagaggggtaaggagagaggggagaacgtgattgtcctgtgtattgtagcatgtttaatagcatccctgatacttttactcactagatggcagtagtaacattcctccagttg

SEQ ID NO: 34162 - DNA, 1045 bp, Homo sapiens
ttagatgtgaataaacagtaaacagaaatgattgacatttgagataaaattataaagcattaaaccttacatttaaagtttcaagtttccagtaaaataaagtctgttcagttaacattatacaacacaatcttttttcagggaggcttgtggatcagaatctgaacaaaattgggaaagatgaaatgcttcaaatgattagacatggagcaacacatgtgtttgcttcaaaggaaagtgagatcactgatgaagatatcgatggtattttggaaagaggtgcaaagaaggtgagatgtagattaaataatgcttttaatatagaatgttttagaccagaaacaggaaatatttgttacattgatgataaataattttatttccttaaagagaagcttttgtgtacgtgaagttaatttattttgactgcagttttcatgctttctttgctgtgaatctaagaagctgattgttttgttctctagactgcagagatgaatgaaaagctctccaagatgggcgaaagttcacttagaaactttacaatggatacagagtcaagtgtttataacttcgaaggagaagactatagagaaaaacaaaaggtaatttagaaataggtttgggttacatgaaagctttattttactggaaacttggaattttaagtgttactgtaatgtcttataattttgcttaaaacagtagtcatttttgcttattcacatctgaatattttcatcattatgtaaaatttaatgccagtttttcagttggtaagctctgaaatatttttaaagtttttgtaatgaagtttgtggtatatgtttacagtgaaatatattcttgtatgggatgaatagtaatttgggatggtaacctgattcattttattttaaacagcagaattggctggtaataaagggaaaaatttcttaacttcataagtaatacttggtaatatagagataaattgaaaaatacccagagattagaagaaaaaaataattctacccagtgtttttcttgttaatatttaggtcta

SEQ ID NO: 34163 - DNA, 2055 bp, Homo sapiens
tgttgtttaaggatgcatttctaacaattaacagtgtaagttaatcttggctgttcttttttctaatagccattaatcttggctgtttttttcctaatagccagtaatatctggcatatgtttcttagcttattaatggatggttgtgaagtgcaggtgcattaaaatatatcattctgatgttatgtggctttttctgtgtaaatctgagttgttttattatttttgtatacttgtaacaggttgcctatccctcgtccaggtgaagttttgggattagttggaactaatggtattggaaagtcaactgctttaaaaattttagcaggaaaacaaaagccaaaccttggaaagtacgatgtatgtattatcaccttgtaaaaattaatatcatgagtcagttttatgagattttggggggatgatatgtatatttttaaaatattcttattttcaaaattatttatggaattaatgctgagaaatttataaacaaagctcttttgtacttttgaactaaaaatctgttaatgttacttaactgaaaattctgagttgttaagccttgatctgaagcagaattctgcttgattctgctgtattacacacgtttctatttaatttgtcccaataatgtaaaaatagctcaattagtttttgttgcagtcaatagtttgattaggcttttgactcatgaatggtaaatttccaactttagtacataaagaaatttaggagccactgtgtaatgttcttaagttagatatttttatttgtagatattataaaatggagcttcaccagagtgtgaatgccgccctattaattgttcaaataaatcataagtgtattttgcttttcatttctgaatccttgattaagtatccagaaagatatcttggatacctgaaaacattttcacttgttttgaaaatatgagcaggaaacattccttccagcttaacctcttattagatgcccttctatgtcctaggtgctaggaatctgcttttgaataacataatatctgttctgttttctttctttgctgctatagggaaatgagacttttattaattatgttcgcctccaaccttaagttaaaagccacaagtgttctatttgcatatataatctatttcctgtagcattcatcctctttgtcattgtattattaaattcacatgattctgtattttttttttttttttaggatcctcctgactggcaggagattttgacttatttccgtggatctgaattacaaaattactttacaaagattctagaagatgacctaaaagccatcatcaaacctcaatatgtagaccagattcctaaggctgcaaaggtcggtttttgatagagggaacttaacggatattagtagaagtataaaagatatatcaaaataaacttgttttactttgtgattctttttaatattgaaagaaaatagtaactgtttttggtatattgtggcaggggacagtgggatctattttggaccgaaaagatgaaacaaagacacaggcaattgtatgtcagcagcttggtaagtgtttattttttgtttgtgtgaatatatatttatttattttttgagacggagtttcgctcttgttgcccaggctggggtgcaatgatgcaacctctgcttaccacaacctctgcctcccgggttcaagcgatactcctgcctcagcctcccaagtagctgggattacaggcatgtgccaccacgcccagctaattttttgtatttttagtagagaccgggtttctccatgtcagtcaggctggtctcgaactcccacctgcctcagcctcccaaagtgctaggattacaggcgtgagccactgcgcccggccattttgtgtatatatttcaataggccctgaacttaagtgatgaaagtacacatctttatgtggattactgaaaatctccagtaattgttatatttaaacaattttcaactgaaatagcattcaaacttcaaatgatgacatgcagtatactttttacctggaagaggtgaaatacattgagca

SEQ ID NO: 34164 - DNA, 1024 bp, Homo sapiens
agtttacagattctgaaattatggtgatgctgggggaaaatggtaagttttctgttttgtgataagtaaaaatcttcctgtttatctagtaaattagttttaactgttttgtggaaaaatttgaatcatatgttatagggctagaagcagagttttatttaaacccacaaatttcttagtgtactttcacatttttttggcattgtgtaattcaatttcactgtaattcaatcaggttaatagttcttattttgttttataacctctagtgaaaataaggtgttctttgtcagctggttttttacatgtaaattgataaggcagttattaatcttataaattgactaagatggaaaggataaatggtgattcagaaataatccagctttaaaaattttttcctcatacacttcaatgtggaacttttcttattttaaattcagagcaatctacctttgtaaataattgtattaccagcatatatttcataataaattgtcataagtgtagatataagatgaatttgactactaaatatgtgatattgccttcatgatttaagaactatttgaattgtaatcttacagcttacaaaactatagaagataaattttatataaagattgttacaatgtatcagtctttagataatgggaattttgaattgggttgcaattaatttaaatattttatataagtaaactttaaaattacagttatctttcataaaacagtctatactgtcttaataaattgtgtgccctgataatttagctaagtagatcttttcaaactattgcaggatttaaactttatagacataccatttattaaaattgtcataagctttgactagtctttattcctcttaattaccttagaatgacacttcagaggtgagccatgaaagacttaagtatttttctatataaacttcagaattcaataatgtcagtgtatatctttaaaacaaatttctcagttaaaaccaaataggacatagtgatttactttaaacgtcaag

SEQ ID NO: 34165 - DNA, 1069 bp, Homo sapiens
tttcatctgtatcttaaatggccccaggcatctgcctctggaaaactattgagccttgcatgtacttgaaggatggatgagtcagacacgattgagaactgacaaaggagccttgataatacttgacctctgtgaccaactgttggattcagaaatttaaacaaaaaaaaaaaaaaacacacacaccttggtaacatactgttgatatcaagaacctgtttagtttacattgtaacattctattgtaaaatcaactaaaattcagacttttagcaggactttgtgtacagttaaaggagagatggccaagccagggacaaattgtctattagaaaacggtcctaagagattctttggtgtttggcactttaaggtcatcgttgggcagaagtttagcattaatagttgttctgaaacgtgttttatcaggtttagagcccatgttgagtcttcttttcatgggttttcataatattttaaaactatttgtttagcgatggttttgttcgtttaagtaaaggttaatcttgatgatatacataataatctttctaaaattgtatgctgaccatacttgctgtcagaataatgctaggcatatgctttttgctaaatatgtatgtacagagtatttggaagttaagaattgattagactagtgaatttaggagtatttgaggtgggtggggggaagagggaaatgacaactgcaaatgtagactatactgtaaaaattcagtttgttgctttaaagaaacaaactgatacctgaattttgctgtgtttccattttttagagatttttatcatttttttctctctcggcattcttttttctcatactcttcaaaaagcagttctgcagctggttaattcatgtaactgtgagagcaaatgaataattcctgctattctgaaattgcctacatgtttcaataccagttatatggagtgcttgaatttaataagcagtttttacggagtttacagtacagaaataggctttaattttcaagtgaattttttgccaaacttagtaactctgttaaatatttggaggatttaaaga

SEQ ID NO: 34166 - DNA, 1033 bp, Homo sapiens
acccagggttaccattgggttaaaaaacaaacaaaccaataaaccaagatttctaattccttataaggatttgtgcatatgcagttgtagagaattctttttctcccgagaggagaatgtataggatgtaatattttagcttggtaaaaccatttttcaagtgttaaaatttattgatacaaccaaagaataggaaaaaagtttctgaattaattctgctttgatttctttatcatgaccttaaataaggacaatgattttattaatcatttctgtcattcatttataaggtctgttttacctctgtagctaagactactcaagtaaacaattacgtatttacaaatgtgaaatgtaaagaatttgcctgatttttatgattctgacaggagcatacctacatttttaagtttcatagaaggaaatttacagtgtttacatttgttattacttttctgacaaccagtgaaaactatgtggaaaacaatattgtaatgactgaaaagcaagctccaaggacacaagaactttgtctctttcttcactggcacattctgaaggccaacaacaggcctgaaatatagttggtacttaatgaatatttgttgaatgaataaatgaaatagtaaaggaaacagatgaggaaattgaggctcatgactctattagtaagggttctccagagaaacagaatgagttggaaacatgtaggtgcatgagaggggatttattatgagaatttgctcatgtgattagggaggctgaaaagtcccacatttggctatctgcaagctggaaaaccaggaaagctggtggtgtaatttaatccagtctgagtttgaagtcctgagaatcaggagcttccatgtccgaggataggagaagatggatgtcccagctcaagaaaagaggatgaattccctcttcctctacctttttattctattcagaccctcaactgcttggatgatgcttgccaccttgactcttcttcattcagtctatggattcaaatgttaatctcttccagaaa

SEQ ID NO: 34167 - DNA, 1043 bp, Homo sapiens
tgaatttggtccatgataattatttgcctttcaagaaaatctgttatctgccttcataatggataattcccagatcaactcacacattgactaagtacctgtagaaaacacagaggaatctaggctagccgtgccttcaagttgctgacgttctatttgaggatacaagcaaatagccaataaagttagcctggataccagcggagttttatactcaagtattttcttggactttttttttttgagatggagtctcgctctgtcgcccaggctggagtgcagtggcgcgatcttggctcactacaagctccgcctcccaggttcacaccattctcctgcctcagcctcccgagtagctgggactacaggtgcccgccaccaagcctggctaatttatttgtatttttagtagagacgaggtttcaccgtgttagccaggacggtctgcatctcctgacctcgtgatccgcccacctcggcctccaaagtgctgggattacaggcctgagccaccgcgcccagcctctctcggactttttgagaccaaagaacacaaagatactatttttaatgtgaaatacctctaaaaatgttcattgaaagtagaaagattggcatcttaatacaagattgccagggtagggatggttgtcatagaaatttaccaaattggaacacatgaagacagagctaaaagaaaaatttatcttaatatcatcagcaaaatttgcatttgcaacatcccaaaaagaaattttatttatgaaaacccactgaccacatatgaaatggaatcatcttacaatgtaaacactcccaggaagtcattcagaactctgtgaaatgtctgagcactgcatttttgcaatctcatgaataagagtttaaatgtgagtcattgacacttttcctgctttttgttctggggaaatagcttcacggtaatattttcattaattgtatggagtgacttcagaatcatctccagctcctgtaccatcataaaggaagtcaacccagagggagtggtatgcactaaggtg

SEQ ID NO: 34168 - DNA, 1022 bp, Homo sapiens
actagcaatatagggttttgtttggttggttggtttgataaagcagtatttggggtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccataagtgtaaaataaaagtttacagaaaccttgcaagtgtctcttcatttttatgtagttttccatagaaaatgtttgttacataatgcctgttgcaaacctctccttagtaatatcctggaaagcagtttactatcaaacaggtacttcctacctctattctcaaccaacctattttgttgtactgagcatttaactctgtcattcattccttcatttaccttttcagtaagtttaattgggcatctactatgcaccaggcattcttccagatattggggacatagtaaacaaaacaggcaaagtccctgattccatggagcttgcattctaggcaataaacagttacagtcaataagcaatatattaggtagatatctggaggaaaagattcatata

SEQ ID NO: 34169 - DNA, 1046 bp, Homo sapiens
ggagtgcagtggcgcaatctcgggtcactgcaagctctgcctcccaagttcatgccattctcctgcctcagcctcccaagtagctgggactacaggcacctgccaccatgcccagctaattttttttttttcagtagagacagggtctcaccatgttagccaggatggtcttgatctgacctcgtgatccgccgacctcggcctcccaaagtgctggaattacaggcgtgagccactgcgcctggccaagaatggacattttttaaaaaaacatcagtacttcctaccactgctgcatgagtataatgctccggaattatcagaaagcataatgcagaaatacgaattagtggaacttaatcatgtgccatataagcttacctaacaaacagttatatccctattcctcaactgaatgtctttcaataaataagaatttatcatttattttctgcaacttttttatgtctcattctttaaacattaaaaacccttaatattttaacaaaaatttcttgattagaggcacagtgaaaaagaagtcaaaaaaaaaagttctacttttcatcagtgctattaaaggtggcagcaaatgtaaatcttggctgaatggtcttaattactcattaaaccacagtcagaaagacatataggtgctatttgggaaaactttttattacctaggatggggtttctctaattgctaatcacaaccccactgggtcatgtttgacattttataatgaaaataaaacagaaagtgccatagtatgttacagaaagcaaagatgagtattgtttctcaaagcctttgctttatgtatttatacacatactcattcatatctatctatatatatagagagagatagtggttcacagtaatcatacaaagtctttattccatccactattataaacatttctattaaaactaaaactgggctctatgtaaaaaccccaaagatacacacacaaaaaaaatctgtttgttagaactcaagtgaattcagtaaagttgcagaatacaaaatcaacatacaaaa

SEQ ID NO: 34170 - DNA, 1046 bp, Homo sapiens
tgggccatggaaccctttgagaaataaaagtaggagctgcttttccacaaaaatgcccaagtacaagtaatcttgcataagttttagggcttttggatactctgaagtcaactcataacctctgtaggtgttcgtagattccaagttaatttttagaatagactgtggactaatgatggaccatgttggacagggaaatggggaaatctaggagtccacgctattttcagtttttcttgttaggcataatttatcattgtgagtcatttaagatctatttagcaaatatttttgaatgaagtttacataattcacagccaggtgtttccaatatcatacctggaaatataaagtacacattagaacagggatgggtgtgtgtgctgtggtgtgtgtgtgtgtgggggggggggtgtgagtgtgtgtatttcaatgtgccacgcccattttcattcctgacagactgcaaagtaatgggtgtgtctattgtgttacgtcttctgattaaaacacaaggtgggatataactcagcaattctgagcatttgctgaagaatgctagtgctgatagaagtttcatgaggttgggtgtggtggctcatgcctgtaatcacagcactttgggaggccaaggtgggcagatcacttgaggtcaggagttcgagacaggcctgaccaacatggtcaaagcctgtctttacaaaaaatacaaaaattagctgggtgtggtggcacatgcctgttgtccgagctactcgggaggctgaggtgggaggattgcttgaacccaggaatttgaggctgcagtgagccatgattgcacaactgcactccagcctgggcgacacgatgagaccctgtctcgataaaaacaaaagaagtttcatgcaaacagtatctgaagtcagaattcttctatagctcatgacatgttctatcccattttggagatacacaatgctgtgattacagttatccctccatatcctcgggggattagttccaggaaccccttgaatacccaaatctgcagatgctctcaagtc

SEQ ID NO: 34171 - DNA, 1131 bp, Homo sapiens
atacctgtgttagcttggtgccttatcaacgaggcggctgagctggtgactgctggggtcttcatgggtgtgactaggccctaaacccctcaggtgggagagagtagtgggaatgtttttcgactgttctctcgaggcaacctcctgatgggtgagagttgcatagcaggcatgccttggtctgtaaattgactaactctcgaggacttggatgaacttagtagggaatggctggtgaaggagggagtaaaaagctattttttagcatttctaaaaggctgcgtaggaagtggggaatgaaaaaaagaaaacatctctttgaaaaatggggtacttggttacatatttatgtaacaccttctccctctttgaacacagctagttttcaggaggtccaggcccgtgtcagtatgctctagggtgctgtggatgatgttgattctggggtctagcttgaccttgcttgtgaggaatacttcacagacctcactacccagccagcacattcattttctaacagccacatttccagatttcctttccttccttctttcctcctgttggctttgtgttcctcagtgtagctctccgtttccttccagtcttcctgggaactgttccttccccaggagctgcccataaagccttttccccacctctgcttctttcttctcttctaatatttcaacatagtcaagatattttgattattcacatacattttacaaggacattgtaaagaaagggctttgtggcccaactgtggtctgagcagtgtttgttccccacaccgaggcagcatattttgatggtttagactgagaactgaacccaggacccaaagcctggctttaccatttaatgtgatctgacttctgtgccccttcttatgcttgtctctaaaatacagtgtgaaaatgtccatgtaatttgttatagtgagcattaaatgcactagtacatgcagagtactcacttggagcagcgactggcacaaagggagtgttaaataaatattagatggttattgcacatacttaacctgcttggaagcactggtgtgaaacaattttccagttaataatgagtgttcaaatttctttatgttgaacacagttccttatgtttcag

SEQ ID NO: 34172 - DNA, 1064 bp, Homo sapiens
ctggagcaagtttgcttttttaagctttatgttatttttcttacgtattttgtttcattcggttggtgaggggtgagtgacgtggaattaatttttaacattgctaagtctgaagaactgaaaaataacataggcttggaaaaaagtccattaaaggaagaaataaaagtgtctcttctatcctaatgctgtcttgatgattaagcagtaggcttggtacagatatgtttttttagatagctttatcacattcagagtggtgctttgttttattttcagatatttttcataatttgagcttcccagtggattaaccatgtgtatccttttgtttctgtttaatcatagttttttttttatttgtaggaagaaaaaaagaagtttgacaaagagacagaaaagaattatagtctaattgataaacatttgaatttatcagcaaaaaagaaagactcacatttacaagaggtataattttttatttttctgttacgttttcaaaatttgataagcaatacatgtcttttaaaaatgtgctttaatttggataacttttcatctggcattatatagagataacaaaaagtgaacaggtattgtcataaattaagaaaaaagtccttgtgaaacaagaaaaaataatgaatacatcttatagtgattaatgagctatggattcatagtagtaaaatttttgtttctgagcattattttataggaacataactttaaaccagcattagtgaagaacagatatattatttgcaggaatagatcaattaattggcttttgggagttcttgaagaaatgaattgaatttaataagctcatataccattatgcgtttatgtgaaggcagcattaatcttatttaatgctgaggattcaggaggttcaactttgttggaaagagagcatctgttttacttgtattaatagactcatttattttggaggcagccatatgtaagcaggaaggaatttatattttatttttcattttctctttgtttacttctaaatcccctgccatttgtttctctcactcacacacttggatgga

SEQ ID NO: 34173 - DNA, 1029 bp, Homo sapiens
ggaagcaaaagcaagaagggggaagtctacccctatgatcaagtcacctcccaccaggccccttctccaactttgggaattgtaaatgctacatgagatttgggtggggacccagagccaaaccatcccacatggccagggaggccctgtgtggctggaccccagtctgcctccacagctttctgttgtgccactctccagcaggctcatggcgccagtgaggaggctgatcttagctcctccagagtgtgcttttggtcttctatgcaccttctcagcttaggggacaactctgcattcaaaaaaaacttttctgagagactactttttaaagaatagttttcagttcacagtcagaagaggaagatagagattttcctgattccccccaactcccacacatgcatagcattccccattatcaacacccccaccagaatgctgcatttgttagaactgtggaacctaccttgacatatcataatcacccaaaattcatagtttacattagggctcactcttggattgtacattttatgggtttgcccaaatgtgtactgaatgtatccatcattctagtatcatacagaagatttcactgccctaaaaatcttgtgctccacctgttcatccctttccctccagtccctggcaaccagtgatctttttactgtctctgtagtttgaccttttccagagtgtcatctacttgaatcacacagtgtgtagacttttcagataggcttctttcactgagtagcatacatttaagctccctccatgtcttctcatggctcagtagctcatttctttttagcaccgaataatactccattgtcaggatgtactacagtttattcattcaccttctgaggacatcttggctgcttcaaagttttggtggttgtgagtcaaacataatttggtagttgtgaataaacatccatgtgcaggttcttgtgtagacatagttttcagttcctttaggtaactgccaaggaatgtgattgctgtgtcctacagtaaaaa

SEQ ID NO: 34174 - DNA, 1027 bp, Homo sapiens
aagtcccaaagaaaatagcagaacgttctttttgttccctcaatagcagaagacttatcgtagctaaaccctagttctaatcagaagccagtcagttaaccagtatttattagcatcacaggacatgcatagtcatgctctaggcctctgggatacgtgttcaacgttggttacatacaatccttgatttattagtggctgacaaaacaaaagatttgtaagtaattgaagtgtaccagatgatcaaaatgttgcaaatttgcaccgattaagagaatatgagtgcatgttgaaggattgggaagcatgtgatgttaattgaggactgtctttaggagtaggcttcctcagatttaaaggatgggaaagtatattttggcgtttagaggaaactcagcaaagatacagagaaagggtgactgagaaaagacaaacttggttgtgaaggaaacatggagaaacagtaaaagcaggcaatcaggcttatgcatttgattgtaaaggaactgggtgaatactagaaggtgatacgtagcaaagaaacaggcattcaaaaagtaaatatgaaaactaatattggtagtcatgcatgggatgccccagggttctgcttaggatgcagtatttataagcgaggtaactgattctggataataggtttggcagtggggtagatagtgcagatacagccgaatgattttgctgaagttgtaccagtcacatttagcagttggttgtatatagaggataggaattctgcaaggaattttaccttgaagtgttagtttgggtaatgaaggatgtcaaggaaattgagaggtccatgatctcataacgtatatcaggagcactaggggtgcttcttggaaattcagataactggtctcagtctacatctgttgaatcagaattgttgacgattgggtctctctgctttagacgatgagagatccaataggaatagtcaggtggagagaagaattttctgatcttctgcctttcggggacagaagatgccccaggggct

SEQ ID NO: 34175 - DNA, 1027 bp, Homo sapiens
attaataggactttattctatccttacaataaatcatcttgcttctgggtgtatttggggttggaggttgggtagttgtcagaaaatgacaatggtatattttcaagtagtgctgaaggtgtttttagaacagaagaaacttggtggaactgtcttgctacagagtaggcatgctaggctttgtttttgcattacattctgatgaggtctgtgacattttatggtacactgttagcatagtggtgaagaacattagcccaaaagactatcttgattgtaatctcagttttactccttattaactctgcctgtaacctctctgtgtctttatcatctgtgaaaagggataaggatcagatctccttcatggggttgttgtgagaactaaaagagaatgcttaggacattggcacctgttgaatagccagtaagtgtgagttgcttatttagagataaatccagtcattgaggccaattataattaagtagtctcattattgatttaaggctctaggagattgaagaactttctatttttttttttttaaaatagcaatttacattgggaaataaatcacccaaattcactttatctgttaattttatatggctcttagaacaaacagcaaaattaactggtttggcttttaacctcttcctcttcagtgatttgtggacatttgagcattaagatatcctgagcagtaaaatagccagaggctcaggaagaacaccacggttttcagattatctcaagcttttcctcagaagccaaacaaacaccacaaaacaccctgaaaaccaaaagcaggcattcttcctcctgggatttagtacctgctgctacagctgctctgaggtggagaggcagagggcagcagcgagacacaacattaggccttttctgatgtttcccatctctgcagcagaggaatgaaaaggaatcttgcaaaaagcaacggcccacttttgccttgagtttgagtctctttttgatttattgtagtaaaattttgctagtacttaa

SEQ ID NO: 34176 - DNA, 1075 bp, Homo sapiens
acagtctccataaaactcggtagctgagcagatatatattaataggctcagttgcacatgtggtatcagaggccagaacaaggtaggataaacctgtcacaggtcacacaactaggcaaagctggggtttggagcctagtctcccgactctaagccagacttatcctatggcagcagaaacagggtgagaggaagagttggtggacagtgcaacttattggtgataggggagcttgatcctaagggaaggcgcagaggctgtgagatactccttttgccaaggttcatgctgtgaggaaaaactgaagggcacattgagtgagtcacagccagtgcctgtattagatactgggatcgggagacctctgggagagtgtggggccccaaaggttactaatgaaatcggaaactccctgttactccgtcgctttcctctaggccctgtctcggcactttgccagtagcttgggtagaaagaatagcaacaagtctagggcatctggtctgaagctaaaatgctttctcttgtgttgcctagaaactgaaaacgaggccagccacctgtagtatacagtccattttgaccataatacagaggttacagctagtaaactttctacctttcgtatttgagacttggattcgggaggatgagacttagcatcaagtcttaggtgtatctttagaagcctaaaattgtcagtacttccaaaaatacgggtttagacccagaagtgagtatttgctttgcactttttaaaatatttctcacttttctcctgggatgggacagtagtgagtggatgtgacagacaaccccagtgggcacagccacccttacgtgccaaactgtctggtttctgtgttgagtctctggtttgtttgggagtgggaagactgtgggaatgagatcctaagacctttcctgaaagtgcctgctggtggggaggctaatcatcacaatacagaaatgcgtttacacaaagagtaggagaaggcgaacatgccagtgaaagcaagacttatataggaaagggaaaaacagattagttggtggcaaataatagctgtctgt

SEQ ID NO: 34177 - DNA, 1049 bp, Homo sapiens
agtatcactgtgggctggtgtcaaaaaggggatttttatccggttttgaaggtttagatgggaattttactcactgtcgaatcttgggcaaccagaatagcacctggcacatatctgatgaataaatatatgacagttgaataaatctgtgaagagaaggggaagagcattcctgctggggagacttcagcctgaatgtagccgcagaggatgcaatgaacttggttatttgtgggtgatggtcgagctgtctgttgtgattaagttgaatacactgcagtccctgtaggaagatgaggtgaggcccgtcatggatgtgtgcgtgtgtgtgccttacatacttgttaaggctagaggatgtgggctggatctgaaggctggctcttaaatggggatccaggggacattagataataatagtggtttgaaaataaaaagatagaagacagtgttcagaatggattatagttgtgtgtttctttttagggattccgtaataaatgtgtgtgcatgaaattcaggactgtgttgaagaggcagacattagtctgaagtttgaagaaagagtggacattgacttgttgcatttggaaagtgacagggaagaagtcaaagatttcaaatttctaatacttgttgatcagaaatagtgatccctttggttgacagggaaatttggaaaagaagctggaaaaggacatgataaactcactaatatgccttggcatattggttggtttatatccttaagatgtatttgatgccttttatatgaacatatatgtgttcatagataaaaagtatgttccagctctcatttagttcagagcctttgagaacagtgtagcaagaaatagaaaatcgaacaagacttgagtgtatgtattttacgtgcgatttccaagctgcttttgtgcaaggtttatttaaatttcatttaaaaatgtagaaactgtgttgagtagctttaattcccccttgcacctctcagtatgcattagcaattacttctctcaggttgatgaatttgaacttgatcaattatttga

SEQ ID NO: 34178 - DNA, 1067 bp, Homo sapiens
aggagaaatgcaacacttgatgtctgttgactgaagccctttatcccttgggaagtgcttggatggttactgctaatgcctttctaaaattacagtatcattgacttttgacatttcaatattgaaataatttagcatttatctgcctctgtgtcttcgataagctccatgatcacatctttttcagtttctgttagttggcacagcatcataagcagatggacattacagtgtggtagatgctgatttgtagttacacaattaaaatgccttttccactacagtaagctcctaattccctggcatatttcaagaatttggtattatgattaatttagtatcctagtttttttttttaaggtaggctgttcattctttgtcaatcagtagcaattaaaataaattgcattagcataagcaactttagatgatttatcttcaaaaactttttttggagtaccttaaaggtattatgttgtagctacatagaaatgattgcgaatagaaagctctgatgattaatgtcaaaacaagatagagaaaaaaatggttttatttaaaaagcccagagtatttttttttttgtttttgaagaagagggaaaaagacttggcagaaatggatgtgtgattttaaaatagattaggatgggctagcaggagagagactgaagatagtgaaaggttttgactctatttttctttttttaaattttttaaaattatactctaagttctagagtacatgtgtacaacgtgcagatttgttacgtatgtatacatgtgccatgttggtgtgctgcatccattaactcgtcatttacattaggtatatctcctaatgctatccctccccgctccccccaccccacgacaggcccaggtgtgtgatgttccccttcctgtgtccaagtgttctcattgttcaattcccacctatgagtgagaacatgcggtgtttggttttctgtccttgcgataggttgctgagaatgatggtttccagcttcatccatgtccctacaaaggacatgaacgcatcctttttaatggttgcatagtatttca

SEQ ID NO: 34179 - DNA, 1042 bp, Homo sapiens
ttgtatgaaacattcattcattttcattgcattctgtttgaagaagccacaatagatttatctgttctactgttaatggacatttgggttgtttccagttttgggctaatagaacgctgctgtgagtataggagtatgtgtcttttaatgagcatttatgtgcatttttcctggttatatacctacgagtggaatttttgggtcggtcatagggtatgtgtttgttcagctttagtagataactgccaaacagttcttcagagtggttgaaccctttaatgattaccatctagttagcatgtggaagtttcagttgcctcatgtccttgccaaagcttagtattcatttaaagccattctggcaggtgagtattactctttcattgtgttgttaacttctgtttcaccgatataggtttattctgttttcataggttttttggtcactggaataaatattttgtgaaattcctgccccggtcttttgcccttttgtctgttggattgtctcttttttccctgattggtttgtagttctttctaatctgattgcatgctgtttcttatgtatatatgtatttcagatatttagtactttgtactaaggtcattttctctgtgttgtccaagattttagtattacaggtatttaacttttgtcataaggaaaactattatccttttgaaaaaataaatgcccctttcttgatctgctttacctctctttcccattctcttgtttttttttgctttctgaacaggtgttctgaaatcccactcttctccccttctccagcagcttcctctttgtttaacctcctcattttagtagaaaggggctctcagttgataaaactggtgatacccagggccccttaatcccagtgtttccattccttgacctctccttacctctcgagtccactggctgtgcccagcctttgcagatttcttctcacttgccttcctgatgacatcgtacctccctggtcctcccacctcttcctcctccttggctgcattgcctgcttgacttagccct

SEQ ID NO: 34180 - DNA, 1042 bp, Homo sapiens
tgttttcacttgactaatttagaagccaacagtgagacaacttcttcaaactggcctttgcagaccagagttggcctcgggctacctttctatctataccctcgaagagctgtctctgcacaggctctgtgctttttgtcatgctatttactgaatttggaatgttccccttgcccctcagtcctgcctttccttgaacccttccccgttcttcaggacccaatctccaagggctctccattatgagacccttcctgagcttccctggccagccctaagtgaaactacaaaaccgtttctaaccttcttttctgtcagcagtaaatttagaacctaattctcttttgtcacttctttgacgcctgtgaaaactagcaaaatcttcaacaacaaacattttattgatttatttgatagttttccaatcaagaacacaataaagggaattggggtacactgttaataagagccacgtataataattccaaagtttgggggttaagggattgtgttttccagggctgttggaacaaagtacttactactaaccaagtggcttcaaagaagaggcatttattccgtcacaattctagagtctggaggtctgaaatcaagacgttgggagggccgtgctccctctgaagactgtaggagggatccctccttgccactcacagcttctggtggttgctggccgtccttagtatcccttggcttgtgggtccttcattccagcctctgctgtgacaggacaacctccgctgtgctgcctgtacacggtcactatccctctctttgttttcttgtaaggatgccagtcatattggatgaagaagccccaccctacttcagttatgatctcatctaaactgacatctgcaacagctctcttcccaaataagatcgtgtattaagcacgcctttttattctgatgttttgacatctggggcctcactgacccgaggaaactgcccctcccagggctggcccattcctggagatattaaacttctgcaggcttttcacatggaactctccaat

SEQ ID NO: 34181 - DNA, 1115 bp, Homo sapiens
tgacaaagtgaaaggcaacttcttctattgcttcctatgtaattttaactgtgcttctgtgtgggatgaacatttccccctttctgtggaggaggaaaaaaaaaaagcttatttaatgcctttaaaaaaaatacatagctgcttctgtggtgaaaataagttcatggcaggtaactcagatttatagaagagagaaaaattctttaaagcttctctccctgtggagtgggttttttctccacttctaatagcttttattttaatttctagttctgaattcaagcagctgtcactctctttatagccccctttgaaactcttgtggcgtaggaggtagctgggctgtctaagaaacatcttttcaaaccaaccaaagtattgtttatcctgaatgaaatggaattttaaggctgtcaagagtgactgatttgaaacgttttctttgatagccaggaagatgagcagaaatcttgagggagaaggtatttctctgtgtaaccaattccaagtgacttctgttgctctgaaaactctatggcccatgattaaaatgaccatgatctaagagtgttgtgtacaattaatagaacaaagccaacctgtggccagttcatttttacttactgaattcttaccagctgttgaggaaaaagaaatgatgcaagactgaggcaatgccagagaacactccttgtatttatcatcagttgtcttcagttggcttttcttagttctgggttgcatctttgcagcctggttccctctgcatgctcattctaccttcctttgtgccctcctaggctgtattaagaagcagtacagggtcacctttagatgaaagaaaaaaaagaaaaaaaaaaaccatttaagcctattaaaatgaaatttggggccaggcctagtggctcactcctataatcccagcatgttgggtggccgaggtgggaggatcagctgggcctgggaagttgaggctgcagcgagccgtgattataccactgcactccagcctgggtgacagatcaagaccccatctccaacaacaacaacaaaaaaatgaattttgagactggcattttggatctactaatagtctttaaaatcagcagcacaag

SEQ ID NO: 34182 - DNA, 1027 bp, Homo sapiens
gtttctttccaagatgcaaaaacttgaccattggaatggatacaaaggagaaggaaagagacaacacccagatttatttgtcagcccctgtttgagagaagtgtgaaaggtctgcagaaagcataccccattctgctattttgggtttatatgctatccgggatttactggccttcctgcaattttggtgaataattccagatttcccatacattccaaatgcagtatgtctactttacttgcagagtgccaaacactgatataggttacaaaggaagttatgaacttcctactctggaggaatttaaaagtagagttttctttgcctggaatggcaaggagaagaatgtgtaagaagagtgatggagtaaggtgtctatccatttggtttagctttttaaataattactttgcacagaagaaatgagatcaggaagaaagaaagggccaatatagccgataaattggcgggtagtaaagtacattggaacttggacattttttgaaaagttgcctctgtgtcatataccaggtatcagataaaagaagaaacccagcaatgtttgtcttttatagtggaagtaaagtatgaaggttaaaagcatagaccctggagccagacttggcctgggtttggatcccagttctgccactgagtagctgtgtgactatgggtcaattacttaaaccttgtgcctcaacctcatcatctgcaaaatcagataacacggtttacctcataaggttattatggagattaacaacctatataatggctggcttatagtaaacagtgttagctatgatattttaaatatactgttagtcctaaaccatttgctcctacagcagtacactttcctattctccgttcacttggcatctgaccttatcaataatttctcctatttttttttttttgtattttctttgttgggttatttggtattctgggctatctgcctggcttcctctcactaatattcaggcatatcctcttctgatgtctcaacccacccattgcaaa

SEQ ID NO: 34183 - DNA, 1062 bp, Homo sapiens
cctttatgtatcctaattatgtctcagttcccagccctctaggggaagagagaatggctgatacttttgcacatccttgtaacacctggcaaagttccctaccccatttaatagataattctgaaatgagtatatttgtcctccagtgggacccagaagattaagatagcaagaggagaggagccagccttggatccagaagattaaggataaaggaggggggaataccagcatctttgcctcttgctatttatttaccccattattagattattagggtatggagagttgccactggggtttggttttcaattcttcccagaagtgcagctgctgattgacaagaccttagagaataggaaaacagcatgagcatcagttggcactagctgccacagtgatgttattccccaaagcaccactttgaggggtgactgacacacccatcagctttcacagtcatgacagaagaagacaaaagagctcaattccctggggttctgaacgctttaacggcagaagtagttgaaattttccacatcactctgacacttgtccagtgttctcaagtagttataagttggcctttctatcatatttgttgtcagtcttcattttttttttaaaggaaagaatgatttaatgaccttatcagaattactgtaaagatttctggtgcaattttaaattaaaatgcaaattgtgttttttaaattatactttaagttctggagtacatgtgcagaatgtgcaggtttgttacataggtatacatgtgccatggtggtttgctgcacccaccaacccatcatctacattaggtatttctcataatgctatccccccaagaggccccagtgtgtgatgttcccctccctgtgtccatgtgttctcattgttcaacacccatgcataagtgagaacatgcgatgtttggttttctgttcttgtgctagtttgctgagaatgatggtttccagattcatccatgtgcccgcaaaggacatgaactcatctttttttatggctgcaagtgttccatggtgtatatatgccacattt

SEQ ID NO: 34184 - DNA, 1025 bp, Homo sapiens
aaccaggtgagccaatggtgtaagtcttggagtctgaaggctaaataacttggagttctcatgtcggagggcaggagaaaatggacatcccagctccagaagagagagtgaatttgccatttctctaccttctgcttctatctggctctcctcaaaagactggatcatgctcacccatattggtgagggcaatcttcttcacttggtctactgactcaaagtctcatttattctggaaacatcctcacagatacacacataaacaatgttttaccagctatctagttatcccttaacccagtaaagttggcacagaaaaaaagataaagaaagaaagagagagaaagagagaggcagagagagagagaaaacagaaggaaagaaggaaggaaatttggaaagaaaagataataaatgaaaggagaataaaagacaagaaaaagaaaaggaagaacgaagggaaaataaattagttgtgtattgttgcaagaaaactttggcgtggtagaacataataactagagttttagtacttaatcctccattaactatgtgaccttgtgtacgtaatcacacatctcctggctttttctcatcagatgaggggtttgaaccagaatatttttagagtcccttccaactctacagtgttacaacattgacgatgtaactcatatggcccaagactgttgatttgtgttgttcagaaaatgccaaaaaatagtacagttatatgccacatagtaacatttcagtcaactatggatggcatatataacagtggtcccataagattacaatggagtggtaaatttctattgcctagtgatgtcatagctgtcataatgtcatcatgcaacaccttactcgtgtgtagtgatactggtgtaaacaaacctaccatgctgtcagtcatataaaagtctagcacatacaattatgtacagtagataattcttgataataataaacaaccatagtactggtttatgtatttactatgctttttattgttattttagagt

SEQ ID NO: 34185 - DNA, 1061 bp, Homo sapiens
tcgatgaaaattacccaaagtccattctctttacctgtattaacatacaacattccaaaactttgtgataagtgaaaatcaagccaatgcttaatgaggctgaactgatatcccatctctatgtggtggttccctcataaaacattgatttttgtgactgttctctttgctgacttggtgactgcattggttgtgcttggtttcctaaattttcagtctcataaatagtttgcttgaggtattatatgatgattataaaattctaggcttacaacagactcttcaaattcaagaggaagacatgggaaggctttgtaaatactcaaactgatgaatatcacagtaatgaattatttctcccataaaactttttatagtctaagatgcagaacttagattcttccacattctctttcatttctgcttctagcactagcaactccctctcttttgaggaatattttttcacaggaaaacaaaatttatatcacctcatgatctgatctgtactgtgttggcacaagtagagaataatagatgtaagttgcgctgtggatgatgaggttataagcattacacttgcatcatgtccagctcaaatttttccccttcgaagttacttgctgttggtaaaaccaagaatgttaaatctgtgaatgctgagagcttgccatgttgtctaacctaacatatctttacatgataaagctcctaaggctttctttaatagatagatggtgtttaatgtggctgggcagcattttaattagtgagagaaaagcatgaatctctccccatcataggagtctgcattgccttcaaatttctctagatatttcaatatggcttctctccacactgagtttgaggacctctgagctaaacaacctgtggaagattctctcaaattgtaggtgtctggggccaaggattcagagtgaacaccatgtcggttgttcggtgagaaagctccaacataaaggagcagtaattcgttgccagagcacgctgctcaggggcctgcaagacagtactggtgagtcaaatatggcatcacactt

SEQ ID NO: 34186 - DNA, 1014 bp, Homo sapiens
taactggtcaaggaccatgcagtagtaagtgccagagctaggatttaaaccaggcaacccagcaccctaatccatgctcttaacctctgaggcataatttttgtcaccaactaaagcagacctatgccctataacttccagttcctactaaattgcttttttctttcttaaatcctatttgggggtataagttctatgattgagtggtaagtaagtgatctttcagattcaccaactgccttctctctttgataagattagactctgttgtttatattgcttcagagtttctccccctaattctcaatattttttgtctcagtgaaaatgattctgtttctcacttgctaacaggtttcatgatcatgtaaatgaaaaatacaataattataaagagaactgtggaaactgtattcaggtctgttttagcatttgaaacagtcaaaatacaaaaatgagtaatgtggattaaaggagctagctttacatgtcttaggaggtaatttgcaaatcagaaatcttatttccgttttataggcaggcagtgggcatgcacgccacgcacaacacaggaatatgtttgcttaatgacttaccagatctagcaccagttctggtttatgagcatggccctgactgttgccatgtagatgatggattgtaataaatgtgttcaaggacgttagatcacatctgcaaagagattcagagaatatctaccatacagcgtggaagaatgttgcaaacatttcttattaagaaaaggctatttttttgtgtgtggaggtctcacttcatctttctgtcctttattctttaactatgaaaactatacagtaaattcttttgtcattaaatcaactttcaaatctactaaaatatatcttaggatataagttgttaccattagatgacagctttgtttgaattcacttcatagccttgactttctttgagttcatttttaatcaaagcaatatattgaataaatgtattatacaaaacagcagttgt

SEQ ID NO: 34187 - DNA, 1046 bp, Homo sapiens
ggttgcaagtgacagaaacccaaataataccttcttaggcaaaagaggaattttttgaaagaatgcttgagaaattgtgtataatcagcatttgggctgaacactgaaactcaaggaggatggagcacaattctctttctcactctcactctcactctcactcttgttctcttccttatacttgctccactctcattctagctctggtttctttttctctcagtgattcaaagcagcctggtaagaaaaataaggtgttgactgtttctgaattttaacatgcctggttgaagaatcctggtgaaagactctgtgttgccagtcaactctgccaagaaaaaatgatgatcaatgaatttactcagtttgctacattgtgagctctttcaagtaacaagggagtctatcataaaagtttcaatgctacaaaggacaatggtgaggttaagaccctgtcctcccttaagtgacatggacagtcagttctgaaaggaaatatcagtctgcagaatccatggcaaattcaagctaccccataggagaaaatgcttgaaggtcacctggaagtaccgcattcaatgttgtagcatatttgggagccactgggaaatccgtgccacccacagactggccaggaatgcagcaaataaagtaaggcttttattttctgagaaagtatgggaaaactgtgaggcaagggtaatggtgcatagcagctcaggctctgcaaacatttgcattgtggctgaaagccaaggctagggcttggaacctgcaggactgtagatgagatcctggtgttgtagcagaaaagtccattcttcactgtacacaaaggaaagttgatcctcaaggtgaaataacaagtcggtggcataaatttccttaacatgaaagtttctcgactcccatctcttcttttttatataccatcttgcctttgagaaattatgttagctctgcaggggtccaatttggcttcctaggcatttatggtctgagaagtactcaggcttaactttgtagagggggacaaatatccccaa

SEQ ID NO: 34188 - DNA, 1043 bp, Homo sapiens
aggaggtttggggaatcaggaagtactttagaattcaactggttcatccacttcagtttattgctaatgatactgaggaccaaaatgtggagaaatgaattatccaaggtggcacatttggtcaacatatttggtccagtgcttctcaccctgtaatccttgttattctctcaaaaccaatctagactatttaaaagaaaggaaggtgggagaatgccaaaggaaaagggtgaacatccccttttagtgaacccactaaggttaagggttcacttaatgggtttccagcatctgttctttagaccaaatgcttctatgatagagataatcatgctaataaaatcaaattttgctttttaggtgagagttacgtgtgtgcatccaatgaaccatttcgtaaagtcgattacaccaaaaatattaatccaaactggtctgtgaacatcaagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggtaagatgcttctagctcccagctctccatctgacttttaaactccctgtgccatggtggctacatagtcaacaatagaaatttagtagtgtgctagaaatccttctgggagtcatacttgagattgtgtgtgtgtgtgtatgtgtgtgtgtgtgtatgtatgtaaaattaaccatttttgtgaaaaatgtaagcgacttaagtacctcaaaagtgattatagagaagtctatcatatacttcttttggttattggaaggaaaatgtaaatttctgagggaaaagtataagttgaggagacatcctacgttaaatggcatgtcatctatttatgaataactgttgatt

SEQ ID NO: 34189 - DNA, 1180 bp, Homo sapiens
ccttttgttcacaactttttttttaaagacggggttttgctctgtcaaccaggcttgggtgcagtgtcaccatcatgggtcatggcagccttcaactcctgggctcaagcagtcctcctgcctcagtctcccaagtagctgggaagctgggactataggcacatgctacttcacccagctaatttttaaatttcttatagagaccgtacctggctagttattttactttttgtagagacggggtctcactttgttgcccaagccagtctcaaactcctgtgctcaaactgtcctcccaccacagcctgtcaaagtgctgagattacagggataagccaccatgcccagctaacattttgatcaaccagtcaatatacaagcttgttttatgtgtgcttctgtttaaagccaccatagttaatgtatactgatgattgattaacattgaattcatggccaacatcattattactcacgacttaaaaaagcttcactaacatgtattttctccataaggtccatcagaaacttctttcacttaggaacaccagatagcacttcagcattatgcccggggaccattttaaacagctaaatcaccaacaaaaaggtcaaagaaatgtgccatgaccatgaaaagaccgtgaaaaggacacgtgtttaccatatgagaaatgaaacaaggtagaacatcaccttaacctcaccttgatgtgcacagcgcaactcagattttttacctctctgtgcatgtatgagaatgaccacgaaagtaccacaaatattgattttgagattaaagataaattttagcaagtagggtgaacttgtacttacagaatctgtgaataatgagcattgaacatactttgagtttcaactaataggtagcagtgagcaggtctgaaatgcaaaaccacctatcaacatggcaaagtaagtttactgtttggttttaaagggatgatatagcaggatatagtacattcatatataataaaccaaggcagtgttttttaaaatttgggagaactggttcaaaggatggaaaaagttcctgtgtcaacatttccaaattaaacatgaaatgtatatttttctctctgataagagaatgtgaacaaggtgttgtgggtttgataactgattgtgctaataatcattcagtgtcagctaatta

SEQ ID NO: 34190 - DNA, 1158 bp, Homo sapiens
atgagcagtccatcctagggctcagtaagagtgtgttccttaatactacaaagttctgcccccactaccattggaagccaaagtgcaccccctccccaccccccgtaattccttgtgtttctgttggttagatttcacacatctttgttcttcctttcttagcttaaggcacagtcttttacccaggactctcatctgacacaagtaggacctttccttctggaaaatgacaaaaatattcccaacataaaaattaacttctaaaaatccctgcacaggactgaactgactgatgctttagggttatcatatttagaaggaaaaaaatggactgttaaaaactttagacaaattaaacaatttatttgagcatagaatgattcgtacatcaggcagccttccgaacaagaagtgggttcagaggcctggtgcagtggctcacgcctgtaatcccagcactttgggaagctgaggcggttggatcacctgaggtcagcagttctagaccagcctggccaacatggtgaaaccccttctctactaaaaatatgaaagtagccagtgtggtggcaggcacctgtaatcctagctactcaggaggctgaggcaggagaatcggttgaacctgggagatggaggttgcagtgagccaagatcgcaccattgcactccagctgggtgacaagagtgaaactccgtctcaaaaaaaaaaaaaaaaagtgtggttcagagagctctactctgcagtgtgggcacacagcatttatggatagaaatagaagtagggtacagaaacagttttattggttacagctgggcattggctttatttgatcatgatctaatccattggtggcctgtgattgacagacagctaattgttacaaaagtatacagtacacctaagttaggctttcagttaagttaggttataattcctgaagtagggacttaaaatacagaacagccgcaggccaaatttatttaacaggatgtacttatactaaaaaatgatctgttgcttatctgaaattcagatttaactaggtatccagtattttatctaaccaaccctagatgcaagtagtttttaaatttttatttatttattttcttgagacagagtctcactctgacacccaggcttggagtacagtg

SEQ ID NO: 34191 - DNA, 1055 bp, Homo sapiens
gaccagggtggtggccgtgggtggggaatggaatagagaatggtatgattttcttttaggctttccttttatgtcccttctctggaccttgtttttaaacactgtagctttttaaacattctgccatagagtgctgtcgatttggagttgccttcaactttagcagctgaaaattaaacagaacaacaaaaaaattaaattttgaaaaattgcagttgtccatcagttgtcatttatcatgaggaaataaaatgattaaactcctaggagtcacatggttagcctggaaccattagaattatctatagttctaagccttattgtgccactaataactatcttatccagctatcatgccatagagtcttttgattccttttatggaagtaaaaaataacataatttcaaaaaaaggtaactgatgatttttcttatgtctaatctgaatgaaatatctaaggaagaaatgcactgatgtgatgtgcataaggagagaggtgagatgagaagaaagggaacgcctcctcggtttctgtgacacatttttacattctgtaagcattttgtgtgtcaacggattagttagctagggatttgtaaattatcctgataaataatggtcattctcctctttcagcagatttctgctcatggcagatcttcttccaatgtaaacggtggacctgagcttgaccgttgcataagtcctgaaggtagttctcagtctgatcattactttgataaaggaaatcatgcatggggacttggtgctcacctaaaactcacttgtgctaaattacgatcttcctaaagagggatgtgatcacatcacctgtcagcccctttggccttagtaagaggcggggatgggggttacttcaagataaagaaaaatctcattgtcattaactaggttattgaagcttcagattttagacttgggcttcttttatttttgtggtgatctgatcacaacttctaaatatatttcctttctctcaattagataacaaaactgtgttttcttgatttggtgtcttctgtgtgctggacac

SEQ ID NO: 34192 - DNA, 1062 bp, Homo sapiens
gacagagcagggtgcatgcaggacggcctcccatgtaccccggggggctcgccccagttgcagagaccaggagagaccatcttgtggtgggaagggaatgccgagaagccgccgtcactcggcgcctgcggtgcagacttgagaagggacggattcaagggcattgccttcttcgctgggggattatgccttgtttcagggggaagttggggaaggatttgggtttattgccttaatttaagatagacaaaactgtttcactcgtgttgcttctgttgaaagtaagtctagtttctgtccctgcttctctcctgccttctgcctctcccgccgcctgcattgcttccctctggctaggtccaaggccatggtatgtactaaccgcactgccagcctgccttctgccacacacgcccctgtgcttctgacaggaagagaaaaggagaaataacggggggattgttttcttgtacccaggagacattttgtggtaggaaaaacctgtatgctggctctctgcttcccatgtaggtgggagcatcttttagtggagttttccacagttaccctttctccaggtagttgaaattgtccttggaaattgtagggatttggggagttttgtttattgagacaggatcttgctctgttgcccagactggagtgcggtggtgtgatcctagctcactgtatcctcaaactcctgagctcaagccatcctcctgcctcagcctccaagtagctaggactacaggtgcacgccaccttgcccggctaatttttaaattctttgtggagatggagtctctgtgttgcccaggctggtctcaaactcctgacctcaagtgatcctccctccttggcctccggaagtgctgggattacaggtgtgagccactgcacccggccagaaatggatgactgttcagcttgaacttgtgagggcctgtggagaagcagccattccataggtggccccaggtgccctgaaggccgccacccaagttcatcttagaaagccctgttgttgattcttattttctccagactttttttgttgtt

SEQ ID NO: 34193 - DNA, 1073 bp, Homo sapiens
aaatgttagatgctggttccaacttagaaaagagtatgacagctccccaaggcatagaaaagatgctagctccttacatgtatataacaagaaggcagtaagcactgttcaaactactcttgatatgtttttcacaaataaaataattatcaatgtatcaaatgttttaaattacagtgtattaagtacatgtgagttttactacttttttcatgttatatgtataactgagtatgagtttttaatgttttgacaaaattattcttagagacagggttttgctgtgtcacccaggctggagtgcagtggcatgatcatggcttactacagccttcacctcctgcaatcctcccatctcaccttcccaagcagctgggactacaggtgtgcaccccatgcccagctaattcttaatttttttgtagagatgggggtctcactatgttgccagactggtcttgaactcctggcctcaaatgatcttcccaccttagcctcccaaaatgttgggattacaggcatgagccaccatgcccagcctgacaaaaatttttaaagaccatggaacaattgtaaaatttaccaatgattattcagatcactttgtatggtttcagttggcgtgctcacttttacagttccatactactgtgcaaagaaaagatgacctgtaatatataataggttcattttacgactcctgttggctcaggacgtatgaaattattgagtataagggaaaaatccagtggttatagaattattgctatcattattactatttcaatgttttgaccaaatttataaacataatcctttaaatatttaaaacaccttattaactagactaataagtattacattttaggacacagaggagctgatccaaatactctgtttccccaccagataaacccaaaagatgtgagatataatactttgttgtgtgttcagacttcagctcagagcagagacagagagatggatagactattatgatgggataagtaagcaacgaattggaaacagctccattcctagtcagatcctgatttgttgcatgtgctctaagc

SEQ ID NO: 34194 - DNA, 1029 bp, Homo sapiens
cttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcaggtgagacccaaagttccttagagtggttgtgctatgggtgtttgaccaaggatagcatggtttgatgactggaaggagcaagttcattttatttatttattgagaccagtgaaatgtccacaaagttcattttaaatttttgttttcttgccgttgttgagtgctaactctggggttgccacaccatattttacttactatttaaatctaagatttaatagtggtgtatcatcaaagtcagattttcttgctgcatagattagtggttttttgaggaacgtttaggtgcaggtgggcggttttgcctgtcttaaggatgttttttgacctcagaattgagtgaatgttgattaactgtggcagtagagcataattgtggcagagcctctggagtgaggttaaaatctgggctccatttgcctattgtgttctcgttggaaagtaacttgttttctaagcctcggtttctttatttgtaaagtgcagataagagtgtcattttattgaattgtgaggatgaaatgaaaatatttcagatgtgtctggctaactatccagttggaatattttgtgggagttttttgtttttgggagattgagtctcttatcgtccgggctggagtgcagtggcgccatctctgctcactgcaacctcctcctcctgggttcaagggattctcatgcctcagcctcccaagtagctgggattacaggcacccgccaccacgcccagctaatttttgtatttttagtagagacagggtttcaccatattggccaggctggtctcgaactcctgacttcaagtgatctgcccgcctcagcctctcaaagtgctgggattacaggtgtgagccactgcacctggcacagttcgaatatttt

SEQ ID NO: 34195 - DNA, 1062 bp, Homo sapiens
actgtaaccactgcttcctgggttcaagcagttcttgagcctcagcctcctgagtatctgggaatacaggggactgccaccatacccagctaatttttttaaatttttagtagagatggggtttcatcatgttggccaggctggtcttgaactcctgacttcaggtgatctgccagtactctaaatgataacagttttttcgtgtttatttattttgaatgaagctgtctcacagtagatggagttgaaggacaggaaatgtttttcccctacttggaaaatacactgaataagttgagtggggtgggatgtgcctggagtcccagctactcaggaggctgaggtggtaggattgtttgagcccaggagtttgaggccagcctgggcaatatagggagaccctgtcccaaaaaataaaaaatatacgtatatatatatacacacacaaagaaaaaatacactgaatagacaaaacctttcatgattaatgatgcacgggaataagtgatgaaaaaagtttcggtcccagatgatggccagtgataacaacatttttctgatgttcccatgcaatatacagttagctaagagggtgtaatggaaaaagcataaggcttggactcagaagactctactaactttgccactagctagctatgtaattcagatcatctatcctttacatgtgaaaggtaaataatggcttatcttaacaggaggatttatgcaggttaaatgaggtaggtgttatgtgtaggtttattccaaggcttctctacttttaaaggaaatggcttatatctgagaactaggacttttagaaaaaaatttactgttactggtttgcaggattccagacagcattggaaaagacatagaaaaggcttgccaatctatttatcctctccatgatgtcttcgttagaaaagtaaaaatgctgaagaagcccaagtttgaatgtaagtgagaaatcacatgattcctgtagggccaaatacattgtttttgggtggaggaggagtgtggggccatatcatggccttctttttcttcctgtcatgc

SEQ ID NO: 34196 - DNA, 1032 bp, Homo sapiens
tttattctgtcatagttttggaggccggaagtctaaaatcaaggtataggcagaccccattttctccaaagactctaggggagaatccttgccttttccaacttctggtggttgtccttggcttgtggctgcatctctctgctctgtctttgcatcattctcctctacatgtgtccctgtctaatttctttctgccttgctcttataaggatacatgtgtgctcgcttcagcaacacatatactaaaattggagggacatgttattgcatttagggcctgcctggataatccaagataaactcttccctggaatccttaatttagtcacatcttttgccattcaaggtaatagtcacaggttctggggattaggaagtgaatatctctttgggacgtaatttttctgcctatctttaatatgatacatgagatttgcttttaaaaaaacaagcggggcggagagaggaaatggaagattatagttggctgaatcaaaattggcaatccattcattgttaactctgagctgggtgatgatagttcattgtatgggtctctctactttgtatatgtttgaaaatttccataataaaaaacaacaaaaaaggttagctctcacaccaagattctttagtaatcatttcctctcagaacctagaaaataccatattaacattgataaatgcaacgcttaatttttttttctgttcataaaaattaggtatgagactgcagatatcctggctaatcctttcatttcttaccaccatttcagacatatttctttgtgcttctcaagaaaagtgaagggtgaatgaaaatctcttcacttgaagttcagaaattataaaatgacctgaggtttaaataggataatcaatttttcttcttactgaactattggtgaatgaatgaagtggtgtggttgtatttgaagactcattggcaaagtaacttatcataatatcttgccaggcagatgaaatcaagaaagggccaacagttttattatagggaggtccccatctttc

SEQ ID NO: 34197 - DNA, 1047 bp, Homo sapiens
atatgggtaaccagtgacagagctgggttctgaatccagatctctaaagcaaagctggtgaccttaactactctgtagtacagcctttcctctggaagagaggcattatgtgccataagaaataatgcaactcctctttattgaaaatatgagacaaattcagatttggaagataagttagtaaattacttgagcctttattgaactagcaatccaatttaatagaaatttgtcaagggcctagtatgtgtaaagcattatgttaggtgccagacaggttatcaagatcaccaactcacagagcttttaaaatatgtgtgaaaataactttcgtataagacaagattcattcattgagcaaatatttacttggcacctatgttgtgctaggactgaggtagacactaggaatcattcatctagtcatgaattcatgaattcatcctgaacttttgatgatctgctgtgtgccaggcactgttctaggtgctgagaatatagttgtgaacaaagcaagcaaggttcctattctcattgggtgagtgaggaagagacagacaataaatatgtaagcaggaaaagacctgctcttcagagaattaaagtcagatggtctgcagagagtgactgggtggctgtattagattgcaaaaattagttaagacttggtctttgctctggaggagatggacttgtaactccagtgtgattccatttgtgcagtgatcaatgtatgaacaaagtgtgctgggtaaatccaactgtggagagccttgcatatcctcatgaggaaactgagggatgactaggcactgtgctgacaggatcagaagtgtgtttaggatggtaaggttgaagcagtcagaagtctaggctagacaggagagagattgataagatgtgatgattactctctggaattacagccctagtcaagtgcagggggagggagagaggaggaagtgcttactttttgctgagaggactagaaagtgcttcctgggtgaggtaccatttaaacctggtcttttaacatgcagagatgaa

SEQ ID NO: 34198 - DNA, 1030 bp, Homo sapiens
aatcattggaatttgagctgatctaatctggtaatgattttagttccaatcagtgtatgcagatcttgcctcagaacactgtgtagtattagttggttgtttactattgagtaatgagtaggtcactggttaggtaaaaagaattgacctcctactgccaatcattccttgattctgttgtctaagaaaatatcttttctttttcacactatgcaaggaaacccttgctcttggtggccagatgaggaattggactcctttatgacacacatcttttaaaaaaattgatatgtaatagttttaggtattttgggggtaatgtgatattttgatacatgcatacaatatataatgattaaattggagtaattgggatatttataacctcaaacatttatcttttctttatgttgggaacattccaattcttctagtcttgctattttgaactatacaatacattgttgctaactatagtcctatagtcaccttactgtgctgtggaacactggaacttactccttttagctaactattttcctactcattaaccaacttctcttcattctctcctccctccaccctctctcagcctctggtaactacgaatcaactctctacctcatgagattcactttttaagctcccacctgagtgagaacatgtggtatataaatcttataaataaaaatcttttaaattaaaattatcaaataattaaaggggtatctgtgatgactggatttgccctatttaacctccagtaaaaaattttcctaaacctgcgttggtataaatctaaatgggtttgggtgtggtggttcacacctgtaatcccagcactttgggaggctgaggcggctggatcacctgaggtcaggagttcaggaccagcctggccaacatggggaaaccccatctctactaaaaatacaaaaattagccaggtgtggtggcacatgcctataatcccagctactcgggaggctgaagcaggagaatcgcttgaacccaggaggctgaggttaca

SEQ ID NO: 34199 - DNA, 1029 bp, Homo sapiens
ttttgtatagcttgaaaaaaacctatttgtttttattttacagtattattgtgattattttagagtatttgaaagctaatgacattattttaaagaggatcttttcaatggatagacttctgggaatgacagaaggagattttctaataaattagagagttatagttgtttagttttctcatatcaataaatctctgtaataggtaaatatggtcttgtagtggggcttttttggtaattttaacagtttttttccccataaatgatgtatgttaagaaggtatgtgtttctgaattattagttatgtccttttatcattaatggaaaacctgtgtgggctaagtaagaatagaaaaatatgaaatgtcagacaacttaaagtttctgatatgtgtgaagctattaggtgaatttaagcccttgaccactgacaggtgcatttggaacaggaaattgcctgagcagtggccttctgcatgtagggaagagccctggccctggaagtgtgctttctgaatctgaaattattctatttggtctatccgtgttgtgccctaccaggaaagggagagaggggttttgtgttttagaagaacctcacaaattctccatgttccagaacttattactgactgtaaaactgcaaagtagagtttattccttttccctccacctgtcacatatatgtcttttgactgattgagaaatcttaacctttttggaaattagtggctcctttctgtgtttttaaaaaaggtgttttttagtatactgtctggctgccctagttctataatgtctttgatttaactccccttccgccccttttttaggtatctctgagaccttttttggaggggtggggatcacaaactcagaggccaggcaggtagtataatatgaatataagtttctagggaggaatggtaagaactatgacagactggaaaatacttctatctccaaaggtaattaaaataaaacaaaaacagaaatatattttgatggccaaacaggaaatccagatt

SEQ ID NO: 34200 - DNA, 1058 bp, Homo sapiens
gtgtagacacaaaacagctatttatgattgtgtgcttttctgggaagagtagggggaagggaggcttagggaaagatttgttaaaggatccaaaattatagctagataggagaaataagttcttctgttctataccatggtaggatgactatagttaactatctagctgtaattttgtatcctttaagaaatctctccctaaccttcccttccccctagtcttccaagtctatcattttagagacagtttaagatacggaacagaaaagctgataatcataaatagcagttttatgtccacgtaggacttcttatgaagttctgtttctaattaaggtatttcaggaacaaagtggtattgcataaatttggagctcattttagactaagatttaataattgttaataggcattgagcctgtgtttaagttttatgttagcatttgttgggtaatgacttcttaaattcgggatttgactctgatgaactctgagttttggtcttaagtttggaatgtgtgtgtgtatcctctgttacagggcttttcccagttaactccaaccaatgagagctcctctgatgttttagggagctttaatttcaaggtccttagcagaatgaacattcttatgataaagaattagccactcatgaatcctggggataacctatagtcgtttacaaccattcacctgtctgtagagcagaagttgtttggaacatgttcttgcctcttagctctagaaagcagcatgagtgatagaatgatatttatactggtttggaaaaggtcagaaaccaaatattgttgccttagacgtgaggttattttgagttgtgcaggagactttgggagtggggtgtgaagagtacaaaaacaaatatatgtaaaagggaaggcctggcaaggatactaagaaggtagagggagtagcttaggtggttgtaggactgacttggataatgaaaggatgtaacacttgggtgtattggtttcttccgaggaaatgatggtggatactaaaggtagcataacaaggaccacccaagtggaaaa

SEQ ID NO: 34201 - DNA, 1070 bp, Homo sapiens
ctgatttactgaaatgatggacgttttacagtgaatgagctggagttaaactatggcaaattgagggaggcttaagcacaaggtccagaagaatagggggctattagatgcttgctttatttttcgcagtccagcattgccctgtgatattgtggtgagagagaaaagagaactgggccagaagattagagcacagggaggatttaggtttaataggattttatgaggctctaagaagaggttgtctgaggtaatttgacccaaaatgaaacaccctcctcaatactgctattagttataattgagggcacaaggttcacctctcttaaggtgttcccaatatttgatgagtcttcatccttagatggaattttacatgataagcacatttacagtaatagactttttatatattttttatgtatttagtagcagccaattcagggcattccaaagtacattctcaaacaatgaatttttctattggcagttgctcaggaaataaacaaaaaaaacctcaatcatggaattatatttactgtggctgattcctgtgctgtacgttccttaagtcaaatatgccttagtagtaaaaagaatcccatctgcaactagatttcttataaagatttttgtacaaaggccatcatccttctttaatgattatctgattacccctctccaattggtataacagttgtgataaagtacataaaataatgactcaagctgtaagagacctaagaaatcctactttagttgtaactgcttacttaagtgacattccaaaagaagagtcccatttttcactcaaggtttcacagctggttagagctagaactagagttttgggtccctgcctcctagctcaaagctcaggttcccaggttgggactttaaatttttagactttcaggcttggactgagccaacaactcttagccattaccctttgttccctactttaaatctacctatattctctagccatttccacaaaccaaccagagtaatatcaggagggatgaagaaggaggggtaggaagggagccagctgtgcttcccatcaa

SEQ ID NO: 34202 - DNA, 1033 bp, Homo sapiens
gatagattaaaaccaccacttaggcagtgtcttgttgaagttagtgaaaacaggtaggggtgtgtgtgtgtgtgtgtgtgtgtgtgtgtgtgtgttttcccaaactgtaaattgtttgctttgggaccaaggaaaggagaatgcagggattcttctagtttgatattgaaatctctcctttaaaacattagtgtttctaaattccttcctagacttacagaaggaaatgaggctgcccactttatttcctgatttgtggttttgaggtttcttcttagggatagctgtttgtggtccatgctctggagatccagtggatttacaaactgatgtgcctatctttaatatgtattaaatatcaccaaccaactaggcacagttcagagtaaaaaatttaaattctagttgtattttgctttcattttcttaattttttttgcttgaggcatgtaccttaggatttgatttggctttgctatgaaaaacaaacaagatgtttcagtggtgtggtcctttggaatgttgttgcttatcttgacatcccctttccctccattctgtatgagatattttaatgattgtttctctcttgtgaatacgttagtatccttccaagcttaatgtaagttttagagtacatatttgaacttactgatttggttgtgaattatttgttgattgagggttgcagttctaaaggtctgatacttttttttttagaatgttaacttgaagagacctatacagctcatcatagtctatcatgagtatccagtttcttctgctcacagaataagttttcctctgtctagcaacctcacttgggggagcagtcaacataagtttatagagaatagcgtatgctaggctgggcacggtgcctcacacctgtaatcccaacactttgggaggctgtggcgggtggatcacttgatgtcaggagttcaaaacctggccaacatggtgaaaccccatctctcctaaaaataaaaaaattagccgggtgtgtgttgcatgcctgtagtcccagcta

SEQ ID NO: 34203 - DNA, 1022 bp, Homo sapiens
catggataaggtgggggacctactatattttcctcattggtgctgttttatacaggcggtcaaatgataactcctatttcacaagaaagtaagacagcaaaaacgaactgcctgaaccttccatttttccatgttactcttcactatctctacaggttccttcttcctttattctggcctcactggaagagattttcttcttttatttaaagggtaattcctctacctttgttcagaatttcttactgtttttaaaaaacttttcatctaattttagacttgcggaagagctgcaaaaatagtagagttcccttacattcctcaccccatttcccctaatgctaacatcttacataaccataatataattattacaagtaggaaatgaacattgatataatattattgattaaactatagctcttattagaatgaaaccaaattttcaactactgtctgttttcagtcccagggtcctatataggaactcacattgaatttagcaatttctccgtagtctcttttaaagtttctaacattttgcttgtcttttatgactatgacacttttgaagaatactaatcagttatttttagaatatctcgcagtttaggtttgtctgatgttttctcatgattggactgagcctatgcatttttggcaagaataccacaaaaatgatgttgtgtctttcttagtgcattgtattgaggggtttatgatatatgtcttactacttatgattacttgatcacttggttgagtgtgttgtttttacactgtgaagttactatctttccctttttagttggtaagtatcttgttggagctacgtggagactgtgtaaatcctgtttctcctcaaactattgctctctaattttagcatctctcaagtggatcttgtctgcagtatttgtgatatttgcctgatgttgattgtttcccactttgcttcctatgttaatttacttatcgtctattgtgaagaagagttgtcgcttttcctccatttacttatc

SEQ ID NO: 34204 - DNA, 1025 bp, Homo sapiens
ttatctgtcttaattataatctgagagtgtgcccttatttataaacaaaagctattagtaatatgtttttttttatttcttggaggaattttgttgaaaatacaattcataatgaaaggttgaaggcttatctgtcttaaattataatctgagagtgtgtcgttatttataaacaaaagctattaggaatatgtcgtttttaaattttttgaaggaattattttgaatgtagatacatataaatatttccacagtgatagtatgtgaatgaattcagtatttctttgatgcaagttggtacatgattcaagcttttgaactacttagaatctagactaagtgggtgaggccaagagggtaggcagtgaaccaccaaaaggtacttgtaagttcttgttaaatattgttgaatgaatgggagagagggagaaaagaagattgaaattgtgtgtctgtggcaggcaggtgtgtgtgtgtatggtggtaaatggaaaaaaatcaataaaaatgttagatttactctcttgattagatggaataagatacaggaggatattgtgatcataaagtgagttattaaacttatttaaagtgagaatctagaagtgttgcttccgaagtgatgacaaggtctaagagtggcaatttgagtttaggttgcctgagtggaatatggggtatgaaagatgaaaggcattagaaatgaagatgttaatgaaatctgagactaaggtgtagattgggttatactaagtctaaaatgtcttttatctgccctgacacttttttggcatgttgtccaactacagattcccaaacctgatccagattaccaattttacgcatttctgcaagtatacggagggaaaataaaatcacatacctttacatatcattattactatcccctgtcattctgcatcagcataggtaggcaggctcatggaacagattttaagtgttttacaatttatattttaaaatatagcaacttactacctaccataacattagtggactgtatt

SEQ ID NO: 34205 - DNA, 1022 bp, Homo sapiens
acacagctaagagcaatctgcatttttaacaggatcctcaggtgattcctactgaaattaaggtttgagaactggttgtttagaagtaccaatagagagtttagaaaatgctgaccctgccttctaacaatagaatattgataagtagaatgttggaagataatcagttttataaaactcaagataattgtggagaagcagagaggccacttaaggggggttaatagtgttacagaactggggatgtggaggctgttgtaataatagctttgcttctggcagatactttttatagacagctaactgttaaactaacaaaggagattttaaattaacagaattcatcaaacatttaacataagtgttttagtttgtttctttaaaaaatttattatgtagatgctttggaaggttttgtcccttttgaagcatgagatgttactgagaaaatttcttgccaaatgaagtaatagacactctgctagatgtcaagaatacaagtggtgaacaagatagataagcttcctgatcttagcatatggtcttcggaatgggaagagaggatatagacaaattaattttaataccatgtgaaaaatgttgtgctaggccaagtatagcatggtctgagtactggtgggagcatggaaagattacctgagtgattactatataagctgaggtctgaaggatgacctagccagataaagggtgaaaaatattctcatcagaagcaactgtaacaacccgaaggaagtgtgagaccatagaactggaaattcatgttgttggaatggagaatgtgagggcaggtgtgtgagaaatgaggctagagagataagtagatagtagatcctgcaaaaccttgaaaaccatattgaagagtttagtctttacctaaaaggcaatggagagccactaaatgctataaaaatgggagtgtctcagttgggttcacattttagaaaactgtctctgtctagtttgaagaattgattgcgggactgacagtactagagaca

SEQ ID NO: 34206 - DNA, 1024 bp, Homo sapiens
aataatccttgttgtatctgtcaattgttgccataagtttattcttttgcttgtacttaaatatctttattcttttttttttttttggcactacagaagagctcttggtgctatttgatagggtttggctgtgtccccatccaaatctcaactccagttgtatctcctagaattcccatgagttgtgggagggacctaaggggaggtaattgaatcatgggagccggtctttcccatgctattctcgtgatagtgaataagtctcacaagatctggtgggtttatcaggggtttctgcttttgcttctttctcattttctcttgctgccaccatataagaagtacctttcgcctcctgccatgattctgaggcctccccagccatgtggaactgtaagtccagttaaacctctttttattcccagtctcgggtctgtctttatcagcagtgtgaaaaccaactaatacagtaaattggtaccaggaatgggttgttgctgaaaagatacccaaaaatgtggaagcgactgtggaactgggtaacaagcagagattggaacagtttgaagggctcagaagaagacaggaaaatgtgggaatgtttggaacttcctagagatttgttaaatggctctgcccaaaatgctaatagcgatatggacaataaaatccaggctgaataacttattgggaactggagcaaaggtgactcctgttatgttttagcaaagagactggcggcattttgcccctaccctagagatttgtggaactttgaacctgagagagatgatttagggtatctggcagaagaaatttctaagcagcaaagcattcaagtggtgacttgggtactgttaaaggcattcagttttataagggaagcagagcataaaagtttggagaatttgcagcctgactatgcgatagaaaagaaaaacccattttgggggagaaattcaggccagctgcagaaatttgcataagtagcaaggatcctaatgttaattgccaagatgatggg

SEQ ID NO: 34207 - DNA, 1031 bp, Homo sapiens
attctcttccattttgaacttgctttataatatatactgatctccaatattacattttatttcagtatatactggaaagcaatttaaataaaaatccactgtagagatcatctaagacacttcctctaggaccctgatgagttgggaaattggtggcaactttatatcttctcactacaacttcctttacaaagcttcctgtaggaaatctgtagtactctcatttccagattctttaggttttgctgaaaagtgtagatttatcagattggaatatatgtgaatctagttttacaacttctttcaagtgtccagtttatcttaatttgccttataatcagtatcatcttactcttcccactgctttggcttcctggaaacaaaaaacatttcctcattaattcttcacctctatgcctgcttgtaaccgttatttctgtgggggaaaaaaaggccactcagacagcagtgagtacatttctctcactgtgctaagaaacaatccttcttcaatgaattctgacttaatggattattatatctaggctgttgtgacagtaccacatgctttggcttttgaatagagtaaatgtctctgataatattgcatagggaaaaccctggtgtggaagaaaaatatgggaataagtgatgtatctatctcctttatcttgttaaaatttctggcattatttcttgctgatggttttcttgttaaaatcacatcttcagttcaagtttctcttgtgattttcattttctaggagtgtttgtacgttttccacagtaatactttatccccttccgtggttttgatctctcacccgtcctgttatttgtgattaaggatttctctacttttaaaaaataacactcttttgttaaaaaaaaaaaaagtttataaggctccttagttgatgagaatagaaaatgtgttgggaagtagaaaaatatataagcagatttgtgtatattgacaagaaaaagtctcagattattttgttcatagaaaagaaatattcaggatatta

SEQ ID NO: 34208 - DNA, 1038 bp, Homo sapiens
cggtagcaaatgatgtgttaggtatcccatagaatgtattgctttgtttgttttttccgttttatatacagtttaaggtcacagtttgcttcagatacacttgaacttggatgtggtagctgtcttttgtgcatttgaaactgaaggcatctctaaggtgctgtgatgtgttctttttgatagaactgatgtcatgtgaagagctacattcaatattacacttggtgctccaggctgggaatatcatgaatgcagtaagtaaaatccaaaacaattgtaatgttatgttttcaaccttgtctatctaaaggtgtgtgtgtgtgtgtgtgtgtgtgtgtgtgtgtgtgtgtgtatgtatacataattttttctttttgatttgtcttctttagggagggtatgccggcaatgcagtaggatttaaactgtcttctttgctcaaattggcagacacaaaagcaaacaaacctgggatgaatctcctgcactttgttgcacaggtatgtggaaatgattaggacttagagaacgcatatgaataccccttggaggcagtgaagtttttcccaggcataagatggtgtccagcagggttaggaaagggcatggcaagttccaagatggttctgtttgtagaagcgccattagcagattcctgagttgtactgcacccagggctatagggctgaagggaagtgggagagtgaagcagagaggctggtgaagccagctatgaaggatttaagtgtcaaaggtggggaatttggatttcatgctttagcagtggggaaccaacaggagtttgtgcacagtgtaatagcttgactggatctcttttgtttttgtttttaggcaaataaggcactgtggaggctgggttagagtagagaaagaactagaaataggaatacacctccgcagaagttggctgtaattgtttggtgagcgttgagggggagggtaatggtcatagggacagagaatagaggatggaggattgaaattttctgatgtggaattgactagatttgtgaccag

SEQ ID NO: 34209 - DNA, 1047 bp, Homo sapiens
agggagattgaggtgacagtatgctatctgtcttttatttatgaagataaccctgttgacccaccaggatatgctttgtagttttctccatccatcctatcaatttttattagttatgaaatttactggcccctgtggcacaaatctagaagaaccagctcacttggttcaagcctataatttcatcaacatagcaggtaactagctgagctcacttggaactgagatcataataatgatttaacctctcatttgagcaaggctttactgtttaaaaatcactttcacagaaataattccatcttatcttgacaatgtccctgagaggtaacatcttagaagcgaggaaactaagtttccaagaagtcaagtgacttttccagtaaagggggagtcaggactcacacctaggatgtctttctcactaaaatacacgctcaagtatacttgattggttgacatatgataaatggatacaagaattgtgggaagctctagaagaaaggatgttttgttgagaaaacaaatctaggaaagtgtctggaaaagtggttttcaatagagattgtttactttaaatttaactctagacccaagaatatcacataggaaaccattagggagtcatgtgaacaagacaatcaagtgtcaactcatatgatacagacattaagtacaatgatggttcagaaaagagagagaacacaataaggtaataaatcaaggataatataattgaggaagagggactaaagttagaacttaaagaatgtgcaagatttagatggaagagggaagtgggaagggcacaatgggcattgggaacaacccaagcaaaggtggagagtcattttccagacagggattaggagccagacacatctgatgggaggagggactgagcaggtctaggcaaggaagtcgtgggcattgaggtgaaataaggaggtggaatcaaagaggatcttcagtgcctattggagaaatacagacttgatgcttaggtgctctaaagggtggcggcatgagggagaatctgctccatgc

SEQ ID NO: 34210 - DNA, 1046 bp, Homo sapiens
ttttgccatgttgaccaggctggtctcgagcgcctgatctcaagggatctgcccaccttggcctccaaaagtgctgggattacaggcgtgagccaccacaccaggcctacttcagtcttttctacaaaactacagaactccctatcaagagtaatgctagagaaggaatattaatgggatggtttgttagtacctagaaaaaaaagcatcctgagttccataagaataaatgataccagaccaaccaaaattcctccttggatagggttgctgggcatgaatttatgtccaatatgagtcaatatgagaaaagtgccaggacctcagaggtaattaatagaaggatagagcctggagcaagcaaagtgatggtcttgctctgctctgtgctgggcagatcccacctggatatgtcttcagtttggggcagctccctgtgggaaacatactgggcagggagtcaggggtgcttgacctgggtcacctttactgcaaatacagcccggctgcaaagggctatcctgatccttgagactctgagctgaaggcagataactcagtccccaggagtgattttgagaggttctgtttgtgtcatttatttttttgtcaccagtgccttgtataccacctggcacacaatcacttgtgcaatgtataacattaaagggtcatctgaaggccaggccacttctggtgtgaattcttgggttggaactgggtcagctggttcccaattaatctactcctatccacataaccccaataggttaaggccaacttgcaccttttctcttttaaggatgcttaagagaaagtcctttctgcttcattcaccattacttcctgacagtcctgtttgtccttaaaacctcccccacagccactaatgaatgatcccaacccctaaacataggaggcctcaccagggctactgccagtagagaggaaggggctcggcctcttggggtccaaaccaaaccactcaatcaaactgactacagagagtctggactgtccagaaggagcttggctttgagggccac

SEQ ID NO: 34211 - DNA, 1064 bp, Homo sapiens
caattgcttgcttactaatccatctcccacactagattgtgacctccctgagggctcagaaatattaaattcttctctgtatcctcattgcctactcagtgcttggaacacatgacactcaacaagtcttcattggaatgaatgattgaatgagtaagttaacatcctctggctggaagcccagcaacaagaccaaagatctctcccacttctccaccttcagaaaacagagacctggtctagttataggtctcaagaatctgggttgactggaagaagagaatgagagagatcaggacaaagaatgtgctggggggcggggtcagcatttgatgaatttggctttgggataggcttagtagcagaatgagaagaagaaaggactcctgttgtagtaagtcagacacctgtctgatggcctgtcttaggcttgtaaaactcagtgggggtagcctgcttccagttttagaagtgggtcctaattaaactgtaaacttctaaagcagaacatacgtccgcacaaaaccttgtgcacaaatgtttatagcagcactgttcataatggccaaaaagtggaaacaacccagtgtccatcgactgatgaacagatgaacaaaatgtgctaaattcacgcaatggaatatcgttcagccatacaaaggaacgaaatactgacacatgctaccacatggatgaacttggaaaacattctgccaagtgaaaagagcaagacacacaagaccacatattatatgattccattccagaatagggaaacctttagcgacagaaagtagattagtgattgcttaggactgtggggatgtgatgtgggagggaagagagagatagctaaagggtatgggttgggtgtttgtttgtttgtttgtctgagatgatgaaaatgttccaaaattggctgtggtaatagttgcccacatctatgaatatactaaaagccattaaattgtacactttaaatgggtgaattatatggtatgtgaattacaattcaatgaagctttaaaaaaatccacaaaacttctaaaatagggtgttaactg

SEQ ID NO: 34212 - DNA, 1035 bp, Homo sapiens
ccaacatggtaaaactctgtctctattaaaaatacaaaaattagctgggcatggtggcacatgactgtagtcgcagctactcaggaggctgaggcaggagaattatttgaacctgggaagcagagattgcaatgagccaagattgtgccactgcactccagcttgggcaacagagtgagactctgtctcaaaaaaaaaaaaaaaaagcagggggggatagtggagcaagaggattgcttgagcccagaaggttgaggcagcaatgagctgtgatcgtgccaaagtactcctgcttgggtgataaagcgagaccctgcccctacccccacccaccccccaaaaaaagaattcaactcaagttagaaaaagagtaataaaataaacatatggaacatacacaaagaaagaaaagaacagaaatatctacacatagtatagtaagtttattaaatacatagtatatatatttctgcattgtaggaaaagctagaaaggtctcccatttcatttgtgatacgcttataaccctgataccaaaacctaatgaagatagaacaaaaagaaaatcattagtagcttaattaatgacattggctgtaaaattattaattaaaataccccagcaaattccttttttttttttttttgctgggtctcactctgtcaccaaggctagagtgcaagtggcactatctatcatggttcactgtaacctccaactccagggctcaagtgatacccctgtctcagcctccagagtagctgggactacaggaacatgctaccatgcctggctaattctttaagtttttgttgagaaaaggtcttatgttgcccaggctggttgcaaactggcctcaagggatcctcccatctggacctcccaaagtgctaggattacaggcatgagccactatgtccagcccaccagcaaattctttttttttttgagacggagtctcgctctgttgcccaggctggagtgcagcggcacgatcttggctgactacaagctctgcctcccgggttcacacc

SEQ ID NO: 34213 - DNA, 1073 bp, Homo sapiens
aagatgtgaccattggaggaaactgagtgaagagtacacaggacctttctctactatctttgccacttcctatgaatctataattatttcaaaataaaaatttaacagaagtaacaaagcagaaaccgatagaccaaaagaaagtgatttcacatccaaacatataatcagccccccgtacccccaaatctcacatttgtgaattcaaccaaatacagatcaaaaatttcaggaaaaataatttgttaaatacaatgattaaaaataatacgaattgtaaaaatacataatattatttacattatatagcatgctctaggtattagaagtaatctagagatgatttaaaatatatggggggatgtgcacaggttaggtgcaaatactaggctattttatataaaggacttgagaatctgaagattttggtatcagtctcctgggataccaggggatggctttacctgttgaaccattgacttcttacaacccactcttttctaaaaaggaaaaaataatttctactgtctcattgctattatgactcaggaacattcttccatcatctagttgctgatttttccccttataagtgtgggggaggaaaaggatgtgaggctggaagtggaataagtgaagatttaacatgaacaataagcttcattcatttttaagcaccatctagggcccttcccacccaatatttgttgtgaccactataggaatacaagtgaaagctagcagccaatggcatattcttctccaccacctggaaatagatggggagaggagagaaagcaaggtaagtggagagtaggattatagatatgatagtgacataaacaaagacatatccatagatggatagatgattacttaagtgcttttttgttttgcttttttttttttctgctttttttttttaagagacggggtctcgctattttgctcaggctgttcttaaactcctggcctcaagggatcctcccaccttcacctaccaaagtactggcattacagatataaaccactgcacctggcttatgctaatgttttaaatataaaagcatata

SEQ ID NO: 34214 - DNA, 1031 bp, Homo sapiens
catggacttctcctctctagctatgaaagtcctagatggcatctttttccaacagaaggctgttttgtctaccctgaaaattttttgtttagtgtagcttggctaggtcttctggataacttgcttcacttcatagtacttgaaacctcgtcttgcacttttacattatggagatggcctctttccttaaactttatgagtcaacctcttctagcttccaactttttctgtgcagcttcctcacctctcagcctacagagaattgaagagagttgaggttttgctctggattaggctttggcttaagggaacgttgtggttggctcgatcctctacccagaccactaaaactttctctatctcagcaatacggctgttttgctttctcatcatttgcgtgtttactagattagcacttttaatttctttcaggaacttttcccttgcactcacaacttggctctttggcacaagaggcctagctttccgcctgttttggcttttgactgtatcttcctaactaagcttaatcatttctggcttttgattgaaaatgagagatgtgtgacgttttttcacttgaatgcttagaggccactgtagggttattaattggcctaatttcaatattgttttgtctcaaggaatagggaaggccaagggagggtgagagatgggggaacggtgagtcactggagcagtcagaatacacacagcatatattaagttcactgtcttatgtgggcatggtttgtgacaccccaaaacaattacaatagtaacatcaagatcacagatcaccgtgacagatataataataatgaaaaagtttaatgcaagaattacacagagacaagaagtgagcacatgccattggaaaaatgacaccaatagacttgcttgactcaaggtagccacaaacttaatttgtagaaaacacgctatctgaagtgcagtaaagcaaagcacaataaaaacgaggtatgcctgtgcaaagagggatcgttcaggccatcttagaggatatcata

SEQ ID NO: 34215 - DNA, 1076 bp, Homo sapiens
cataaattaataattttaatgggcaagaaaagctttatgtggaagtgatgaaagtggtagtgcatgttctaatctgctagttctcctgaaatatatgtaaatttttttagtatttggatgatagtgaagcagctattttggctcgacagataataattataaagattaattatgttgtagaaacttccaactgaaatgacatttctctgtatgctgaagaatatatagaaattattaaaagtcaagagatgactttttcttcttgatagctatttctagaattttagctggaacttgttcattttcccccgtgtggtaatgatttagtcactgtgtgtgtggatgtgtgtttgtgggtgtgtgcacacacacacttgaaagagaaaaggagtgagtgtgtttgtggtctttctgaatattttttctaaggaaaagccaggtaaaaatgtgtaaggataggttcttcccatcatcttctggttctcttctttgcccttcccaaataacttggtcttaagaatgaaagaacaattcaacttcaagggaatgacttcctccattttactttggcttgtgttagtggacatagcatggggtactgtgatgtgcacacagccaggaaagagcaatgttgtaactgttatgtttaacctgctattcccctggagtcacctggcaatacaggaagtaactgaccactactgacttgaaatgcacattttttagtctttttccaaaaagaatagaatttccaaaatttatttttgtatttgtacccctgtccgtcccttccacacttcctgttctgacttacatattccttttctctggtgctgtggtaccccgagcataactctaatctgctggactatgctacaattgttggcttactcaaccccatgtcttagtcaacttgtatcagtacctagcaccgtttttggcatgtggtagattcaagtatttgacaagtgaatgaaaattaaaggaaataaagggtatgaagttattcttaacaaaaaccttatactaatttggagaattttattaatatggcagcaagtctatgtagtggtttt

SEQ ID NO: 34216 - DNA, 1066 bp, Homo sapiens
tcctagaagttaaaaatggttccttttaaaatctgcctgctttttttcatccatatttccatttctactttctgctttttttttttttttttttttttttttaaagagccagggcctcactctgttgcacaggctggagtgtagtggtgcaatcatggctcactgtagccttgactttgtggctcaagtgatcctcattcctcaccctcttgagtagctaggactacaggtgcatgccaccatgcccagctaatgtttaatttttttttttttttttttttttttttttgtcagagatagggtcttgctctcctggccaggctggtctcaaactcctggcctcaaccgatcttcccaccttggcctcccaaagtgttgggattacaggcgtgagccactatgcacagcctatttctacttttattactttagtcttattaaatctagttgaggtactagtcacttgttaggctctgactctgcctgacagttcgttttttcacattgtaattgattgtggtcctatctttagcaggcattattttatgtgtgtctcagcatgtacttattaagtggcttcacttgtcctttatgtttcttacttgatgggattttcatactctttatgtccattatttaggatttctggactacatttcttatttccaggttcttaatgtgttcctcagggttggattgctggaaatttaaccctctggttaagtggaacatgaatatgctgtattcttgctagcttcacagagtgttttcttttaatgactactgtcttacagcatataatgaaaaataagttaatccaaaaatattcaacaaacatccagtactcactacatgcaaagcaataccttaagttgttcattacccagctatattttgtgaaaagatctgagccaataatactgtaactgtatatgtagtaggtactttataaatgcttattgaatgaagagctttcctggcatgcattacttcattccagccactcttattcttggacactttgttgtatgtcccaaaatagaggaataggatgttttaaatttga

SEQ ID NO: 34217 - DNA, 1077 bp, Homo sapiens
cgtatgattcatcttcaaaaggaaacagactgcttgttcaggaggacttagaacattgtgtaccttatctagagcaccttctcattctcttgcaagagaacttcaagcacagttttcttaactaggttgaatactttcaggtgatttattttcaggatagcatgactgtgccctctagcagttcatcatgaaaaatctgagtttcacgataaccaaatcggacccttcatttactcttacttgccttttttcctgatttcagttttgtgtgattcttgtactttttccttggtgtgctacctctttgcttacctgtttcattctcttatatgtctaggacctacaactcttaggtatatccaaaaagacgtaagcttttccactccatggtccctattgtactgccacagctatttccatgggcaggtgaccctcactgacatcacctccaattgactccccagtccttttcttaattttgatatattctgcccactcaggaatgaataaaactcttatttaggcttactaaactactgtaacctacactgatagtgaccctgagccagtggatcacattaaggttcaggaaattaacagggatagggaattgtgccagaccaattcatgaagtggggaaaacttgtattttaggcatgtaatttaagatgttgccattccttgtaggtctgattcgagtagcacttttggcaaacacatcacctcttaggtaataaaacttcagaaaagaagttcagggtatacaaaggacggtgaactttctggagggtggaataacacagttgaggaggcggcaactgaaattttaaactggttgcctgcattctgctgtctatcttaacccttaaatttataactttggtaatttatttcccaacccaaggaaaacatgccattgtgaatgagtattatgagtattacagtatatgaggtctcactgagagaacaaacctgaaattttctgttttttcagtgagattttttttttttttttttttttttttttggagacagggccttgctctgtctcccagactgaagtgcagtgcatgatca

SEQ ID NO: 34218 - DNA, 1056 bp, Homo sapiens
tgtatatatatatatatatatataaatacatttcattttatatatataattttttttcaggccaagcaaataaagtagccaaagaagctgctaacagatggactggtatgtactataataatgctgataaactatagctaaattcccttcacacttactgcgacgtgaaattcagataccttgtgctagctttgttcaagaaaggacgttaatgaaaaatgtatgcattactcaaatgtttacatattaaatcatttcagttatttaaggttttttttataatcttatgagtcattttgtaaagcataagatatttttgtaaaactaatgattgcttccagtttaacttttgtgcaacttttcccaagataagtcacctgggctaatcacttaactttcatatacattaatgtaagatacacttttaagataatgaaatcttaaagatttatcatcttgctaataataataataataatagctaaggtttgttgaggactatttgccagttactgtaatgtctgtggttcattctcattttatctccatgataatcttgaggtagatatgattattatccctaatttaggagacaaaactaagaccctcaggagtccaaggccacacatgtgtcagacagcagaacaggaattataatccaacttttctggctggacttaaaatgactatgtttagtcaaaggcgattagtcactgcaagaacagatgctggagccaggtttctctgactccctgtccaggcctctgtttcacacaaaaaatataataattttttttcctactctattttagaattaaatagactggtaaaatcaatataattggcctttcggattttttttttctgaaattgcagttttatttattacaaagttatttcttaagtaaggtaatgctttagtgataagaacagagggtgaaacagcaaactgacatgaagtaagtgtcccacaaagtataaataaatgtggatttttaggttaaaaataagatacgaatccaaggtgatttcccccagtattttcaacaaagaggc

SEQ ID NO: 34219 - DNA, 1082 bp, Homo sapiens
tgtaaacacatatgagaggaatcttaatgagtgaagagggacaggtgttatgagggcccaacctagattcattgcaaatgatattgcccatcctattcctataggtatctttgctgtgtcaccgtataaatcaaacagaaattctgcccgtcttaaggttgtttctttaaaagaaaaaaattattctatatccattcataaaaatttctacattaaatagggaaattatttgacagagaatgaactatcaagattctcagtggcattttatcttgaaggccgacatccagtggctcaaagaaatgtttaatcagagtcttctttgaattggtccattaggcattgttgtggagaggtttttatttgttctttttcttgcttttaacctttaaatgtttataatgaaatggtttcttatcctcctatgaatcaggaaatccttcctgtagaggctgttcaatagtcttaccctggtgcctcattctcatttctgatccaggtttgaagtttgttccctacaagcttcctacattgttgtatctgttctctcatttcctagaaatctttctgtattcatgaagcctatcctgtaagctatacacataagacttggccttttctctctgagacacctatcactttgtaattgtttagtaataaattattttttttcactcttatgtcaacttgaaggcataggtttttcacattctgtaatacctgcagtgcacctgatacttgtcttatgtagcagcagacataacatttggatgtgattagcaagaatgtactggttgggcagagactggtaaaaattatcctagaatatcttatggtgttattttaacattctctcttaggttgttaggaaaagtaaagattcattttagattgttacaaagagtaaagatcattttaatatctgttgacattccataacactttgattgaaagaagttaattttgttaacattattctatttgatgcagtagtattctccataaaattcattccagaaatgtgtttatcaatatttgatacttggaaataaacttccatagaaaaaatattttaaaaagtg

SEQ ID NO: 34220 - DNA, 1028 bp, Homo sapiens
gaggagttgagtggataagagcagcaggctgagctcaggaggagaacttgataaggagtaggggaaaggaaggtcaggaatgagccaaggctgggagatcagatggtgagatacaggtggatgtggtaatgatgacctgaggcaggagatttttgtctaacctcaaggtagggtagtagctcagtggctaaaagatatgcttgggactgggtgcggtggctcacgcctgtaatcccagcactttgggaggccgaggcaggtgggtcacaaggtcaggagatcgagaccatcctggctaacatggtgaaaccccatctctactaaaaatacaaaaaattagccgggcgtggtggcaggcgcctgtagtcccagctactcaggaggctgagggaggagaatggaatgaacccaggaggcggagcttgcagtgagcggagatagtgccactgcattccagcctgggtgacagagtgagactctgtctcaaaaaaaaaaaaaaaaaaaaaagatatgtttggggctgggcgcagtggctcacacctgtaatcccagcactttgggaggccaaggcgggtggatcacaaggtcaggagttcgagaccagcctggccagtgtggtaaaaccctgtctctactaaaaatacaaaaaattagccgggcatggcggtgcgcactggtaatcccagctacttgggaggctgaggcaggagaatcacttgaacccaggaggtggaggttgcagtgagccgagatcgcaccactgctctccagtctgggcgatagcactagactgtctcaaaaaaagaaaaaaaacgcttggagccagaccgtctgggtttgaatctgatgtcatactgcttagctggtgacttttggtgagttgccaaacctctccatgccttagtttgcccctctctcaaataggggtattgttaatagtacctaccacagagtttgttttgaagattacataaatctgtgtaaggcatttaaaagccttgcatgtaaatgctctaatgttacctgct

SEQ ID NO: 34221 - DNA, 1031 bp, Homo sapiens
cacattttttaaggattaacacctgtggaagggagggggcagaagcagagttgggcagagcgagaagtcaaactgcagtataggcctgcagagccttgaacaacaccacgggaagctttggagtgtttatggcccatcagagctatccagtgttgggttgaaatggccaggcttgtttttatctgcctgtcttcatcagtctctggatgtgaactgtcctttggagggtgtgttttgggcgggtggctgttagtagccgaggcaaaccctgaaggactaactgctagaggctgtctccaactaaggcagtggggtccttgaagtgggatctgcgtggcacatctccacgtcccccatgcttgctttttctctagtagaagactgtgtttacagtggtaagttaggaagatgagtttcttctcattgctgtggacttctgttaccttatggcttccaagagtctggaacatcgtgttcacatttgtattattctccacattgtgagtcctcatgtcccaaaagagaatacaaaacaaaacaaaaacgtaagaacctatcaaaccgtattacccagattctcttgctgttaggatgcagacttttgacttaagtttctcccatttgagtgagatcttgtagcaagacttggattcaggagtgagatgcaaaacaaaaaaacaaacaaacaaaaaaccagggaacgcttatgtggtgtgggtgatttcagaggcagcttcctcatcgtaatacagctggggtgcatctagtggccatgttggcagctgctcccttaccagaccggttctacagtgggattcagcccagatcctagggctgggtatcaccatcctctgctgcagtaaatgactttgaaacacatagaatggattctgtagttggcagctaagaacgctgacacatttcgtgggtgagttgtgtggaggaaagactggaggcaaggagactgattagaatgtgaaggcctgaattaggatgggtttagtaaaataggaattgatttgaggagaatg

SEQ ID NO: 34222 - DNA, 1006 bp, Homo sapiens
agcccaggaagggaacccaacacgttttacctggcagcgtgtggctgagcctggagtgtcatcttgggcccctgactctgaggtgaaggctgtttctgcaacatttgggtctaacctcgtccttttactgcgacctgcctcaggaccaccttgcatttgtctctcttcagtttcctcttttttggtactatatgcgtacaacttcgagaagcttctgtaattttagttcagtttgtgtgttgtgcagccataccattaactgagcaggttcttttcctcaccgtctggtctgaatttccttgtcctgcggaaaggcattgcctgccacgccttgttgagttctctcatctctgaaataaagaggaaaatagacgttatacattttgaaagcctcagtttacttccaggttttggcataatataaaacaggttacagcttgcctcttcaggtggattatttagtcgtaaaaatggaaacttattgatagggaaaacccagcctacgaaaacagaacagagcgcaagactgcgtttgagctcccagcagttggcattggtagatttgtgtgggtgataaaacataagttttgtatttgatgtatccttttccagtgaagtgggaaaactgtgacatgtttcacaatattgaaaaaagcgtaccagttttaatatagagtgtgaagtctggtggcagtaatgcagataaaccattcccctttggaaatttaggggctttaaaaacaacaaaacaaatcacaataaggtaagaaaaagtgtaagttcaaaagcaggtaaaggaggaaaatacttttaaatttaaggaggaaattgctttctcacttgcattctttttaatgtttttcctactttccctaaaataacagaacctggtctcttataggttctctgcctaggctgtctcgtaatgtgttcatattaaagttgctgttccacaagcaaagcaggtacagcgtatgcctctgtttcagagcttccaagcctaata

SEQ ID NO: 34223 - DNA, 1025 bp, Homo sapiens
ttccaaaggtccagagcattcagctgtctcaaatgcaggtcattttaatagatttactttgaatgctggtggccaccaaactttgtaaccttctcagaattggttattttactattttctgctttttgaaaaaattatatagaagtaatatacatatataaaatatcagtggattccacctaacttctttttaatggctgtggagttcacagtgttgatattccagagtttgcttaatcttattgttggtcttttgaaatgtttcctgtttttcactgttattaccgttaggccatatacctattttataagtttctttaattttccttctgaatcctctgtttccttggggcatgtttcataaagaggagagattctttagttaaagactgtgaacgattttgtagagcttgttaaatcttaccagcttgcttttcagggaggcagcccccatggtcacaagtaataacaggcccctaaggatgtcctgcttttagccctgcccggatggggcttggtgggaagaactatttctgatgttatagtagatgtataatgataagtttaaattcttttaatatacatttcatgaatcattttatagggttggctactttttccctttgattatccatatttccttgtaactggataattttataattgagaaaagctcttgaaccaatatattatgaaacttacctcttctttctgattggtaaataaagaacattgcttagaatttgtagtcagtaccattagtacctggggctttcattcattcagcggttttcctgagcctctgctttgtgccaggccttggtctagagtttgtatctgcgtagagcctacattccagttggggagaagaaccaaattaatttacctctaggattatatctggaatctttatcaccaagtacataattcttagggatcttaaatcatatttttatttttataaaatggaaaagcccctccttgcagaattttaaggaagacttcttttaatttgcaaatttata

SEQ ID NO: 34224 - DNA, 1083 bp, Homo sapiens
taagagatttactttttcttgtctttttgagatggactctgttacccaggctggagtgcaatggtgcagttgcagctccgcctcccgggttcaagcaattccccagcttcagcctcccgagaagctgagattacaggcgtgtgccaccatgcccagcaaatttttgtatttttactagagacagggtttcaccatgttggacaggctggtctcaaattcttgacctcgagtgatccgccctccttggcctcccaaagtgccgagattacaggtgtgagccactgcgcccggccgagatttacttttataatgacttctaatatttagcattcaaaattgtgaaaggggagaaagatgtctgagaaatacagaatctaagattgggatttgtctaagtaattctttcatatttcataagttgtagtccttaaataaaaaggtttcatgtggttattaccaggaacatcaagcctcttgttcattctgtctggattaatatagattctcaaatatatttatttattaggctgtgctttactcttgttgataagacatcagaatgacttaatactttaagtctgttatttcctttcctgtttaattgcacacagtccccccaaatcacacccttcttgtggcccagggcaccagcaattccttagcaagtgaagggagatgattcctttctctctagtatccagttccctaaattcatacttcttcaccacaaaactgtggaaatacatgacatacaaaaggagttttaacatttctattttcttgacctttgcattttatcttggtatggttttctaatatatatccctgtgttgatggatttttaggcctttaggtacctaggagaaacagatttgatctattttaatttgttaaaaaagtactgactgcagttgaaaaacctgatttttttttctgtttttctactacctagccccaagatctttgataagtctcttaacccctccaagccacaatttcccccatcttctaaaaggggataatactttatatgaaataatatgaaatatataaactatattaatactttcaatgaagactact

SEQ ID NO: 34225 - DNA, 1050 bp, Homo sapiens
atgaagttattatttatataaaattttatgatttttaaaacatgtatttttcttttaacattttcagaattacttttaggagacttctctttctctctttttaaaaaactgtttttaaaagagctcaaagggaccaggatatagcctttcaaaattatttgctcttaccattattcaaaaatattatgtatatgtattgttctaaaaagattagtaaaaatgagcctggttcatgataaaatagtaggttttttgcaaaatatcacttactgaaatttcaagattacttttgtgaaatttaaaacagtgtcatcttaagcattatttgtaacctatcatttctataaaaatattccaacttttgatctggaaataactgagtaaaatcatactttctgaagtatagaagaatgttagcatcatactttataatgattttaatcataattagtgttaggaaaagtaatttctcttgcttcttttctttttagattctgaatttcactggccctttatttctacctccaggctgttggaatatattttctttgaaacttgctgttaaagacattgccataaatctattcaccaatgtatttttgactacaaacataggtgccatttttgcaatacctctacagatttattcagcaccaaccaaggtattttctacaatactatatgtgtgttacagttttcttaattactgttgctttttattaacctttagtgcttgagttttattaactgggttaagctcacgttctttaaggctaagaaactgaaggatattaccaggccagtcttggatgataaattgttcagacataaaaatctttatttggaaagagttttcttttttataaagtaatttgaagttcttgaatgaaataaggcatgaccaatagattaatagatgtcattttcatttatttccaaaatttgtagagcaaccagtatgtgtttgctatagaaaacacaggttggcttttagtacatacttgcaatgacttaataaattaaattgttaaatgctttatttggatctct

SEQ ID NO: 34226 - DNA, 1023 bp, Homo sapiens
aataaggtctggctctatcacccaggttggactgcagtggcgcaatcttggctcactgcaacctccacctccggggctcaagccattttcccatcccagcctcctgagtagctgggactacgggcacatgccatcatgcccaactaatttttgtactgttttgtagagatggggtttcaccatgttagccaggctgagctcgagcaatctgcctgccttggcctcctaaaatgctgggattacaagcgtgagccactgctcccagcctatggtcagatttttgacaatttttaatctggaaaactcagtcaccttttgtcttatttgaagcatctaaatataacttcatctttttcacttcttgatattggagaagaggtacagaaatattatggattgactacttctgatgagcttttatgcatttggtgaaaatcctcaactgaattttaaatgttctgtataaggacatttctaatttaaaagaaagttggagtcctctgaggggaatgtggtctaggcagctgcacacatgcattcttggtgcatttagtccaacccgtttgtaccgtttcccctggcagtggtgcacacgcctgaagtggacttatgtctgcagggtggacactgtgccctgtctcctccacctggcgtgtgagtatgccccctggtaatgcagttcacccagatcttcaaatcaaaccatggcataccttgtctgtggatgtattatgatggggtgattgggtgtcttattctgtttctctcccagacactctctggggtctagaatacaaaacatttgtgaaaaggtgaattatggagtgagtcctgttggacatttcccctgttacgtgagtcttttaggcttgagcacagtctttgacataggatgactttgcacacacttgaaattagagttgagggaatcctccctccagaagtgcttcttctgtgatcgcttgtgcccacaagagatatgtgcctgcaagatgcaatgcccgtggcagtgtggtagatgga

SEQ ID NO: 34227 - DNA, 1118 bp, Homo sapiens
tgcatgtgcatctaccacagaagactgaaggtttgcctgatgattccagtgtgggattttaaaaatggaggccgggcgcagtggctcacacctgcaatcccagcactttgggaggccgaagcagacagatcacttgaggtcaggagttcaagaccagctggccaacgtagcaaaaccccatctctactaaaaattcaaaaaccagctgggcgtggtgacgagcgcctgcagttacagccactgggaggctgaggcaggaggcggaggttgcagtgagccgagatcgccactgcactccagcctgggtgacaaagcgagactctgtctcgacaaaaaaaaagggggtacattagttaagaaaaactacaagtgtgtcttttgcttgagggaaaggctaacattagtagaatgatgaaaattattaatggtgttgctgtacagtagcatagtatgcagtcttcaagttgcatttgaaggttatataatagtagggaaatgtccccagtgtaataaatggtgtaaaaaaacaaaagacaatgtatatgtgaaatatgattccaattttatacatatacacacacataaaggagactgtaaagaactttgggaggccgaggcaggtggatcacctgaggtcaggagttcaagatcaccctggccaacatggcaaaaccccatctctactaaaaatacaaaaattagctgggcatggtggtgcacacctgtaatcccacctacttgggaggctgaggcaggagaattggttgaacccgggaggtggaagttgcagtgtgccgagatcacaccattgcactccatcctgggcaacagagtgagactctgtctcaaaaaaaacaaaacaacaacaacaaaaagagattgtaaagaaatatacctaaatgttcataattgtagtataattgcacgattcatgtttaatgtttaattaaaaaatgtgagaatatcagtttaaagtgaaaaatcagtcatgcattaatgatattaataacctatgcattttaataccgaatatacagttgaagtgtactttttgaaacttgtgataatgtgtttcttttaatgcaggagacagtgtttcacaaaatgattttccttct

SEQ ID NO: 34228 - DNA, 1024 bp, Homo sapiens
agttttgttctacttttataagtatggatattgttttcttaaggaatggatatgaaacaaaacaagagcagagtagttctgcctgtttgttcatgtactgtgatttgaatatctttatccagtgtgctcttcctatatctaataaaaatgccattatcaccactttatctggcaatcatagcaagaattaaaaggacattttttcttttttttataagcttcaacttattttatgtcttatattttataacactcttcttagagactcagccactattttgtacttctctcaataaagtttattatggattatgcttgtcactgaggaagatacaaagcaaagtttatgacacacactccttgacttgaaggaatttaaagtctgcatgaacaaaaccaagaaatagtctcagaattatacatgtcagcacttaacaatgagcataatatttgtagaatagttttaataagttttaaagaagttaggagaaggaagagagttcggtatgatggaaatattgagtaaggctttccagaggaaatctaagacttagctgaggttttaaaacaagatcaggatgttggacatcacaggacctgtaggatttaaatgtggcaaacagtaggaagagtattctagacagaggaaaggaaaggattcactgcagggatcagatgtgtgtgtgggtgtgcatgtgtgtgtttgatgtgtgtgtgtgtaccctgtgtgtggcggaacgggtaatgctgagccttcccaggccatagctttgaagtatttatttgtggagaacaccacttttccatttctagcttttcgtttccccttgttcaatctttgtggggcccacacctacacatcttgtagatctcaaactaagctctgcttcttaaaacctttccctgaacttccaagcctaaattgcatgccttattatgttttcctgtaacacattgtgcttcctttgtagaattattatgatatgaataattacttgctgaatttttactattatactgatac

SEQ ID NO: 34229 - DNA, 1015 bp, Homo sapiens
ttctaatatttcattaaaggaattagacatgcaacttattatataatagaattagataagataaaaccaaaatagaatctttctgctctaagctgtgctgcaaattctataattttttagttcaataaaaagaactgttgacttagatataactttcttggtatattctctaatgctcatcaagtaaagattgctttctatatttgtaggataatgagcattggatatattattagagttcccttaaacaagctttgatgcatgaaaaaaatggtttcataagtataaaacattaaggaatctttctgagaagctagaataaaattgtcaatcatttatttaataacttatgtcagcacaattttcttgtagtatgcaatgagcatttacatttggttgtatgtaccaaaaaaaaattttagggttgctctgaagttatcaaggagacactgatcatttttttcctgttataaaaagttgcctagagctctagtagaagaagcatcacagctttcgtaaggcaagtgactgaagacttgatccaagactggacttttatctttttttaaaaaaattatggacctatggatgctaggcaagaccaggcactttatatatattattccaaattcttaatttgaatctgttacatcatgactttaccattttatgtgtgaaataacagaattcatgaagttatgaaacttgtccaatgtcacactaccaccgagtagcatttgtgatagtcaacatgtattcctcccatactgggtagcagtgcttttctaagtgctttctatttattgctttgtttaatctcacaacacatttatgagatagttgctattattatccttatttttcagatggagaaaattgaggtgaagttcagttaagaacttcactaatgtcgcagagttagcacatggtagacgcagggagcaaacacaggccatctgttcatgtagcctaagcttttaactgctacgccaactccactgcctcagggaacaac

SEQ ID NO: 34230 - DNA, 1033 bp, Homo sapiens
gttctagctgggctctcagcaaagagctggaaataactaccagccatttgattgatccatcttggaaaaccagcctgctccggcattctgataatttcagcccagtttccatctgattccgtcccaagggtagaactttctaatttagccagacaacccacagaaccatgaaaaataacaaataaattattaaagttgtttgacatacagctatggataactagaccactactctgtgcattatttttccctttatattttatgtctgtgttaatatgtgtgtatatgcttgtacaatgagtcaagagctttgagaaagctgtatttgataagataatctattacccctgggaataggagccatgtcagtcccaaacagggctaccaattcaatttcgatggtattacattattattacattatattgtttttacctcccctacaaatttacagagttaaaatgcaattaaaatgagcagcgaaggctgccaggttgactatgaaaatatacgtgggcaaatgcaattttagagaacagttaggatttaaattatgacctaatttaaattagaactcaggtgaatagttagatcagcgttctttcattatttgctggagacactggcttcttcaactaaccttgatatgttgacagtttcagtcattcactcaactcagatatatttgagtttatcaactagcgcctctgttcagcctgccatgggattttcttcaattcctgttggctccaggttttgacttattaaatacaacattgtgatttggccaccaggaacaatctgagattgatgactgatctaattcttaaatgtttgtgcaaagggttattttaggaaatatgaggattttcctgaacagctgtaaaattctaatacttccctaaattatttatatttcttaagaaaaaagagcaccattcactttatttttaactttggaattttaaaaaagagctgttttctcagcatccacaacgccaatttctataatccaataataaaaatagtttta

SEQ ID NO: 34231 - DNA, 1062 bp, Homo sapiens
tggttcaccgcacctggccaagtcttttttttaataggaaagattaacattactggtcaatgaaagtaaaatagagcaattgtacagtatataagtaaacaactttctcaaaatataacgtgcttttaggtaataatgcaatatatgcagtgatttggaataaaagttaattttctattacaggtcatcttcaattaatatttctcaaatgtaatattgatcatagataacattttattccagcatcattattatttaaatagagattattatggttttacagatgttccataagagatgaggtacattttgggaagtatattttgtaaagaaaggacactagaattggtattttgtaataggtgtttgtatgaatttgtgagagtaaaattctggagagagtatcatgatccacgtaatgtctagcattaaattcagctccatgtgaagggatatttcctgattttcacccttaatagtcctgcttattctagtgctgcagcatattctgatgtcagggccaaatttctgggtatatgacacaatggccctgaattatgtttgtgtgtccctccttggccatctgcccagctggatatcagctgggaacaatggaggcaggttcaggaataaccacaatctacaaccatctcaactcttcactgttactgtttttgtgccacaagctggagattagcattttagggaactggacattgtcaggccttagtattcctaagcgaaaggacacttctttgtgttttagatattctttctattaccttttctttgatgaatgttgggacattaacacaaactgttgtctatgtcatatagtcaccgtaattctatgtatggaatcaagccatcttgggtttctgtatctgagcaagctgataaggctcctgttctcccagtacacccaccccccatcctacatcaaatgtcataatcaaattattctgaagatggcaacagcaaatcttataactaccatatatattacgagagtattttagaggacattctcttttcacaactacattattaaatagccttatg

SEQ ID NO: 34232 - DNA, 1055 bp, Homo sapiens
cttaactcagactcaaaccctattgtcttctttgggaaacctttcctaatcctgaggatttagataatcacattctgtgcccccacagttccccaattgccactcatacataatacagtatgataattatctattgtaattgtctgctttccccactagattgtaagctccatgagagcagtgtcttcattaccttaatcaccagcaagcaacatagctcctggcacaaaatatacatataataaaaatttatttaatgaagtgaataaaaacctaaagatctttgactatctcttattaagtcattacatctggattttgttaagttacctgaaattgactgatatgatccctgtggaaaatttagaaatatggtctcaatataaggatacctaggtgagttagcagctaggtaattagtggaataccttcaccctggattatgttacctggttccgttttggcctcatcatagtcaattatttgtcaatgactgaaataaaactacacagagaaaaaatccacactgaggctctgtgatattcagatatgtagtgaatatgtgagacagaattaggatccgatctgatcttgaagggctaaatgagataggtctaacactgttgaagaataaattgcactttggtctagaagccacttgggtaagtataggatgaggaagaacatagcttagcagagcacatttgggaaaaatattacataataattatcagacaaatgaatagtgttttatatatatatatatatatatatatacacacatacttacaatttagtattttaagaaagacattcttaaaattaacacattcttaacataaaattagtaaaataagaactattttaatagtaaaactattttgctaattttatgttaagcgtattactttttagaactatttaaagcaaggtttacagagatttctgctctgtgctagtgcagaaatatttgcaggagagagaaataagaatagtagaagtaattaaaatcatatcatattaggaagagctgaaggaactgagatacttgaaaa

SEQ ID NO: 34233 - DNA, 1072 bp, Homo sapiens
ttttttccttctgaattctgctggaggtttatctgattgcatataacttcctcccaagtccagctgaaggattatctgattataacataactttttccatatatgaaaatgccagactaatcagttgtattttattgagtaattacttaaacctctcactcattaaggttaattctattaaggatgtaatttttaaatatctatatatatgtttttagtagttaaaatatactttattcctttgtgtcaaagttacctttttttagtgtacgtacatgaaactcaacaatttgttatggatactttcctcattaccttttttcttcaagttacattatttggaagcattggtgattaaatttcacaagtaagagtactgtattaggcattgtggaaggatgaaaaatgtccaagttttgttttctctttctagtaatttgattattgttattagtggatatgaaaaaaattaatggtgtgaataatactacacaacttcctgaactgaactgtcaacatgatacagaaggcatttcctcattcctgtatttaatagaagtgtattggatgctttttatactcagcctcagcaggtctctattctttatggggtttccagcctagtgtggcaccatagcaccacctagcaggctctcctaatagaaatggactatgaacatagatctagaaaaattaattatccataaggttttattgaagaatctttaattataaaccttgaaaaatgatatattgagaaaaatcactactatataacctaagagtttttacaggcatttgggtaacttgcaattcttatatggaattttaacctgacttgaggctaaattttaaatccttttcaaaccaggcttttaatagccctattgacagaactttaattataatgctgccagatgctataagagctgatctcttttatttatttgaatgctaatttttgccataatgcaaagaaaacaaatgaattaaagattatatatgtgagctattctaacaacattacaaaatataaacagttcttaatattaaaatatcatttatgaaactt

SEQ ID NO: 34234 - DNA, 1046 bp, Homo sapiens
cccgcccagtctcctcgtgggtctcagccccggaccacaaagacgtttcatttttcgggacagccaatcatatgagtcaattcaccttaggcaactcacggctcctgcgcgagcctccaatcgatctcgaagggcactcgtagagaaaactacacctcccaggaagccgtgtgcgtcgccccgccttctactgcctttcactgcgcgtgcgtcgtgctgtgggattcgcggacccctctggccgcgctgtggctgtttcaccgctccccggctgggacttggagtcccttatctttccctggtttggtacatgacccggaagcctcggctggccgttgcgtcatccatggcgccggcgcagagcgagaaggaggtgggaacgccgtgaagcaagagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctgggtgagaggaaacgggcggtggggataagtggaggagttagggcaaaagggacaaggccggtcctgggggctgtaggcacctctcgccccttctctcatcagctttctcaggctatctagggcaaaggtcacgcgctgtcagcctgttgggggaccctggcttcctccctctggggttgccccagttggtagaattaatatctaggctaaaggtcaagggcggggaaaacttgtcaacacgccctcggcatcaccaccacctgtcaacacacacacacctcggtggactcctgaactgaggcttcccaaatcctggttctaatcttcaaacctctgttggaaatggaaaaaaaaaaatcgtatttgcccagtttttctccctggtcctgacctgactttcgtcttcggagccattctagttcagtctaaagaaattgaagtctgatctgtcacatcatggttaacatt

SEQ ID NO: 34235 - DNA, 1024 bp, Homo sapiens
tggcaggaagttggcgtttaataaatacctgttgaatgaatgaatgaattcaagagttttgaacactgatgatccttaaagagtctctagtattccagaatctgatctcttgaaatatttcttgatgtttctagcatgcgttgtgacattttagaaaatgaatcttgttacagacaactcaaagaaatttcctcctttttgtcaatattagtgaattattttcctggtatcaaaatgatagggtaaaagtgctctaacagttgattgacctgcacccccacctccctaaaaaaacctttaagaagacacttgcctaagtaatatatcagagatccagttatgaaatcccacagctgtcagaaatgacctactgaaaaatgatttaaatatttatgaagctatgaaattgttagctgtgggttgatgatgtagaactcttctctatatacttttcagattcatttgaattcttgtatggcttggtaaaactgaaatacattatggaatgaaatgagcaaattggttctctcaaatttaagataatagtacacttaattgtgaaaacaatattgatattctgaaccctgcgaagactatatttgcatgttaaatgaagtaagcactttagaaaaaagatggaatcatctctgctttccatgtatgatttttccatttgagaaactaatttagaaatggatttgcgaatctgacatgttctttaaaaagaatgtgccagactaacatatcattaatggtggcctaccctgtgtgaggaggtgagccatgagtaaacattttctccaagcatatcaggcaatgactgtttgctttagaatggtacattgagtaagttagttgctagggcagaagggggcggccggaactactggccctgccctacccagagggcagagatggacccctggtagccacttggtgctgagtgcacaggctccacggaagaccatgtggacgctggtaactggccctgcagtggggttgccatatattgcttagtgccatg

SEQ ID NO: 34236 - DNA, 1023 bp, Homo sapiens
caggaaggaagtgtttggttaaacacagtttagctgggtggattccacagtgttttaaagtggagttctgccaggtggctaatcattacagtagttgttgggcttgttaggtaggtgaagggagggagggggaaaccaagaaatctctcaggtgattcactgtaggctttccaggttagatttgtaacagaaatttaggtgagccagcacttgaccctttggtggacaggagatggtttacctcttagtttcttgaattatttcccatttctctgaaggcctcacatggatggtctagttgagcagctatcactggggctgctcatagtggtggcaggtggaggggaaaagaaacacaagttttcaaaaggaactggaatcttcagtgtaccagagcactgataatgctggaatctggaaacataggctttcttagaagcattcatctaaccaaaaaggcatcttaggttcaggaggtttgtagcttgcccaaggctacaaaagaatccagtcagtgctctattcactacaccaggtggtttctccaattatagactgttcagcattgtactccagccaaagggtctagcagtctgaagcagtggcacctcgtgtcacttaggccctctgaggggctgtgtttctggcttaagtgagattgagtaacagctttatctttagcgtgttgagggagtgctgggtgctcaggaataatcaagtgccactttgaatgccatcattgctggagtgacagttgtggtccagcacattttgtgttttccttacgttcttttcccattttcagtccccaccgccccagcctcccttggcaagcacaaaacgtcatgagtttgtatcaagcacatgactgcaggcatttgcattagaccaccagtgtgactgtcacattggagattagataagctgcaattgcattcatgtttttttccaagcaaaagctacacaaggaaaaaaaaaaggcaaagaagactcagaatagaaataacttatcatagagggtgc

SEQ ID NO: 34237 - DNA, 1025 bp, Homo sapiens
cagcatatctaccttctagcacaataagtatacagcttaggtcaatctgaagcattcctagaagtctgtaatacttcagagtgttttccacagttcatgccagaacatgagtttttctaagtaactctacaataatactgtgtatgggtgtatatggaaagaaatggaggaagaaatatttgaaaatgagtataaatgttttctatctgccaagagagtgggttataaacagagaaacattttttgaatttatgaaatggttttcaagtatttctcttccctaagtcgcctacagttactaccaaaactgattataaagcattttgaaatacattgctatttaaatactactactaatgaggaaaatggctaaaaaaaattacctgagaatgtttattcattgcatcaactgcacgaatcatttattattcagagttttttttttaagagttgaacatcactcagaaaagtttgtatgcttacaattgaatacaggcagatttttatgagatggttacttggttctcttttcttctcatcatctttttatatatttaattttgccttctagttaatctctattaaaagcttatgccaatcatcagtagcagtagcctactttgaaatttaaaaattactgcagtcattttaaaaactttatctctgaagagcccaataacatggttttcttgttcctttatcttagcacacagcacaccagttgatatgccaagcagaggacagaatgaagacagggacagtggcattgctcgatcaggtacttgtactctgtttattggtttaactaacagagtgaactatctacagtggtgtggaaggtgggaaagtagaagacaggtagataaccctcatcctgttctttgttttttccttcctaagatagtctgacatatctaaagatctgaaactttaatgtacagtatccatgagtgattgtgcaacataaactagttttttctaacactcaaatttatatgagactaatgtttgttaagaaatttctt

SEQ ID NO: 34238 - DNA, 1061 bp, Homo sapiens
cactactgcactccagcctgggtgacaaagtgagactctgtctcaaaaaaaaaaaaaaaaaaaaacccaagaggaatgttaaattgaattccagggcatagtgtgcaggtatgtatttctgtgacaaatccaaacatagttttctagatcttagagttctttaaattctgaaaacttagagattgactgataagccagatcataatatgtttacactgcccagtctctaatggggttgagtttcctttggaaagatgatcagaaatctccagtcaccagaactttagcttcaactctctgaccctgtgcaagttcaggcctgatcagggatggccagcagtggccccggtggcccttgaattgtaactaaaagtagttgatgatatttttatctctttccagcattcatttcttttcttgaatatttagacttccctctagtttgttcttcctttaaaaggtgtttattctttagtaaataagtaagtagctactaagtgatatagttagatggaggcaattggattgattcagggaattgtgtgttatgtatttagtagcctgagaatatgtaattcttggagttttttctcttttgaaaaggttctgctggttcttttctgttcctggggcctgcatgcataaaagtcagcaatccatgctgtaaggaacacaagatgctcatcgactcttgtcatttgcttgtgcttaatctgtctcattttcattcagcaagtaacatttttcaaatgccagctcctgtgctagaggctaaggatgcagagagaagattcagccccactttcaaggaatggactcccgcaaattcttgtcagtttgtctcaatctgtgtactcattgttctttcgtctttactcaggtctctacctcagattctgcctctttgctccagtgatttaaaaatgacttgtgagcctataatcccaacattttcagaggtcaaggcaggcagatcacttgaggccaggagttagagacaagcctggccaacacagcaaaaccctgtctctaacaaaagtacaaaaattaggtgggtgtga

SEQ ID NO: 34239 - DNA, 1044 bp, Homo sapiens
taaatacaccaatcagcaccctgtgtctagctcagggtttgtgaatgcaccaatcgacactctgtatctagctactctggtggggccttggagaacctttgtgtccacactctgtatctagctaatctggtggggaggtggagaacctttatgtctagctcagggattgtaaacgcaccaatcagcgccctgtcaaaacagaccactcagctctaccaagcagcaggatgtgggtggggccagataagaaaataaatgcaggctgccagagccagcagtggcaacccgctcgggtacccttccacacagtggaagctttgttcttttgctttttgcaataaatcttgctactgctcagtctttgggtccacgctgcttttatgagctgtaacaccgctaaggtctgcggcttcactcctgaagccagcgagaccacgagcccaccgggaggaacaaacaacaccagacgtgctgctttaagagctgttaacagtcaccgcgaagggctgcagcttcactcctgagccagcgagaccacgatcccaccggaaggaagaaactctgaacgcatcagaacatcagaaggaacaaactccagacgcgccaccttaagagctgtaacactcactgcgagcgtccgagcgtccgtggcttcattcttgaagtcagtgagacaaagaacccaccaattccggacacagtatgatcttggctaactgcagcctcaacttcctgggctcaagtgatcctcccacctcaacctcctgagtagttaggactacaggtgcatgtcatcatgcgtggttacttaaaaaaattctttttgtagagatggggccttgctctattgcccaggctggtcccacgctcctggccccaagcagtcttcctgccttggcctctcaaagtgttgggattacaggcataagccaacatacccagcacaatctctggcatttgattggattgtttagtccatttacatttaatgtggtcatagtcattgatttggtaggatttatgtctgttattttgctatttgtt

SEQ ID NO: 34240 - DNA, 1104 bp, Homo sapiens
tacaagtcctttatcagatatgtaccttgcaaatattttcttctaatctgtgcttgtagtttcattttttaaagtgtcttgtgaagagcagaagtttttaattttgataaagtttactttattaatttattctttaatggatcataccataggtgttacacctaaaaattattttgttaaaaaaattattttttgtagagatgggatctcattatgttgcccaggttggtctcaactcctggcctcaagcatgagctactgtgcccagcctaaataatctttgtctaatctaagatcacaaagtttttctcctatgttttcttttagaagttttatagttttaggtttatacatataggtccatgacccatttcaagtccatttttgtatataagaagagatatgaagttcaattgtttttgtatatggatatccagttattttggcaccatttgtaaaagactatcacttttcactaaattgcttttgcatctttgttttaatgatacatatcactgcacacacacacacacacacacacacacacgcagtgttgttaactgggtccctatgtgaaatgtatttcttactgtggactgcagtcagaaaagtttgaaaggcagtgctatgatggctacctgaattacttttttctctctctctggtctcctaatcattcttgtctatcacttccatatattcagtccttcctgcttcttcaatttccactgttcctctaaaacgtcattttctatgaaagcacatttatgatcacctcaggaaagcattgtttttgctattcctttcattttttcctcccctctctgctatacagggaaatgataaaacattttatatctccctgccaagtttataccactctctgtgtaattcgccctgtgacctttcattcagtgtttcttgtggttcgcaattggtttacagcacatcatttcctttttcatttgttttgctttattgggagacagcatgatgtgtagaaaagagaatgggccatactccagctgaaccctatttcataataggctcataaccttcttcaaaataccatctctcaggctcagtttctttatctgaaaaata

SEQ ID NO: 34241 - DNA, 1058 bp, Homo sapiens
aaaaagttgaatagctaagttagtgcttttagtttaaattgcagacatagctgcagagcaggcatgttccagtacaccctcgggaagggcaccctgcggattcttttggtgttgcacaaccttgtcaaaattagataagtttgttaacctttatacatttgtttacctgcaggcttactcttctcttacttatagcggctgatagggttggatttggttgtctcaagttttactggagagggggaaattttataaaaatgtggtagcttaattttctccgcctttagttgctgactggataatgacgcatattcctaagcgttgggatggtgactataggagatcctgcctgccaaccctcttaagacaaataagccctcctgatccttgggaccatcagacatttaggatctaatgcttgaaagtgttgcttcgcttgttagatgttggatgccatctgttcaaatccaaatgctctccttctctgatgttgattattatttactgtggggagagcataataaaatagactcttcccctggctgcctttggacaagccccaagagtggcacctggtaccgtttttgatttttcattttccttgatggagctgtcacatctgggagatcatggatagattgcacatatttatcaaacgtgtggaagatggctgtaattttacaagaaaatttatctgtctccagaaagttcccattctaaaagactatttttatcccaacaaggaatgtcctgcattgatcttgttcttctcttggtgttgcacacgctgcctttcctatgcctttctcatctatttgttttaaaatggtcagttggatcagtcttctgcatctgaaaatgcacattccctgtctcagtgtgaaggaaaagcagatttcagtgagatatttcatttcctttcaagaatattgttttaagtgccaagtgaaattacgcatgctgagaatattagaacctagcaaggctggtcagaaaatgatgtcagaggcctttggtggaaattagagaagggggaagtggtgcatttggttgattag

SEQ ID NO: 34242 - DNA, 1018 bp, Homo sapiens
ggtaggggaacatgtaagatgttatcagatgtttctctagtgggaccagtactgagcattattttattgttccacacctgaattgactctgtatttaggagagtagaaattcctggaatttagtttgagcagtattacagaagacgtggtaattcttaagtgtgactttggtctttctcaaggaataaaacagcacttttgtctattggcagacctctgccatttaattagtaaatgcatcccttatgcctcacaatgcactctttttttttttttaaacatttatttttaatataacacttatagctataaaatttcctctcggtactattttaattacatctcacaaattttgatatgttttagttagtgttgagttctaaatatttgcttatttctattataacttttactttgattcataggttatcaaaaacttattgccaagtttccaaatatttgaagatttttctagatatatgagctacttattcccttataaaagttactgtaaaacttaggcttaaaacactgtgtacttgttatgtctcaatttctgtaggtcagggaactaaggatggcttagcagattccagtgcttcaggttcttttacaaatctgtaatcatcctctggctggggctacagttttatatgaaggcttgattgaggaaggatccacttccaagctggctgttggcaggactcagtttctcaatagaaatgaaaaatcttttgaaagtgtcattctacttaacatcccacagcacttgaaattgttttatatattttactgctgcgtgttgttaacttctgaatatattgttactaattttctttgaacaatttttataacacaactaaaaaaagaaaagaatctctgtttaatccctatgtgttatatctactttctgaattcttttctataaattatgatttgtatgtaattttttttttagcctgaggaactttttttttgcatttaaaaaaaattatactttaagttctagggtacatgt

SEQ ID NO: 34243 - DNA, 1034 bp, Homo sapiens
attttatagtatgtgaatcatcagtaaataaagctgttaacactttgaaaaggagaggattattttacaaatttcttaaaatagatctgttgtagattttgactaaggtttaagagaggagtaaatatccctcatattcttgatgtcagaaactatgtgtaatcctagactcctagatattagagtcttaaaatactaaatcctttctggcttgtcacaaatgaatataaacaggactttgaatttttacttcttctgaactttcataaataactttgagtctttttttttctatttactgcaatgtgatctggtaaaacaaggcacgttttcttttttaaaagaaaatatttaaacttaagtatttctatataagaaaatatttctatataagatgtaattttggtaagaattgaaaaaaattgaatttatatccatttttaagtgtagccaggaaataacaagcattcattttatattgactaagaaaataatttgatttaactatggtattgacaaatatactgtgaaattaaaactttgtacttgctattttgatgtaaaaggcagaaacaggtgataaagaacgatttatgaggaatttatttttataagttaatcattttattttatattttagtaggtttagtgcatatcccagaagcagttgtaatggatgacatttgtacaactgagcttttaataatgtttatttttactgtcttaagaaaacatgtatttttaaaaaagctatccatagtttaatttggtttgtagatacagtgtgacttattttagaaaccccttttcctgacaggtctaataatttctattcttttctttgaaacaggatctggaaatagtatattcctatttacatggtatggaagccttatcaaacttgagggagcatcaacttaggtatgtcattttaatattcagttaatcatagaatggtaaaaatttgaagcatgtaacaatttaacattttaattttttacttttattcttacttgacataataattgtacata

SEQ ID NO: 34244 - DNA, 1031 bp, Homo sapiens
aaaatatacaaatttttaaactgtaataaatccagtaacagaaatgatgtaatgtatttgtgaaaaagattaaaattattgtgtatctggaaagccatctgtctattggaaggtggccattgttagaacttatttttttgaagccgtggaacactttgttcatagaaaatcctgttcagcccaacaatagtagctattatggttgaaagaggtttggacgccttgaaatcccaagggctcttgacattgaaaacctctgatctcaactgtctgcgggacgcctataaaaggatagaggataatttgttgtaaataagtaattttcactgtggttttttggcataatcgtatatttgagagcacaagtctaagctggccagaagtctgtaataacagcagtgtaggtgagcaaaaatgggaccctgaactgtagcaaagggtttcgatagagacttgggaggggaacccgcagaatgtgatgataggctgtgaagagggagaagcttcggaagttgtccctttatcttttggttggagggtgttggtgagaccgcagatacaggaaaataaaggtgtttttctattttttggtcatgggtggctggccctctggagttccttgtggtccccatgtagttattggaacctttgttagtcttcattttatttcactttcttgttttataggcatgtgatcaatagccctcgatgatgattcctgtctccttttctccagatgccaacagctttgtcttttgaatgtgatactgtgcggtattacatcctggatagtataaagtgacctttctaaaatagcaccaaaattggtatttgatgctatatgtggttctcagttgtgccgaacctgtctcagatagctgtgtcgtgtgctcggctcagccactgtttctggacattttgcctattctttctcacaaagcaatcgccatctttttgcttctctgttttaatgaccttgttaatgctgtccatgtgaagcatttagaggagcttcctcactcccctgggcc

SEQ ID NO: 34245 - DNA, 1028 bp, Homo sapiens
aagatagcttagataaagggggacgaacttaaagagtatagcaggcagtctcataaacatctaaagagaggcaaagaaagttcattaagaccacatgggactagaaatggaaagccagggactttcattgacattttttgcttctcaagaccatatggcctttcatttttgcatttgtctgtggattggctacctgctctgtaaggctgttaattcctttctccctgtgtctttggcttgtatgtgctgactactcacttatggccttatgtccctaatgtttacattgttttgactgcagtgctggtattgtctttagattcctcaggatacaatctgactggcctgggttggggcggatgtattcctctgttccaaccagctgtggccagaaagggttagggctcatctgttacatacatgattgcctagattcaggttccccaagggtgtcagctactgagtttcagtagttacgtttctgtgtgcttttcgcaagtaaataatttttactaaaggttttaaaattttaagtatttttattttaaattactaaataaatattttatttgaatcgactaaagtacagggattgcccctttctgtcacttagctcttctataaaaatattgtaatgtcttgttgataaatattctgactgggtcagggtcatattaagaatctatttgaaagatgtgaacagatttttataaaaggtcagagtctgaaacaaggagaggtaattttgcactgtagagaaagatcagcctgggtgtggtagctgacgtgagtagaatgggcttttggtggccagaatgctagtgaaggagtgccagaggcacgttgcatttaattaaaaataatcttgggtgcgattctcatgcctctttgcccttctacttctttgaggtcaaattggcaaacatagtctctttggaaaatggtcacatgagggagggacactctattgcctgcttgtttctgtagtagcaatagtcttagaaatgatgctagcattggtggtggtg

SEQ ID NO: 34246 - DNA, 1024 bp, Homo sapiens
cctcccaaagtgctgggattacaggcatgaactaccacgcctgaccccatttaagtgaacttctaaaatcccttatgtataggaaattttgtgtttgaaagcatcattgtggctgaaacagatttttttcattgattatctatgtcagaacataaagtaattttagtctttcaaatatagtagagaagagctgcttgattaccactcaagcccaagaagcatgaattttaatttttctaagaacgtgcttgtgggacagtatatagaaaagactttagagtctttgtgttaggcaataaagatggtttgaagatgacatggggcaagactttcaaagtaattgcccaaggtagagattttcaaaccaggcagttattagatttgcctggcttaggatgggcaaagtactgagtcccacgccctagagattttggtttgccacatctgagttggaccttagactctcttgttttaaaagcataccagcaggtggttaatcagattcgaacagagaggctgtaggtgaatgactttaaaatcgatgtgtaactgttttaaaggtagagcaatagaagaagagaatccctggaagatctggtaaagttgaaaccagagacaggaaccttatcttaatggtctctgtgtgccaaagctaagggcctgactagtatttccatggaaaaagaagttgatggagcataatttaaaagggctaattggtggaatttagtgactgaaggttcagacaagggaagaaaaaaagtaaaagatggcttcagatctttgaatttggatgtctacagagcagttactttgacagctataaccaaatctggagggaatgaggtaggtgggtatcagagttgaaatgaagatacttgattttaggcatgtttaattaatgcattaacaaataggtgggagctacaggggatataaagagataacctgggtcacctgagaaaggttgtagatacagggtagggtaggtggagagttgggtaaatagaaagaataccagagg

SEQ ID NO: 34247 - DNA, 1050 bp, Homo sapiens
gtaaacaattctaggtctcttttcagagaagatgtagggtttttccctatgatgtaggagaggaattctgtcagaaatgagaacttcctcatcaaagctagcgaactttttgtaaaatttactaaaatatttggtaaagttttacaaaacgtactcaagtgagaaagtagcatagtaatggtaaggatttaggattgggaagaatgtaggcagatatatagcactttccaacagtagatagtcttagatatttccttgagattttgccctctgttaatgctacttttagatttctctggaggatttttagtctttaaaactgagtattttatacttgctgatactacacaaactactaggtttgctggtgtgagaacagttttgtaacctagacatgcctccattatgagaagtcacatgaggaataacctaatgtaacttttattccctgttcattcatcagcatttctactttttttttttttttttttggagacggagtcttgtcgtgttgtctagcttgaagtgcagtggcgcgatctcagctcactgcaacctccacctcctgggttcaagcaattctcctgcctcagcctcccgggtagctgggattacaggcacgtgccaccacacccagctacttttttgtatctttagcagagatggggtttcaccatgttggccaggctggtcttgaactcctgacctcgtgatccacccgcctcggcctcccaaagtgctgggattacaggcgtgagcaactgtgcctggcctaaaatttttttaaatgaggaattacttttaaacaacactatttataaaaaaagaaaccgaagtcatggaatgaaagtagaaggagaaacccttgcgtaacctaccaaagccattctgttagcactgtttttgagtcattcaggatttggaagtttttacagatttccatcagggtttttttttttttttttttcttttttctacgttgcttaagacagtgtggcagttgctttcataatgtgtggtaatgtatcctgtgagatctttcactaataa

SEQ ID NO: 34248 - DNA, 1030 bp, Homo sapiens
tttggggggttttatttcaggtggactatatggatgaaaatgaagaatattttcagcggcaagcttcccatagacagtctcgaaggagatttagaaaaatcaaccagaaaggtgaaagacaaacaattattgacactgtggatccttatcccatgggcaaacctcctttgcctagaggctatcacacggtaagttatacaagtataatatttttatttatttctagttttttgttggggttttgtgaaaagatgtttaagttttccatttttgacaaatcttttcaattatatatatatacacacacattaagtatacttaaatatttatttttatttgttatattaataaatataaaaataaatatataatatgtatatattatttaaacatttattatagaaagagtagatttttctgggaaacatgatatgattagtttttaaaagacattgaaataacatgtcaacagactttgctagctcctttatttcttaagttgttctctgaagatcagctttgtgataagcacatgtaattgtaattggaatattttaagttgttttaccttaatctaacattttagcgccctcctgtgcactccacccttcactcccaacccaaatgactgctgtcatccctgttttttattttaaaagtagatatgtaaaaattacattatttttcatagctttttatacctttatgagaatatctctgagatttattttttaatgcagtgaaggaggaataatttgaaataatgctttttaaaatctcaatgtaaagatgcttagaaatatttctaataggttcaaagatcctcttaaaggcaggcagacataacccagttcattgtcatttatttcataaatattgataaataaactgctttttatgtttgaggaaaccaagacatagataatgagtgctttgttcaagatctcaataaagtcactttaaagccttttttttcttattcctttgttttttcaagagcaaagtcgcttagattcctggatatgtcata

SEQ ID NO: 34249 - DNA, 1045 bp, Homo sapiens
gcacttaaaaaaatgaatggaacactgtccttcactaacctgctttgcaaataaaaaaatgaagagagaaaggcaggcagacataaaggattttttttcctttttatgtgaaagcttatgggaaattcattagaaatttacattttaaatactacagatgaaaactttaaagttcaggaatctcaatgggagaacattttgggaggccactggtaaaatttcagtcagatttttttttaaaaggttggtcaaaaaggaaacaaagtttaaaatctcttgtattttcttatttgcactttatttttaacaaggtttcttgcttttatttcattctacattttaattgaggtctgtaataatctccttgctcacttctttgatgccagtacatgactaagtactatactaagtactaaagtacattactaaagtactgtactaagtactaaaatctatgattttcattatgagttctttgaagatctagattacatttggggttatccgggaattttgagtcaaggaagaaaaactgatttatccttgaaaactaattggttaagtaactagtagcattttatgcttgtgttttattgttgtacagggaaaagatcatgaataatttattcacattggggaaatctatcattgatatatctttggctattagagtaactttgcctaaaagtatgaattttatgtataatttttcgaattaaaatgagacagttcctttatgttctatacaagagagtacgtattagaatgccacaggtgtcatgattgctatattggtttttggaagcactactaatttttaaatgatgtggtaaatctaaaacatttttatgtaattttaaaattttaagttcactaaaataattttaaaattgtacagagttttatgtacctcagtgttttgagcttttctctgaaaagagtacacttaaaatatatataacatgatattttaaaagataaatcaatatgtaattgatcttcgtctttttttagcataaattaccagtctaattccaacttagaa

SEQ ID NO: 34250 - DNA, 1028 bp, Homo sapiens
gtgtattttatttcttgtatcatagaaaagctcaatattttcatttatatatttttggtcatttaacaaatattcattgagtgcccaccatgtttcaggtctgtcccaggctctagagatataaaagtcaacaacacaggagaatctgcctcctttgcccttacaatctcacagggaatacagataaataaatggtacacacccagggcccctacaggagtcggggatggtttcatgaaccacctgaatatcttggctcaaagaaagatattttgtacagaaagaatcttatttgttcaaagacttagaggttgagtggttatagggtttttgaaagccatgttgaaagttgaactttttcatgactgtaaggaacaacaaagagactgaagcagaggtgtgacatactgagatttacatttaaataaactactctggctccaagatggaataaattttggggatagggatggtaaagtgggaccacaagacctggttaagtaatggaaatggaagtggtggctagaacatggcaactggagtaagaatgaaaggtgagggatttaggtggtattcagggagaagaaagtagaaataatttgtttctttttttttttttttttttttttttgaggcagaatttcactcttgttgcacaggctggagtgcaatggtgcaatctggctcaccgcaacttctgcctcctgggttccagcgattctcctgcctcagcctcccgagtagctgggattacaggtgtgcaccaccaggcctggctaattttgtatttttagtagagacaaggtttctccatatccgtcaggctggtcgcgaactcccaacctcaattgatccacccgccttggcctcctaaagtgctgggattacaggcgtgagccactgcgcccggccgaaataatttatgtttcaaaataaaactttaaatagctctaattcattaatttctgatgatttgctttgtgggcagtactttctattccaatagtgtttaatgaccatattgtata

SEQ ID NO: 34251 - DNA, 1050 bp, Homo sapiens
gtctgttcatgtcctttgcccactttttaatggagttgtctgtttttttcttgtaaattttttttgtttctcgtagactctggatattagacctttgtcaggtggatagattgtaaaaattctctcccattctgtaggttgtctattcactctgatgatagtctcttttgctgtgcagaggctctttagtttaattagatcccattttgtcaatttttgattttgttgcaatgctttcggtgtttttgttttgttttgttttgttttttgtgaaacctttgctcatgcctgtgtcctgaatggcattgtctagattttcttctaggattgttaatagttttgggttttacatttgtattagtcagtttcacactgctgataaaggcatacctgacactgggcaatttacaaaagaaagatatttaattggactcacagtgccacctggctggggaaacctcacaatcatggcagaaggcagggaggagcaagtcacatcttacgtggatagcagcaggcaaagagagggcttgtgcagagaaattcccgtctttaaaaccatcaaatctcatgagacccattcactatcatgagaacagcacaggaaagacccgccccatgatttaatcgtctcctaccaagtccctctcacaacacttgggaattacgggagctgtaaaatgagatttggttggggatgcagagccaaatcatatcaacatttaagtctttaatctatcttgagttaatttttgtaaaaggtgtaagaaaggagcaatttcagttttctgcatgtggctagccagttctcccagcaccatttattaaataggaaatgttttcctcattgcttatgtcaggtttgttgaagatgagatggttgtagatgtgcagtcttatttctgagttctctattctgtgtcattggtctgtgtgtctgtttttgtaacagtaccatgctgttttggttactgtagacttgtataatttgaagtcagggtagcatgatgcctccagctttgttctttttgcttagtattgtcttggcta

SEQ ID NO: 34252 - DNA, 1115 bp, Homo sapiens
ttatatattttatttgaatatggtttgcttataagcttttttgaaaaatattttaaaaataaaacgaatgtctaaatatatctacatagagatataaccatgtgagcatgtataaaaatatatacgtgtgcgtgtataagtgtgtttgtaatttaaatgaaagtttgtaaatgtgtccttaaggtctctatttaaatttccttgttctgagatctttgttctctctgacctactttttcttcatccttaacgagtggtctttatctttatagacatgacacatgcttgtgatatttccatatagtattaagatgccagtgctattagtattgtcttaggtattacacagaatgggctaaatggaacagtgtctgatttttggaacataaattaagaaactaatagaaaaaatatattagggaatgtagatataaatttgctactttaaagctactttaaagacatgatataacagagcacactttaaaaatgcaacaaattgcatcatacaagaagttcccttaagctcaccaatggtccctgccactcactgtctttcctattggtgcagaaacacccatgtcataaagaattaatcacttgtcactctctgccatttcttcttcttaactgaacccctaacataggccttatatgtagttatgtttttctctgtctctcgtgtgtgtgtgtgtgtgtgtgtgtgtgtgtgtgtgtgtgtgtatgatatatgagaatcttataattgcacagtctgtgatacatcatatctttataacttatcaatcatccactgtctatatttcttttgtactctgaagtcactatataaatatgccccatatgcttcagatctcttcattctacatcaatagaccaaattctcttttacaacttacactggatattcatcataaaggctgttttcagagacatcttaggcatgagttagccttagatttattaacaaagtgacagcctgaaaaatttctttacaattatcaaagttacattcttctttaatgaactctagagaaatacattattggtttgtaatattgacttggtttgattattaaatgaaacataccctcctttcccctttatcgatacat

SEQ ID NO: 34253 - DNA, 1082 bp, Homo sapiens
tgcagtgtttggttttctgtccttgtgatagtttgctgagaatgatggtttccagcttcatccatgtccctacaaaggacatgaactcatcattttttatggctacatagtattccatggtgtatatgtgccacattttcttaatccagtctatcattgatggacatttgggttggttccaagtctttgctattgtgagtagtgccacaattaacatacgtgtgcatgtgtctttatagcagcatatgatttataatcctttgggtatatacccagtaatgggattgctggctcaaatggtatttctagttctggatccctgaggaatcgccacactgacttccacaatggttgaactagtttacagtcccaccaacagtgtaaaagtgttcctgtttctccacatcctctccagcacctgttgtttcctgactttttaatgattgccattctaactggcgtaagatggtatctcattgtggttttgatttgtgtttctctgatggccagtgatggtgagcattttttcacatatctgttggctgcataaatgtcttcttttgtgaagtgtctgttcatatcctttgcccgcttttttatggggttgtttgattttttcttgtaaatttgtttagttctttgtagattctggatattagccctttgtcagatggatagattgcaaaaattttctcccgttctgtaggttgcctgttcactctgatggtagtttcttttgctgtgcagaagctcgttagtttaattagatcccatttgtttaattagatcccatttgtcaatttttgcttttgttgccattgcttttggtgttttagtcatgaagtccttgccgatgcctatgtcctgaatggtattgcctaggttttcttctagggtttttatagttttaggtctaacatttaagtctttaatccatctccaattaatttttgtataaggtgtaaggaagggatccagtttcagttttctacatatggttagccagttttcccagtaccatctgttaaatagggaattctttctccatttcttgtttttgtcaggtttgtcaaagattagat

SEQ ID NO: 34254 - DNA, 1035 bp, Homo sapiens
tcgtcttaatatcacatcttaggtcatccctttctgtctagtcactgtttatcacatcggtttcttttcatctttgctggatgcagtacttatcacaacttgacagtttcttgtttattatttaattatttgtccccacccactagttgtaagatgcatgacagcatgggctttattttactcattgctgtatttagcaaactcagaatagtgtctggcctactggttttcaataaatgtcgtttgactagttaattgaagagtaaatgaactgtcgtgtttattttatccaaactgcacacagtcccatgaaataggatgttatcagtgtcctgcctacttcttcataaggaatttagaatttcactgtggaagaattttcagttataggtcgtaaaaatgatcctagtatttgtttaggataatgctagctattgtaccaaacaaaacaaaatataatggttcaaacacagtagactttcttttaagtctccttttcataaatctgatggtgttcttgatcaatggacaaattccttctagatagtggttcagggttgcagcccctctccattttttggctcagttgtgtttaaccttcaatgcaaagcttgcgttttcttccaacagagactctctttaatggaaagggaaagatcatggagggtctcatgtgtaaggttgttatgagtaagatatagaagtggcgtactcacttctaactgttcatactccagtggtttgaactcaattggcacttacgtaaccggaagggacgttgggaaatgtaatctagcgatgcacccagcaagagagcactggtgaatagctagccagtctcagccatgctactgtatgtagatctaagttcatttgcatttaggtgtaagatagctttataacttttaaagagttaaaaattaattatgggttaatgtttttaattctgtgtaaggcctccttcccaaacccaaccttttttgttcacaaagaaggcagcttagaatcctccatggatcccataggaatcttttt

SEQ ID NO: 34255 - DNA, 1100 bp, Homo sapiens
gccaggcacttctctaagtccttcacacccatttatttattcagtcctcacaacacaggctttcaataaatgatggatgaatgctgaatgaaaatatagtatcctttattttttacaaatacctcagagaaaaatagaaaatatgtctaggaatatacttactccaccttgtagagattaaaaacgtgaacataaagactcaaaaccctgacaatgatatggggaaagcagtgttcatttgggtaaattctgagtgatgcatcttaatatgaagttagttttagtcactaagtgtgatatttattttactttaagtagatttattcaaggtaagatgcctgggaaaattgactagattccagtgatcatcaccccaaaccttgtgcattctgttataactgttacttaaagtggttccaagattagtttgggaaattatcagttaaatacatttcagtcaatagacagtatttttttgtttttaactattggatttctcagcagtcctaagatgatgatgatatgtatcttggaccatgaaactctcttttacattaaaaaaaaaaaaaagacagagagaataagcctctgttgataataaaattccacaaaactcatccctaaaacttggggatctggtaccacagatgctgcgctatatcaataattagtaattcaggacggaaaggaagaagaagggcagccacccttgtttgtactgcactgtcaccaattttaggtattttaccaatttaactttttttttaacttattattacttatttacttatgagtatttacttattggtatcagagacttcaaggcatccatactcatctttatgttcaagatcgagttcatttattagctagtaattttataaatgccaaccattagattaatcagtgattatcaaattcctatttatatattatagagacttaaataatgtgtagaatttacttttacaaagctaattatggtagcatctgtttgtcctacataataaaaaaaaaagctattatacaaatgataccaaggttttatgaaactacaattagttttaggtttatgcttatataaagtattacttcctgtg

SEQ ID NO: 34256 - DNA, 1078 bp, Homo sapiens
ctgatgagcagggacattgtgagagactgcctagagaaggacccaattgaccggacagatgatgacattggtaagcttgaacaggaaaatgaatctacgagcaattaaaaagatttagtggcaaaattgtctgatgaaatagagcccaagactagtaggctttaaaaactcattaatttattaatttcctttgtataaacagtagtatttgttggacaaaaattggaaaaaatcaggtttactcagtcttaccttcaggagtctacaaataataatgtgaatgaaacttcttagtaaaccctttccacataaaccctttcttaagcttagtttatgacaaaaaaaaaaaaagttaaaatgagcctttcaagcagtattacttctattaattttctcgtgagcactgtttttattaagctcatgttttctgtatgtaaacataaaggcagttggtaaaattgtcacagtgatttgcttctactctggttttgtgtgaagacgcaagtgggtggaaggagacagcaaaatgtcaggttagtggcatataggctgtgtgatggttgagactttttttctgtctttcttttgctgtttttgtccttttttttttttaatttttattttatgttcaggagtacaagtgcaggtctgttacataggaaaacctgtgtcatgggggtttgttgtatagattatttcatcacccaggttttaagcctagtaccctgtagggaccagccccacagggtcggtgggtctctccccatgtgcagagacgagagagtgtagaaataaagacacaagacaaagagataaaagaaaaggcatttaggcccggggaccactaccaccaagttgcggaaaccggtagtggccccgaatgccaggctgcactggtatttattggatacaaaacaaaggggcaggataaggagtgtgagtcatctccaatgataggtaaggccacttgggtcacgtgtccactggacagggggcccttccctgcctagcagccgaggcagagagagagaggagacaaagagaaagacagctaatgccattatttctgcatatcaga

SEQ ID NO: 34257 - DNA, 1044 bp, Homo sapiens
cctgccttaaaagcagcatggggcttcttctccccttcttcctttcccctttgcatgtgaaatactgtgaagaaattgccctggcacttttcagactttgttgcttgaaatgcacagtgcagcaatcttcgagctcccactgttgctgcctgccacatcacacagtatcattccaaattccaagatcatcacaacaagatgattcactctggctgcacttctcaatgcctggaaggattttttttaatcttccttttagatttcaatccagtcctagcacttgatctcattgggataatgagaaaagctagccattgaactacttggggcctttaacccaccaaggaagacaaagaaaaacaatgaaatcctttgagtacagtgcttgtccacttgtttacaatgtcctccttttaaaaaaaaaaaatgagtttaaagattttgttcagagagtaaatatatatccatttaatgattacagtattattttaaaccttaagtagggttgccagcctggtttctgaaaaaccaaatatgccggacagggtgtggccacaccaagaagacgggaagacctggcttgtgaccctggcttcccatgtccttctggtctcacccgcgaagtgccctatcctggaagtatgaaatgttagccaattaataccaagacacctcatctgctccttccccagtggatggggttcttctgtaaaactgtttgcacatggccaggggagggaactaggacccttgtgtcctgtctgagccttatggaggcaggacggtgtcattggcggatgtgtcctgctccattgagatggatggcaaaccccatttttaagttatatttctttgatttttgttaatttagaggtgtaggttttgttttttgtttttttgtttttttttaagagaaacatttataactggatagcattgcagtgaaagcagcttgggatgttggagctaatgccagctgtttatactgctctttcaagacagcctccctttattgaattggcattagggaataaacaagccttt

SEQ ID NO: 34258 - DNA, 1064 bp, Homo sapiens
tttgcacagactccggaaaagtgaaggctgccaatctgagtagtactcaaatgtgaggaactgctggtcttggattttttttccattaaattcagctgatcatattgatcagtagataaacgtaaatagcttcaaattttaaaagtggaattgcagtgttttttcactgtatcaaacaatgtcagtgctttatttaataattctcttctgtatcatggcatttgtctacttgcttattacattgtcaattatgcatttgtaattttacatgtaatatgcattatttgccagttttattatataggctatggacctcatgtgcatatagaaagacagaaatctagctctaccacaagttgcacaaatgttatctaagcattaagtaattgtagaacataggactgctaatctcagttcgctctgtgatgtcaagtgcagaatgtacaattaactggtgatttcctcatacttttgatactacttgtacctgtatgtcttttagaaagacattggtggagtctgtatcccttttgtatttttaatacaataattgtacatattggttatatttttgttgaagatggtagaaatgtactatgtttatgcttctacatccagtttgtacaagctggaaaataaataaatataacataaagccttgcctatattcttaatgaatcatgcatgctttttattattaaattggaatagaagcctttcgtctcctgcagaagcaagtccttcggctggagagatttagcctcatggttattggaaactgcccaatagcctatttattttaggcagatctctgttgatccaaagcaattaatatcattaacgttagcaccagccaaaccatgttcagaattcagtgtttcttgaaaatgaagatgctgtcacaatatatttgcataacatttgtctcttctcaaccgtttccaacaataatctttatggtacgtaatattttggttcccagtatacatactgagagacaggacctcagagaaactgacattcaaggtcatgattattaagtggagagtacaatttagctagtg

SEQ ID NO: 34259 - DNA, 1082 bp, Homo sapiens
gccgcacctttgcatcttactgtctgtgtaagtacagttgaccctccctatctaagggttctgcatccttggatccaaccaaccacagatgaaaaatagtccgaaaaaaaaaagtatgtactgaacatgcagaattgtttcttgtcattattctttaaacaatacattgtaacaactatttccatagtattaggtattataagtaatccagaaatgattttaagtatacaagagggtatacataggttatatgcaaatactacaccatttttatatcagggatttgagcatccatgaattctggtatctgaaggaggtcctgggaccagtcctccacacatactggggggatgactgtaataaaacagtcttacaagggcctgtttctctactggccgaatccatcagcctttgcttgacatttcccattcgggattttggtacttaccattccctcttcctgcgttgccattcccctgagcttttgcaaggccaacaataactgattgttctctcttcctttaggtctgagcttaaaagtgttctctctatctaaagcatctctacccccacacccttgctactcttggttaatctctatcacagcacccagtttaggatcactggacacataatgacagtgattaatgatctaggaatgtttgctataatttctggtggtgagggagggtgttaagttcagatttccattttgggcagaggagttggctcatataattagcagactggtagaaagccctgtaggtccttagaagttggacatttggaaacagctttgttttttgctatcaccaaacctcttagattctaatatcttgcttttaatgtttattatccatgcaattatctgaatccactattatctctgaacagaaaaatgctgttatatgcttatttttctatatccaagacttattcttgagacagtcccgctttagattacattgtgatttctcttgaactctttttttaaagcaggtttgaaagtccacatagtttattttcattggtttccctctgtttgtgtatttatttatttgtaccatgtcatgagttagtca

SEQ ID NO: 34260 - DNA, 1034 bp, Homo sapiens
ttaatgtaggacatctttctttgacaggctactgtatctataatcaccgttaatctagctcactgcaatgtcattcacacatcagttttacatgaatatgcaaagaacacaataatcaactgtcaaacctaaacgattaattacttatcacagaatctgttgaatatttttgttttctaactgagcaagggaaatcctgtcagcttttaaaagtaagggctagattcttagtcataattactcatcatctgtcaagttgacacctcatatggatgaaataagccttacacatttgatttaataacaaaaataggtaattttattcccctattgtaagtacttcatagtaacaatttatttatttcacaactctgctataggcagattgattgttttatctttctatacttttggatttttaccctttagagatgtgaacttcatctgactttaaaatgaggacacttaatttaatgcttttaaaaatcataactaacttttgtgactttgaaataaaagaatgaattaaactgttttgaaatactcaacaactgttaaataaagcagaagcttagtctctaattttacggctgtgctatccaatatagttaattcaagttgaagtgtacttttaaattaccaactggattttgaaaacttggttcaagaaacagatgtaaactatcaatcaatcaatcaattttttatattgatgacatgttgaaataacatatagtgtttttaaaaaatcaaaattcattttaacaaacaaacatttatttttactttttaaaatagggctactgggaagttaaatatttgcatctgtggcctgcatttgtggctgttgtgtttctattggacagcactgtattagaggaaccagatgaaaataaatataagacctgataacagttctgtgggtatttaacagagctaattatatccgaacattttctgaaaatcttttgcgtgacttaaacaaacgtaattaattccaaatatcaatgtcttcaaatgtatattgcatctat

SEQ ID NO: 34261 - DNA, 1072 bp, Homo sapiens
taatataggtttaagctttagcacatgctattcctctgtttagagtgccgcgctctttacaataaacttctactaatctttcagaacccactccagggagaaaaaggtgcaatctgtcatgaggttggcaaacacagcattcgtgccctaattactaccaacactctttcctgctaatccctatgatagcttcatggttcctaacaccacaatctaggtcaacttctggagttggcatgagaaaaaatctttttgccatctggcccagaggaagaagatgccttttcacaatattgcaaattccctacatcgtagtccaggagaaaccctattaatgttaactaattaaatgctgttgtttggagtaaaatagagtaactctgaacttcttaataaaactaggagaaagactgacggtttcatgtctctccctacccaagtcgctatttaaaaaaattaattagtgtatcatggagttaaactctttgaaggaacagattcaattatcaatatatttacttaagagaagatgctaaaagatgttagaaaacaaatcgtcaagaaaacagacctttgattttagaaactttagagtacgaaaatggactataccaggcatttatcattaatcagtgtctgttagtcgtatacaaatgtttccatggtccctttctcctatagacttctttgatcttaaggataggaattttaaaaatagaagtatgctacttggatttgatttatttatacaaatgcatttgcaacgaacacgtgttcgataatagcactgttgttatctagtggtaatagtggtactgtatcatgtattccaatactctccagaaacattttcattttaggataaaaaatacagaaataattacatacaattatgagatgaattgctttatacttatttataaatttcccaagtaacttatagacaaatataatactttaaagtagtaataataatttttgaccattagtgcaacttttaaaaaatgttgttctactttgacagcactagttcctcatctaaagatttcacagtatcgttcataacgaaaca

SEQ ID NO: 34262 - DNA, 1046 bp, Homo sapiens
agtttcacagtcaggcacagcttccctagctgcatgatagaatcatctaagggtgactaagtataaacctctggggataaagcccagctttgcagcattaggaacataccacaggtaatctaccatgcagtaaatgtggagaagccctggggagggtaaatgcaggatgctatgggactacgtggtagggcagtgactctccatccttagccagcatcagaatcacctgtaggcttcttcagtacaaactgctggcctccaccatcagggtttcataggtctagggaagcaggaggttaaaaatatgcatttctagtgaacgcccaggtgatactgatgttgttggtcccaggaccatactttgagaatcactgtgctaggaataacgatcctacttcagggagctgtaatgagtttcccagaggaagtgatgtttaaggtaaactgcaaaggctgagttgggatgagggaggtgtgtgagaatatatgagtgtttgagtgtgtgtggtggtggtggacaagagaagctggaaggaaatgttttacagagagaggaaagctgagcaagggcctggatatagatttgaggagctgaatgaatgttcggcctagctggcttcaactaggtcacgggggcagcatagtcccactgaggaatttcggttaccttttaatggttaagtgggaataggatgtgattagatttgtgtttttgtaaatctgctgggattacattactgagcatgggttgggttgaagttggcaaaactggagaaagtctagtcaagaagcttctgcagttttcaagttaaaaatatgatagtttccacatggatggtagccatagggaaggaaagaaatggacagattccagaggcattcgagacagagtgaataggatttggtgattgatttaaggtagaagaggaaggagatcagagtgaaagctgtgtatctgggtttggctactagatgttagtggtgccgttcccacaggtgttagagtgagaagtggtaggggattatgcattgcgacacgctgagac

SEQ ID NO: 34263 - DNA, 1047 bp, Homo sapiens
cacagaaaccgtccctgctacagagcaggagttgccgcagccgcaggctgagacagggtctggaacagaatctgacagtgatgaatcagtaccagagcctgaagaacaggattccacccagacgtccacacaagaagcccagctggtggcagcagctgaaattgatgaagagccagtcagtaaagcaaaacagatttggagtgaaaagaaggcacagaaggctatgtccaaactgggtcttcgacaggttacaggagtcactagagtcgctatccggaaatctaagaatatcctttttgtcatcacaaaaccaaatgtctgcaagagccctgctttggatacctacatagtttctggggaagccaagatcgaagatttatctgagcaagcacaactagcagctgctgagaaattcaatgttcaaggtgaagctgtctcaaacattcaagaaaacacacaaactccaactgtacaaaaggagagtgaagaagaagaggtcgatgaaacaggtgtagaagttaaggacatagaattggtcatgtcacaagcaaatgtgtggagagcaaaggcagtccatgccctgaagaacaacagtaatgatattgtaagtgccattatggaattaacaatgtaaccatctgaaagcaacttttcttggtgtctcaaaggagtaactgcagcttggtttgaaatttgtactgtttctatcataaataaagttatggcttcttgttggaaaaaaaaaacctagatgatgggttgataggtgtaggaaaccaccatagcacgtgtacacctatgtaacaaacctgcatattttgcacttgtaacccggaacttaaagtaaaataaaattaaagaaaagaaagaaagaaagttatcagaagtgttttgatggtgacacaaaagggtatacaggatgctatgggaggatggagaagtgatagaagagtcaacaactttggatgaattacccattctaggactcactttcttctgctttgtataggaggcaattatcactacttctcagttctaatgcatagg

SEQ ID NO: 34264 - DNA, 1014 bp, Homo sapiens
acatggtaaaaccaggtctctactaaaaataccaaaaaaaaaaaagagccaggcatggtggcatgtgcttgtagtcccagctatttgggaggctgaggcaggcgaataacattaactcaggaggcagaggttgcaatgagctgagatcacaccactgcactgtagcctgggcaacagagagactccatctcaacaataacaacaacaaaaaagaagtcctccagttactgatatgctttcattttattttccattctttggctcttaactctgttattagtttatatatcccaggccccggcggtagtaactactttacccaggcctgttcaggcacccctcactgtccagcttctgtcctttccactaggcctataaaatgatcaaacttttttatatgcgcaagtattttcatgtgtgtcccctctgtctttgtcataaatgaaactttgtgtttcccccaaacctgtatgtcgtgagcagacttctcgaagggatcactccccacagcccactgggaacctaggtagaagggtaccacttccagaccattgctctcactgccatcagcctaacttttttttttttcactgtttattacaaaacaaagtaattttaagatatttttaaagattgacgttaagaagctagattaggtgacttcttataatatgtgacattaaatattttgagaaattcttggtttccttggaaggcatttataatgataaaccttttttcagttataataagatactaagcagagataattttgtcatcccagatagcaatttcttattcacaattgataacatttgaactgaaagagattcctggctttatttctatatttttttctacttaggtatttaacttttttgacatcctcttatcccctcaataggatccaaaatatgtctaaaattaattcaaaagaaaactatttgaattattgcttgtgtttgaaaacagtatttactgtagtattccacagtttcttctttttttaggcta

SEQ ID NO: 34265 - DNA, 1046 bp, Homo sapiens
gtttcctgataactttgggaggttatcatacttcttttagttcagtcccttctccagacccagagcctttggtagggggcacttcatagattgattcatttattttcttcctctctgtgacctaaaattctctaaaccttggtaagcatactatgttacttctaagagatggcatatttgtagtgttattttgtgggtagagaaaggaaaatgaaaattgcaatgggcaagattcccacaatgaacattccctggagttagttatgattttgggatacaggattgtttcatgctgaaacatgctgcctggtatgttgctgctcacgagtctccaggccctcttaggatgtctgttaaattctgtgctagcagggggccaaaacaggcaacttcatctgaactggaaaggtcttgttgccatatggaggactgcatttccgtgtatttttacaggggtgggggaataaagcaccagaggttaagacagtaaggggcagaggtacatctcttgcctgataacatctgcaaaacattgagctcgtcaaacatatctggtgattccagttctccctacagggattcagagaactgtgagccacattgcctgccctcaggctggcacagggacataaacattatagaactaagaacaataaaaatttgaacaatttaaagtaattatattatagacggtacatttattaaacctgaagtacacaacatagatgttatttgctatagggttcgggagctggacataatcccttttaggctaaagtggacagggaaggcatcatagagaatgtggaactttaactgaggattcagagttaaagagaacagagtagatggtgataggagcctgtccgattaggacagcagcatgaaaaaagttgagaaaagtgaaaagatggttgaaacctgagtctagcagtctagtttctccattcactgattccgtaatatctctttagcccaaggatcagcagactttctcttgaaggaccagagaataagtattttaggctttgtggttatatggtctc

SEQ ID NO: 34266 - DNA, 1028 bp, Homo sapiens
aaaccccatctctactaaaaatacaaaaaattagttgggtgtggtggcgggcgcctgtagtcccagctactcaggaggctgaggcaggagaatggtgtgaacacgggaggctgagcttgcagtgagctgagatggcgccactgcactccagcctgggcgacagagtgagactccgtctcaaaataaagaaaggaagaaataataataataataaccttagaaagaaagacaatttagtgattggatgttcttgcaaatgaatagcattttcaaggatttatttaatcaggctcctcctaagagtagcatgttctgacaacagctatagatttatcagaaagcaatctttggatattggtggtagttgagttgcatgttgatcattaaatgctgtactccttttgcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtaatttccttttcatttattctacattgctgctaaaattaacgtagtagtcatgtttatggaataaattgtggcaacattagggcacatgtgaggttttttgtgtttttttttttttttttgagatggagtcttgctccgtcgcccaggctggagtacagtggcgcaatctcggctcactgcaagctccgcctgccgggttcatgccattctcctgcctcagcctcccgagcagctgggactataggtgcccgccaccacgcccggctaattttttttgtattttttagtagagacggggtttcaccatgttagccaggatggtctcaatctcctgactttgtgatccgcccacctcggcctcccaaagtgctgggattacaacatgtgaggttttaactggtatttaaagataagtttaaa

SEQ ID NO: 34267 - DNA, 1021 bp, Homo sapiens
ggaagtagagctcagctgtaatacttgctcacctgccgctcacctcctgttgtgcagcccggttcctaacaggttccagacaggtaccggtccatggcctgcggtttggggactgctgctgtataagactgtcaactgattttaacagttgcttgggggaacaattcaggtgacataaatgtgtaattttatatctggagaagggctgttaagggatggattgccacagttatttatttatatcctactttgtctcccaacagaagttaaggaaggctctaagtattattattattatttttttttaattgacttgggcaaatttgcaggtttccaccccctcctcatcgtaggtgtaatctgtgcacttagaaaaaaacagctttattgtgatataatccacatcatacaattcacccatttcatgtatacagttcattgtgcatccatcactgcaattcattttaaaacatttttattatcctctaaaagcaatcctgcttcccttggctcttactcgtatcttacccaaccttcagcaactgctagtctactttctatcacttagagatttgcctcttctgaatattttagtcatacagtatgtgatctttggtgactcacttctttggcttagggtgatgttttcaagatttgtttatttatactgaggcatttattagtacttcatgcctttttaatgccaagtaatattgcattgcattctgttattaatttttgatttaaccttttttccgatttcctaagataactttggtatttaattctgtcttacaggatgttgttcacttatcaaatagtgttacctaaagatataatgagtgtgctattttatcagattattgatgaaagtataaaattaacatcatcagctataccctgcagatcttcataacatgatttgattaccccatctgtcaccattaggcaagaccctaatatatttcataaaaatcagcagcactttaaggggaaactctgctgccatgaaggaaaatat

SEQ ID NO: 34268 - DNA, 1035 bp, Homo sapiens
gtgtgctttgggagtagtggggttgggaagggcgtccgagaggaggttactgaaggatgactaggagttgaatgggaggacatcacctgtaagggaacgatatttccgtgggcagagaggaatgaagcagtagcaaccatgagtgatcagatactgcaaaaatgtgaagtgtaggatggcgagaatgtaagaaatgaagagtgaagaagtctggaagggcctcgtgtgcatcaatcacagcggggcttgatctttatgcttagggcaagcactcccttgaactttgagtgttttaaggaggttatctctgatgtttaaatttatatagatcgtggcattgcatcttagaaataaggtttaggaagggcaagcttggaggcagggcaagtccagaaaatgaaggagctggtgaaatccgtgttaaagtgccaaaggacagagactggctgacagctaaacttcaaggtttctgagaatccacaaataactaaatttatctagtcaacctgttccagaacaggcttccagtcatttaggttgcccaagaatgagtaaaggaaaaggaaattcaattttccaagaccttgtttcccctctcctctttaattccttgttcggttagcaacagtatatccattccctcgctcctttgtgaaaagtaaattcctgaatgttaactaaaccaagtgtttctaaattgggtaagagtttgaagacttaaggcagcagaatgggagagacttaaaacgttatgtctgagaattaggcattaaaggaggcctagtatttgggcgggggttgtgaggagcacatactgaacctttggacctgttgagtgagttcatgtgcctctgaactctctgactggatatgaccagtaaacttggataattagatcctggagtttaggggagagggctagagatagagatgatggatgtcagcatatttttaaaacagaaaatagttaagatcacccaagacaatctggaatcgttagaagggagtaaggaaggcattattgggaaactttcc

SEQ ID NO: 34269 - DNA, 1082 bp, Homo sapiens
ttggggaaggggacttttaaagcactatttagaatgcttctgaggctttaaaatactcatttttaaaatggtccaaaaaattcataaattagaagcagcagtggtgaacatttttaggaaagtgacccttgagaagtttattttttggttagtgacctattgagcttatttattaggtaagtagaacatgctcatttaaaaagtttaaattgtgcaaaagacatatgtcagatttttttttctgtcttccataacactatttcctaccccgccgcgctctgtcttccgtaacactctcccctaccccgtcgccactctgtcttccataacactgtcccctactccaccacactgtctcctaccccgccgagctgtcttccataacactctcccctaccccgccacgctgtcttcattaacactatctcctgccctgccacacaactctgttttcctagaagtcaccagtgtgaatttttccctttatccatatgtacattttttgtttctgtgtgtctgtgtatatacatatgcataaaagtgcatagataaaatacatatccttttcaaaaaatcttaagtggggctcttgctatgcatactgttctgtaacttgttacttggattaacactgtatcttagacatctttctatgtagagcgtatagatcttccctgttcttttaaatggctgtataattgtctatggaaggacttaatttatttaacccataccttgttgatggcttatttgtgttttgcttttattttttcctctttgtttttgctgctacaagcaatgcttccttccatcttagcggatctgtctttgtacccttgaatgagaaagttgctggatcaaaggatgtattcattttgaattaggtgttgctaatttttcctccaatgatacactgatgtatcccccctgcccacagtgtgtggtcatgcctgttctctcaccctcttaccagtactggacattaataagcttttaaagatttgctactcaggctaaaagtgtctctttgttttagggtgcatttcctcatttaatgaagtgaagattcttccttgtttagt

SEQ ID NO: 34270 - DNA, 1618 bp, Homo sapiens
tttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtatttgcactttgagctcttgaaataaatgtgatttttgtgtgattatctggtttccagttttaaacattaactgtcaccttttattcttaaacttgaaagtacagaaatcattaaattattaagttgtacaataaaaggattggtttcttttcttttttttttttttaagtgcttcctttgccgaaatgtttcctggctgtttgaacatgaatttttcaggtttaagtattgtgggaaatcatcttgacctaataaagcaatacatactgaagcagttctttgccctgcttagataatgtatgttttctgtacagttgaagaatagagctaaacttttcagggctgataaaatctcaactatctagtttgtaactcatcaagggttgggaattcttagtatgtggtgttaattatttttatttttttaagctgcggagtcattatctggtaacttccttttttttctttttctttttttgaaaccttacacggtaaagatgtccaggtgtaaggga

SEQ ID NO: 34271 - DNA, 1049 bp, Homo sapiens
agatttagaatgcctttttttcaaatatgaaaataaaagatataatagcttatttctgtgatatatgcatacataattgcttcccacctaatttttttttcacttttgtagccttatatgtgtgactgtcttaatatctcaaagggctagtgctatcctcacccttattcttagattttatctctttaattattttctttgctttgttattcccaccagtttgtcttctagaaggtcttcatatcatgttatcacttaataaacattctcttttttattctgagtgaaaatgcaccaaagtataaatctgagaaaaagtgaatgttttataacttttgtttctcagaaaattatagcagttatgttaatattggtgatatacttctcattgtagtcattcctatgctagcaatatttttattgctactgtggataaattatttcattatatttttaacttgttattgttggagtaaaacaactatttatttttcatataaatattttgtttttggcctttttgctgaactctgaattctaatggctgtccagtttgtttatttatttctttattttatcatctccattttacaggtgatgtctagtttattttttctgttttttttctgagtgtactatataaattgtatacagtgttggtactttatatttttaagtttatatatcgtaatttattcctatgcataattgaatagtagagaatttctagtatactgttacatagtatgtcttttccctgattttaatgggaatggcatttctgtgctcatatgcatagtcaagcattcaaataaccattcttctgaagttgcagattaggtactttaagcatttggaataattagtttttattaaatgtcattttgatttaagataattttttatttataggatactaaaagtaaactttggagcagatttttaaaacacacatttctactttctgacattttacttaggttttcatatgtatattcataaaggaaattggcccgtacttctctattttatataaattttatcacact

SEQ ID NO: 34272 - DNA, 1033 bp, Homo sapiens
atttaagaagagttggatagttttcactaacaaaattataaatttctgtgttgaaaaatgcacaacataaagtaagaaatacaagtttagactgagaaaatatttccaatactgcattataaacaaaagtgtaatgtacttatacaatgagacttaataaagcattaagaaacatagaaacaacaggcaaagcataagatttggcaagatacattggatggaatgcagatggccaataaatgtatgaaaaatgtttaactttttaaataaaagaaatacaaattagagtttttgttttgctttgttttgtttgttttgagacagggtcttgctctgtcacccaggttggagtgcagtggcgtgatcacgactcctgaactcaagtgatccacctgcctcagcctcccaaagtgctgggattacaggcatgagccactgcgcccggcctagagttattttctaatagtttggaaaaaataataatttttattgctggccttagaatgagtaaacaaaccctttcacacattacgaaggggggtgtgaattgctacaattgttttgggaaaagctattgaaatataaaattcatattctcctcaaatcaacaacactgctgttagaaatcttacctactgaaatgaaagcacaagtatgtattgataaacaaattatgcaaaacttaacaatggagatatgttttgagaaattagttgttagatgattttgtcattgaatgaacatcagactatatggtagagcctactacacatgtaggttatgtggtatagcctattgctcctaggctacaaacccgtctggcatattactgtactgaacactgtcatacattggtaagcatttgtatatctaaatatagaaaaggtacaataaaaatacagcatgaaagattaaaaatggtacacctgtatagggcacttaccatgactgtaggactgaaagttgctctgggtgagttagtgagtgctgaatgaatgtgacggcctaggacatgaccatttaaaactgtaaa

SEQ ID NO: 34273 - DNA, 1064 bp, Homo sapiens
ttagcaaaacatcttaatattatttttagtttggagtgtttgtagaatatttaaataaacattaaaaaattcctaagggaagggacaggtgaaatactaatacaaacaaaaactgttacaaaatcagaaatgtcaagattttggggggctactgtgtatctgtttatctacttgatcttatatgcgattttgtctttcatttcattactcttcttcattgggaagaaaaaatcctctcaaggtcctatctcagtccctgaagaaataaataaaaaagagtagcagaagatggatgagattgagtgggaggtaaaattagaatggttgcaatcagtaaaaatcttgaaagtactttagtgagagaaccataaacaaaatatgatagtgcatatcctataagatccatgattactcataatttattcacaagtacattaaaaatgtaaaaccatgcataattatttaatgtataattaaaatttaaatattgaatttgaaactgggacaagcaatacgctttcctgtcatctgaacagttctggagtatcataggattatttcatgtctgataatattccatcatcttcctgtatctaacatcagatttaatacacacagcaggtactttttgatcatacagtttagcatttataatgaatcttggagctgaagccatatagcagccttgaaaattatgctgtatgcctttgaatgcgtgggcactcaagtaggttggagtaagaaaaagcactcaagtttttgttgttgttgttgtctttaattattttaaaagtcagtctcatttgatctctctttctttcccccactcttgattttggaggttccaaatggcctttctccactcaaagagtggttcttaggcctgcaggatagcatggtccactgacaagccgcatggcatcccaggggagcttattagagctacaggctctcaggccccactccagatctgccgaattggaatctgcattttaataggatcttccgttgcttcacgtgacatccaaatttgaggagccctgccatatgggataggtctgaat

SEQ ID NO: 34274 - DNA, 1128 bp, Homo sapiens
ctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaatccccagtgcatgtatttcagttctctaagatttttggtctggcattgtggtcttatgatgaaaacatgtatcctcttaatggcggcttctcatatattcatcctgtacattttaaaatttgttaagcaactactgtgtgctaagcactgcatagcctctatgtatgttattgtggcaggcaaaaggttctgattttgggcacaacctttatataaataacacaaaaattaatgtttggacacaaactctaaatcagtaacacactggttaatatgtaattatgcattgtgataagtaaaatgacaagaaagagtagggaaagagaaagaatgacagagcaacttaaat

SEQ ID NO: 34275 - DNA, 1096 bp, Homo sapiens
ccctacaaacctttattcacaataattttatacctaatagtcccaaattggaaacaaccaaaatgtccatccttaggtgaatgagtaaacaaaatgtacatgttagaacgtggattactttatgttgattttattcaataaagctgttaagattgaaattcaacttatgttggattttaattgaacaaaaatttaaatatttccctcatcagattaaactcatattaaactttcctttagccctgtattataatgtcttgattcacaaaggatttcgtgtactaaattcttcctggttattgtgattttctgttgactcctgtttagatcttatctcctgggccttattcacctcgtcatcttctcctcctgttgtcttcctgtttactggcatgccctgcttgcacctcctccctggaattacacacactcctacttttatagaggtgaaatttggttgaaattagcatcacatacaactttgaagtgagcatagaacaattaagagtgataatgttggaactggttaggattaggggttgaagtgaagagaaggtgtctgaatgtgttaaaacaaacattaggattcctaatctatttttgaaaagcgtcatcggttgcttttctgactcatttcccagtccctcaccgtgagacaccccacaaatgtctgctgaggcagataccatcattacgttctaggaatgattctgcttgccttttgagagtcataatggcatagttcatttctaggataggagcagttttgtatacattataattcaggagtcagcaaactaaggcccgatgcctgttttggcaaataaaagtttcattaaaaaaagttttattggaacatagctgtgctcattctattttgtattgtctatggctacttttatgctacaacagcgtatttgagtacgtgcagccactatagatagtgtgagcctctagaaagcctgaaatatttatttttcggccctttaagaaaatgcatgttaacctcttagttaattaaaattaataataacaaacacatagtatgcactacgtgccagcttcttgtcatatgttaagtaaaaatattagttct

SEQ ID NO: 34276 - DNA, 1030 bp, Homo sapiens
cccatgtgatagctttactggaagcaggttgccaagtcgatttcctcctcgttccatagttgttcaatagaatgtgagaagttagggactccggtatcgttctgtcagggtatcttgattaggaacttttttattgagagataattataacaagactgcattctattcccttaaaaaaagtatctgtttatacttactgttgtgtaaacacatcatagaaaattacatttgaaattacatttcccatagaggtgcttatcttaccatagaaagaaaaaaaaaaagcttttggattgagctgttttctttttctcatttttcttctttaatcaaatataaaataccttaattatgcattggagttcaccagcaaatatttgaaaaaatcatcaccatgccacatgaactatgaagcaattacgtgtttattccaagcagtttttgaaataagagatttcggccaatttcccaatggatacttttcttatttaaataacaagtccagatcattgacttaaaaaaacaccaacaaaactcccttagtacatgatagtttgttataattaaagtcttctgtgaaaatgaaattatttatgcttattaactcaatgaatctttaatacatgtctctgaaattctaagaatctcaataggttctggaaacatagtttatatccttatgttgctgaatgttgtctgattttattgtgagagaaggccttctcagagctgagtgtttttgtttggtatctcatactgtttctcagagacagcatatatatgttagtttttgaaatacggtttaattagaaagaactcttaaaccaaatcaatgatatgtagcttactcacttgagaaattcagggcaaagctgatcctttttaggtatgaaggtctagttgaaaatatgtaagtgctgtgttgcaaaacagaatcctatatcactgagcctttccattctgcatattgcccttaatttgctgttatacaatttaacagctgtctcttaatagccatttaaactgagat

SEQ ID NO: 34277 - DNA, 1035 bp, Homo sapiens
aaacagtgagaattttacttctttctgtccaatttggatggcttttattttgctttattttttctcgttgtcctggctggggctttcagtactgtgttgaatataagtgacaagggtgggcatccttgccttgttccttatcttaaaagaaaatatttcaggttttcaccattgattatgacattaggtgtgggatttttatatatagtttttattatgttgaggtagcttcctcctattcctagatttttgtgtgtttattatgaaagggtgttgaatctgtcaaatacttcttctatatcagctaacatgatcatatggtttttgttctttattctgttaatgtaggtatttgaagtttcttagttttaaaaattctgaactcacagagtctataaaagttccaattgtttttatgatgttgcccatcaatatatttaggaaatcacttatgggaagaacaggaatgtatctatagggtctttatatgagtgactattttgtaatatacatgcttctgaactgtggactgcccatttttcatttaaaaagtcgtaaaattttacaaatttttgttaaaagtatagctgatttgctctttcaatgtagttagaacaaatcaagaatagtaagtgaaccatgatatgatctgtctctgcctattgatagtggctcactgaggaggttcagtaagattttgcattgcttacttgtcaggatatggagaagaataattgttaacttcctgaccacaaaaaagaagaaaagcatgagtgactaactcccttgaaatggaagggagattaccttagtagacagaatgaaacaaaattcataattctgttgtctgaaattgaatatattctctccaagatgtcattgaccttttcaaattgaacctttttttggaagttaggaaaaaatcgaaccccagaggccacaaatttgtttttagaaatagaaaaagaaaatggtaaatgctttgttagtactgaagtactacagaaatttaatactccattaatttgggtttat

SEQ ID NO: 34278 - DNA, 1071 bp, Homo sapiens
ataaactttttttcaaacaagtttttgacctttgagccaacccacccgtagactacgaatgtctccctatggctggtagcatttgaagactaaagacttgtcaaatatatcaagagtatatcattgcaagggcagcacttgtcctgtggaacaactacttataatgccttagaattcctgcacatgatcaaacagatcctcctaaaacacaccttttgaaatgttgaacataatagtgtatgttaattaacagctctatgaagaaaatccatttccatgactgaagcattggatataaatatggtgtcctgctttttttgtagaaaatgtaatttgaggatgaattttctgctttaaaggcatgtgtgtttttaaaattaatgaatgtagatgtgtgattgtctgagtgagtgaaactacaagaggtaaaaaataatgggtggttgaaaagttaaaatgtatgtgccaagttctactagaattccatttgaaatagcaccttccttaggtttcatggacaaataatgggaacttctaattttgatcaatcccattaaaaaaaggctctttcctttagagaaactctattttgatgtcaatatagattactgtatgaagtagctttgtgtctgttacctgtccatgagcatacaacattgaatacaattgggtgtattctttcagttttacacaattaaagtatacacacagatgtagcttatctgtttttttcttaaattgttgccctgaaaaaatttcttgcatatgaattgtaaaatgtaaatacatttttataaccaatgttttgatcttattgaatgttactttgaaaatgtataactattgcctgcaatgtagatgagccttttagtagagctgatttattccagtaacttcttccatattttctcactaatctcccgttagccaaaatatgccagaaatgggaaagagaggagaaaaagtcattaacattaacacctatactgttctatactactcctacccgtgtgctaggaatgtgcactagctctttttaaattccatgctacactttgaggactgtcatca

SEQ ID NO: 34279 - DNA, 1855 bp, Homo sapiens
atagaagtatgtaggaaccggcttccctaaaaactgttttcttagccattgttaagtggaaggaagaaaaacagacgtgactacaatacatctgaggcaagagataaattttataggactaggtcagtgatattttccaaatgctaaaacataaatagcctttgaaattcaggaaaacatttaagcattctgtttttattactgtctcttcctaccctcttcctttcctctgagagagtcactcttgctcgctctctccccctcctctctgtctctttctctcccctcacctccttcattccctgcctctcttcctctttctccatctcactccctcattctttttatttattttttctttactcttctctttactctcttctctttactctcttccttattcatgggcaagatgttttaaagctccagaaataaagttgaaattccctagtacctagatatagccccattaggaattagatatttagataaagaaggaaatagcaggttgtctccaaatggatctgtgcaactgaaacaggtttttcttgtcactgctgcgtcgtatctgtctgatgtgttttacactcccctctctgtctagacagaagtcagcttgcatcacaaatcttttcagactgttttgtgaattaatagctagtcagcttacttaagaccaacatccgtttgtcatagtaccttctctggccttctttgaaattctgactttgtactgatagactccttcaaagactagtctgggggtgggggacacagaagactcatttgacagctgttaatactcagtctcttactcactcagctgtctggaaacagccacaaactgtgttgagttacttctatagcactgtctaatagcgtgcaaaattaaaaacacaaaaacgcgtcttactggttgtggaattatacatataaaagtatattgcctcctgctttcaattttaatttctgctcaccagtgtgacccatgctagatcttgtacggtagagtctaggctttgattctctgattcaaaatataaagtaagttacacttagttaaatgtactaaggtgctgttgtaggagggcaatgatagggatgtttcttgagatcccagtagattgtatgcagtaaaaacttaatgcatgttctaggttaggacggtgggttgaacaaaagtaggccatatgaaacttatagttcaccaagagtgtgacaggatgccctggggtgccacaccacgctgacagggatgctgtaatatatttgaaatttttttatgcaaacacattcaaacttgacatttgacagatatgacacaatgactggcttgaactagttcagaatttcaacattagatcaccctccattcttttctatgacataatctctttgtgaaactgagtttttgatgagtgtgtgataaaaagtaagtacctcatgaaaatccatgtaaaacatgaaatgaggctggctcatccaatctgattccaagagaggtggtacagtgcccagcagatgcacacagccattagtaagaaatagtggttatttaagaataaaataatagtatttttctttcaatttatatgtatttttaaacactaaattgtttaggcataaacacttattaagttctttggaaataactacataacaaacataactattagttatgtcttttggcttaggagcaccatttaaaaagtattgagaaacttagagtcccatgaaccaagaaagtttgttttactctctagaggaggagtgtccaatcttttgaattccctgggccacactggaagaagaattacctggggtcacatataaaatacactaacactaatcatag

SEQ ID NO: 34280 - DNA, 1018 bp, Homo sapiens
ctgagttaggcctgagcagggcagcccttcaaatgcaattcaatgctgctgagagggaaacgaacggagtccatcccagccgtggagtaaatggactgattaacggcaaagctaacagtaataaatctcttccaacaccagctgtcctgctttcacccactaaggagccaccacctctgcttgccaaaccaaaactgtgagtatttctgcatggttttataataatttccatacccctgttacatttcctgtctggtgagaaaaaaacttttgcctgtattcaactatgtggcaagttggccttgactcatgggaccttgctgccaagtggtgtctttcaacaatataaaagacacctaaaaataaagaagggaaatgaaaagcttggtgaaatctgccctttgctgaaagctataactggttatggctgtgaaaatatctgtgcccagtgtgggcttccaacatacagctaaggatgtagccactccctggaggccatggaaaagggggatctactttcagccctttattaaaagcatttcaaaaagtgagtataagtactttgcatttgttactttaaatattaagtatcagtaagaagatctgatatagacaagcggggaaagactaaaaactgaggctggaaattcagggtgcagatcctggcagggcaatgaaactggagggaagcaggcttgtgggcaagaagagcgcccttcacaacacaggctacttggcttggaattccatggagctgcatatttccatgaataccatcttcacagttgatgtccattattttcttaggatgataaaccttgcatgagctgtttccattggcaccgcacagcagagagttgttatgaatggagccattacaatgtcagagagaggcagaaataaattagctcaaagggttctaccatagcgcaagagaccctgaattactgccctgccagaggttagtggaaatgtaagagtcatagtgaatgtgtatgtattctatgaggtcacattc

SEQ ID NO: 34281 - DNA, 1014 bp, Homo sapiens
atgttcatgttatctctgctcttattttcatcttcattgtacacctccccttacatgtatttgcaagtctctcactttgcaaaatggaactgataagtactaaacctcctcaaaaaaagcacaaacagccccagagtgatgatgcccaaaacttaaatgaccacagcaaccagtgccatgccagtgagttttggagctgagctttggtcttgtccatagaagcttttaagttgaaagcttataaatagagggtttctatattctgtgaatgatagaggtacacagttccaattgtattctgtattacgtgtatgtgccctctttgcataaatgtgcctgacactgtagtggaggccagcttcttgaaagcaaaaaaacacgcatcccattcatctctgtatttccagggctcagcactagtgggtgctcaataaatatactgaatgaatgaataaaagtattactgcaaagatcagtaagtcccatgccaaaaaaagaaaggaagaaaaaagaaagggaaggaaggagtgagcgaggaatgaaaagagaaagagggaaagagggaaggatggtgagcctcttcagaaagacggctgctcatgcttgctctcttgggcatggagtgggtcactggctggacgtttaatgggtttacattattccttaacagtcattgtttcaaaatgaggcatctctgatggctccatgctggcttgtctctttccgcctatgacattctctcaagagtttagagtaggagaggattttagaacatgatagtaacaagtaaaattagtattttttggactccaggtacctgtttgaaattatattgtttagaatataacaataacagtgaaattaaattgttgtcttaaagtgaataactgtaaagccatgtgtgatctgaacccccgagcctgcccttatctatcaaaatcctggtgtctgaagaagtccaaaatggaaacacactctgaacagatttccggcaggagcttccaccaggttttc

SEQ ID NO: 34282 - DNA, 1018 bp, Homo sapiens
atactccctgaatctaaaataaaagttgaaaaaaattttaaaaagaaaattgttgggaggctgaggtgagaggattgcttgagcccaggaactcgagaccagcctgggcaacatagaaagaccctgtctctaccaataatcaaaaaaattagctgggctttatggcgcacgcctgcagtctcagctacttgggaggctgacatgggaagatggactgagcctgggattctgaggctgcagtgagctacgatggcgtactgcactccagcctgggtgatagagtgagaccctgtctcaaaaaaaaaaaaaagaaaaaaggaaaattgtccaaggaatttaaaaattttcattttggctctctcatgcgcagtaaccgtgagggtttaaaggacagtgccagggccccatgttgttagagagcactctgttgtctttggcatgggagaggacttcagtgcaaaacggtgtatgaagtgtgttgtcagcagaagctaatttacaccctgtgctggacggagggttgcttgtttggagttgtttttcctgtggctaaaggattcctgggaatgctgttcaggcatgtctctgctggtggtatgctgtcatccttttcttttccatttacagtgtagagctgttacagttgtaaacaggcctggctttttacattgttactcactggtgtgggaacaatgtatgttaatgacataagtactgcccttgagagtactgcccaaaacagccccaggttgaaaatgtatcctcacagatttaatttttcttataaaagaaagaggtatgttccttctgtgtagagcgaactagaaatatattaaccctgcaactaacatgcagcacttcacaactcattagtgaggcccctgggatatggctccatatatttgcccacaagttggtataggccagaaaccagctgctttttcacctacgtggtgagagccagaggccagtcaaggaacaaggaactataggagaggaactacaaggagaatcttca

SEQ ID NO: 34283 - DNA, 1027 bp, Homo sapiens
acggccgggccaacaagggagggtcccgtgagcagccaggctggccctccccgggcctgggtgagctcccaaagctggagcgcagggctctaggccggccccgccccggggctgggggcttcccgcccgtttgtctcattttaacttttgggggcagctctgtcccgaatggtgagtggtccagactctagaaaggggtttggtcgcttgagcccggattgaggcttgggacctttgctctcttgctggggacggaagggggcgcgctgggcaggagagggggcgtctcggtcgggtctccctgggctcgggcatcttcccaccctgcggagccgggtcttgcgctgcgtgccccgaacaggcccgggcacaccgagtcccgttactggtcttcaggcgaaattccaggacgggtgtgcattcatcaacctgggagtctctaggagccagagatgactggctctacattttaatgcgtaatcacagagaaactagcacgagaaaaggacagagggaccgacccaagcttcagagacatggaataatatgatcctggttcataagccttgaaaagctcccctccgccaggttaaggaatggtgtcaccagccttggctgtgaggataatttcttgatttgtgttatgcaggctcctgtcaggactgtctccttaactcccactacctaaggaaaagatagccagagaattgtccagggatttgggtttgggttgcttctagaaagacagcatctttcttgctattttttttttcacatccccccaaaacaatttttttcccccttcagacttggcagactttgatttagataagaggtttgagttaatttgattttccccatgtctgtttagatcaatggatataggagatagtttgaagctaatgtacccctatgcctttgtgtgagtgtaagatttataacttgagggaggcagttaataaatagcacatccttgaaccataaacatacgagatagacaagagctagataataaacagtttttccc

SEQ ID NO: 34284 - DNA, 1067 bp, Homo sapiens
atttgtcttcataactataaatggatgtatttgtgtggaagatgtagattttttttaaaaaaaatctatttttggctctattaagagacaaaatgaatccaaatgtattccatacttctctcacattgcaccattttgttatgtaacagagaacgtttgagtacatactgtccacaccagcaactataaatctgtcctggcaagtgactgtaagatacccaggaacaagagataaggagctcgcctctccagggagaagcttttatttgcaagagagagagtgatatacaagaacttgcaaatgtctttgaagggcagaaaaaatcagctagggctaataaggcagctgtccaagttcatgattccttggcccttctttatacacaaccaccaagagttgtcagtttgcaaacctagaaaagtataccattgtaatatcagttcatctcccgcttttccagagctactcagaagcgtggtggatgcttagtgaaacgaccagaggtgtgaagctgccagacctttacccagatcaacttctttgactcagggtacaaatgaacaacgtagtctgacagctcacctaaaagttatttggaatgattttatattgagagatttttttaaagcctaaatttagattcatcagagcatatcaaggttgagatatgtgaaaggcagtgctatatgggagggtcaagttccattcgtttaaaaataccaggacatttgctgctgtttagtaggggagttgggtagggtagatatcctcacctccactatacagatttatttatttatttattttttgagaccaagtttcgctctgttgcccaggctggagtgcattggtgtaatctcggctcactgcaacctctgcctcccagggtcaagcaattcttctgcctcagcctcctgagtagctgggattacaggtgcgtgccaccacgcctggctactttttgtatttttagtagagatggagttttaccatgttggtcaggctggtctcaaactcctgacctcgtgatcctcctgcctcggtctcccaaagtgctgagattaca

SEQ ID NO: 34285 - DNA, 1050 bp, Homo sapiens
gttaaagactcagggttatgttgtttggatgttttgttgtttgctttttgaaaaagccagatcagatttttgtcattgtataaactccagtaggagaagagggatgcgtttttaaggtgatttctagaatgctctggccgacttagctgcagaagaaaaaggagaaaggaagagacagtgtatattttggcactgaaacttctttagtaacaatgcattcattcacaaatctggagagaactgaatgtctgctttttaaagtctgaattgaattctcgactagactttgagaccctgagaaggttttcaatccaaaccatgcttaatattcacgttttatcattattgatggaaagtgaaagaaaatttgaattcttggtagccagatttgacattagacttttacatttataacctcacttaaactttacaagaaatctcattacaggtattattatccccatttttaaagcaaaaaaaaaaaaacactgacccttggaaagaagaactggcactattgagattcacaccacgtgtggctggctgcatcagggggctcataaagaattcagagctggcccccagcttatcttccccattccctcttctcacccccaagctacctccattaaaagagatgccaggctatatttattttattatgtatacttacgaatgcatttgctcatctttggtgtcataaaatacaatgaataaactcctatccagtttttcagtgtatttccttaatttttaaagcaataaactcctttaatcctcccttatactcaatactaaaaaatgaaagatctgattttaagcaggaaaagttttgtcttagcatatagccaggaaacttcatctgcctaggtcctgaaatgtaagtgatctgccagaaccaagcgtgggggtagctcgcgaggcctcagccctcctgctcctgtgtgagagtgctttcttctgcaacctggctcctggaaggaatgaatgctcccccttcagcccctactccccaccaagaatttaaaagataagagggaaacatttccc

SEQ ID NO: 34286 - DNA, 1024 bp, Homo sapiens
ctaacatagcattagttttataggaaaacaaactcagttgccaaatttttgcctcaaaacttataactgcttttctttcctcatgcctcccctttcaaaatactccacttttatttctaactctcaccttgcatgctacccctaaaccctgtcctcaacttttaatttcgtaaagtgtttctgaattacgttagtccagtgagatgctctgaaaaagagaagaggttccatattagaataagtgtgagaaaactgtattccatacctctttcctcagggttcacagtgcccatccgttggccctgccaggctggttctggtcacaggacctctgcactgccaagctctccctgtaggtctcacatagccagccacttcctatggtttaggccaccactgtagagtcacctcctcagaagtctgatggaccacactgtctgatacagtcatctgctcatacttctgtcctttcattgcgtttaccacctcctgatatgtcttgccttccattcttttctcttatctctttctgccatatccaccataaaaatacaatttttctaactattgtgacctagttcaacattgtatttctagcacctagaacagagttgaacactgagaaggcaatcagtaagggttatttgcacattcttgtaaattctggtcaagaattcttggcatctttttaaactccttcccctcttccattctgtttatctcagccaatcttgtctctgtgacttacttccatgctgaatattttctgtttgccacttcagatccactcttactacaccaggcgctgttctaagtgtttagtacacattagttcatgtagtttacccagtgatcgcatcagatacgagctgttaatacccacattttacaaaggaggaaactgagacatatggtcattaggtcactagcccaaaccacacagcttttaagtggttaaaacaaaacaaacaaacaaaaaaacaggttatcacgtctgtttctttattcacgctgactctgaatt

SEQ ID NO: 34287 - DNA, 1068 bp, Homo sapiens
atcacgaggtcaggagttcgagaccagcctgaccaacatggtgaaaccccatctctactaaaaatacaaaaattagccaggcgtggtggctcatgcctgtaatcctagctactcaggaggctgaggcaggagaactgcttgaacctgggaggcagaggttgcagtgagccgagatggtgccactgcactccagcctaggcaacagagtgagactctgtctcaaaaaaaaaaaaaaaagaaaaagaaaaagtagaataatcagtttttacttgagccaaagactaattgtaattataccctttgaaaggataaattacccttgtggcagggacacaaaccaaggtgacaactctatggaatgttccagagcagttgttctaagtccctttaagagtcaaatatactgagaaatgcttcccaaggaacaggacttattctacagtgaatagacaggtattttcttgtccaagggaacttgtggctgacttttaaaaaccagttctccgctcctccgattgagatgacctgttctgaccttgatggtctccctgtctcccctttctttttcatttgtgctgagaacacagctcttagtgtagtctacctgcagaaacacagtggtgccttctgtcattgaaggctgctcatcagcacatagttgttctatggtctacatcgcacaggcttagagtaataatgggaatgtgtgtgttcccagtccttgctgatgtaacagagagctggctgccttcagtttacctttaagatgacttcaaaacctagctcttctagttctcagatgtaaggctgtagtgaaatgcagagaacttcacttccaaaattgtataatttttacttgtcctgggcctgactttttacatagggtctgatttcacatggctctggcacaagttttcttgactgaggaagggaggggagagagaaatcagaagtagagatggacagtacatccattcactcatttcagaaatattatttgagtgtctgttaacagcactgtgattaacaaaggagccatggtaagggagagacaatatgaaaaaatag

SEQ ID NO: 34288 - DNA, 1400 bp, Homo sapiens
agggaccacaccttgagaaccactgctgtagcagggggctgttttgcttttgcctgtttataaatacaagtatatcatatatattcttctgtgacttgctttttttcaccggaactttgtttttgaagttcagctttgttgatatgggtagcgataggtcaattcatttccccattgcttagtattctatttctcattaatttttgtccactgccctatgagggaagaggaagaaaaataggaagcaacttgcttaaggcaccaacagaagtgattctgtacccctcaagcatccagcaccaatgacccttggctcacacagctcaggtcattgttgctgcctttggaaggaaagaggcagtgagatatcacctgtcctaagagccctggcctcaccagaagttcaggaggctttgagacaccaggcacagcaggacctgcagacctcccagagccctcttgtataaaatagacctcaaataacattggcctaccctaatcaaatcaggatataaggggatggaagggaaggtaacaaacttaatattgatttcaaatgggctaggcactattgttgaataatgattacaaagcactagaagactgaataaaagtatgataaaaatacgttctctttcaacctctcaacattcatatgtggtatatatttttttaaaacttgcccaaggtcacaaacttaatacgagatagagtcagattttaaacctagctctacttataaatcatatcattctttcactttatgctgccgcctcgctaagacttaaatgtaggccttccccatccttggcatctacctacccactaaggcatactcccctaatgtatgtgaaccttctctgaaacctggatccaattagtgttacctgaaccagctttcatggttctttccatcatagttgcaacagatgtagcataaaaaatagtgggagtgacatgctgataccttgcactgtctttgttggacttgaacgtttgacttggatttatatgcctgacaactaactatactgccttgtgtttttatcctgcagaggatttccaaagaaggccagtagaactgctagaatagcctccgatgaggaaattcaaggcacaaaggatgctgttattcaagacctggaacgaaaacttcgcttcaaggaggacctcctgaacaatggccagccggtactgatagatttgggacctggacttggaatgttagctacccacatacctttcttcctttctctaagacttaggttcttgatatttgtccacaacatcatcattattattattattatttttgagacagggtcacactttgtcacccatgctggagtgcaatggtgtcatcacagctcactgcatccttgacctcccaggctcaaaca

SEQ ID NO: 34289 - DNA, 2120 bp, Homo sapiens
gggtaaaataactactctgggtctatcaaaaggagaaaaaaaaaagattcaaagaacccagagcatcacagtaaacagaccagtttctaacactacctattatagtattccaaccaactccaaagatcagttgacactcccagcatcttaaggggtagggctaagagtcttctttacctaaataacccaagacaggcaaaaggaagggaaactcatgaagtctaggcctcagtgtgtaaatgtatatatcccactgaaattgctgtgagagaattttgatatttatgccacttagcagtagtagtatttgttccaagtttctgagcatgttgcctagttgattttaattccaagagtaaaaccccttcttttctgtcttgggggcttcagtaactggtatgtccaaatatggcagatataagttctgtgagtcatcacttaaaaattggagtgaacttcactatccattagcaaaacaaagtggcatttaaaccatgaccagtgacacaccatttttctacctaactcttggcataagttaccatttgttgctgtaaggatgccattctggaaatgtttaatgctcttagaatctcagctttacaacatctattaccgtatattaaaacttttttcttataatttatgaattaagacatgagtttaaatagtcatgtcataaaaggtggtgaaaaaaaaattcaaaatagctaaatctttcaagatatagtaatcccaaaagcataaagtgtagttgacagaaaactgaagttgactccttacttccttaatgccctttagttaccttaaattttgaaattttaaagttatttgagtttagaaaaaaaagtatttgggtttgaaagggagaatacatgtatgttttctagtacactgtagcccagatgaaatgaaataaccaaggaaaagaggaagactagagtggaaaaattagttcagtaatgaaacacagacggtagagctctcctgagcagtggaaaataattacagaaagcagccaagagaagggtgagaaccaaggagggaggaaaatattaaagttcagcagaatattttatagaatatgatatttttccacctgggttaatcttttgggaataagaaaaacattagatattgttgactgcatccaaattctacttgggatagaacacacagctctaaacatatactgggctgtgtatcacactcgatgtgtgtagctcaagcaattcataagagaccaaagcaatcacatagtttagcaaaataatgagtgactgtgcagttacaccaaagagaatgccaaaatgaggatcacaaatacagtttattttagactctaatcctatctttaagaacaacgacatctaaacacgaatgttttactttgttttgttgtgttgctaagttactttgtattgcacttggattttggaatggctattttgcagtctgatgtttcctcaaactgcattatgtatacaagtggcaagcttttatgaagacctgtgtgccacaagttaaatttcataaactatgaaatataaatgttatttccatattacataaataattggccttgcacaaggtatgaaataatctttacaagctggatgtttaatacagaatcacttttagaattcaaacttatttgtaatataagctttaaactctgtggatttgtttggaatggaaaagtaacacacaactgagttaaatataaaatgttagtttgttgcttgtgttttgttttagcattataaggtttcctggctcatttcaagcttcactctaaacattcccttccattattcttatgttcatagtaaagcagatagaaatgagaaaattaataaaagcaaatgcagcagcattaatgtgcatcagagcctactaactatgattaccagggttaataggcatattattattaaaatcacttattgctaattctatatgacctttgtcaaaaatagtatgttcagacttaaaaacctgaattttctattatgcacatggaaggcatcttttcaaaaaagcttcactgaactctgggggttttttcccccaaacaaaaatgacaaaattatacaacttcttagtttggatgctctcta

SEQ ID NO: 34290 - DNA, 1055 bp, Homo sapiens
taaaatattcaaaaggggcagtctgtctttcaaaccttgtacttcagccatcttgttccctaccctttgggcaacttacttggaactctctcctgagacaaatctatacatacacaagcaaaaatgtaaatatacgttacatttttcaacttaacaattggagatctacctggagaaattcttcattcttttttacaactgtataatgagaataaaattattacctcaccccaaaatacttaataaaggtaactattgttacagtgaatacgcttaattttttttagcacatagatcataactttccttttgtgatgttaaactagatgatttttattgtatgtttgaaaaatgttaaaactactttttcccccccacagataatcagacagctaaatggagtctgagcagctgttccatagaggctactatagaaacagctacaacagtataacaagtgcaagtagtgatgaggaacttttagatggagcaggtgttattatggactttcaaacatctgaagatgacaatttattagatggtgacactgcagttggtaagttcagcatgacagcctaatgtttgtattcatgaatatccactaataaatatgtacactattttattgaggttgaatttttcagtaactttaaaaatttgagatcaaatttacataacataaacttaaccattgtaaagtgtggaactgagtggcatttagcaggttcacagtgttgtgcaactaccgtttctatctcgttccaaacattctcaccaccccaaaagaaactactacatttaagggtaagcttttaaatataatgtaatacagagaggtgtgcaatcatcacatcttagtgtggaaattgatgaattcctacaaagtgaacatttattatataactactcctcaatcaagaagtaaaacattaccagtagtttcagaatccttccttgttccaccttcagtttcaatattattttgatttctatctagattaattttgcaagtatttaaactttatgtatgtggaattcatactgtgtactctttt

SEQ ID NO: 34291 - DNA, 1040 bp, Homo sapiens
cccagtagtgtttcagtatacattcagaccaagaatgtatgagagcttccattgcttcatgttcactaaccacttgatattgtcacacttttaattttgtcagtgtgctagctatgtatggattttgattgtggtttaaatttgcattttctttgtagtcaaagagatgtagcatcttttcatgtctatttggaaatccttttcagagtaccagtttgggtcatttactcatttttctattggagtgtctatcttacagatttgtagaagttctttattttctagacacaaactttttgttggataaatgtgttacagctatcttctatggagtgcatttcactcttctaatggacaaattatgaacaaatattcttagttgtaatgtggtcctatgtgttaatcttttgctttatggccaaggctttttgtgtcttaattttaaaaaacgtccctaccctgatgttatgaagacatttttctatattattttgtaagagctttgccgtttacatttagttgtgtagtcatctgatttgtatatgtgtgtgtgtgtgtatgtgttagagtgtattcatttttttctcatatagatagtgtgttagtctgttttgcattgctgtaaaggaatacttgaggccggacaatttataaagaaaagaggttggctgggtgcggtggctcaagcctgtaatccctgcactttgggaggcccatgtgggtggatcacctgaggtcaagaattagaaaccagcctggccaatatgataaaaccctgtctctactaaaaatacaaaaaattagtcaggcgtggtggtgggcgcctgtaatcccacctactcaggaggctgaggcaggagaatcacttgaacccggagggtggaggttgcagtgagcctagatcatgccaccgcattccaggctgggtgacagagtgagactccgtctcaaaaaaaaaaaaaaaaaaaaaggaaagaaaagaggtcgtgcaggctgtataggaagcatagtgctggcatttgcttctgtctggtgagggc

SEQ ID NO: 34292 - DNA, 1047 bp, Homo sapiens
acttcatgtttgaaaaacatttcaaaagctaagaaaaagtttgaaaacctgtttgtaagtacacctggggtaaaggtacaccctgtggcataagatgtcgggaacaactgagggtaagaatggggatgcattactatcgtaaacttctgctaaagcataaggatgtgagtgctgggagcaaagcagtgctcaccacttctgcaattttctattgcagcattttaaataatatgggaaaaagtggactgcaaccaaaggcaaagagggatggtgatggtgaagggtaagattgtatttattgtccaaaggctaagtgcatatacatatgtgtttgggagaaggcatcacgtaatagttcttaacctactctgagagaaggttgtccacatttcttaaagtatacatgtaaaccaacaatgaaattattttagtgacttgagaatcaaagtgctagagtttgaatccctgttctactacttgctagcggtgtgaccttgggcctgtttaactcttgacaccttgttttccaaatttataaagtggagataataatatctgtcacattgtgttgttgtgaggattatatgaactaatatatgtaatgtcctgagaacaatgtctggtacacattaagttaattaaaattagctgttcttactgttattattagacatgagctagataacagtggcctctacatgggaaagattattttaattctgatgtagttcagtttatctattttttttatttttgtcccttttgcattgatgtcatatctaaaaaacctgcctaactcaggatcacaaaaatttactcctgtattttataattttagctctttagatctaggatccatttttagctaatttttatatatggtgtgaggtaggggtacggtttcattcttttgcacgtgaatagccagttgtcccagcatcatttattcaaaagactattctttcctcactagaaaaaatatttctttaaagaataatgaatccttttttttttctttttaaccgctgttactcagttggaaaaaga

SEQ ID NO: 34293 - DNA, 2033 bp, Homo sapiens
ttacaaaatggttgcagtttaattgttgttccttttttatttattagcttgcatatttctatagagagtttaccccacatcaaccatttggattacctgaagtaagggtggtacaggaaagggagaaatcttgaaatactaggttccttagcatcctcaaagttgaccaatgagattttttgcttgtttggttgtttttttctgtgtcttcatggactcatggatttaagtatatttgtggtttaatcatcactgttattattcttattgatgttcatgttattttagattagtgggagcttttttagtttgctatctgtgtccttcgtcatgtccttagataatcctaatcctaatcctgattcatcgtagacatttcccgcagcaaacctggaatcagccatttctcaaggagctctctgattccattgaaggaaaatataatataggtacaatctaggcactaggtgatacttgttacttctgggttggctattgtttctagcctcctaagtttatatgactgtactaatttgaattcataactatgggactaaacttctaattcttaaatctgcatttcctttaagtcatgccaaaaatctgaacatcacaaacatagtcatttcgtttaccccacaatacacacatacaacattgtcagtataacagtaccaacaccatctccaacaatatgcctactgaaaaattttaggtaatctgtctccagcctcccaggtagctgggactgcaggtgcacaccaccatgcctggctaatttttttttttttttttttttttaagagactgggtcttgctatgttactcaggctggtctgaaatttctggcctctaacagtcctcctgcctttgccttccaaagtgcagagattacagacctgagccaccacgtctggcctatcctttatttattccaccaaagttatttatacaaattactttgttgtaaagtcccttggaatagtttcttctgtggcattatgttaccagttagatgcacctttgattcatttaactttacttcaatttttaaggtttgctttttagatttagttttgttttattatacatatatgaagtatttccacggttccaaagttaaatgaacaaaacaggcatgttcaaagaagtctagtttctatctctgtcccatccaacccattgtcttcttccccttataagtaataatttacatttttaacttgtggtttatcttctgatttttaaaaatataagcataaatatttatattcctgtcttttagcatgcttttagccatcttgcttttttcctgtataatgctaaatatatctcattctttttaattgctgcagaatttctcattacataggtatactgcaatttatttatctgatgctatgttgatgaacatttaaatgatttccagattttaggaacggtgatgattgaactctctgtacatatatcttttttacttggtacactccatcaagcaactacttaagtgactgactatgatgctgtgcaagcagttatataaagaaaacagcagtgactcagcctgaaaacggcttaatattatcatgttttcttacacattatttttattgaggaaaagcaacatggagtttagtgattatttttgaaagaaataacctatttctaattctaaagaatggttaatatctgtgtttggttgcttatagggtagaaggggtaaaattgcctcattcaacttagaacttaccgtgtcattttagtggggcgttgtgacttcaaatagacccgattcttgaaatagactgggtccatgtcctttgttgggacatggatgaagctggaaaccatcattctcagcaaactgtcgcaaggacaaaaaaccaaacatcgcatgttctcactcataggtgggaattgaacaatgagaacacatggacacaggaaggggaacatcacacactggggactgttgtggggtcggggagtggggagggatagcattaggagatatacctaatgctaaatgacga

SEQ ID NO: 34294 - DNA, 1028 bp, Homo sapiens
aatttagagctaggatatttaccattcaagttataatatatcagaaacatcttataaaattatagcattaatttttcttttccttttcttttttttaggttagctattattttcctctcaaaactttatggagatcattttttgctgctttagtggctgcatttgttttgaggtccatcaatccatttggtaacagccgtctggtccttttttatgtggagtatcatacaccatggtacctttttgaactgtttccttttattcttctaggggtatttggagggctttggggagcctttttcattagggcaaatattgcctggtgtcgtcgacgcaagtccacgaaatttggaaagtatcccgttctggaagtcattattgttgcagccattactgctgtgatagccttccctaatccatacactaggctaaacaccagtgaactgatcaaagagctttttacagactgtggtcccctggaatcctcttctctttgtgactacagaaatgacatgaatgccagtaaaattgtcgatgacattcctgatcgtccagcaggcattggagtatattcagctatatggcagttatgcctggcactcatatttaaaatcataatgacagtattcacttttggcatcaaggtaagtgctaatgtgaggtgatatttgggtaattttggcatgttcaaaacttatatgtggaatgagagaggttgttgtttcataaatgactgaaaaaagtacttatcttttgagtttaattttaagtaatgaaaaagataattccttagcatatattgttgaccatgttatctgttgctatttaacaaattaccccccaaaacttagcagcttaaggtaactacttattttgttcttgatattgagtcaacgacttgggaagggctcaactgggcaatttttgcttgtggtctttcatatagttgttattagacatggcgagggctaatcatctcaaagcttctttttttcgtttcctttttaaaaaactgtttttgtggatac

SEQ ID NO: 34295 - DNA, 1039 bp, Homo sapiens
ggtaaatcccaactttctcacagtcagttgaactacaagaagctggaggcaattggcaggcctttgttaagtcccacctttgactcagctctggctgaaggatcatacctggcaagagagtgtaaaacacactttgattttttctattgtttatccttttaatgatcctaagagactcaagagtacatgccatcattttgtgtttggctcatttcatattcagaggagtttattactctttcagtagtttgttcgtttgtttgttttttgagacaggatctcgcctttttgcccagactagagggcagtgttgcagtcttggctcactgtaacctccacctcccaggttcaagcgattctcctgcctcagcctcccaagtagctgggattacaggtgtgggccatcacacccggctaatttttgtgtttttagtagagatgtgattttgccatgttggccaggctggtctggaactcctgacctcaggtgatcctttgggaggccttggcctcccagagtgctaggattataggtgtgagccactgaacctggcctctttcagtagtctttaaatgatcttgcttatggtgcttcttatccctgtttattatccttattaaatttaatcaataaatatttttctctttttaattgattcatataaatagacttacctgagagatataggttcagttcagagcaccacaataaagtgaatatcataataaagcaagtcacataaaagtcttagtttcttagtgcatataaaagttctgtttacactatgctgtagtcttatgtgtacaatagcattatgtcttttaaaaaagtaatactttaatttaaaaatacttgattgctaaaaaatgctaatagtaatctgagtcttcagtgaattgtaatctgttttgcttctgtagggtcttgccttgatattggtggttgctagaggtaggactggctgtagcaattcttaaaataagataacagtgaaatttgccgcattgattgacactgcctttcatgaaagatttctct

SEQ ID NO: 34296 - DNA, 1054 bp, Homo sapiens
ttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatatttctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcac

SEQ ID NO: 34297 - DNA, 1026 bp, Homo sapiens
tactttactgtaatagagtatataatgcacataacatgcaaaatatgcattaattgacagtttattttattggtaaagccactggtcaaaagtaggctattagtagttaagttgaaagttacatgcagatttttgagtgcacaagaggtcaatatccctagccccagcacttttcaatggtaaactgtactagcagtgcttcctacaatgtctttcttgaattcatccacgtctcgttacaccccttgtgagtgtcctagttgggatcaccttaaaaactttactggacttctgtgagacaccctcagaaggatactctgccaccagcttgctctcaagttcaccctcacagcagccagagctgtttatccaaggtgcttaactgagcaggctactccagtcttaaatctctttattggactcttacagcttcagataaaagcttgttttctttgatacagcttaccccgagtcttcttgatatgcacccacatccaattgatcactatttcactgccaagactccctaagcctcaaccattttgagcttcttttagtttcctgggagtatcatactttttccccctggaatttgaagacattttctctgcagttttgcctggttaatttctacttttcgtcaagcggtctctgggaaactttcctaatctcccatgtttgcattagatacaacagtttgatgttatatcttctttttctgcccttataacggtacttatcagtctgaatatcaactacctgttcaggtagtttattctctattgatcagtaagtttcttaaacatactagtgggtagaatggtggcacctaagaagatatgctcatgtactactccctgaaacctgtgagtattatcttatttggaaaaatggttatcgcaaatgtaattaatttgaagatcttaaaatgcagaggtcattctagattatctgccctaaattttgggccctaaattcaatcacaagtcttcttacaaaagacacactggggaatttgatggacag

SEQ ID NO: 34298 - DNA, 1029 bp, Homo sapiens
gacaaattctaacctaggtctcgtaatttctagaatgagttagtgttcccacaccagtaatcaaattattattacttaataagaataatcatcatttaattcaaattaaataattaagagcttggttggcttcaatttaggtgtgtaaataaattttatgaattatccatggtctgcctttccatttttccttgcttttttttattatttatttagtgggtaaaaacaaacaaaaacaaaaggtgaggtaaatactgatgtagaaaattttaaataattacattttgatgactagttgtggtttcttttaaaagaatcatttggagtaatatggactgtgtgttattactcatccaagttctggctcgtattgacaatttgagtaataaaagtttgtgagactaggagtgaaaaatctggactggaagggaagacctctgcctactctcttgagtatgaagtttaccaggatggttgctctctagacaaaactcataagcaatgcattcaaagagaatatgtgtagactaggagataaaataggctggaaagataaggtttatcttgtaaacactgaatttattttgcttttgatatttcctaccttaaggactttttaaaaattatctcttttttatttcaactatcttcagattgttaaggaaaaagttctatgtcaacacttgtaccaataacaaaagtgattacagaggcaatatgatgatggcattggtgttcctcaaaagaaatatggaaattgaaagatgaatatctaagcattttaatgttagagcattcttacacaaatgtgaggaagcaggttttattttataatggaaggctgaaatttcattcattcatttatttccaaatatccattgagtggttctaacctgccaggtactatgttaggctatagggtcataacaatggggaacacggaagcggtctattcactcataaagtcagcatcacagctatcaccttacacagcttaggttaggttaagaaaaaattgcgtattatttt

SEQ ID NO: 34299 - DNA, 1087 bp, Homo sapiens
tcaaagaaactaaggtacatccatttatgtctcccacataggtctgaacatttcggaaatgtttggcgaattcctaagaattgttgtatttatcacttctgtggaaaagttttccatccagtggtctatgtgaggtcaggcatcagccctgttaccacctgcttgcccctcccccatccccatcctcccctccctaagacctcatgaagaatactgataacacctgaagtgggagttcctgctctcacaatctagttgggggtggggagagctattgcttaatccagtagcaatgtaaagaaataatacaagaactgtcacaaggatatgtttcatcagtagtcaaaccagtaggtggagaaggcttaaaatggcctttggggaatgcacagttactagtaaagagagaatgaaaacttttgaacagcagtctattttgtgacttaggctggttgcatgggatgggagataacgtgtgagatacgatttgggttcctgtataaactgttagacaatagtaaattggagaaagaggaagagagaaaataattcacgaatgaaaagcaaaattctgagcttgagccatctgtaaacagaatatgtggaaattctaacttgagttattaaaaaagttggtcagcaagatttgagtagctattgaatgaaggaaaatgactgtgattattcagctcctaactagataattgtctttgttcatattttgaatttcgattctcattcctgaagaatgaatgtacaatctgaaaagtaactaaattaaagatttcagtaataacagcaacaataatagtttacatatattgaatccttactttgggcctaatacatattctacatgtatttggttgtttatttgtaacaaccaccctctattgcaagtccgatggaatcccaactttatagatgagactgttgtggtatagagaggtgaactctttgtccaagtttattcacttaattaattgtagagccaggattcaatctcaggtgttctaacttcagagctgtgctctctgatcttgcactacagtttttaacaacacagacaagtacacatgggctacat

SEQ ID NO: 34300 - DNA, 1047 bp, Homo sapiens
acaaaattatctacaacccatcctatccaaagataattatcattagctattggtgtatttcttgcctaaatatatgtactatacatagacatagtccacagtataaataaactctgtggattgcttttttaatttcactgtagaaatattttaattgttgttaggatatgtatagatttgtaattttttttaaccatctggtcattttagtattgagatggtttgaggaaagaggacattagaaaaaaaaaaaaaacctgtgtactgggaattacagatctgaaattgtcatatacaccacatttgcaaaattttttcacctgcccttgaaaaaaaccaaggcatgattttgaattttataagatggtctattaagattgctgaaacttggagtgctttctggcaaaaccagcaattaaatgaagagaaacagaagccatcactagaagagcaactattttgtggcagttacttgtttcactatctcttccctgttctttaccccaacatagttcataacttaaagttgtggactttaaagcactctaaggcttttaaacttctgcctagtgagttagtattaagaaatttaagtcagtgccatggggttaaatatgaggtttaataaaaatattggtttcttaattttgtttattagtcttactcctatagtctgtgtgtcgtgaagcataatttctcttttctttctcctgatgcaactcagccactccaggattttctcattttccttcatattatgaatatgtaaaaattaaaacaaataccttttcttttagtcattgcatagttggactacacttatttcactctgaggtgatagggctcttcttttctatgtctttgcatcttaaatacatacagacattatgcatttatttatacttatatactaatacaacaggtcagcacagtcactcctcacccatgtggggagccaaaattctagtctgaaaattgagcatcaaatactaataagtaacttatactgaactcttaggtatgtttacattcttaatttaatcttct

SEQ ID NO: 34301 - DNA, 1068 bp, Homo sapiens
aaatagacttcatagtcttttatggtactgttagggatccatgccccttctctcttgttactctgtcattcctggagagttgctttagacttcatagtcttttatggtactgttagggatccatgcccttctctcttgttactctgtcattcctggagagttgctttcatctacgtggtctgagattttactaccatgtccacattgcagcagtaggaaggaaggaaacagaagggatttgcttcttcacctgtacgtgtcactttcagtatctttattctaggtagccatgtgcatagctaaaaatggttttagtgagtgggtaactaatgagatagaaagggagaaaggatattgggaggaatcgtagtctttgctacaaggtaataccgtataattttttaaatgataaagttgtataagtaagggtcaaaagtcacttgtagctaactttcattagttccaccttttccttgcctagcacagttagcatggtcttggtatctagtgtaaatctgatcttatccaaacatgaatttgttactttttatattacttggttaactgttgatttcaagtctcttttcagacttgtctcccaagttcacatgaatagggccaggctttaagttttttttaatgcgttcattattaccaagcagtgctttttaacactagtgttcagtaagtttattgaacattgggttatgatgatttattgaaattctacatttattgctttgcttggttgttaatagagtcaatgtctcttgtcttttttctgccaactggaataatccctactccacgtatgtgagctatatcctgtatcagaaatgtagaggaggcgtggaattggcaaagatttgttaccaaaaatcactatcagaccccattgctgttggcagtcagggaaccatggaaaagattatgggtcatggaaggttataagcaaaagtctgtggatttgcatagcagcattgagaggtaggtcttacaatgggcaggttgtattggaggactgaaaaaaaaaaaatggaaatattaaggaaacacacagatagtgat

SEQ ID NO: 34302 - DNA, 1095 bp, Homo sapiens
cctgtccattatgatttttctgtacttcagccatattgctgagatattcaactttataagcaacaagttcctttaaaaaaaaatacctttgtcttcaaactgaaagccgtctcatccctgtttttatataagttgccctttgcagaacaatttgtagtttctgtatgtggatcctccctacttctgaaaggttgtctggagaggtatcagaatcaccaaacaatgaaagatgcccaagctgccatgccaccagaagggggcatgtctcattcatatgtacactcgagttcttgaattatcatcgttgccttgaaaggctgtagaagtaaattattgggaaaccatcagaatgcacctgcctgagcctttctccctcagtcttcctgtttgtgttcagtggttaatattatcctctccacgtataaaatttgaattcagcaggaccttgtaagacacatgcgtttcattttaagctacatcccattctcagttctctgtccctatccatgggtgggaaggttcaaccctgttccatggacatagctgatgggacaggagtatccaagctaggtcaactgtattctctctcctgggatttttgaatcatgtggtgttgtccactaaagacggcacagagttggttggtaggcatagtaccagggtcagctccttatgcatcagtcacataccaggcaaagttatgggggaggaaaacctaaaaggtttgccaaggaagccagtctatagagaaaggagtgaagtagattttcactttctttccagaaaaagagataaaagaaagatgatatggacagggacaaacagacaaaaaggctcggcctctgcctctgcctaaggaccttctaatattaccatgagacgtgcctgttcttcctgctgattaggttgtgatataggcctgaatccttataacaaacactattttatttaagctagcttaaattggttttggtaacttgtacataaatcattctagagtaacatacactccttacagaaataatctcctgctttaccctaaaggaatttactattatggaaaattcacatggaagccaggaagggagatttttg

SEQ ID NO: 34303 - DNA, 1029 bp, Homo sapiens
ggtaagagttgatgtagctaattctttgtgcaccttcttaaatattgtacttttctcccctttctggtttattttttaagtaatatgtataaatgagggaagtaactaagttgctctccctactgatccacagggtcatgatttctttagggtacatttctagtattttaattgttggatcaaaaagtatgcaaaattttaagtcatttgcattttagaaaggttatgtaagtttactcttttaccaataactgaacacctttgtggacaatggatattttcatttcagattttgtcaacttcataggtgaaaaacgaatctcatttttttaacttatatttttaaattgctagtgaagttgaacgtcttttttatttacaaattggtcatttggatgtttcttattttgtaaattgcctgtttgttttttcctgttttttaccattgatgtgtttatgtgttcctattgatttgtaagagttctctaggggaggggacttggatttaagaatattaacaatttgggtgtcataaatattagttactccccccagttgttttgtttttattttatttgtgatattttaaaatattattcaaggttacaaaagatgtaatagttaaaaatgaaaagtataatcatgctgttttcttattttctacctaacagcattagaaaatatacaattctttatatttttgttttagcaatagaaaatttctatgcacttcttgatagaaaagatgtgaatttgacttaccctttcccatttgcctcttatcctattaatatttgatattttaaaaattctggttatttatccttatgacttgaagtaactcacctaattctattttgtactccattatcattcagcggcatctcttgactgtctactttataaaatgagaatattagcacctttatcccttcttaccccctcctccgcacccgcagactgagcccagagcatttccaggagtttcttcttcctccataatctacacaggacaggctttcatctcca

SEQ ID NO: 34304 - DNA, 1216 bp, Homo sapiens
gccccatgacttcagtgcttcagagttccatgtgtgtttccttccgtgtgtctaacataggacattaaagagcatgatcatttcttcaaaaataggttccttcaagctgagtacaagatccaaattttaaaaataccttttgtggaaaatactaaaacttggaaccacaaccttgtttctctcttttaacgtaattgctcacttcatgaaaaaaaaatcccctttggacaaatggatgtaattgtatatgtaatgcactgggaagtatgagttactattgattaacttgtattaaatatctgagaaaaaggtatgtattttatttgtaattttaagttgacgagatgataaatagaaaaccccttatttggagttccctgatgtattcttagtggtcaagacccttaaaacaaaaaatgtgatttctcgttttacattctcctcctttctagtttttttttccttcttatgcagaacagagattttattgtagaattaaaactgataaacctgatccctcagctctgtgctattttgtttaccccatgaggagttgctccccataaacctgagagtttgttagaaggtaccttgttcagaagattatcaggtttaagcaattgccattcaagagagtaaagaagaactagtctggaagctggcaagaaaaaaaaagttgttatttctaagtcaatgtttgtagaacaattgcctggttaggcaatgagacagtagtgtttaatacaattgagctgtggtgtataatatgagtagtcatacactcttttgtaagagtcttggattgatatttttgttatactttgcaatcaaataaaggaggctgtttgcacatatcctgaaaacgatttgataactatatagtgattatttctcggtaatttttgaaggtctactaaccaaaaaattctaataaaattcactcttatgaaattaaagattaagtcacaaaaatacaactgtttagataaatattcaagcactgacaggcatatagcacctcagttctgtttgtttgctggccattatgtttttaccagcttttgttttaaaagtctcatctttctccttgattaaattaaatgaacatcctttcctgttactccaaaggattccttataatttttttatagcacctttgattttagactgagggcttttagatagacttaaatagattcttctactgtatgtttct

SEQ ID NO: 34305 - DNA, 1070 bp, Homo sapiens
gtgttttattgacagttgtttgaaggaaattatgcacaggtacctaaaaagagcaactcaggcaagtttcccagccacttagatttcctgtttctttaagttaagcattgctattcacattgtgttgactgtagaaggattgatagtgtccagtacaaataataatagtaaaatagaatttctgcttagagtttgtggtaaatatcaaaatatcttagtgataagcacatgtattcttttaaattttgtcagttgcccagtgcttccattcattcatcacttgtttattttattcaaccagcatttattgaccccctgctggttctgggtttcctctcatactgtgctagatgcctggtatgcaaagataaatgagtcatggtctctcccctcaagcagtcaccaactactaaattcttggtcattttagttgttttcttttttcttaaaaaaattttttttttcaacaggtttttgggtacaagtggtgtttgtttacatgaataagttctttagtggtgatttccaagattttggtgcacctatcatctgagcaatgtcactgtagccaatgtgtagtcttttatccctctcctccctcccagtctttcccgagtccccaaagtccattatatcattcttatgcttttgtgtcctcttagcttagctctcacttatgagtgagagcatatgatgtttggctttccattcctgagttacttcacttacttaccctccagttgcatccaggttgctgcaaatgccattatttcattcctttttatgtctgagtagtgttccatggtgtgtgtgtgtgtgtgtatacatacacatacataccacggtttctttatccactcgttgattgatgggcatttgggctggttccatgtttttgcaattgcgaattgtgctgctataaatatgtgtgcaggtatctttttctataatgacttcttttcctctgggtacatacccaggtgtgggattgctggatcaaatggtagttctacttttagttctttaaggaatctccacactgttttccacagtggttgtactagtttaca

SEQ ID NO: 34306 - DNA, 1035 bp, Homo sapiens
caatcaatgctgagctgaatttttcaaatagagtagagctattaatcatattaggtcagagatgtaattctttggtgagagactaataaatgaaataaaattataggtctttttgagactaattgaaattatggaacaaccgatagaataaaactacattctaaaattgtagtttccagattcagacttagaacattccttaattaacttagcatttgatttatagagaactttaatatttcaatagtattatctatcaaatagttaatgaactattttaactttctttgagaaagttaaaaggcagatatctccagttttaacattcggctctgactcaaattttggttaagttttgctgtcacatctagactttattacataaacaaagatttaaattaattacagttacttcaatgggatatataattcagatttattcaactttccccattctttaattactactggtcagagattgttcttgtgagagatacactattttagcatgactcagaaaccttagtaacaaagtgaacattttaaaagcatacaaaatacaagcccgaattcgattcagaaggcataaaattaagctattggatgctgtagtttctcagtgctggtgtgactctctgcccctgcctcatgatagaactaggaaccataacagttcactgagtcatgctaggccatggtatcagcgcgtgcttggcagaccctcagtaaacctttgtgtgagtgggggcatttgttgcacagtgatgatctcaacattactttaataatctataccacatatttatgcttggtattggtttgttttaaaatgcaatttttaatttaattttattattattattttttgagatggagtctcgctctgacccccaggctggagtgcaatgacgtgatgtcggctcactgcaacctctacctcttgggttctaggattctcctgcctcagtctcctgagtagctaggattacaggtgtccaccaccatgtccgactaattgttgtatttttagtagag

SEQ ID NO: 34307 - DNA, 1022 bp, Homo sapiens
atggatgctcatgtgccttctctgtggctcactgctgtcgtctcctctgctgctcttgcagccagtgcttagtgactccacggtcataggacctgacgcctctaatgtcctcaccaaaaggaaatacagtcatccccatgcagccactcttaacaactgtcagctgtgaagttctcacctacatcttctctcatggtatctcaacatggggagcataactttctcatttttgggggctcattaggacactaagtgaggaggagcatcaggggatggctgagactgaggtgttctctaaaactgtattcgaacgtttctgtcccagagtttatacacattatttaaggttatagtagagactgcaagctgaatggtccaatgacgatgtgacctttaagaagcctctggcttccttcgtgaattctaaccgtaccgttactgtgtttgaggatcactggcagccgagctctgagtggggaactgagataagaaaggtgttgtcatgataacacctggacagctgcatcccacagactatgggagtgccaggaaactggctacctcacagcagagtagagaaaatggaaataaacacaaatataagcttttcagtgagctgtgggtcagagaaggccacaagtggtctggcagatcatggtgcagctctttgtttcatgagctacgtgcagcagtagtttttatgagctctttttgtagctttccagccctaggattcagccatggtaaggtggaaagtttctggtactagccctgctgttctgctaacaatggtccactttcctccaaacccattgattatttagacatgaaataaatctatgcatctcaactctctgcctcagaaaatgaaatctgtcccaggaaaagttcagatgcagtaacctgctaggaactagggatgcttgtcttaaaaccctacacacatggcaaacactgttttatttagattgagctgattgggaggggtggacctgatagggatatgggcatgatgagctaaa

SEQ ID NO: 34308 - DNA, 1224 bp, Homo sapiens
ttttctgcagttagaggagtgaggaagatcaagtaaaagtacagaaacacattttcataactgttcccaagaaatagcaacaaagggttgagagaaccgctaagaatgtggcaagtactatctgtgaccccacacacacgcacacgcatgcacacgcacacgtgagctttttcatgggtgatagggaaaataacaggcaagaaaatcttataaataaggtaaaattaccaaaagaaagttgcctttaggaccaaagcgaaaaggagaaaactctattaagctcagtgatatagttctttgtccctgacatttgtctgtaagcctagggggaagtctcctctctcctgcccttacgtaaacaggcttttcggcttttatgggacattcatttactctatttcccattagatattaaagtcccctagtgcacaaacaaatcaacaacaaaaagagataacgtagttaggcatgctgaactagtcttgggttcttaaatgctttttcattttctgtaaatgtttcagaactacatgtactgtgcctctaatagattacatagatgggaatgattattccattgaaccacagcaaggtggggatgaagatggttttgccagaggggcctgggactggagtttactatggaaacgtattcctctaagccacaaggaaaaggccaaaagaaaacataaaactgaaccttatcggtaaagactattactttattttcttatgttgaatgtttatctaagttcttttttttttcttccccatgaactcgtataaatgtgtgggtccatacatacgcttccatttgatctttgctgccatcaacacaatacagaaccatttgcactgtgccgcttatagatgtcataaatggcaacacatatgaaattataccccaagggggtggtgatgaagatgggtatgcccgaggagcatgggattggagtatgctctggaaacgggtgcctctgacccctcaagagaagagactgagaaagacaaaaactgaaccgtatcggtaatcactaaatcacttacatatttttcttttctccagttgctgctaacctattaacctcttgccaagctaaagattcgttattaaaactgtagatgttgtctcagattctgaaagaacatctttccttacactgtttcagagctttcaatctgctccatttgctccattgtaattgcttttaccctaaatgtgat

SEQ ID NO: 34309 - DNA, 1031 bp, Homo sapiens
ccagaggtagatggaagttttttatgcttaatgtaaatcctaagtagtgcattctgaagcctttataaaaagatatgaacaatcttttaagtgtttaaaacatttgagaaatctgaaaatgaaagcaaaattaaatatagccagttgacatgcatttacacagtttgaattgttacattttagattgacaatttttgcagctctgttgtcacataacttactctttttttgacctcagtttatattatttatccccaaaagattaaattctttaataatttatgttggattatataaattttttaaattttttttgattttggaagtaaattttattgtgctgaagttaaaatgtttgttattatacatatcaatgataaattttcaacaaattgtatgaactcatttatacatgttaattttttctaggttgatttataccaattacaagtaaatacacttaggagatacaaaagacacttcaagctaccaaccagaccaggacttaataaagcacaacttgttgaggtatatatgagttttaaactatttgaactatctgcacaaccgagaggttattaagtgctaatggaagttttaatgtagtgtatgtaacagtacattttaattagaaagaacaaagttaaaaaatctgttgtggaagaatctagttgtgtagaaatgtttgtctgccacttaggaaattcctttttgtaatgactgcttagtagattgtgtacagcaccttctgatactggctttcaaaatgtgttgattgttttttgagacagaatctcactctgtcacccaggctggagtgcagtggcatgatcttggctcattgaaacctctacctaccaggttcaagcaattctccagcctcagcctcccaagtacctgggacttcaggtgtgcaccaccacaccaggctaatttttgtataatatttttagtagagatagggtttcaccatgttggccagacttgtttcaaactcctgacttcaagtgatctgcccacctcagcctacc

SEQ ID NO: 34310 - DNA, 1032 bp, Homo sapiens
gactattcaaagcagtatagggcattgagttcagatgagggcaagtcagaaagatgatcaaaggatgtttcctagaaaagaagctgagctgtatcctgaagggtaaatgaaagttaaaagagaaataagatggttcatcacccaaacatgtgtgatacatgtaaaggaggctaaaaacaccttctacacacaaaattttattgtgtcacttattttagttaacagtaggttcagtctcaaacatttactttgtctttttcctgtggcaaagtctccgtcacggctctaatccaggcgatcctactgtagtctcagctgtgaaatatttagaatccatgtgctaaatatatatcgcattaacacttcctggtgccaaagtctctctgtaatcccaccccctctgtcctgattctaactgtgaacatggaacacctgtagacctcttatttttctctaattttgggtctgggactacttttgctcataaaaagtataaaggatcactgtattaggatcagaactaacttcatttattcagtcaagtcattcattaattccataaactttgttgagtattaactatgtgtaaaccactgtgctagatgtgaggcaattaagaagatgaatacaatataagtcttgtcctcaaaaagtctgtagtctaggctgggtgcagtggctcacacctgtgatcccaatgctttggaaggctgaagcaggaggatcacttgagcccaaccaggagttcaaggctgcagtgagctatgatcatgccactgcactccagcctgagcaatacagcaagaccctgtctctcaatttaaaaaataaagtctgcggtctaataagggaaagcaaaacaagtaatatacatgatagaccgtaaaatccatagcaaaggagacgatgttgaccttgtttatggctctatcccacacaaagttcaacttttggctcacaataattactcaagaaatagttactgaattgaataaaaaggtttaaacattatcgggcaggaagaaatatttc

SEQ ID NO: 34311 - DNA, 1058 bp, Homo sapiens
tgatgaattatttcaatttttgtatgcttcaaagagtagtttgtttttgaaaaatatttttgctgtgtaaaagatggcacatgtatacatgtgtacctaacctgcacattgtgcacatgtaccctaaaacttaaagtataataataataaaataaaataaaattatcatttgattttttttcagtactttatatttctctactgtcatctgcattacattgtttctgatgaaaatctaatgccatcctaatgtttgtccctccctaccccactcaggacaactgatgttcctttgtatgtaatgtttttttcttatggctacttttaagatgtttttctctctatcatcataattttaagcagtttgatcatgttgtgacttggtttctttttatttatttatttttgtgtgtgtgtgcttacagttcattgagcatctcggatctgtggacttttgtacttcattaaattgaaaatattttggccattatcttttcaaatattaccttgacctttttttttctttaagaactccaattacatgcatattagacaagtcgaatttgtcacttagctcactgatgactctgttaaatcttttttagacattgtgttttatttgggataatttccattgtctttaaattaactaatattttcttctgcagtgaataatctggcattaatctcatggcaaaaatctcatatttttcttcttgaacattctaattttttatttctagatgtttagatttgtgttatgtttttatttttcataattctgcttaacatgttcaattttacttcttattgtttgaacatatgaaatatagttataataattgtataaacatccattttcattaattctataatctatataatttctgtgtcaattttgattgcttactttttctcattattgttcatattttcctgcttttttgcatgtctaataatttttaattaaatgccagtcattgtgaattttgccttgtgttctgggtattcttgtatttcaacaaatcttctcaaattttgttgtttgaagcacttaa

SEQ ID NO: 34312 - DNA, 1026 bp, Homo sapiens
gtaaagggtgaagaacagtctttttttttcccagcgaaatgttctcaaagaaagggcctcagaacaaagaataggtaaaatttggagtttttgttaagatctttaaaagatctaaagtggtactttataaaaccttacagacagacaaaagtacctctaaggatcctaaggcatgcctttcaaataccataccttccacaaataatacagctgctaagagtcttaaagtcttagctcaaagagattgtgcttatatgtaatagagtgacccccaatatgatttattttaaaaaaccctataaatattttaaaataattattctaaaggaaacaccagaagcttgacctaaaggaggcatttagactccacctatgaaggacaggaagaagaaatctcaggtacacatcagcccactttgtatagaaaagaaagaataattcacaaggaagagccaggaaccatggagaacaattcccagagattagaactgaggccccgtcaaagaactggcaagatatgtcctgttggattgcagattgcctcatgcacagtacattctcccccacttttagaatgggcctgtttattaatagttatacccatctcaccattgtatgctgagtgtgtagaggagggcagatgacttgtctttttagttcactggcctttagattgagaataataatatgcaacttgctgtacctgaggaacttcacctgaacagcctggagtgtacaatctgattagatgacaaggtctcctacaagcttgagtatagtgggatgagaattcgtgggttttgggtggggttgagtgaattttgtatgtgagagggatgtgattttttgtggctagaaaacagactgtgtcagattgtatattccaaagctgactgcaaaagtatctcctgcctcatgtgcccttctagaacattgcaacaatcttcctaagatatagagtctaattttccttcccctgaatccaggcaaattattgactcccttataaccaatatattatgctgg

SEQ ID NO: 34313 - DNA, 1032 bp, Homo sapiens
gaagtattttaatctcttctgatttaaacaatattctttgggtgaactattcagtccaattagactaatttccatctattcagtccaagtagaaaaatatctgtctgttcacagttccttatctgagctttgtcttgttgtcagagtctgtcttaacctttcatctttgtcttaccactaatttaacagggtccatgtgggaataatcccaaagtgaccagaaagggagagaagacagggatgaaggtgaggtgggcaaaacatgtgcctacaagaccaggtgcaggccagagaaaagagcagaaaactcttgatactcaattggctccttcactgtagatgatgtgcgatttgagttcatttaatttgccacatgagatattcctagagcttctagatggccaccacctcaccatctcacctctgtggattctgtggtggatgatcctataggggcacagtggtgtactgtccagtgggaggatccattctacaccccacagactatgctggtgaggtaactttactctacagtattgcatttttggggagttgggtgctgtcaggccagtttattccttctactactttctatagccttctctaggcccacaagagacctaggaattaccaccataccaaacaaggcacctcaggaaaccaagggtgagctgtactctctcccatcttgctatgccacatgctacctctatgaagtctggcagtgctgggtaaggttggcttagcaaaagaaacaagaagcagagactagtttcttatatacagtgtcagtcctcaatatccagtgagattctcttggcgatcccctttccacgaggaacctattgaagagatgggagaggccgtgcatataatcattttgtcttagtctgttttgtgttgttacagcagaatctaacagactgggtaatttataaacaatagaagcatatttgcttcatggttctggatgttgggaaatccaagactgaggagctggtatcttgtgagggccttcttgctacatcataa

SEQ ID NO: 34314 - DNA, 1073 bp, Homo sapiens
actcaaggtattgttatgtattacttttcttctatgaagtgtccatggacagttgtggtagatgtttttatgtaagttattgagtttcacgttactggctgactagacttttatagttcagaaacttacctccttccagcaaaggttcttaatcgtttatatacctatttatgactcttctttgggaaaaatctcctttgataatctaatgaaagtcccactccatgcaagaaaattagtcatttagaaataaattccatgctattacttttggggcagtttttaaaaaatgaatcattttgtttaaagtctcagttcgttcaaatcttttggttcacgtatgtgtttttctgttgtgtacattcttcagagtcatattcctgtttcataggccccatgtatgtcagcttttagtaggtatcaccagtaagttttccaaaataattgtaccatttactctttctgtaaaaagcatagatattttgaatttcttgcctttttttctgtgttcaccttttcttcttggaagtagacagctggctaaccagcaggagtttgggaccgatgacagtgcaaaacatcttgactgacaatggtggtggcttattaaagtgaagaatcagcatcaagagggggaatcggtgtattccttctatttctaggccattgggatataggtcgttatgggaccccaggtagtaacccagctcattctgaaatagagctgagaaatgacaaggattaagtgttgcttttcaggtagagtgctattttggacccttggcacagattttggttctttattatgataagtaccaagaaggaaaagaactgggtctattagagaaaattaatgagggggattaattagtttgggatctaagacttatttgaggtggtgacatttaagcaggatgccgaggggtattagccagatggagaatgggagagggaaggagttgctctgtatctcttcaagcttgaagaaatggcatgtgcaaaggtgttgaacagcttgagatatcaccaaacatccttatccaggtccaggaactttatcccagataccattt

SEQ ID NO: 34315 - DNA, 1046 bp, Homo sapiens
ggatttcttatagacaacatgtagttagatcttatttttgatccactttaacaatctctggctcattttacattctcacaagcttaatattttttatatccttctattcttgttttaggttttaatttttttttctaatctcattgagaattgaaagcttcattttgaaattttttctctatattatctctatttccaccaaatttttcttctctgcttattttgtttaaggtatttatatatacttttcatactgaagcttccctctaatagttattgacctttgggcatatattcagttttaaacatgagtctctaagaaaaaaaggtgcctggttagggcttatcaataagtgagtttgctgcaggtttattgggcaagacctgcccttttcaatggggattttcctcaaatgtcagaaatgtgatacttttttctctaggtccatccaccttctctagcatagaacctgatagtctgctgtcacagaggatgtaagtctaacagcttcttgaggctgagatataggaagaaactttattagtgtgtgtgtgtgtgtgtgtgtgtgtgtgtgtgttttcattaatacttctttctgccttcgaacacttccttctgtattgttcgccttgcctgatgttaccaaatttagtgcctccttgattcaatttctttggagtgtaaagctcttttctctttccagggaaggtgagaggtagttgccttgctgagcaagttatgtgtgtagggataggaggcgggagggaaaataaattctagggttagctgcttcttatgtagactctcaaataatcattcttatttcagccccctggacttacccctttgtctttcagaagcatcaagtgtacctgatttgtgaacctatcttgcttcagttggtttcctcctaaatattaggcagatgggattggctggtctgtgctctgctaggttggttatcccttattcatttgcttttcattttccaaaattttgttgatacttgttttgttatgtgaaatctcctgtagttctttttgtc

SEQ ID NO: 34316 - DNA, 1046 bp, Homo sapiens
caacccccatagagcaggcagtgtcctcccctataagctgtgagtacatatgactaataagctgttatcagtttcatctgcgttgtgctgggttttgtgttgggccttcccataaccctaggtgggaattcctccctcaccaacatggtgaatggggggtgattaaaacagtgtgtaatggtctctcatcgtagttttagcttacatttgtccaaaatgttgagcataaagtatttatttgccattagtatatcttctttggtgaagagtctattcaaagatattcccaattgtatttaggttgtttgtcttcctgttgggttgtaaagggcctctattgaacagttttgcaaagattttcccccactctgtggtttctcgttcatttcattaacagtgttttttaaggagcagaagttttaaatttttataacatccatttataaatttattcatcactgagagaggggtgtagccatgtacagtcactcatgcctgtaattccagcactttgggaggctgaggtaggagaatcatttgaggccagaagttcaagaccagcctggtcaatatagccagatcctgtctctacaaaaatttttttaaattagccaagcatagtggtatgcacctgtagtcctagctactcgagaggctgaggtgggaagataacttgagctgaggaggttgtggcttcagtgagctatgaatatatcactgcactccagcctgggtgacagagcaagaccctgtctctaaaaataagaaaaagagaggtgttgaagtctccaactagaactgtagatgaagactaaaaaacttttattttttctttcagttctatcatgtatttttaaacctgtttttaaatgcataaacatttaggactgctatttcttcatgataaagagacttatttcttattatgagttggccctctttatctctggtaatattctctcctgatatctatgttgtctgacagctattccagatttctcttaggaagtgttactacagtatttatttcccatctttttactttt

SEQ ID NO: 34317 - DNA, 1098 bp, Homo sapiens
ttctttgtcttttttgatctttgttggtttgaagtctgttttatcagagactaggattgcaacccctcctttttttttgctttccatttgcttggtaaatattcctccatccctttcttttaagcctatgtgtgtctttgcatgtggcatgggtctcctgaatacagcacaccaatgggtcttgactctttatccaatttgccagtctgtgtcttttaactggggcatttagcccttttacatttaaggttcatattgttatgtgtgaatttgatcctgttattttgatgctagcttgttattttgctcattagttgatgcagtttctccatagtgttgtttttctttatattttggtatgtgttttggagtggctggtaccagtttttcctttccatatttagtgcttccttcaggagctcttataaggcaggcctggtggtaacaaaaatccctcagcatttgcttgtctgtaaagggttttatttctccttcacttatgaagcttagttgggctgaatatgaaattctgggttgaaaattcttttctttaaaaatgttgaatattggcccccactctcttctggcttgtagggtttctccagagagatccgctattagtctgatgggcttccctttgtgggtaacctgacctttctctatggctgcccttaacatttgttccttcatttcaaccttggtgaatctgatgattatgtgtcttggggttcctcttcttgaggagtatcttagttgtgttctctgtatttccggaaattggatgttggcctgtcttactaggttggggaagttctcctggataatatcctgaagtgtgttttccaacttggttccattctcctcatcactttcaggtacaccaatcaatcgtaggtttggtcttttcatatagtccaatatttcttggaggctttgttccttcctttcattctttttttctctaatcttgtcttcatgctttattttattaagttgatcttcaatccctgataccctttcttccacttgattgattcggctattgatacttgtgtatgcttcatgaagttcacgtgctgtgtttttcagctccatcag

SEQ ID NO: 34318 - DNA, 1073 bp, Homo sapiens
caaattgtttgttgaatatggtgactggttattaatcttgaagataggaaataagatgttccttgattagtgttggtcctgaaagaacttattgtcttattaagaagaaaagactcaagaaaagtaatccaaaacagaatatagtcaagtttcaactgtatgtattatagatgttcagagaattgtgttgtgttgatttttgttagcatagaaggcattgtaaaatgtgtgtgactaggagccaattagaactgagtgtgtgtgtgtgtgtgtgtgtgtgtgtgtgtttgagacagtctcgctctgtcgcccaggctggagtgcaatggcgcgatcttgactcactgcaacctccgcctcctggttcaagtgattcttctgcctcagcctcccgagtagctgggactacaggtgcccaccaccacgcccaggtaatttttgtattttcagtagagatggggtttcaccaggttggccaggctggtctcaaactcctgatctcacgtgatccacctgcctcggcctcccaaagagtgtttttacaggctccattccttattcctggagtcatcttagggaaattttctgacattttattgccttagaactctcatctgtaaagtagagagaaagatgcctcacttgcttgctgaggactaatgagatacaattttgagaattcatttttttcatcccaatgattttcaccaaccatgatcatgctaaatttgtctcactcaaaaccaggcataatgtaatgctgttaagaacatattattctaatattcggtccagaattcctctctgtgaaccgtttctgtttagaatctgtgttcataaatgctgggagtgtgtcagctggtgacttcagaggaaaggggaaccactacacatgaggtaaaaggaggaatgtgttgttttgctactgagaaggactggggaggggagtggaataaaaggtgggagcagagaagagacaggccagcaaaatcaaaaagcaggtgctgcagagaaagagccaggagagaaacttctggtggtgagtgataaaaatggacttgggggacaggaca

SEQ ID NO: 34319 - DNA, 1103 bp, Homo sapiens
ctctgccaggtttctggaaataccttggaatatattatatatgtgcacacatgtgagcatgtctgtgtatgtgcaaaagacaaagacagttccatttcaggcatagtaggatgacagtgaaggtactgagcataaaaacaattacctgatgggagctttattagcctcactgtcttagtccattttgtgttgctgtaactgaataccacagaatattctgctataacagaataccacaagctgagtaatctataaaccataaaaggtttatagtttatagtaatctaaactataaactagtttagattagtttaaggctaatgtaaagaggctgggatgcccaggagcatggcacaggcatctggtgaggaactttgtgctgctgaaagcaggagaggacaagagcatgaaagcaaggggagacctagctggcttttataacaaagccactctcacaataaataacccactcctacactgtctatattaatccattcataagagtagagcctacatgacctaactgcctctgattagaccctatctcctaacaatgttgcattggggataaagtttataacacaagaattttgtgggaggcattcaaactatagcactcactgatccgtgggttgaatggatactccttcatgctttcctagtcaagaggtcatgagagaattagcaaagctaagtagtgataggggatgggaagatgggggaattgaggaataattagaaactaaatgactctctacttttaccatttgattgtgttcagagagagagacctctgaaagaacagaatgtttttggctactgtataaattcttcccatatttgcttagcgtaaaataataggcaaagactctttatcctctcaaaattttaaaataaattattcacttctttaatacttaacataatagtgacgccaccctgtatctgtgggttctgcatcagtggattgaaccaactatgaatgataaatgttaggggaaaaaaattccacaaaatttcaagaagcaaaacctgactttgcagtgtgacaagtactatgttgaacccatgtgaataatgtgatgtgtaggctttggattagg

SEQ ID NO: 34320 - DNA, 1144 bp, Homo sapiens
ttcaataactacatgtaatgtggatgtagctcatccttatttttaaaattatttcttcatacacagggattcttaactttgaatatttgggcctccaagggttttatatttcatcagagagtttgggaatctctgagaaatttatgaataatttttagtgtgtgtgtatatacgcctatatctgtcaaagagtatcttagtactcagattttcagagtttcatgatacgaaaaaggttaaggaccactgctttatgtatccttcatctcctacaatgaggagaattacagaaaaaggttttacttacaactcttaatgacaatgtttgtcctttaagcagaacataactgagcctattctgttgattattgcagtatgcacctccactgtaggttaccttggctagcaatataggaattggaccagccagtgcagtcaccttgcactagagctcatattagttgaatactcttcatcctacaaaagtatttgtctgaaacataaaacataaataaaacttatgactgtaaaaactattgtttcaaatcataacacagaagatctaatctgacttatagcattctttcactctctacattgagaatttgcatcaagaaagtaaaaatgttagaaaatggaaattctgtcattttctgttatgtgattactggtgcatcatgactttgaggtaagtggggatgatatttaaaagataaatgagggttgacaaggatggaagtagagtaggatatagataattacataatttcctctgtatcttagtgtagataccagacgaaaagaaaaaaaatgcaaataaattttgaaacatatccccaataatttaagaaccccaaaaggagagcagtttaaaaatgttagaaatatgatgagaacatttttagtgtgtataatcatttatcattaagtagtttcttcatatttttattcctagatagcagatgacagctgctcctttgttctgatggagaaaacctcttctatcactgtcttacaaaaggcacttatttaaatccttggccatctactactcacttagcagtagttttattttcacaaatttttttatttcttaaaacagaaagcattgtttatgtttttatggagaaactgtatttttcct

SEQ ID NO: 34321 - DNA, 1044 bp, Homo sapiens
tgtgtacaataatttacacagtatactctagtcaatttatgttaactttatttaaaacacaatttatttggccgggcacggtggctcacacctgtaatctcagcactttggcaggccaaggcaggtggatcacctgaggtcaggagttcatgaccagcctggccagcatggtaaaaccctgtctccactaaaaatacaaaaattagccaggcatggtggcgggcacctgtaatcccagttacttgggaagctgaggcaggagaatcccttgaacctgggaggcagaggttccagtgagccaagatcgcaccactgcactccagcctgggcaacaaagagcgaaactctgtctcaaaaaacaaaccaacaaaaaccacaattgatttgatgaaaattagttttaagtaaatgtttgtaaatagatattggttgaatttttggatatattatgttgatttaacttttaaaatgttgtttaaaagtgtgaagctatgaaaagcctgataatgtgactacagatatttcagttggactagaattctgactttgaaacttattaaattaatgcatactggaagtactttgatactcaagttgtttcacaagatttataatatagatggttttgtttgactaaagaataatctcatataactagaatacttgtggcttttattatctttaaacttgttgcatttaaaatatttttaaaaccttcttaacaaaacttcttaaaactggaaaaaatatatattatgtatctatgtatcatatttatcacatgaccacttttgattccttaaaaagacattacaggcttaaattccattttattaaaaaaaaaaaattgcctgtaatcccagcacttcaggaggccgagatgggcagatcttgaggtcggtagatggagaccatcctggccaacatggtgaaaccctgtctctactaaaaatacaaaaattagctgggtgtggtggtgtgtacctgtagtcccagctacccaggaagctaaggcaggagaatcgcttgaatccaggaggcgga

SEQ ID NO: 34322 - DNA, 1040 bp, Homo sapiens
cgcctggccaatgagggagcaacacaacagcagagccggcgccgccgcccgcctgggctggcgcctcccgcgcgtccggtgccgctcgtggtccgcatgcgaggccctccaggcgctgccgccgcgctctgggtcgggcttccgtggggtttcctggcggctctggaggccacaggacggggttgtctttgtgtcattcatcacccgagtttgccctgtttgacattccctttacagttgttgcctttgcaccttcagaaggcagtaaacagttggagctgctttgaagttggccagagatgttgggcactgagagaattaagcatcttagccttctgatacagcgagatttttgttttgttgggtttctttatttctttttcttttgccaaccacttgaagaagtctgcgaaaacgccaaaaaatgcagttcgaaatgacagtgccatttcgctattgcctattttgtccttgattttattctctggcacttttgtctttaatcgtcgtatttttccatctcttgttctcatacccttctactctatttccgtcttacacaagttctttaaccttagtttatttctttgtcagaatcgccaagaagccagttatcaaatagcgagccttctccccccaccttttttttttttttttaaattactgtactgatgtttgttagatattgttcgaatagacctggggtggacatcagcactgccattgtcagccctgtgagggttagaagagcttggtgcatattaaacactgaacagatgttagctgttgttgtcttgagcaagttttcttaccattctgggccttaatttctttttgtttaagatggaagtaatacctaatttttaggttgtgagaattatttgaaatgtgaaaaatattgtcagtgggtctgagccgtagtaaacagtaaatagcagctggttacagtagtatccccttaatggggtaggtatacgttccaagacccccagtggatggctgaaaccacggatagcaccaaaccctatatatacttggtt

SEQ ID NO: 34323 - DNA, 1045 bp, Homo sapiens
acaagccagtggaggtagctgtgttatgaaaacatttgatcttttgggagcctttttgttgttgttgttgtttgtttgtttgttttctgtttgttctatttagctctctagcattggggtctccagaatggagacttgctatatgaacagacgttaatgttcatattcagcccttaagtcagatagatgggcacatgccttctacaatatgcagatattctggaggaaaggaggaattctgtaggtcaagaagttcaccatgctacctagtatttattcatttgctttcagcatgttgtaaaatattgcagtatatgcaatacataagtggattatattataaaattttagccaatcctttcaaaatggaaaagtggcttaaaaagatttctgcaaagaaatcacagattgaagataatgctaataatccatgcatatgtaaacagtaggaaaatggtggagctcatacttgtattcctcttctgagctgctgtgtcacactgaaggattaaaaaaacacaaagacaacctagatagatctgataacttggctgagacactgtcaatgatattaattaacaatagtaagatcagaaagatattgctgaactatcaactaggaaatggagtgggtagccggtagtattgccaccactcagctgtttcctttttttttttacttttttttttttttttaagacagagtctcgtgcttgtagcccgggctggagtacagtagcgccgtcaatctcagctcactgcaagctttgcctcctagattcaagcagttctcctgcctcagcctcctgagtagctgggattacaggcgcctgccaccattcccagctaatttttgtatttttagtagagacggtttcaccatgttggctaggctggtctcgaactcctaacctcaggtcatccgcatgcctcgtcctcccaaagtgctaggattacaggcataagccaccgcgcccggccgttgtttactctttaagctaaaatattctctctccacagctgcaattagagagctgcatggtga

SEQ ID NO: 34324 - DNA, 1071 bp, Homo sapiens
ctgtcccatttccagatacatatgaaataacgaagagttattaaattattctgaatttgaaacaacatatttttatacttaatgaattgtatctcattaatctcttcccttacatcttcatgtattgttggtttgttttttggttttgggtttttttttttttttttttggtataagaactaacatcaaaaggcctgtttaaagggaaaggttaatgggctacttaatattatgaacaaaacaaaaaaacaaggctgccacagtggaatattatcttacaagaataagaactacataaaacagatttgtaaaaaatacatatttgaagtattccctgtatttccattattctttatggaatataaagtaagcatgaaaggtagttaaaactttcaggtgcctgtagagtcataataactgtattttatgccttgcattcacgcaaattcacattggatgtgatttaaaagtagacattctctttttcctcttttaggatatgtttgattactggaaaattaatatggttatttgttagaagtctggtttataaaaaagccaaaagtgatggaatttattccatttgtcttaggaaggcccataatacttgtttttcttacatgtgactagcaactttctccacttaaagactaaatacctctttatatgatgtaaattattctaattcattttaaaatcttttaggtcagcaaaatgtgtgtcttcagtgctttctctaaaaacgttcctttatagctttgtacttttttttttagcgttgccattgaaagttaaaatgtttgcatggtttaccctctgagttatgtttcttctagtgagcatgcctgctgtcactaagtgaattatttactactttttgtaggtctatattttaataattattgggataataataattgtggtatgctttccatttacaaaccactcatatactttagtgtatgtcatcctcaataatctaatgaggtaagtagtataagtgttagctctttgcagataagaaactgaaacccagaagtttattgaattgcttcattgttacctagccag

SEQ ID NO: 34325 - DNA, 1060 bp, Homo sapiens
agggaacaaggaacagatggtttgtatttaagatctgactcagatttacaaaccttacaatgaaggcttactatggaagtaactcttttggttgtctatcatatataccctgggtgacctttgttgaacctctttttgtcacatagggtttatgtgaatactaaattagttaatatgtgtaaggaacttaaaataatatttagtatctagtaacctctcaataaactttggataaagcattaataattgtagatgtgttattgtgtgttattaatatcatgtctgatatactaatctttatttcttccttatatttacgacattttttctgttgttttacccttgtatttaagtgactattcaaatggtatcagatttgaacattgactttcttttttaagcaacttgaaaatgtcattctattgtattccctcatcaaatattgtaccaagaaatctaagcataataatagtttatagccatcttatgtcccttatgtatctgactgtatttttaggggtgctacaaattctaatgtatttgttactcccccaaatcttatgatatagaaattattataatctatattatgtcaacaagaaaactgagctatgaagaagttaagtatcttgtttaatgtttcagagctagtttttgactgagcctaaactcaggggattaggcactgccctctccttcccctttatgaatataaacatgatacttttccttgttagatggttagccattcttgttggaaaattttagaacattttctttgttttttattatattgaattttaccattgtttgtccatagggaattattcataacttctttagcacagttgcggcccttttaatcagtgtgtgtgtgtgtgtgtgtgtatgtgtgtgtaatttcgaagaaattattagtcaaataatctatacaaagtatctctcttgttatagttctctagaatttcttgcatacagatattgacatttttacctttataataatagcttatagccatattgtgcctactctgtgtctggctatatttttagggatgtt

SEQ ID NO: 34326 - DNA, 1027 bp, Homo sapiens
acttagccttatctcatcccaagcctttgaatctgagaaaatgccaagagatgctagactgttccatgaataaaagatacttcatctgacaagaaaagaggagcaggggtgtatttttttgggcttattgttggtaccatattatttctttgagaagttattttacttttgagttgaaaaactgattgtcatgtcttctatctttataaggatacaaagtcatgagagaaaaatatataataatcttaccactggtttctgccctttaaaagtgtctatcctgactaacatttgtttgcttataatccaaaaaaaaaatgatagtacaggaaaaaagcttgataaatgatatactttctgccactcaaaaatggtttgattttgtttcaggattcatttcggaatgaaaggcttcatcatgattaatccacttgagtataaatataaaaatggagcttctcctgttttggaagtgcagctcaccaaagatttgatttgtttctttgactcatcagtagaactcaggtaaaaaaaattaaataaaagtacttacgctgcaatactgcagagcttggtttgggatgtcacacgtgtaactaaagaaacaaataaataaagagtttgtaattgatgaaacctcattttaaagaagccttcagataatataatttgtaaggtctttgttgtttgcatatgtaactcttataccctgattaacataaagtgcttatagcaaagctcattttaaaagacactttgtgaaattataaccagacttatgattaatgtgttttatattcctttctatagaaactcaatggaaagccaacagagaataagaatgatgaaagaattagatgtatgttcacctgaatttagtttcttgagagcagaaagtgaagttaaaaaacagaaaggccggatgctaggtgatgtgctaatggatcagaacgtattgcctggagtagggaacatcatcaaaaatgaagctctctttgacagtggtctccacccagctgttaaagta

SEQ ID NO: 34327 - DNA, 1050 bp, Homo sapiens
gtcgttgaagggtcagctgtacatatagatattcacacacaggcaacaagcatgaggcatcagagggtttcttttgggattaccattgacggcacatgtgccaaataataattctgcaagggtaacactgagatttatgttaggctgtgtcagaaaaaaattcttcagtaaggtctgtgtctgagctcttccatgtgttaataagtactttgatattaatgcatgtatagaaatgcatatcttttctaaagctcgatagtgaccttggtggtcatctactcctgtgcctattttcccttcccttctttctgttttatattgttcttggtaatttttttttttgagtccagcaagacttctcaaggtgtctgatagacaatgctgagactttgaagatgtctaatacagaataaatattcaataaatgcttgaatttacaattaaaatgtataaataggaatcatattttgtcagtaatattatcagttcaaaatataactactgttaatggtactaaatagatccgtaagaaatagagctctagaagatattcatatacgattgactcttgaacaacacaggaattggggtgctaacccctcccattgaaaatctatatacaatttttgactcttcaaaaacgtaactactaatagcctactgttgatcagaagccttactgataacatagttcacacatattctgtatgttttatgtgttacatatgtattattacaataaagtaagcttgagaaaagaaattgttattaagaatatggtaagagccaggtgtgatggtctgcgcctgtaatcccagctacctgggaggctgaggcggaaggatggctgagcccaggagtttgaagctgcagtgagctatgatgatgctgctgcactccagcctgggcaatagagtgagaccctgtctctaaaaaaacagaagaatatcataaggattatatttactactcattaagtggaagtcggtcatcataaagttattgctcctcatcatcattacattgaatagattgaggaggaagaggagg

SEQ ID NO: 34328 - DNA, 1060 bp, Homo sapiens
aaattagcacattaaggacttttagttgattgtagcatagttaacatggaaaacgaagagactgaaaatgcatgtaaagaagctggtgcagagtaatgggcaagcgatggttaccagcctggggtcaagacactggacgtggtaccctagtaaaactttttaaaagtcaacaaggactgtggcagatttgataggtaggatgatgcaaaaggtttcaggaccaaataataaaaattttcacattgtgggtctgggaaaattgggatgcagcagtgaagatgcagtatgtgttagatatgtgaaagaaccctggaatatccaggaagacatgtcttaggggctgcgatccaggatgagagaggctgtcggcacagtgctgttgattgaagcattccaacttctcagttcagtaagaatgagaaaggaaatgagccaaggtctgagcttcagcaaatacctataactacaaagtgggcaggaaagaaaaagcaaaggaaacaaaaccataggattggacataggaagagactcagggcaccactcggctgtgggaaacccgggaggtgggaagtgcggtcatgtctgtagagctgggggcaggggagggagctggtgtgcagaggaagtcccagcttaagtcttcataaatatgtccagaactgcgtgctttttctttgtgtccctgcgtttcattttctgcatcactcttcttgttctccaatacttttctctacagcactctatatcttcttccactcagccgcttcaccccgtgttactatcatagacatctgaaatacatttagataattttatatatatatatataatacacacttaatggtttttaaattttttatgaacattcataatttttttttatgaacaagaactttcatagttttttatgaacaggaacttttttataatataggtatacatttatttgaccaagtaactagatactgcgttgaacacagtagctggcagatagaagatcttcaatatatatttgtctactaaataaatgattaatgttctgtattggttttctatgaat

SEQ ID NO: 34329 - DNA, 1051 bp, Homo sapiens
aaagttaaggcaacagcaaggctctctattggacctttctgcctctcctccctccgtgcattcccagtgatggcgaatactaccagattcagctatcatctcagaccatttctggtaaagatctttaggttatgtgtcaaactatagttcttgggccaggtatggtggctcacatctgtaatcccagtactttaaaaggctgagagggaggttcacgaggtcaagagattgagaccagcctggccaatgtgggaaaccccatctctacgaaaaatacaaaaattagctgggtgtggtggcgtgcacctgtagtagtcccagctacttgggagactgaggcaggataattgcttcaacgcgggaggtggaggttgcagtgagccgagatcgcgccaatgcacttcaccctaggtaacagagcgagactccgtctcaaaaaaaaaaaaaaagaaaaagaaaaaacctatctatacatacatgtataagacatgaggcgatgataagtggtgattagtgttctcaagaacatgagccacagtagcggatagtgacggagacggctcatttttgatagggtagcagataagtccgtggggaggactttgttgaaaagatttgatgacttgtagcaatctgagggtgggggaaatatttcaaagaaggtagcccagaaaagcataaagcctctgagttgttgaaggaagagaaagaaggcatgtatgactgaaccaagcagagggaatgagagacagaggcagcccctctgcttgggagggaccaaggagcatgcagagtcggcttggccaaggcaagtttctgagtagactggggagcctttggagggttttgaacgggcgtgaaataactgacttaatgtttgaaaagattaatcactctggcgactgttgccaatacttttgagctgggaagccactgggagagtttgagcaggagggcagcatgaagtgacttgggttttctgaggatgatttgggctgctgtgtggaatagagacggtcatggaaccagagtgaagcggcagcatcggggg

SEQ ID NO: 34330 - DNA, 1091 bp, Homo sapiens
atattcctttcctcttctcgcttccggtgctgccagcgttctttcatgtgtggctacatcactgcaacctctgcctttgtggtctccttgccttctctttggtgtgtatcaaatctccccctccctctctcttataaagacacttgtgattgggttaagggaccatcagctaatccaaaataatctctctacgccaagatccttaattacatctgcaaaccctccttctttataaagtaacatttatagattcctggaattgtgccctatgtctttgggaggccattattcatcctactacaaaacattaagtttgggattcttcttacacatccaagtggagattgggaagaatttattaatgagtgattaagaaatagagcagtaaagaaaggaaagaatgtttccaaagcctccatatgtaacaataaaattctccttatgatcagggaaacttttaggacagaagaaaatgaaaatagggaaaagttggagcacatggaaaatctaaaagtcatttaaattgtgtttgtttaattatagataaatgcatcatgctgcctttcaaagtaagttagtagaggacagagattaggtcaaataaacaaattctgtagaagatctgatattccatagggataataaatactgagtggcattaaaagtcaagggaagtaaagataaaagaatcctaatgagatgtatcttactttcagattttcttattctatttattattttaccagacactcctgaattttaaaactagtgtaattatatgtaaggaacaaaatgtcacaggagacaaggttacctttgaaagtcaaagaactcatgttctgaaatgtaagatacatagcctttacctgcaagagctttgttcagtattaatgtttgggatcatgaagggaatccgtgatactgccatggttgcttaactgtgtgacatgctctatatccagacctatagctagctgtgcattagagagtaggactatgtcacagccgtataaaggcattttgtgtaaaaatacatggtcaatgaaggacttcagatggagaatcatgatttatatttgtggccaaaaatc

SEQ ID NO: 34331 - DNA, 1051 bp, Homo sapiens
ttgttccaggacccccaggataccaaaatctgcagatgctcaagtccctgatatgaaatggcatagtccttgcatataacctatgcacaccttttcatatatttaactcatctctgcattacttcttataatactgaattcaatataaaggctgtgtaaataattgttatactgtatattttgtgtaatttttttattgtttcattattttttgtttccaaatattttcgatccaaggttggttgaattcatggattgggaacctacggctatggagggatgtactttggttgggacctagagtaatctcaggtggaattctgagattcactggcttttcctcttattagctgtgcctttactgatgggtagatgccttctctcagcggtggggtgagggaccatttggtgtaaactcctagagcaacctgtaggaatccttaagcttatttcataacaaattctgagacagtctctgctcaatagatgtgtttactccaagtttcctattccagctctaaatttaccatcagttaatcctgatgatttatccttgactggtttttttaatgtcttgttcataatcatttatgataactggtttaacttttgttcatatactcacatttgaagtaagctaagggggctaaacttttaactgactggataaatccaccacgttttcactttaaccctaattagtgcctcatgatagaagttcattaaggagttaattaagaatgtttgagttgggaggctgtcctggaacagaaaatcatttccaaacagtcttttctgttccgtggcttaagtggaaagtagaagtgatcatcttaaaatattgtggcatttgttgtacctagatgaaatatcttggcatatttttatttccttaatgctttgtagaaaatctcagacattttaactaatgaattagggatttaaaaaaacattaatgtaaccttaaatttaaatgatttcttcataagccattagtaataggatcatatgattaatcacagtgcacagcattacttaggaatgctgcagc

SEQ ID NO: 34332 - DNA, 1031 bp, Homo sapiens
acaagaaatttaataaaataatagctattacattgttagagtatatcatatttataatcataagtctagaagtgttgcacttagcttgtaaagttagaaagacactgagtgactagtaggtactagtagtacatatgtggctaataatccaaggtaagaatttgttcttcctaacttcagcgctacatcaaaacctttggtttatgcattggataaaggtttataagaaaagcaatttacatgcctgggatttacaataaccttatcaaatcctacttaaccacacttgacccaaaaaagtgatggcaccatagcaatttagctataggcgattcctcctgcctttccagtctgtggatgtatccctaaagatgaacctaagataggagataagaacctcaggtccgtttagtcagtctcacttccggtattcctcggtgtgagcatctcatcaggctgagtgtgattctaatgttcagagatacatattttttctagttactcttcatctggaatagaactgaaaaaagaaaatattgatatgtttcagtgctggcgcaaagattttctggtggactttttgaaagatcaaatatctgtcttcaatgtgataccttcttaaggaatttcccggggaaaactggatagtgattttagacctcaatctctaaacacagtgtaactctaccctacaaaattcacagatttcctcctcaagaagcttttatagatgtaatgggaaaatattattagcaatattcatggtattgctaaaaatataatagcctttttcatatctctcttgaggtcaaaattagtaagaataatataatagaatctgtctaattcagtctgcgtaagtatttgattctttcttttcctaaggaagtttaatattaaaatcatgacaaatctttgatcttacagggttttttttgttgttgtttgatttttttagagacagggtctccctatgttgcccaggctggtttcaaactcttgtgctcaagctatcctcccacctcagcctc

SEQ ID NO: 34333 - DNA, 1077 bp, Homo sapiens
atgtttcagagaggaaataacaatggcgataaccttaaagaaggacctgaactacaccctacagcaaggggattaaggatggaaggaacagtgcaaaagctgtttttgtttagggaacagagtccagaagttcaaaataaaagtatttggaagagatgctggggtgagtattatggttccaatgagacatcaaaaatttagaaataggaaacatgaaagaactcataaaagtccttcatacatgacgaattttgagagccaaagcctcagattaacctaggcatatattatcctatagatagaaatcaggtatcagaacaatgaatgttattaccaaaactaatctctttctctctctacttctttgcagcagagattgtggcttcaagtgcatggaaacactgactatatagtgtttctggaggagcagattgtagggtcacatggtttcaccccatgatggatccaagtagttccagagtcacattcattgaaatctattcgagaaggggtaaatcctgtactcaaaggagggcctggggaacagcagagaatggaagaaacctattgttctactttctatgtattatttgaattgtattgacttctctaataaaagagtaatgagggaggaaaaaagaagttaaaaagagatgaagagctgggtgcagtggctcatgcctgtaatcccagcatgctgggaggccgaagcaggcagatcacttgaggtcaggagtttgagatcagcctggccaacacggtaaaaccccatctctactaaaaatacaaaaactagtctggtgtggtggcgagcacctgtagtcccagctatgtgggaggctgaggtgggaggatcacttgagccagggaggtcgaggctgcagtgagccatgatcataccactgccctccagcctgggcaacagagcgagaccctgtctcaaaagaaaaaataagtgatgaagaaaaaagtgaagacaaaaaaaaaagatcctctgactgcgaatagaaagggaaggatgaagagaacacctaaagtatctatatttatgtgggcacttggcatctgtttttggta

SEQ ID NO: 34334 - DNA, 1024 bp, Homo sapiens
acaatattttccccacacccacaaattactcactaatttttatttttaccactagacatattatctctgatattttggttcataggaatacactgatacatttactcacttcattaaaatgttcctcattgtctatgtttttctttgtgtgtgtttatatttgtttatatataaggaaaggctatctcactatttgttctaacacaggagttccaaaacttggttatgtatcagaatcacatgaggagctttgaaaaatacagattccctaggatttacttcgaacttgcagatttgaatttcctgataaaggtcccaagaacctatatttgaataagcctccactgagaatctttggcaagtcagtcttctgataggcatttggaaaccaatactaaatatttctccatttgaaattgacccaagtcccacagacaggttgtgagtttttctttttgttttaataaacatagaaattgacccttctggtcttaaagcttgaaactcaccaggtccagacaatgagataccaggcccctcaaaaggtattgaagaactgaaactcaccagattatcacatccagacaatgagacatcaggccccttattcatcatgattgcctccttactcctcccttgttcctgttttcccacacatagttacatttcttccctgctataaaacccctaattttagtcagagagttggatttgagactgacctcccatctccttggctgtggcaccagatggaagccttcttcctcggcagtaactgctgtctcagtaattggctttctgtgtggcgagcagcaggacccagaccgaacccctggtgtttagttaacacattcgggactaattgtgtttaaatacttggggtaaatgaaataatacagatgacaaagctacatatatttatgaggagctctattttgatcatctatttggttttcagtctggtgtctaggacttcttcgagggctggaacttacttcagcttgttcacccatgaattccctag

SEQ ID NO: 34335 - DNA, 1049 bp, Homo sapiens
atatagtagactgatttttaatagttgtctattaaaaataaaataaagcataaaataaaaataataaaaactaagaataagttgttgatgtagtttttaggatttaattttgttatttagaagaagataaatatttataggtttaagttttggttgtatataaaattaacagcagcaagaataaataatcccatatttcagccaaaatggcaactagaaatgataaattggctttcttgtgtatatgtgtgtgtgtgtgtcttttaattttctatgtcaattaatatgtactatcagtagaatagaatattctgagaagataatggtatcttgttgaacatagatttaaaggttaagcagttattattgaaaaataaacataccaatttactttccatctctaagcctttttcttaaagtatatttacctaaatttaaacagcatctataatattgataaaaatttttaaaacataaatgtcaaattaagtgctcaataaatattaggatctgtctatctttgatctcttcttattatcaaataaaaatcagtacactgatatctttcttttaataacaaatagatgcaagatagtctaaggttaacaaccagaaaatatttgttttgtgatgggatgttcataatttctttttctcattgccttacagatttatttattttaatttcatgtaggatataacaattccttctgcaaaataaatgttttttttgataaaattaaatacactaaagtgccttcaattcttaagtatgttgcctaaagatttgagtttcaaaagtattaaatttatattttgcatgtgtcattatttatattgtaggatttttcccaaatacaggtcctcttgtgttatcattgtgaagttttttattcatacttttcacattaatacttttccatacaacttaattattttgctttttatattcagagcagagttgacaatattgcagttattgccaactttattttattttgatttaaaatatgttaaactcatataaagtattaacactcataatatgt

SEQ ID NO: 34336 - DNA, 1029 bp, Homo sapiens
acaaacaaaagaaaattttctttttgtttggttgcttttgttttgttttgttttgtttttgagacaagtctctgtcacccaggctggagtgcagtggcacggtttcagctcactgcaacctccgtttcctgggttcaagctattcttctgcctcagcctcctgagtagctgggattacaggtgtttaccaccatacccagctaatttttgtaattgtagtagagacagagtttcaccatgttggccaggctggtctcaaactcctgacctcaggtgatccacctgccttggcctcccaaaactgctgggattacaggcgtgagccaccgtgcctggccagtttggttgtttctctaaataaagtttacaggtacttaacacgtccctattgaattaacttatgaattagatttgtccttgtttgtgttttaaatccagttattttgcccctacctgaatctggttatcccggggtagattatcaaagataacctttcctctttcagtgccactctctctccaggtctgtaaaaaatgctctttctagaagtttttgcttttaaaataatttttttaattgtaggcttaaattagtagaataaaaaccttcaatttagactagaaaattagctgcaaaccttcagcagcaaatttcctatcaatcaaggtgtgataattctgatcgtctgtattctcttgtcagcaaacagtgaaaagcctttaatgtatatgatagaagtctcaggtaggaatggatcggtatgctatagagaggcttaggcacatatgtcatttgatgttaaactttagtccttttttctgttcttctttccctctttttcttttttttccagtatttttcccccctgaaaacatgacctttctcaactggagaaacctagagactgggggctagcataaattttaattaggctaaagtgattttaagtggttccctttgcatctactacctgttattgatgaccacatctcaagaaaaataaacaaaaaaagataacaggttagttt

SEQ ID NO: 34337 - DNA, 1047 bp, Homo sapiens
gtactccatagcattgaccagtaaaaggaggaaaaatgcttttgaaatcagtatgattttatttcatttaatcaaaggctaatcattacaaaagcaaatgatttgattgtttggttgttcagaaaataattgtaaatggtgtccatttcattaagcttttaaaaataaaggcaactacaataaatagttacagcctgtttatgtccactttcctaagttttaatacactacaaaattcagctgacttactgttcatataaccagcttaagagtgtaagtggtaacttggaagatgacatttggaaaaatagactgctctctcagccccatgaggctcactgagcatgaaacgaccactggcaccatggtggccttgtattatcaagtaactggagtgaagttgatataccagcagtggctggagtcaggttctgactcataaaatagaccttttcatgctctgctacgttctcgttcaggaaagctaccatatgtagagaactgtgtacataaaatttggaatatgatttcttgtagcttttggataactgttatgaaactcacacggcaaaaaatattcttagtatttcaacaaaattatttttattttattttgaaaaatgcaattttaaaaaaatctcagttgtttataaatatcatttcaatcagtcttttatatcaaaagtgatatgtttaatatacacttactgtgtacccacaaaaattaaaaatagcaaaatttaaaaatgctgttttaaacaaacattgatacttgtatgtagcatctaagatggctttagcaatatatattaatatacaatacctttatatggttatgataatagaataaatactgtttgttctaagtattatttattcattcatgcagtaaatatttattgagagtcaaacatgtaaagggtaccatgctattaattagtttggaatctaacttccaattggagtgagtagataaaagcaacttttgttacaaatgaagatttacatagatcattcttttagtcacaaaagtggaagggagaattt

SEQ ID NO: 34338 - DNA, 1045 bp, Homo sapiens
taaaattcagtatattaattaaccaatgcttatcaaatagatctacaagtaaagcaccgcattaaaagctttatgcaaggaagcaaaaataaggtaaagccctaatgtttaaggagcataaaatctagttgtagagataaaatatgcacggcaagatttgtatggcagtagaatcactgtgtaactaatattagcaaagttgaccagataaaagttacagcagttcaaaagtgaaacatgtcttataaactggactaccctgaaaaagtggaaggcttgactcacaggttcaagataggctttatattggcagggagggcatttcaacatggtgcattggtatgtgcaaaatagagtgatagcaatattggagtaaatagcacagggattcttctcaactgggcatcagagcctatggcttaatgaagaaatgaactccttttctgtgttagtcgttcttcaaatatggggcaatctctgtgcttctggtctttgcactggttctctagtccccctacctgtgtccctgtaattatttgctgactcactttgtttttttcgatgttgttgttgttgttgtttttgctgcaaatgacaagatttcattctctattatgtctaactaatatttaacagtgtgtatataccacattttaaaaatttatgtatccattgatgggcgcttaggtgaatctctgttgtcttttgtgccatccctttaggatctaccagtctgtcttcatttttacttatttgctggcagatgacaagaattgattccccagatcaaatttcagaaatctcccaacaagaaaatatcatgttaacggtttgatgtagtacctcacacacacacacgtatctatatgcacacaccacaaatatcattgttaacagtttgatgtagtaccatacacacatctatatgcacataccacttttttaaataataaaattcggttgttacttttaacaattttttttccacataataagcttcctcctggcatgtttattctttgcttgtgaatgaggcttctcaaac

SEQ ID NO: 34339 - DNA, 1046 bp, Homo sapiens
ttctaatagttcttttggcattgttaatagttttattttgtctgatgaaccttaccagtaaaagaaaatgttaaggaagatatttcaaactgctttgattggtgggataaaatatcctgatgcagtgggaagaagaactctttgagggaataaacagtttggaggagaatgtgctgttacttccagaaaaaaacctattttccctggaaaaaaataaaatccatagaaagtgcccttggaggcatggcaaatgaatgaagacttggttatgttaaagcagcttcattctgagatggaaaaagtgactctttcaatcttaattctctggttagagtctaatagaatttttggtcttgtctctgtgcctattctgaggcccttagagtccttaaaaggtgaatgaattaaaaaatatgaaggatgtttgtccattaaatgccataatgtctctattatttacctatttctttgtaacaataggaaacttgttgatggtagaagttgttcagcactcatacacacatcgttttctgcattactctaattgtttactttgcaatttaaatgctagcagggaacaccaaacattttgctaaattccccattgctgaaatgaagtttaatagccaaaaaattgctattgtatgtattgctattgtgtgtgtgtatatatatatatgtgtgtgtgcatgtgtgtgtatatacacatacatatacctatatttccaaatttgttgtgtaagtatatttcttcgactagcaaatttcagattacaggtactaatgagagtcagatcaaacaaatttaaaatgtattggcaaaattcatttaagcttttataataaaacttaattaaatcatgttttattaatttactatttgtagtaatttattagtgctaaaatgaggttcacttttgtataagaaaaataaataattttactaacatgatagaatagaaatacaaaacacatattcaaagaaaaaacgacagagctagattccatcccccccccaaaaaaaaaaaaaaacacatttgaaggca

SEQ ID NO: 34340 - DNA, 1842 bp, Homo sapiens
atcaccttagaattacaatcctgaatgggaatgcctagcttgacattagctttatttcagtgaaacagattctggcacaaaagaaaacagcaggttaaaaagacataaggaacacagctatgagggaagttttatgcttaaaggtaaagaggagtggtttgaatttctaaaagataaaagaataagccacttagatctttcagagtactgaaatagtcattttttacgtaaaagcaaaactcgcagcttcagagagttcagagaacttcttcctggagctactgatccagccacaccagggattgtcagctattgcagggcactctgtcagctgtcaggaaataaatctctctatcagacggaagcagtctgagttggagcaagtcctccacagcatgtcaccccgggagcgctcaacatgcttggcgaacaagggctccctgttgtactctgatttatgtatatctgtaaagttactcctgatagggtaaaaggaggagactgatcaagagtctgtcacactcgaaatgctttcatactgttgccaccccactcaacctgtcgtccatggaagcaaggaaacaaaagcactgcagaccgttctcagcagccctttcctttcctcggtgaccctttcacagaccgttaccagaaccaccactcacttcttgtgctagtagagaacagcaagtagttatatttgtgttttaaaggttgtcctgttaatagattgtcctttcacacatgccatgtaccttattatctgaaaatttactgaatgctcaccttgctgacaaatttcacacatgcctaagcatgcaactggatttccccacatgatcatttccatggttcatttcctcatagctcaggagtgatcagattttgtcttcattttattatgttttcaatccagtgaagtccaaattatatcgtatttttgctagtattaatgggtaaaattgtggatattactgtttggttggtgttgaaattttgtctatcatgtgtaatttactgaatgataaggatttgaagaaaatgaaaagccgggaatactgagttttataacatgatacttgcaagtaaatttaagatacacatcagggctttgttttgcaagaagaagtataaaaaacaccacagaaaggcattaactttcgactttaaattgcagaactcaaaggtatatatgtatacattttggagagttttgttgttgctgttaatagacaatatattgaagtgagtagcccagttacagaagagcattatttgattagggctttaaacaaagcaagaggggttgtaggatttcagaattactgaaaaagataatgatggctgacaatgttgaagaagacttgttttatgtaagagaattatgtagacctggtgtaattgtgaataattttatagctgatttttttgtttgcacccagagttaacaatatatttttaaacttactttgtaaacaagtgcttcatattgcagttatgtgtatagatagattagatagatagatagatgatagatgatcgatagatagacagatagattttccttaaccttctcaagagattatatgcctagagaacagaactgtgcattgtatcccattgtaagtaactaatcacttacaatattgctagaattgggtatctcttcagtaaacattgattgtaaaaataatcctagtaatccataggatttaccccattatttgttttaaactttatgcacatataatttatttttgtctttgtattaatatacctggtttctccctgccaccactgccttgcctgtgttttatttatcttttgtgttatagtactttt

SEQ ID NO: 34341 - DNA, 1051 bp, Homo sapiens
gaaaacattacaagagctatactatgcctaaatatcaacagcttgcaaatatatgctgacctccttcttagttgtggatttcctggattgtggtatacagattttgagttgtgaaaatctatgaaaaaaatctatttcccctcaaattacagatttcttaatatagtatggatattaactttagaaaatttaacacagaaaaatatcactgggttccagtaagctatagccatctatattacttcataaataaaaaatactaaaattaaatagcaaaccaggctaaatattggccaatcaagtcaggtcacttaaaaataatttcttgaatgaatcaaatagggagcaaagattggcaatctaggcctactggcaaacaacaatcattcccttccattaaccctcttaacaattacttgttcaaaagcctacgtagagtaacagctgtggaaaatatcaaaggatcaaatatagaagtcattagaaaggatatgagagattcaaaagggaggcaaaagagaacttacatgtattattggacgttgaagagaaaaaatagtgaacaaacaaaaaggaaaattgaagttataactgaagaaaaaagaaattgaaactgtaatcaactctttactttgaaatttttatgtacaattattatcaataaataattatcttttaaaattcttgaacagcaagaactgacaattatatgatcaagaatgaaataaaaagtcatgggccagaggcaagggtgatattaaaaatcagaatggacatactaaccaatcagaaaggaagtgggttatgcgccttcaatgctactgctgactgacatctagtaattgcactgagaggtagagatgttgtttcttcgaggcgggtttttatcaagttatttattccttctgcatcctcctctcacagtgagtgagattacaaaggttacattgggtaacttcggctactattattctctgtaacaatcttcagggctcacatgaaatgaatccactaaattctggctttgggaggtgggagtaagggggttata

SEQ ID NO: 34342 - DNA, 1653 bp, Homo sapiens
tttagaaacatcgtattctgtgaaatgccaagcattttcttgttgttttacagattacatagaactggacatatttatttgatagtaagatgcatacaatttttatttttcagacttgaatgaagtgatcatgtaaactagagaaaggagattaaaaataacctctggatattcctctcatgtgatctttattctggatgaagcattaggacagctaatagccgtgtgtcactgtaagtattgtgtaatgaacttagaatgtttatttttttgttgctgcataacctcgtatgttgtacactttcacagaatttaagaatagtagatgtagtgtagtagcagtaatgggcagaacaataaaaactaaaatactaagtggcagggatagcaacacagaaggggaaaattattctggttatagaatcccttaaattgagtaaatatttgatataaacaaaagtgaaggacaaaatgataattatttatgatatcaaagtgatctttgctagaatatacttgagagtgtgacagctttctgatgaggaagtaaactaattgtaaagctatgctgagaagaatcataatcttactatgaataagaaatgcgttacgagttacaggatttgaaaaataacagaatgagaagcttttacaagccaggctattttaattttggtgacggtttagaatctatagaagtaccaaaaattatagcaccaacttcaattaatagaatgttcaatctgtatctaatgaagttatcaagtactctttaatcatgcatctataattttatcatacaaaaccattgcattcataaagagaaaaacaatcttataaactggcctgaggacttcatctgatcatataaacgaagaaataggcttccaatttaacattctgcagcactctaatgcaattcaggggtaagtgctattacccttggtgaagaggttgaatttgatagccatttcactgttagactaacgatggcctgttatatctcttaggttacaatgtctttgatcctgtgaatggcaaggaaacatacaacctcagggggaaattcagacagagaaggtatttaatagaaaagcctccagacaactggagtttctttagattttgaaatcatatgtagacctcttagctgagactcaaccagaatccaccagtaaggcattcagcttggttatacctgtgctgtacagatggctacatatgttgtctgtcaccacaatacacgttcaaatatgaatatatgtacaaagattcaaatgtcaaatatgtcttatattttgacttatgaacttatttattatcttactaacttggacttgttaaccagagaaattacttacataatgaaagctcttttaaaaatatcctattaccttttcctcccacaactgaacacataatttggaaaaaagtctctgtgaaggaaacaattaaaattttgttttgcatttgtaaaactagagttattttatttcctagaatgtaacaataacttaccctttccacttcagattttgaaaattttatttgtagtaacattttacctacatccaaaacaggtggtggatctaatttatattttgaatggacaaataacgttttctgaaaaagttgtaagatgtgcttgcttta

SEQ ID NO: 34343 - DNA, 1034 bp, Homo sapiens
agaaaatttacataatttacaaacttagaaaaaaaatcttcatttaaataaacaacacaattaaggataaaaagtagctaagacttcctttgtaattcttactgagatctttcatgctatctaaagtctaaaggaggttaatggtcttattcataactaaggatatttacactgcacttttttttaatttggctctttttatagaaggcacacaattagagaggagacttagttggcagatctgcaaaacgtgtttcagttattagggcatgagttttagcttcatgccagcggtatttttctttcttttttttttaaaaacaattaaagtatgagcattggatgtatctagctaggggaaactgacaaatatcatgcagtagaaatggaaaagtaacaatgaaaagtttaagacacaaagatgagtctcagagtctatctgttctcaaagatgaatttcttgatttcctgtcctttatttcaacattattttagactctgaaattaggctcatagagtaaccactgaatacgctgtggtagaaagtgctatactaggttttggaagacccaaatcacttctcagcttcatccagttttctttgttgtaaaatcagaataatcatgcactacctaacctcacgtgctcacgagcacttctgacactgatcaccattcttttggaaaagtgtacattatcactgcttctcatcgaggaatacatgcagttggagaacatgtggtcttctccctaatatgtgcaccctcattcttggaagtcttcaattaaaactgatttaagtcaggcgcagtggctcacgcctgtaatcccagcactttgagaggcagaggtgggcggatcatttgaggtcaggagttcgagaccagcctggccaacatggcaaaaccctcactctactaaaaaatacaaaaattagctgggggtgatggtgcacgcctgtaatcccaactactcggaaggctgaggcaaaagaattgctcgaacccaggaggcagaggttgcagtgagccgag

SEQ ID NO: 34344 - DNA, 1242 bp, Homo sapiens
agtaaagtggcaagataaaaaatcaacatacaaaaattagtagtgtttttatatgccaatagtgaaacatctaaaaaagaaatcaagaaaataatctcacttataaaaactacaaaaaataaaatgcctaagaataaatttaaccaagaagatgaaagagctctgcaatgaaactataaaacactgatgaaagaaattgaagaagacaaaaataaatggaaagtcatcccattgtcatagattggaaaaattaatgttgttacaatgcccatactacccaaagttatgtacacattcaatgcaatccatatcaaaataccaatgacatactttactaaaatagaaaaaataattctaaaattcgtatggaaccataagggactctgaatagacaaagcaatcttaggcaaaaaaaaaaaaaagaaaaaaaaaaaactgaaggtgtcaccacatcaaaatatactacaaagttatagcaaccaaagcagcatgttactggcataaaagtagacacaagcaccaatggaacagatagagaatccagaaataaacgtaagtacttacagccaagtgatttttgacaaaaactccaagaacacacattggggaaaggacactccaacaaacgaagctgggattttttttgtttttgtttttaatgggagaggtatgaagcttaaaaagtgccaggaacgagagtgaggttgaagatatatggaagagagaataaaactggaggcacaattctcacagcaatcaaaagatgagattcaggcagacattggcttcagagccagctgcaccacttaatggctgtgtgacttgcaatgtcacttaatttctcagaacttcagtttctccatctctaaaatgtaacaatagtatcaatcttagagggttattatgagtattaggtattattataaaatgtacgtaaaaataaattacagtgagaactcattataatatttgctattatttttatttggtgtaaatcagttggcttcatcaataaagaggcctagaaataaacacataattgaagactggaataaagaggaaatgactgatatttctctaggcaattttgtaaatatgatactcagggagatgatgccttatcgtctcaatgactttagcagttatccattttcttaaaataaaacttagttaaaagtggaaaatcaagaccctttctggcctaaaattataaacaaacagctggtcagttccaaggtgttt

SEQ ID NO: 34345 - DNA, 1048 bp, Homo sapiens
tatgaggtagcaaatgaaaagccattcttatattctgttctacagcataagtaccgaatgaaaataattttgaaaaatatgaaacactaaataggtgtgtatagcagtaatactggtagtagtcacagcagccacagcagtaatagtaaatataaattttatactgtaagatatttgtgaaaaaaggtaaaaattaatgtcaaatcaaaaccatttgtaaagagaggtttgagatttaaatttttacttgtttataaactctttaaagccaaaaatagcattaaagaatgattaattatattacattgaaatagaacattaaaacataggtgtatttttctcctgaaatatatctacttctatgtgaagttgatatgaagtcaagaatgtgtatgtttaactagttttagaataacaatcaatgaaacagtaaaagcagtagacaattcatattacagaactgtaatctgaaattctcattgcaggtcctgtagtacatttacacacgttacctgtaggaaaattgagcggtgcagcaatgctaactgatttatacaaggtctcttgtcaggcagaatagaattattctcattctcctttcggacatgtaatattgtataatcatctcttttaatgacttaatctcaaggtatttatgaacaacatactcttatttcaatctaggcattatttttgtatagtcggttccatattattgccataactgtcattataaccaactcttaacttcatttaagtgaaataaaattggatgttatgattttagttactcaaaaagatacaatagaacatacaataaaggttgcaataattgtcacttaacaaggcttacaagcattatctgtgatttgtatgaattatgctaatagaatgccacaaggttaaagaagcttacgatggacattagagaataatagttacgttccaccttatttggcaggactgagtaaagaatgtgaattgtcaacattttgagaaacattagtgggacactgtaattcaaagagaaaagaataagggattgagt

SEQ ID NO: 34346 - DNA, 1031 bp, Homo sapiens
gcacatcctgcattcatttttattagttttaatatatggatagactgcagtaaatattattactagaaatctgtggcttgcttgctttctccaaaggatctggaaactaatagatttctcacatgcatttaaaagattgctgaacaagaattaacgttaacttttgtgtctgcttgtgggctaaacaacaattattgcacatttttatttctggaattcatcatttctcatcttttatttgttattatgcttaaaacctgacccctgttttaggacagaaactacctcttgggcgtcatcagtgatttcatataatctacctttaccccatgttcatgctgtgggatctttctacttggccagaatttctattagaaatctgatagttaacaggcattggcattctaaggaataaagaaagatgactgtccttcttgaagagtacatctgttattagtggtagggataatgttccttaattgtacttctgttgggttactaacaatgtctacatagattagagatctcagagtcaagatgtccaaaatcaaagacctcttttccaattatttttcttccttctttcctcattgtattgattaataccaccgttccttgcattcctgggcaaaagtacaatgagaatagagacatcctgttctgcagacggagaatggtgtcagaacaagatgaagttcctaagatacagacaccataatataatattgtaaaagtcacaaaatcctaagtagaaaaacagaacaaaaaagggtagacaggagaaagaaagttctaattgaagggcatggtgatacatatacatttatgaagaataacttttaaattccaaatatagtaaaaatcaaacacatccatacaacaatcatgtgggaagaatacttgtagaatgttgctattctatcctttttgcagatctcattgcagatgaaggaattattgtccaaagtgttttgttttcctgaatggttttcctgtcatttatgaggagactttaagctataatgctgagt

SEQ ID NO: 34347 - DNA, 1018 bp, Homo sapiens
tcacaatgcattctgtatgtcactgctatactcacctttcctaagaacgtctcagttacctccagtagccctaaataaagcaacctaaagtcctacctgcacactgtgacattaaggcccaccaagccctgactctagagtacttttctcaccttaactctcaatatttctcaaaaacacatagtgatttccttgtgtacaattatatctcacatggaaattcacctttgcttgtatttgcatggcattttcttgtctattcagtcagttttacatcagatcttctttctgtctaaaaacaatttgtacacatgggtctcaatccacatcctattcagctttttagacccatatacaagtgtctgtatgtagctcccttaatgcatttagacaggacttttttcttctctgctttacatttactatagcttaatagatgtttactagaatatgccttaagatctaggtatttttatgcatatctttctcccaatataattaagaactgtggcagtattgtcttggaaattataccatatatcaagtaaatatttcagaagggaaggcagaggaaaacctaaagtcaggcaattacatgaccacttaaacctgctttataaatgttgagaactgtctatggcacatagtgtattaggaagcatccagcacaggaggatgatgtaggctgggaggctagacccatctcacctttttcatgtctttctgcttgctttatattcactggaagctgattagattgtgcccatcagactaagagtggatctgccctccccagcccactgactcaaatgttaatctcttttggtcaacacccacacggacacactcagggttagtactttgtgtccctcaatccaatcaagttgacactcagtattaaccatcacagtgagcacttgataaattttagctattttcttatattgtaattaaaaccaatttagacacatcttcagaaacaatcagccctgtgattctatttccttttaagttcatt

SEQ ID NO: 34348 - DNA, 1319 bp, Homo sapiens
caaattcgctacatgaagatctctaggtggttgattgaactgatttgaagaagtttgaggtgtaagggagaaatatttaacattctgacaactctttccaataaatactcactatacatgtttctctatttgtagataagctttaggtaggtgatggggtaaaatttgaagaaccagctttgggtcaatccctcagcaagtcctgaataaattatcaagatatttatcaccaattgttcccatttctgtgcctcagttcaaaatgaaatgacaggggacatatcttttaatatcctatcacatatatttcatgtatacgctgtctacatggcaaatgtatcttctgtttgctttcttgttttttgtttgtttgtttgtttaatatcatctaatcctttatgaaggcatttcagcattgaactgaattgccttcctgtgcctcaggaaaaaatttaggcacctattggagctgaattatcttagactataaatctctgaatccttattgagcagaactataatcaggtgaagtacttaccgaaccattcagacacaaaaatatttatcttggttgataagaaatttaaaaacaaaattgatgatcataagtatgtagtgcagcagaatatattacaaaaaagaaaaggagaaagattttatataaggcttctctgagatgtagtagaagaactccctctttttttgtttgtataactgagatttgaaaaatgtccatagtgcaagctgataggtttcaactagttctcaattatgaaggaagtttttaaattctgaatttttgtaggactctaaacagagagaaactggagagccaagggacgagaagtcaaagttcaaaagtgtgaccaaaattaagaaatattacaggtatattaaaattaaacagattatcaaattctgagtgtagaaaaaaggttaggtctgtttgagtaaacacatgtttacttaaattattttatatataccaaatatttatagattgagtctaaattccaagaaagccactcttcagacaaatttgaagatgttgccatcatacaaaagattttacataatctttaaacaaaagcatatagtcatacataaaaaagctttcttttttttttaagatggagtttcgctcttgttacccaggctggagtgcaatggcgcaatctcggctcaccacaacctccacatcccgggttcaagcgattctcctgcctcagccttccaagtagctgggattacaggcatgcaccaccacacctggcttattttgtatttttagtagaaatggggtttctccatgttggtca

SEQ ID NO: 34349 - DNA, 1542 bp, Homo sapiens
ttttggcagtatggtcattttcacaatattgattctacccattccatttgtgtcatctgtgaaatatttcagcagtattttgtagttttccttggagaagtctttcacctccttgattaggtatattcctaagtattttattttaatttttttgcagctattgtaaagagttgagttcttgatttgattctcagcttggtcgctgttggtatatagaaaagctacggatttatgtacattaattttgtatccagaaactttgctgaattcttttatcatttctaggagctttctggaggagtctttagggttttctaggtaaacaatcatatcatcagcaaacagtgactgtttgacttcctctttactgatttgcttgccctttatttctttctcttgtctgattgctctggctaggacttccagtatgatgttgaagaggagtagtgagagtgggcatcctcatcttgttccagttctcagagggaatgctttcaacttttcctcattcagtattatgttggctgtgggtttgtcatagatgacttttattacattgaggtacgtcccttgtatgtcaattttgatgagagttttaatcataaaaagatactgttttttgttaaatgcttttactgcatctattgagatgatcatgtgatttttattgtggatgctgtttatgtggtgtatcacatttattgatttgcatatgttaaaccatccctgcatccctggtatgaaacccacttgatcatggtggattatcttttaggtatgttgttggatttggttagctagtattttgttaaggattttagcatttatgtttatcagtgatattggtctgtagctttcttttttggttatgtcctttcctggttttggtattagggtgccactggcttcatagaatgatttgtggggggttcccgctttctctatcttgtggaatagtgtgaagatgattggtgccaattcttctttcagtgtctggtagaattctgctgtgaatccgtctggtcctggatttttttttattggtaatttttaaattacttcaatctcactgcttgttacaggtctgtttagggtatctaattcttcctgatttaagctaggagggttgtatcttttttggaatttatccatctcttctaggtttttaaatttatgtgcataaaagtgttcacagtagccttgaatgatcttttgtatttttgtggtgtcagttgtaatatctcccattttgtttcttattcagcttatttggattttctgtcagtctctctttttttttggttaatcttgctcatggcctatcaatttatttatcttttcaaagaaccagttttttgtttcatttaccttttgtattttttgatgtcacttgaatttatttagttctgctttgatatggttagttcctttcttttgctgggtttgggtttggtttgttcttgtttctctagttccttgaggtatgaccttagattgtctgtctgtgccctttcagactttttgatgtagacatttaggtct

SEQ ID NO: 34350 - DNA, 1051 bp, Homo sapiens
tatatgataactagtttctcatgtttggagtacctataatttatatgtaataagtttttacataattttatgtatttattggtagtgcaagttttgggaaaactgatagattgaaaattccttgctaaatcgccctcagctgctttcactaactgcttgagttgctctttagtggttcatatcacaacagcagaaactcttgagtaggacccttccatagagccaggcaaggtcatttgtaagtgtaagtgctggaggtatctatgggtaatggatgcttaaagtgtgtacgaatgaacttaatgtgattacactaataatggaaaaaagcatattggtaaactattatttcagaaaatcaatttgtacttccatagtttaaaatcttttcattattcttactacattcaccattttcaatactactaaacttgtatttttctctaggaattttatctcaatttactcttgctgacattttaaaactcattaattttgagatcaatcacattttactcttcaaacctatgtattttacatacttttaatttatatatgctattttatattaaaattttaatgcaatttatgtaatataaaaagtagatttatacaatttaaatgtatatcacatttccttatccttataaaattataaatgacatcttacacactaggttaaaaattttgtgaagaaccaaagaaagtataccggttagaaacatttgggaaaatattttgcatattttttaggctaaaacggaatcatttaattatagatatttaaaagtgcaataaaatattagcttccatatttatataaattccagaaaaaatagttcctggaataaagatttaattaaagtattttacaaattttgaactttgtcatttagaatctccttaagaaaataatttgtctaaaaataatgagatcatttcatatacttgcttatttcacatacaagtaacatatttcctaataaccatgtttaaaaaaatagttggccatgtgtaattccagcactttcagaggcaaggtgggcagatg

SEQ ID NO: 34351 - DNA, 1055 bp, Homo sapiens
aataaagctaagttacttattattgaggaaaacctaaatgaaaaatagggaaataggatgaagtctattaaagagattatccatgaggagggagacctcatcttctgagacaagaataaaagatacaatggtggactcagaggtaaagtaattataagtcttggtgaatgtgtgtggtggatagggaggtatgactattctttctcaaagtaagtggtaatttaactattggggaaagggagatgcttgatattttgaggacattgataaagtctaagccaagccacctttttttttttgaataattactgaaccattccttttctttagcaagtaccattacttgaatataattgactctactaaaagtcttcatatatttataataatcattgttaaatcaaaattattttctaaaaatatctaggctaccataacataaataacatatcacaatattttcaaagacagttatcatttagcttattcatataataattatcccgttaacttttttattttctgaggtgataaatctacctattttcattaagattttatgcaagcataatttatactacatataacaagtttttttcaactcacaatgaccttttaaaattgttaataagagtatataaggggttttagaaaactccttggcttgtaggtgtgagagaaagtcacatttattattactagaagcagtgttctgttggcatattacaatgtggcagacaatccttcaacaattaattaccagtaaagtaattatagaatatcctttgatgtttataatgttttaattgaagtaaaaatgtgagaatatgcttcaggggaatataatattttaattatttatgggccaagatatctatatactttgactagagtgcatttctctattctgtggcatctctgttataatagaacatttgtagactaaaaaaatagggtgttttccccccacagcgtattacagtgaatgtagtctactttataatcctcagggttcttttaacttgacgtgaatcaaacaccttaaggaaacagaa

SEQ ID NO: 34352 - DNA, 1034 bp, Homo sapiens
tgagcaactataaacctttaagcaaacatcactttttgatgagctggagaaaaattaccatgtgctgataactctttggagaatgaagaattaatgaattgactttgttttacattctctttaaagtttcctaaatactatcttgtgttatattatttgtaaagcacctttatttttacaatacatgataaataattgttaaagaaaagatgcacttatatgtgaaaacctaagtttgcagtttttttaagaaggttttgaaaaaaaaaagcacaatggaaaaagtttaccatgctccttcttgaaaaagataaggatttgttaaaacctcaataaaaataaaatctacctgatcctttgctcaacttgttatacaatgttagcagtactgttatatagtccacaactaccatataaatagtagctcttttaaaaaataataatagtgaagtaaacttctagtgaatcaatttaccaaaaaagaaatgcttttgtgctgaataataaatcatagccattcatgatctcctgattaaccatttgtgtatggctctaatgacatagacaaatgacttgaagttacggtctgtagattttgtatcccaaagctacaacaatgttgagtatccttgaaacagattgaatacggataacaatgcaaagcaaaacaaataaggctgaatcctatgtgccattattataaaaccatcaatcagtggtcagatgcagtgtgttctcttagttaacaagaagttttctgtttttgcgatatgcattctctcaaaaaaggtcttcacctggggaggactaggagcgtatctattttaataaagagagcatccagatttgatatcaaaactactgacagatctctttgcttgaaatgctcgacatgggttggctattcaattatgaacgctgttaagaggaagtactccaagtggaattccctgccgtttggttgaaacagcagaagttctgataaaacattaataatatgcccttggctatctcaactactttgcccctagatg

SEQ ID NO: 34353 - DNA, 1004 bp, Homo sapiens
agttaacctctctattcttcattagctatatatacatacattagacacgcacatacatacagatattcatatatatgtatatattctctgatgttatcatcaaaggatatatatctgtatttcttatatatttatgtataaatgtatttgtacatttataaatttattttcatatttatatttataaataagatatatatctatatgcatgttttaatttacttcattaattattttaatccttgaaagtacactttctctttataaatacaggtatacatacatacacacacatatgtacacatacacatatatacacaaacatctagatttttgttttatcatatatatgtatatatgtacatatgtgtgtgcatatatgtatacctgtatttataaagagaaagtgtactttcaaggattaaaataattaatgaagtaaattaattaaacttggctgttaaagatactggagaatggaaagacgtaaacaggtacatggatatatgtgcatgtgtatatatgtgtgtatatgtatgtataactgtataaagagagagaaagcatactttgaaaaattaaaataattaatgaagtaaattaataaaataataaaattacttagtatatttcctggcatatagtaagtacatgataaatattaactggtatatgtcatacttttagacaagaccaactttgaagatagagattaacatatacagagatagagattaccatccatctaacatgtagatataaatttacatcaataatcaacctggccccacaaacccttgatcttgaaactcaaactctccatcttgaaacttccatcttacttggccattgaggaatagagtgagttccttcactgtagatgtggtaagaaactctttctttagccaagataattgaaatttatcataactaatttaggttatgagatgaatagaaaatgtacagactgtattcttacaacatacatataaacacccagacat

SEQ ID NO: 34354 - DNA, 1045 bp, Homo sapiens
tcagacaaacagtataacaacacactcaccactagcatataccccttttgcattgtttatgtttatgattttcccattgtggctgcattgctgctcccgtgaaatcatccgaactgccatggccaggatttagtcttaggtcttcacatacattttagttacttaatgttcttgaaaacctacaaacaaactggttaaacaagcaaagaaataacagacgtaaaaggagaacgtttgcttttagttaatgttttcaagatttatttattcatttaaatcaattattaattgagtgcgtactaagcacaggaatataacagggatataagaccccgcattgaagttgcattccagtgtgggaaacataacagaatgaataaaatgaaaattcaagacaggaaagggataagcaagataaagacgatgattaatatttgaagaaaataaaacatcagtaaggataattggaaaagacgctttctctaagaaggcagcatttttactgaaagaccagacttgaaaagatacaaccaaaatgataagaagtatcaaatcccaaaggcagagaagtcttaatgtgatcaaggagcagaaagggtagtgtagacagtggcttggctgcaaagaaaaaggtggaatatcttcatttggaaagacaggagaaggtcacattcttcaggaccattatagctcctaataaagagctgggattttactttacatgcaatgagaattaagtgaaggaactgaaagtggaatagcgtgaaattatttgaatcacatttttatattatcactttatgtgctgcctaggggatggatgaggaagacccagaggaaaattccagaggtgatgggttctggaagtaaaaattgatagggaagatgaagaaatgcatacatattcaagatctcgctaaagggtaagctttgggtgagaaacaaatgagaaagcaaagccatagatggttctatcattaatggtgatatagaaaaccttagaatccagtacatagaaggtggagttcaagagctccatttgagc

SEQ ID NO: 34355 - DNA, 1071 bp, Homo sapiens
gggaagaggagtaaatgaaggaggaagcttctcaaaaaagctagaaggaacttcagagtgtatgaaaaatttgattttttttttttttttttttgagatggagcctccctttgtcacccaggctggagtgcagtggcacgatctcgactcactgtagcctctgcctcccaggttcaagtgattctcctgccatagcctcacgagtagctgggattacaggcacgtgcgggctaattttttgtatttttagtagagacggggttttgccatgttggccaggctgatctcaaactcctgaccttaagtgatccacctgcctaggcctctcaaagtgctgagattacagacgtgagccactgcacctggccgaaaaatttgatttttaaagcagtaagatgaaattaacaaaatcagcaaaataattttgcttttaaagtatgcttcttatattaatagttttgctctagtatagaggaaagaaagcacaaagatgtagaaataaactactatgtggatttgaatttgaactcgaccctatatgttctgtgtgagtgaggcccttcacttacctgctttatagatgagtgataatgcttgtaaattaagtagcatgtaatagagactaaacaagttaaaggggttctccagttagcactgaatttgtagttgtcctaacagtagtatttcctgagtttcacactcctgagcacacattttcttgatgtagtgttttaagaaatattaatagaatcttccaaaaaatcctactaaatttcatagaatgatttatgtaacacgttctagtttctttgctagaaggaaatatttctattgctttattaacaggtgaaatcttaagttggtataatttgccatatttgtgaagtgacagtttataagatactgcaaggtaccatattttgtgtgcctaaaaatgcttaactatatcaattgacaactatgaaaactgagcaaaagccatagcattttgattaagcagttttttggtaaaaacactgttctgtgatgcaagaatatagatcaaccaaacgtggttctatttagagtttg

SEQ ID NO: 34356 - DNA, 1026 bp, Homo sapiens
ataattccttcactgttgatgtttttcggcggggggagaagagtattttctggaactcctattagacttccttagaactttttaatcattatcatattttttggtcctaaacaccttgatcacatcttcctttactaatctttcctccacttactctggctttctgctgttccaaaaatacatgatgtgtattcccaccaagtcttaaatgaaaaacatttctcaaaatatacccttggctcaatatctctctccttttgatactgacctaccttgacctattttttttttcttttgaggctttctgaccaatttcctcactttttttatactccacatgtacttttttcatttatttctgtttttgttacattatttcttgtcttgtataacacattatttcattgttaccctttattttaaacatacttatttcaaattcatttaaaactgatctgccacttcttacaaatcttgaatgatttcattttctaattgttgatttttttttgttgggggaggtgtctttaacattagcctttttatttgtttttaatttttggtttgcaggcttatgtttaattaaattctctctctgctcagccctgcaagtattagagtctaggattctttcatttgtctttaactaaatatacagggccccatttcataatcacggtcctatgttagcaggttggggctttagttactcctcttctggggctcagttgtagtagggcacattattctgcaggatgaatatgactcattggctctgcctccctttgctttcaaaccatgttgcattttgagtgtatttttatagaaaatttttttaattttttaatattattttaacccataatctgttgacttggtaacaccatggaggatggtatcaagcatgacatcatcacgttatcttggcctaaaatttatttgattaatattttcatttaatgccagccatgagtcagggtcactctcccaggcactgaactatacaaatttgcagatttcagagca

SEQ ID NO: 34357 - DNA, 1043 bp, Homo sapiens
cccaagatccagtcaccttctaccacgccccagttccaacattggggattacaatttgacaggagatttgggtggggacacagatccaaaccatatcaggaagaaaggagtaagcaagatgaatgcagagaaagtggaacagagcatgtaagaagagccagtgttatagaacaataggaggaagtaggcttaaaaaaactaaaatgtagagaaataggaaattaataattgttttacagatgccaaagaggcaaagtttaaaactaggagttgctggatatcaaaagctacaaaaaaggctgcagagaatgacacgaggaaattgcgtgactgtatcagtcattagggagttatcagttttatatgaaatctgtaattcttatcacaacataagatcataaagcagaaatggtaaaatcacaaacgtaacatctatagaattaccataagcctggagttcctatctttatatttaaatgtataattgagcttaatgatagatgaaatttgaacatgcaacctcagtgaatacagaatgttattgatctgattaaagtttaaaaacctgtcaccatgatgtagagatttccattaaatgtaagacccccagaaatgatgtagaaatgcaaatgatacagagcgcatgattcttgaacgatgttgtcttttttaaaaatatatttcttttaaaattcatcccctgaggtgctcactggtataattttttttttttttttttttttgagacggagtctggctgtctcccaggctggagtgcagtgacgcaatctcggctcactgcaagctccaactcccgggttcacgccattctcctgactcagcctcccgagtagctggcaggtgcccgccaccatgcccggataattttttgtatttttagtagagacggggtttcaccgtgttagccgggatggtctcaatcttctgatctcgtgatccacccgcctcggtctcccaaagtgctgggattacaggcgtgagccaccgcgccgggcctaccttttttaaatttttatttattt

SEQ ID NO: 34358 - DNA, 1024 bp, Homo sapiens
tcagtgtagctgatttgtctgagagaaatttaagtgagagtcaagtgtaataattgtagaaatacaatttcacaggaaacaatgaaaagctttggtttgcttttgtatcctcccaggctaacaagacatactcaggatttttttaagtggataataacctacaaagtttgcccatttttcttaatgatatctttcctttcgtatgattaaaaagatatggattccgtgcctgtttgcaagtgagaacaagatcatttaaattaacctcaataattagaaatattttggtaaaaatcctcctcaaattatcactatagtaataacaacttcaaaatgtattgcttcacataaatttctacaaaaaaaaaaatcctggattttagtgtatggccagaaattacaaatatctttgaaaaagtacttatttgaactgagtttatttggtttttttagaggcaattcattctgtcaacacttattgaatcataatacatataaagaaatatataatcctgtgcacttttctagaagtagaaaccaataaaaacttattaaattacatttattttattgtaattatgtcatttaggtcaaaacttacaccttctaggccaaagctgaatttaaatatatgaacatagaattattttatttattcagactgaaaatctttggtaagcagtaaagtaggccctcagatgtgaagaagaaaaggcttctatgcccatggagcttctgtactattaggagttagcagcaatttccaaatagggtggtaggtaagagatggggacaagcactttcaatatctgtaaattgttaatttttaaatgaaaagtaattagttagctgcagctgtgtattttttataattaactgcatctatgtattttgtaagaaagttctcaaccattggagtattatgaggagcaaaaaaacacaggaaagatccttgcttacgtttaagtataggtcatttgccaaaatatgcatgtgcatgagtgaagtagcataatgctagctg

SEQ ID NO: 34359 - DNA, 1093 bp, Homo sapiens
tagatgcattagttccagacattaattaaggtttgtgtcataattttcatcaaaagtattttatgcacatgtcttcaatctgttccatttttctacttatattcttcattgtatagtcttcatgcatgatcaattgtgtttctaagacacatggcaagatttgtagcgttacgtaggctatttgatttattaatatttagaccagtgagaccaccgctcagttctaacagcttgcctcggtttgtgtgaaaagtcatgctctaaactcaaattaactctgtagtttaatctgccacaaaatcacctcctgtgaggtatcaaataaatgttttacaccatgctgtgtgtgtgttttaaatacatcctcatgaatctgttcaatttactatgttatctatttagtagaacactttctgaagtttttattccatttttcaaagtttcatctgggtgtaatccattgtcattggtatgaataagcagcctagactcagggatctgagtaagttaatagagatcatgaataggacacgagcctgcgatatgttagagatgactctagaatgtgggaaccggcacgccggaaggaaagaagatgtatgtagaagtactcctagcactaaacccaatgtttcagcttagccttgtagcattattagcacaatggaatctttaatattagcaagctccaacaaaatattttagagaaatactcaaccataagaaaagattcattgtaacccagggaaatcgtcactgtgacccccccccccccccaatatctcttttactgaagtcccacaggaatcatcttctagatcccttacagtcactgcaggaggtctgggtcttcctgtcctgaggcctgtgttggctctggtgtcactctctgacacacacccttctttgcttggaggctttctcttgtgtcttgctcgtgttgtacatggatctgctgccttttttgctcactcgagtcttccaggtcttccagactcctgtcttctccctccacagcactactctgtattccatacacctcacttccagaaggtgaaggaagaaaatccctcacacacttttgcctgcccat

SEQ ID NO: 34360 - DNA, 1049 bp, Homo sapiens
gtcactttttggaccagctatgtctcagcactttttttttttttctggagacaggctcttgatatgtttcccaggctggtctcaaactcctgggctcaagtgggcctcctgcctcagctcccgccccagcctcctgtatctcagcttcaatatacataaatcctcaaataactgtgagcttattgactctcctgtcagaaaattgaattgctttttagatgttggtttatttcaaatatctttgtagatgtagtggtttcatttctaaagattaattgaaaactagtcacaagtttgatttgcatactttaatacatgtctgcccctattgattatctactgctttggtcagataagtcataagtcatttgttttctattcccaccaacactgtttgacctcagatctttgttttataatctctttgtgtcctattctctcatatctgcttcttaaattccttaatccctcctacagataattcttacagaactacataaatgaagcctaaaacctttgcctgctttacaaagacgtctagtacttatgctgaatttatttccctgctcttttaaactgcttctaatgccttgaacacttgagcgttcccctggaatttttttcttcactgtctgacctttgaaaccctatgtatccatgtaagttgagatcaaattccatcttctccttgtatcccttctctgatcactgtgaagtgttcatattctgtttatctctaagagaagtcaagagtgatccctgcaggctgacatcccagagagagagatggtgttccgcggagaccaaggttctgttttacaacactacggtggggtcccagtccccgatcacctgattatgaagctaaacgtccccatgatccagagggtccctccctggagtttaacatctgactcaaaggtccatatatgtcccactaaattctgtttttaaggctttcagtgggctggctggtcatttgcttttgtttgcccaacaacttcatattgccaaatattataggtttgcagactcgagatatccagggt

SEQ ID NO: 34361 - DNA, 1032 bp, Homo sapiens
tggtaatggctagagacatttttgctgtcagtgggagatgtactgctggcctgtagtgaggagaaaccagagatgctgctaagtgaacaggacaggactacaataattatctgctccaaatatcaattctgctgctgctgagaaacagccaatcatgtagctaatggggctgtttagaaggagaagtctgcggtggaattcccttgtaggaggccattgctatggttcaagtgaaaaaaaaattaaaaccagaactaagggactgaaagtatttaggagagacaatggaaaggtactcgagaatactcaagtttgtggcttattcagtacagattctgagatagaaagaaaactcaagcatgactgaactcttcaaacttgggtaactcagagtggttggggagctaatcaagtcaaggaagttacataagcttaatttataagacgctgagtttgcaatttctatgggttcttcagatggagatagatggcaggcaattagacatatagaccttggactctggaaaacagtttgttgattcagtcaaatattaaacatttactgtgagttttgatccaggcatgtggaatcatacaacagtaaataagacataccaggcgccctccttgaactccccacagttcttagtcaggaaaatagataaatgaagttataggtctatgggtagtatttgtcatttttcctaataaattagtaacactatttaaaataatattaacatgggatgatagtggtgtcgtgaaacaaaaactcaatctcatacatttttcatggaagcattgcctagtataacatcttcaaattgtaatttatcaatatgtttgaggtcctcatcttttaaccaagtcattcaagttctaggaagtaatcagagatggattaaaactttcatttaagaccagctgcaatgtcttatacctgtaatcccagtgctttgggaggttgaggcaggaggagcctgggcaacatggcaacaccccatctctatataatttgtttttaaattagct

SEQ ID NO: 34362 - DNA, 1044 bp, Homo sapiens
gtcttattctgtcacagcttcccacccctggcctaatctgcatttcattaactctccaaggactagaatcacctttgaaagatatgaatccaatcctgttgctctcctgcttcaatttcttttctggcttcctgctaaacttaacatcatgtgcagcccatcttccctgtctttaatgccttgcatgtatccctaaccaacttctctaacattgtgttcctacactctccctccaaccttctggccacattagcctgcagatacattttcggatatgcataggatggtcttttctgcctccaggcttttaaatttgcctttccatgtgcctagactgctttttccttggttttttacatgactgcttcctttccatactttgggtttttctctcaatattatctccttagaaagccttagaaattaccttcttaaccaatacatttaaaagcattttttttattccagtgctgtttatttttttctgtcattgattgaaaattatgaattttatgattatttattagtttatttgtttaatgcctttcttgacctctagaatgtcatttccattagggaaggaacattgtttcatacaaaattgtatgtgtgtggtacctacaacaatatataaccctatcagatataaggttgctctttttccaataaaccataacaatggatgtaaaataactgaataggacatattagaacatcaggagttatatactgaatttgataatattatctttagttgaccatatggtacagatttctcttggcttctgtcaaataaatgaggatatgaattctaattctataacttacaaacctgtatcagattggaagtgattcaaagtattagaataacctggagtactctcatacaattaattcatattacaaataattgtatttgtattttgatgatgaaacagcaattattgatcttgaacacggcactgattttaacagagttttattcaaaacctgaagagagcttggctcctctctctgtgatttaacatcaaacagtttgcattg

SEQ ID NO: 34363 - DNA, 1055 bp, Homo sapiens
ttaaacaattgattgtcctataaaagatattgtgattatttggcataaatataacatttgtcccaatacatgtaggacaaatcagaaatggagatatcatccaagttaaatgacctcagatattattttcattactctaaatttatgatatttgggtacagtaattaaatgcttatttccagtgtataccttactggccagctctctgcttattgggttgtctcccaggccattccatcacagaccaaatatcaagaatatcaagtcttctttgttatcttaatcacttgttctttcaagtttggataaggtatatcaggatcaaaattccattttgcctcttttggtttttcaaagattgtcagaattccgaaagtgaccatgttttaaaattatacttcatctatgtattgtatctttattgaatgtaaaaaaaaattcctgaaacagaaattttttaccatgtcattattgacattagacatcattgtcatcatcaacattattaaatacattttctagaacaggttttgggggaatcagtatggtcaaagtggtgaaaaaggggaataaaatgaggtagaactcataaaggatttattttatttaagaaggtcggcataaacataaaacaggaaataagcatgcaaatgagtctacatccaccgtcaaatgaggtgctagtgagtagtaatgtgaatccagaggaggaacattcactgaacaacacaatgcttagtgaagggctttagaaggacgagactcagcatgggctcttgggcctctcaccaaattcaacctgagagatgccaaaacaaagaaaataaagttgaggggccgagcttggtggctcacgcctgtaatcccaacactttgcgaggccgaggtggacggatcacttgaggtcaagagtttaagaccagccgggccaacatggtgaaaccctgtctttactaaaaatataaaaattagctgggagtggtggcccgtggttccagctacttgggaggctgaagcaggagaatcgcttgaacccaggaggcgaaggtggcagt

SEQ ID NO: 34364 - DNA, 1058 bp, Homo sapiens
aatggttcctttctttaactgtctgggaattgtcctaataagaaggaggtgccatccattcctagttggaactttgactcgtactgcagtttatacgtggttttattgcctgcttctgattttgctctacaatgtgtcttgaacatccttgcttgttgttcggtatcatttttatcacattctaacagcttcaggctacacgtgtaccacagttgaacattcatcttgttttctagttttccctcttagtgataatgtcataaggagaacctctgtacatatgtacaacctctattagtcccttcagataagttcccagaggtgaactaatggaagtatttccaagtggtattttattattcatgctgcagatttattatcaaagaaacactctaccattctttagctgtgctatctccgtgttccctcaagcagttctgcagtcactttgaaagtcctactgcttgaaaatgtgagacactggatctccaggctcaaggatttcctccatttatgttccaggctttgtttacgtgtttggattgcctacttctgattttgctctgcaatatgtcttgaacatccttgcatgttgctcagtatgaatttaacacattctagcagcttcacgctacacaggatccatcataagatcatcaacctacttttctttcttttttaatttttttttttttaagatggagttttgctttgtcacccaggctggagtgcagtggcatgatctcagttcactgcaacctcctcctcctgagttcaagagattctccagcctcagcctcccgagtagctgggattacaggcacgcaccaccaccaccatgcccggcaatttttttttttttttttcagacagaggctcagtctgttgcccaggctggagtgcagtggcgtgatcttggctcactgcaactgccacttcccaggttcaagtgattctcctgcctcagcctcccagtagctgggattataggcatgcaccaccacacctggctaattcttttatttttagtagaaatggggttttgctatgttggccag

SEQ ID NO: 34365 - DNA, 1024 bp, Homo sapiens
taaataagtataaattctggttaactatcttaagttaaatagctaaaacacacaggagagagttctcattatcttagtcttctaaattttgagccagtggctttaagaaatagtagggggaaagtggttaaaacgaaaacatgtatccctgaagtcagtctttgagacagagtgttgaaagctggcaagcaattttttcagaacattctctgtgttgtcattatgttttcttgtggagaatgtgttttccacacctctcagcagaatcactgtaattcaatgaacaggtaagttgaattatggatgttgaagccacatcttgctaaagggaaccacagtcctaacaactccttgaacaaaatgctagggctgctcaatagaatagaattcccatgttacccatttttttatgactctccactgtactgggatgtaggcaggaatcacgtctctagatcacttgaaagtaatgagggacagcttgagaaatattaaatttttatcactttcaattctctgctactacttttaacaattaatttgtatttgtgtgtaatactgattcctctttatgcccttaatgtttttattaaaacataatgtgctcataaacacagagactaaatctttttgcttttactaatttaatttttaacaaatgttgtgcataaataggaacttcttaaaccctcgtgattgttattaaacttgtcagcattaattgaatgtactctttcttcctttgaacttgaaaacacattcaaactgtctttcatgaggcttaacgcagtctgcttggtattacagttatttgggaatagcctttcctacagtataacaccaactatctaagttctgcaccaactacctggctcgtttttgtcaaatacacagtcagtactgattgaatgataagtaattgttgccaaacagaattcactaccaacctaaaccatggacttacacattctgtaatacctccttaaactaactctagctctgcagcatagataaacattcctag

SEQ ID NO: 34366 - DNA, 1003 bp, Homo sapiens
ttgatataatacgtacatttctcaaagttctatcaaacatcatttgtttagaaggctcacttatgtgactactggtttccttctgtattaatagaataaaattttcctacttgaaattacttcatgtaaacctagaaaggaaagaacattgttcttgaaaaattggacaaagtgacagtagtttggcatttttaatgatgtgtatgagacaataaaaactttaagttgatattttctattttattctcttaatcatttgctttttaattcattcattcaacaactatttatgtaatgcctgccatatgccaggtattgttttgggcaatgaagataccacaaaacacaggaaaaacagccgtgtttttgtggaactttcattctagtgagtaacacagacaatgaataagtgtaagcctataaataagaaataaaacatactgagtgcttagtaatacaaagaaaaagaaagttggttaaagggataggaaatgttgggaatacattttggagtcaggaaagtcctctctgataaatgttataaagtatgtgaaagggattgctcttaacgaatctgaaagaaagatcttgagaaggaggaaagccttttggagaaactaaaagacctgctgatttcagaaactaaggcacaaggtgaggtcaggaagctacccagggatcaggacatacagcaccttctaggtcatggtaaagttttgaatttttttttttttcttattgggatgagaagtcattggaagataaaaggcatgggagtgatatagcatgactttagaagaagagttttgctgttgcctattgaataaggagactggttagagacatgggttttgaaacagtgacatgagggagaatatatttctttaattcagggagaagttcacaatgtctactgatgtggtggtggtagatgtggcaatggttaggagaggtcagaaggccaaaatgctttttgagggattcaatattgagggtagaaaaa

SEQ ID NO: 34367 - DNA, 1103 bp, Homo sapiens
ttcttcaatgggaagagaacaagtagagtgtcagctcacagaagccgtcctagaagaatttcatgcttcagctgttagagtaggaagaactttaaaaactttaactttgttaaacacaaggttattgctgactattgaaagtcttcaaaacatcaaaatgcaaagggttaatgggtaagtgagagactttacttaagataaagaaacatactttatcttgctctcaatggtaaaactcaggcgcgttagaatggtggttccatgtatatggttggtatgaagatgagaaattacagggttcaatgataggttgattttcaccgtattcatttggtgggggaaactgtttcacctcatcgattttttagtgctaaacaagtcatgttctcctgttcattagggattgcttcattgcttttcaattcgttttttcatcagtttgccacttctatgtgttagggctgtgcttcatagtgagtgcaattcccaactattgatggatgtgacatgcccactctaaaatatgaaagagtacaaaatgcagcatcatcatgggaaacacagatgcaaattcattggagtagactgaatggttgtttagtttcactgtatttatcaaagttcttgaagaatcgttcttacgtcaagataggaaataacaataaatattaaggaaataaagatctatacttcacgcatttatttgtatacaatagaagaataagtacacatcccttagctgactcttaacaagttttattgggcatgtatattctactttattgcataaccataaaatagctcaaggaaaagtaaatgagctaattctgcactatttactaagggaaacttctcatcaaatttattgggagttttgcctgagaaaatactaaataatcaggtattttttttcccctagactattcacatagcagtacagaaagtagtttttcaatgtttaagtgctactgtatttctgcatgaaaagtcacctctttcacaactgctatgtaacttatgatgtgaattatggcttcaacttactgctattaactccacttgaaggatcagagtgttgtgatcagctagctttttttattgtt

SEQ ID NO: 34368 - DNA, 1189 bp, Homo sapiens
aaagaaaaccagattggccacgagtgattattattcatgttaggtgatgggtgcacagagttcagggttcattactattctttctacctttataaatgtttgaagtctttgataatttaaaaatctctttaaagagaagtgcatagtatgtttctttttgattcaactttttatgtaacagaatcctttttgaaacaaagccccagctcatcctcccaaccctttcagatgaacactttctactttatagtggaggggccatgcacagcgttaggaattgctgtcacttcacttgatgaaggtccaaaagccagtctagtaaaacccctgggaatactgttgagtgatttctaacatgttagaagcctggaaatgttggctacacctcaagctcatttatctgtaaagctttacttctgtgatttatcattgtcatttacttccttttacatttgctcctagaaaaatgatgttggtggtgataatgtactaatggttccatgtaatctagaaactttgacttaatagtcacaacagctctatgaggcaggtgctatcatgatatccattttgcagatgaagaaactgtagtgtggagaagtgcctggggttggccacacagcccacatgtaacagagctggggtttgaatccgtgcggtcacatagtattcaaccaagtgaccctccaaggtactttctcaataatagagggtcaggcaaaggaaaatggctcacacttgtaatcacagcactttgggaggctgaggcaggaggatcgcttgagttttgagaccagtctgggcaacatagagacccgtgtgtgtgtgtgtgtgtgtgtgtgtgtgtgtttgtctataagccaggcactgtggcccacctgtagtcccagctactcaggaggctgagacgggaggatcacttgagcccaggagatggagtctgtagtgacctatgttcgtgccactgcactccagcctgggtgacggagagacagtctgtctctaaaataaataataataataataggttaactttccaaactatgtttatgttaccaaattcctctttaaacaacaaaggagagtcaacacctcacacttttgctttccctcctccggagcttctgtcttttttaagtggctaccccaccacgggccctccctgagactctgactttcctgcagtgtg

SEQ ID NO: 34369 - DNA, 1091 bp, Homo sapiens
tatggctattggcctaatgcagagggcagagggagggggagttgctgcctctatcatcctgtcaaaggtatgtgagttctggagacaattgtgaagcatcagtagaaatgttgaccttgctcaagggctatcctgccaagggcaagtggctccaataaaaagagggtgtagaggaagcaggaacagccaaataggagcagtgagggaagaagtcttattttttttttttaacagctttaagtagctgcaggtgctgacttaccatccatcctgtagaatcaggatccaggcgcctggaaatactgattaagtcctgcatggggaggcaccatggggaattattaatgaagactttcctgcccacagtgctgtgctgatttaacgcaattcaaatgacacacacaagcccagcctcaacacacctgtgtctattagattaataaaaacaattcaaaaggatgagtagctatatgaaaatataactaagtatagagagtggcaatgatatgaaacacacgatgatactagagtgaatttgaacgactggaaccagtaaagacagagtaagcgtctccatggagcaggagaagcaggtgaaagatggtgatggaggaggcgaaggaagatttagcatgaaaaagtaggatattcaggaaaaaaaacatactattttcagtacacagtactgtcctgcaaagtaggtttgttttactgaagcaaaaactgagataacaaataagtattacaatttaagaaattcaagagaacactacaaactgtaaaagatcctgtcctctgaattcacatctcatgtattatctatttgtttcctacatcccaagaactgccttttgtcattactgttacttaactttttgtcaccttaattaaatcaaaagcttttgaaaagtacaaactgcctgctacgttttgcctgatcttaaagcaccaagcactgggctgggtacccagcaggcattcagtaattatttgtgaatttcaggattagtcacaacatcatgcaaagacggtcacttttgcttctttacttagctatattggaggcagttgcagtaatgtattcaggcagg

SEQ ID NO: 34370 - DNA, 1113 bp, Homo sapiens
aaataacatagtaatgatggtaatagccaatgtttattagtagttaccaggtacctggcattctactgatgcttttcacgcatcattcaactgtgcctagcctcgtatttaaggttgcatatttatctgctaaatctggccacgctcctcttattaacaataagaaaagtgaagttaaagatctctcccaaagtcatagagctgttaagaagtagttggaatttggaaccaacatcttttgtacttcagagcctatcttttaaatgctacactataatttagcaggctctaatgaaacaatgcaaaagttcaatttgcagaaagacttaatgacaaaaatgatgggcagaatttgtctcattgacaatgacagttgaatactttaagaatgaagaaaaatgtagtttagttttctttgaatttagatttgacatatttattgtttctttgtagaaggatgagtttcgcttcaacttgatttgaatagacactgaataagcacagctgctttattttaactttgacacagacaggaatgcatggaaagtttcatatgggaatgagtagaaactcgtttgagagaaactgagcaataggactagagttctactattatggaaaaaaataacattcttaccataagccacactagattgaacactatatataaaaatatatatatgtatatatatttttatatatatttatttatatatttatttatatatatatttatttatatatatatttatttatatacatatttatatatatatattaggctcctgcccttgcacagaaactaggagatagggatgcaatcttccttaaatacatttcaaaaagatgattccctggtagctgagaaaggtattcctggatcttaaacctggaataaggctcacctagctagaaaggatttccatatattttaacaagacagaaaacaaatttacaattacatgttttcctaagtgaatgttctacaaaaagatgaaggcaggggttaggaggtagtctcttctcttattttcaacaggatgacttatttttaatatatatttgcacttattttaatatatgtttgctcttatccttaccaaatatggaaag

SEQ ID NO: 34371 - DNA, 1075 bp, Homo sapiens
tggaaatatgatgtgcaatatgaatatttgtatatacaggaggtcattatgatggtcaggtttgaggaagttttaaggagaagaggactcctgaaaggagaaagaaagagtgaccaaaaaactttaccactagacctaggactcagagtgaaaatgttgatgtaacagaaacatgattatgatttattccatatttcagaattgttggatgacaagtttatcatatggcaaagaataagtatacccttgattttgatatttaaataaaaggcatctgataataccatctccagagaataaagttttataaatttaaaatccacccctgcctcccagactgtagtcgctgagttttactccaaatattttcttaaaaataaaagtaagtgaacttgttttcttctcccggttttgctgagaacacaaagatttcaatttactttgatgccaattattccaggcaataaaagacacaattttttcatggtaaaatgtcttccaggaagctacagaactgtgtataataaaaatacttaggtgaagagaatatctgttgaattgatgtgcttttgaatatttctttttaaattttatgagctgtctcctgttctatccttttcttgatctcagagaaatgaagagggctttaaaagtggaaaatatacatctttctctgtatgttgcttttaacaaactatgtgatagtatatgtcacccaggatttgaaaaatgaagtgactacatcctctctggcagaagaatatcttttaagcttagtaatgtagagcatagtattggatataatatatactacctttcactttcccttagactatcaaataaacttacagctagtagagaggaccacattagatcatctacttttcaggtaagctggtgtattctaaagctttttgtatggtatgcttattctcttcataataaggcataacacgtatctcttgacatgtttgcaatcccagtgaataaatgagcaaatatatttatgattctcatgatgaaagacatctggtggtattatcatagtcttaatatatataggctactactatta

SEQ ID NO: 34372 - DNA, 1024 bp, Homo sapiens
ctctgacgctctgtgctgtactgcccctcctatccccaaacccatatggtcaccaagtcaaatccatggcactcagacagcctttgttgaggagccctcccacacaaacacccacatcatcctgcctggactttgcaacccactctgggccacagtagctcttttcttctaattctaatgcagctttaggaagggaagaggaagaagaatagtataatttttgagattcattcattttgtgtttgtttggagactgaggtcaatgtttaatttcttgaagatggatatctagttgtttctgaatcaacggataatgattttgagattcattcgtgttgttgcatgtatcaatagtccatcccttttatttactgtgcagtaccccattgtatggttacatcatgatttatttgttttcctattgatagacacttaggttgttttcagtttttagctattatggataaagctactctggacattcatgggcacattttttaatggacataggttttcatttcgttgtataaatatctaggaatagaatttcattgtaagaagctaccaaatcaattatcaaaatggttttaccattgtacactctatccaccaatgtacaagggttccatttgctccataacctttccaccattttgggttttcaatctcagccatcctagtgggaaagtagtaacttgtgcttttaatttacatttccctagtgacaaatgaggtaagacatttttccattttattgtaaaagttctttagattttctctatacaaatcatttatcagatagagagaaagaaaatattttatcctacttattaattatatattcatgttcttaaataatctattgataagcataagttttcatgttgctagaatctagtttattaattgcttttattcaatgttaagtgctttctgatttctgtataagaaatatttgattaccccaatattttaaagatactcttttttcaggaagctttacaattttggctcttgtgtttat

SEQ ID NO: 34373 - DNA, 1068 bp, Homo sapiens
tttatcaggaagtaagaggtgtcttaattttcctggaccatggggatcatgtaggaaagtcctgaataatgatattggatcaagttggtgcaaaagtaactgcagtttttgtcattaaaaatgatgacaagaactgcagttacttttgcaccaacctaataattgtcatttgaggaccttttatggaggcccataaatggtctaggaaaataaacagtataggaccattaaagattgccaaatacgaaggtaataagtttgtatcaacaattttggtgtggttatccagaggcagttcaaaataatttttttatatactttaagttctagggtacgtgtacacaatgtaaaggtttgatacataggtatacttgtgccatgttggtttgctgcacccattaactcgtcatttacattaggtatttctcctaatgctatccctccccccctccccccaccccatgacaggccccagtgtgtgatgttccctgccctgtgtccaagtgttctcattgttcaattcccacctatgagtgagaacatgccgtgtttgattttctgtccttgcaatagtttgctcagaataatggtttccagcttcatccatgtccctacaaagaacatgaactcatcctttttatggctgcatagtattccatggtgtatatgtgccacattttctgaatccagtctattattgatggacatttgggttggttccaagtctttgctattgtgaatagtggcacaataaacatatgtgtgcatgtgtctttatagtagcatgatttataatcctttgagtatatacccagtaatgggatggctgggtcaaatggtatttctagttctaaatccttgaggaattgccacactgtcttccacaatggttgaactagtttacactcccaccaacagtgtaaaagcgttcctatttctccacatgctctccagcacctgttgtttcctgactttttaatgatcaccattctaactggcatgagacggtatctcattgtggttttgatttgcatttctctgatggccagtgatgattagcattttttc

SEQ ID NO: 34374 - DNA, 1033 bp, Homo sapiens
tgactggatggattttacccaatatgactggttttaaaatgatttcagtctttctcacatcttcttacaaatatggtgagggcatatatgtttttgcaaaacctcatgcataaggaaaaatagcgaatggcacagcttaaggcagatatgcaggatatataacggacaaaggacactctagaaggaaaaactgttctcctactcacatcacttctgacaccaaatggagcaattttccagcaattaaagtgtgggacaccaactggtgtccagagttagcaggaaactgccctaccgccaggtgaagggctcagtcgcacaagactgcctacactttagacatcagttgtgagtctggagtgctcgtggtacctacacttctgtttatcttggctgtaaatgtgagattcctacaatccctccccagtttcatgagtttgctcaaagggatcagagaacttggggaaacacttaggttgaccagtttagtacaaaggattaaaaggatacagatgaacagcccgatgaagaggcacataaaatgaagtatggggaaagggtgcagagcttccataccctttctgggcctgccaccctcccggaacacccctcccacagtaccctgaagcacaagcaaacggacctgttggtggcaatggaagcaagtttgtcctctcccattctaagtgcgccatagcccattagggtcattgttctctcagatcctgaggcatattttcattcccagagcctggcaaggccctacagtaccaaagcagggagaaaataaaacacttttctatatactttgcctgaaaaattcttccttagagaattccattgaacaaaggaaggaaatcctccttccactgtgtggaaagtgcttcctggctcagatcttttcgtcagacacctccccgtggccatttctttagatactcattcagaaactacagattgaaataatgccaaacaaacaggcacagaagtggttagtgcttgcttcactccaaaatgtgaatttggtcataga

SEQ ID NO: 34375 - DNA, 1033 bp, Homo sapiens
ctccagcatttggagatacagcagagaaaaatgactttactgataatatcaccaagaagcagtcagtgagaatttttgaggattttaaaagtcctgcttagttgatgaagtatctttccaaatatctttctttttaatatcaatttatttatgttggtctttttcctggtgcttgttgcccacatgtctagcagttttggttgtgttctcgtacttaagacagaagaaccagatagcgggtgtaggtttcctctaattctctaaaaacaggtctgttgtatacttgagggcaagatggggcacataaagctgtgaaataataataatatattttgggattcagaataattctcttttattccagttatgcttctctgattatgagactgtttaaatatttaggttgcactttcacaaatcatatgaagttgaaatatctacatagcttcagagcatggagtgatacggaaataacttaattttgtctattgtctataagcattctgatcaaaataactaatttagaaaaagccacaaatagagaaaaacagtaaacaaaacatcatagttgcagctgatttcatttgctgatatttttacactattactaataaagatgcaatttaaatgactaggattttgctttgattctgaaagtaaggtaaaaaacacaaatgggaaaaaagcaagtagagagaattgacttactgctgtcgacttgctctattttcttatcaatagattgtcattttatgggaaaattcatatgtatttaaagcagcagagtgatggaatgtacaacagaggttttcaaaacagtcaatttgaatgtattccatgagtgctattcttaatagaaacatacattacaatgttgatcttgctcagtgttgttattttggcatcttaaaatttctgttttgtcaaagcctgctatttcatttaaaaaaacaaaaaaacaaaaaaacaaacaaatctttttgcaagactaacctcaaaataaagccatgtccttaggtaccaaaattacaaa

SEQ ID NO: 34376 - DNA, 1040 bp, Homo sapiens
agagagacatacaattgataggtacgggcagaatatatactaaggcatccttaatcttcagctcacgaatccgtaattcattatctgatggaaatacatctacgctattgatttccataagatgaagacttttggtttctctaatcacgtccattagtttcctctagacagattaataattgttcacaattgctaatggcaattgtaggcatttaattttgcctctacccttgtgaagttgctacttggcagcatatttgtgcagtagtagataaagaataatcctaaggcaataaaacagtctctatttgttatagtactttgtttacaaaagcatcgttataagcacttcagagtacaaaactgtccacgtactttttttaaaattagaaatttattttagactttaagacaatttcattacctaagggaccaaaaactgatttttaaaactgatgttacccaaagaagatgagcttctttattttcttttgactggtaaatctgaacaatgcaaatctaagcaatgaatcttttcaagagaattgcagttatttttaagtccatatgtagaatgtttatacatttatacaatagattttatgttttattgtctcatttcttatgatttagagtggtttttgagtctgatatgtgttaattctttaagaacatcttaaaatgttgctctacgattattttaaattaagtagatgtaccctcagttctattcaatggcattcagttgctgaagaattgatcaattattttagagaagtttctactgtggcacagacctcagatttctatggaagatgtaaaagtcctcaatgttcagagtaaaagtattgattgcaaaatgactttcaactccaaacaagctttgatttaaatgataatatcttccaattgctaaaactagatacaacatttgatgtacctaagcataaatcattcttccatcctataaatattgccgaaaattaaggaacttattaggtaatataatcataataagaattaacgtatatcaacatacc

SEQ ID NO: 34377 - DNA, 1066 bp, Homo sapiens
tgattttgcaattatgaattgtgcttccacagacatgtgtgtgcaagtatctttttcaaataatgacttcttttcctctgggtagatacccagtagtgggattgatggatcaaatggtagttctacttttagttctttaaagaacctccacactgttttccatagtggctgtgctagtttacatccccaccagcagtgaggaatggttctctgtttgccgcatccacaccaacatctgctgttttttgatttttttattatggccattcttgcaggagtatggtggtattgcattgtggtttcgattcacatttccctgattgttagtgatattgagcattttttcacatgtttattagccacttgtatatcttcttttgagaattgttcatgcccttagcacactttttgatggggttgtttgttttctttcttgctgaattgtttgagttcgttgtagattgtggatattagtcctttgtcaaatgtatatatggtggagattttcccccactctgtgggttgtctgtttactctgctgactgttcttttgccgtgcaaaagctctttagtttcattaggtcccagctatttatctttgtttttattgtgtttacctttgggttcttggtcatgaaatccttgcctaagccaatgtctagaagaatttttgtagtttcaggtcttaggtttaaggccttgatccagcttgagtttatttttttgtataaggtgagagatgaggatccagtttcattcccctacatgtggctagccaattatcccagcaccatttgttgaaaagggtgccctttccccactttatgtttttgtttgcattgttgaagatcagttggctgtaagtatttgggtttatttctgggttctctattctgttccattggcctatgtgcctatttttatacctgtaccatgctgttttggtgattatggtcttaaagtatagtgtgatgcctccagatttgttatttttgcttagtcttgctttggatatgcaggctcttttttggttccatatgaattttagaattgttttttctaaact

SEQ ID NO: 34378 - DNA, 1080 bp, Homo sapiens
acacgtttgtcaggattattgcttctcttggtatacaacatgtggctacaattattgaagtgtttatcattatagaaagtatgatgtagatatctcactgaataaattcatactactagcaaggcaataacaaactttcttaacaattcatagaaactggaggcatgtgagtcctgggtcctaagaaggccctaaactggcagatattaggttgattctgctccgaatcatttgtcattctttgttttgacagccaacaaatccataagcctatctcaatataggtagtaaattgataattaaactctttattagatttctttgtctagattccaacgagaaggaccgtaagggaatggactgtcttcttctcccgctaaaatgcaatttctggaggttctctatcttacccctaagcagagttcctagatcataaaaggcatttggtaaatgtttaaattgcacatcatgataaaatattttgctgaagtcgttctttaaaatcatttgacatgatatactaaccaatgaattggttactgttgtcatggtgcaccaattgagtcctgagaacaacattattttaaataataagttgattgcctcagcttcaaaaaattttcggtccataggctgttcatcagtaggttcaataaatatatcatctctgggaaacttagtaagcaaatgaattaaaatgtttgaaatatttgaaatgatagcttagtatgaggaattatttcttaaattgtgtaagatagaagcatttcttttctaacagtttgactgaatttagatgactatgagtaaaattttagatttattacatcttacgttatcttccttggcagagagtacatttagaagagaaactggccaaccaaaggcaacagtttattgttttccaaatgtccacaggatgtgtagatcttggaagaaacagttattgccagcagtattagaagtacatagacttgcctttcttatgtaaatatctgtaagaattagtgcatgctatttttatttttttgttaattgaacaagctttcatgttttttattataaatgaatacaaagatt

SEQ ID NO: 34379 - DNA, 1053 bp, Homo sapiens
tctcagctactccagaggctaaggcaggagaatcgcttgaattcggggaggcaaaggttgcagtgagtggagattgcaccactgcactccagcctgggcgacagagcgagactccatctcaaacaaaaaagaaaaagaaaaaaagaaatagatgacagtttaacactcctttcaactctcttatatgaatttttctgattatttatgtcctgttaatatcatgactcagttcatttaattattaaagaccttacaaacgattccatttctttttaaagatttttatttttctcaaactcccactaagctatttatttccaatttgtgtgtgataaattggaaattgtgcgctgaactgttaaactgatgagcaaacaattaaatgcagataagaagctttaaatttaatacttagaaaatataatattcagattattaaagggatgttatggtagattcatttatctaactacaactgtgacggtttatgaaatcaccaaaacactattgaggataatattgagtagattaatctgtaattttgtgaagtaaacattgatttagaaactgttttctttatttaatattaaagctaaattttacatttaaaatagatatagaagaaaatttgattctaaagctttggtttggttggttaaactgccatatttcttagatattagttaatggatacatttgattttcaagatttaaaaatgacaaggtggtcatctttttaaaaaaattttcatcaaatacacattgtgaaaatgctaactaggtaataaaaacctcattgaatgctaaatattcaacattattttaggtatataattgaaagaggtattttcttcagttctttagcaaaaacgccaaaatgcctaggtttaccctctgcagattttaatctaaatcagagatcagaataaatcagaagtgaaactcaccacatgtgcgtatgtatttgtgtgcatgtgtgttggggagtaggatagaggtttatgtgcagttgtcagagtagattgcagatgtgtagtctggtaaagtatgttt

SEQ ID NO: 34380 - DNA, 1032 bp, Homo sapiens
gcaaggaactcagaccccttgagggggcagggctggcttggcagtcagctccacactctgtagcccatgggtcctgaattcatcctcacaccatgttaggatagaaaatatgttgctagatatgacagttctaaggtttcaaaagaaatgcaattatgattattatactgtttaataaagaaagaagataagttcggacattaaaaagtttttgaaatgattaaaattataatattttgtcatttaaacttgtatattaagtataatcatttttcctaaatttgaaacacaaatatcaccatgacattcaatttatgaagaaaaggatattttataaattatataagaaagctactttatgaactgaaagaaggaaaggttttgtacaagcatattccctttatctccaccaatataaagattgaattataaaaattcttgatagacagaaatcttatgactagattgagctctacgatgcagtatctttgtattataacactagagaatctgtacaaaaagcattgtctgctccagacatttaattataaaatatgatcttcattctgaattcagctcctatggtaaagcatgatctctaaatgaaatattttgtatttcatggaccactaagcaaatcctgaattctaaaatattaattttagcaattttattttcctgaaacaaatagtggtcactttcttctctttgtttttgaagtaaaaatgattagatcgttcaagttatgtttagaatatggagtatgcgtatggaataaaaatacaatgcaaatgtaaatgttgacttccaattgaattttcttttcttttcttttctttttttttgagatggagtctcactctgtcacccaggctggagtgcagtggtgcgatctctgctcactgcaacctctgcctgtcaggttcaaggattctcctgccacagcctcctgagtagctgggactgcaagcatgtgccaccatgcctggctaatttgtttgtatttttagtaaagatggggtttcaccatgt

SEQ ID NO: 34381 - DNA, 1047 bp, Homo sapiens
caggtgtggtgacgcgcaactgtaatcccagctacttgggaggctgaggtaggagaatcacttgaacctggaaggaaaaggccgcagtgagttgagatcgcgccattgcactccagcctgcgtgacagggcgaaactctgtctcgaaacaaacaaacaaaccaaaaaaaaaaggactatagagtctgtagtcattgtggaaaatagaaagtattgttttgttttcaaataattaataataatcattattagcaccagatgaaacacaggagactatggatggttcacatggagtttcatgctcatatatgtaagagatgatacaggaggggaggtatcatctgagacagccaataatatctatgaaaacacaaaatgggaaagtacatataacaacttttaaatgttaaaagttaattattctttatagttgaaatactataggaatataaaatacaaaatataaaatagttatttagtagttatataaaatacaaaacatgtattaaaccagttctgcataatgttctgtggaagagtccttgtagacaataaaggcaatatgttaatttccatcttgtcatgcctatatccttgtacaaacttattgaattatacaaaggagatgttatctccatttacagtttgaaagtctgatataccaaaagattgtcatatatctcaaatttgtgtgctaatatttatggagcccagtgaacacggaatgattctgtcagtgggctcttttggtctggttggtgataattcattgtccctaattctcagaactaggcatgaccatctgcccaataacaaaaaaggaacgaaaagattgtggggggaaatatttgggattctggccactgcacaaggataatttatcaaaaaggtaaaacagagtatttgctagggaaatacaaagtggatttaaattcattggtagcttggcttagaacacactttattgttgggagtggaaaaataactaaagatgactttttgttttttatatcaatcactccttataaacaaaaattaaacttttagt

SEQ ID NO: 34382 - DNA, 1046 bp, Homo sapiens
gaatttatggttcactacaatttcacataaggtgattaatgtaaataatttctattaaattcataactctgtcattctagtatcataacaaaactaaaatttatgaaggaagtagcaagtttctattttaagtacctttggcaccctttgattagatatcatgtatatttaaagggtttaatgtaacaaatgagcttgtttcttgcttataaatttagctaatctaggttggatttataaccatagtactgttaggagataacatacatctaaactattgatatactttgctctattaatactccattgtagagtgtacagttggtttttgagcaagcagagagttggagtgctgatgaccctgcagtcaaaaatccctgtgcagcttctgactcccccaaaccttgactactaatagcctactcttgaccagaagccttactgataacatagtcaattaacacatatgatatatgttataggcattatatactgtattcttacaataaagcaagctagagaaaagacagtgttattaagacactcataaggaagagaaaatatattgatattcattaagtggaagtggattatcacaaaagtcttcgtcctcatcatcttcatgttgagtaggctgaggaggagcgatgggggaattggtcttgttgtctcaggggtggtagatgtattggaaaatccatatataagtggacccacacagttcaaacctgtgttattcaggggtcacttgtgttagttatctactgctgcataataaattgcccaaagatgtaacatctcaaacaatgaacttaaagtttctgtggcttacggtttttggagcagctcaggcggttagttctggcttaggagctctttcgtaaagttatggtcaaagttttgactggggctgtttcctctgaaggcttgggaaggctgaaggatctcgttctaaaatgtcaggttcggaaggctgctggcaaggccttcccttcctcctcaagggggcctctccatcgtgctgcttaagcgtcctcactacgagg

SEQ ID NO: 34383 - DNA, 1066 bp, Homo sapiens
tttacacgaccatattttattcagtggttcttgtggatattttgctattttaaaatgttctctagtggaaatctgagtacacgtatctttatatatttagaataataattaagtagatttctacaagtggagttacctggtcaaataatatgcacgttttcaaggtgatgtgggtgagtagtgtcagattgttctccaagtagtgtgactcttctcattgaagttcacacttacggtggatgtgagtgctactttcccaatatctttgacaacactagatattaaaagatattttataacagatctgggctataggacacttggcctactgttgttattatctgaatcatagactttgaaattttcttgtttccgtttatgtacatagaattgttgctcaatgcattttaattaaaaaataattctcgaacataattgtatttctgagaatatattattaatgacatattcaggtataaggtggaagttttccaaacatagaagaaatttttatgtattaaagaaatacaatggacaaggagaaaatttaaatattgaggaacagtatagcttttaaaatccaaacacagaatgatacaaaaactctgaaagagagtgtaggagtgctaagtggagtcggtgaaaggaaaacacagaggaaagctttttcagagagacatattcaatatattctaaatagtgtttccctgtaggaaatcacattaaaatttatatgactttggaaagcagaaaatgggattaactctccctccctccttttcatagatcttggatgctgggaccacagagataattaaattagctctccttggtttatttatttttaatgcaaaaaaatgcacatgaaacaagcattaattaccttgaatttgtactatgatccttttttctacaaacttagagaacctctagttactcatgtttatttcccagcaattcacatggcataattatcagtggaatatatgttagaaaggtgttgccccctgtaaggtgctcacacagaaccaaaccctggcctcctgagagccagttgtctcttcac

SEQ ID NO: 34384 - DNA, 1055 bp, Homo sapiens
taggtctgcccagtttgctaaaacagccccttcgtaaaaaatatatcatgttacttgatttacccgaacccaagtgcctaggcataacttatttcagcagtgcctgccgtttaatagaatacaagataaatttttgcatttcttcaaactgttgtatttcctacttttagcctgatggttgggttagatctagtttttaaagtggggagaagagtatggccgggagttacagcaggtgctttaaggagatggcaaacatttcaggatcagtgtggtattagaaatagctctgcagtaggaaagctgcagaagtcttgcaatcttgctgtaatcagaaggcagtgcgagtgctgagatcattttattacagaaagaatgagatgtgggaaggaagagaaaatacatatctatgttcttaatcttagtatattgacttatattttgtttctctatttttctcataagaatcttttttttttcctaaaagacattgttgcagaatactttatctcaaaaccatcactgcatcattataaatgtattgtttaggaggatttcaaggtcttccagatatgaatgaaaaatcatttattagcagataaagttactaattgaatgagaggtaaccacggtcgcaattgcacattgttttaacagttgtcccgagaagacacttccagactgataggcctcaaagaaaaatatgtgttgtattctacaaatattaataatctagacacaagtgttagagatgaaacttagggaaaaacaatacaattcatggcttcagtgtttttaatatctaatgggggaaatagtactcataggatttatatagtatttttttttattttggctatacaatttgcacactgtgagtcatgcaagctcaataccgtgtgttcagaatgagaaacttgtcttgtttcatttttgtatgttcccagtgcaaggtaagtttcttatacatttaagtgcacataaaatatttattgagctgaaataaaaactatattttgctactcaaaagtaaccaaatgatcatcatcacaaag

SEQ ID NO: 34385 - DNA, 1030 bp, Homo sapiens
cacatgtagaccatggatatttacaatattatgtaccaataacagaaaaagtatagagaactagaaggtgaagacaactcttgaacccaggtcttcagactaggaagtcttctttcttataaagggcttactaaccattacttttccaggcttcatttgctgtcgtggttttacgttgtgcaaatgcgtaagatgctacgggataattctattttataataattttttttttgccggtagataatttaaatagaatctgaactaggcaaaaatgtgaaatagatgaaaaaaattatctgcttctccctactgacccagtcctctcaaactccctttctcccattatcatcccagggaaaacttcctctataggaagccatctaaaattcattgatattaatttttaaaagagcagtaatgaccactaaaagtattaacttctgacccctgtcccttccaccgggacttttgcattccaagtaattaggtagagggatgctgttttaattgtcaacaagagcctatgagttttttttgtttgtttatttttgtttcttaatttaagctgagaagtcaattgttttctaacatttctgcaaggaagcacacattacatacatgctgcatttttatagtagtggttgttccaatttctccatggaataaaagaatttcctaccttatcaggtgcaaaggacaaaataatatacattctttcaaactttctgattctgtgaagtagtggctcagcacgtaattgctgatgggacgcgcactctcttcttctgaccacacacctggatttgcatctgcccaaatgtttcactgattcattaaaaaaatatatattgagcctctgctgtgacctagttccatgcacttggaattctattgtgaagaaaacagtcaatctctctgtccttagacaacttatattttgtgcattttctaggaatcaaacgcccaagaataagcctctaacttcacctttcctaaacacacaaattacattcagatgtatgtgggcctt

SEQ ID NO: 34386 - DNA, 1077 bp, Homo sapiens
attttagaaaatattttgagtgaataatgtactagaaatttttacatttaaaaaatcacaagactacatttataattgcaagtctacattctctaacttctctgaataaatacaaaatttaattaagaactatccatagaatggtagacatttggaatagaaaattaccctatatagttcacctctttcactggagtaatttatttgcagattgaacactcagtagagaaatttttccacatctaagggacagcatcaaccaggaagtcttcctctagaggaagtctctaaaagtattggagttcctagattacttaattggtcatgaaacaaaacactgcaagagaaagtaaatcaaacctaatagggagagtttattctaagttagtattttatattagaaaaacctgattttaaaatagtgaaagtggtatttcaaaatgatttatatttattaataatttcttaatatttaataacatatgaaaaggtagatgacaaatggactctgtaggcactgaaacttggtgatataccaactccttcagtgagcggcttagtgtgaaagacacaaagggcaatgtaaacagagacatcaatatgtttccctcaagtttaaaattagaatttattttggaagttcaagtcaacttcattattctctctccttcttggtagtcatttttttttgtttggggctctctcgattaaaccctgtcacttcaggggaagttcaagagaatagtgcattattgatgttacagaaacagttgttactgatcaatatgttttgaaccacatacagagtatatctttaaggacataattcatcaaaaacaggcttactggagctcctcatactattttcattgatttttttcctctctaggaagacatggtagatagtctatatgtgacacaagagttatattcaaaataaagaagtcaggtagtcaattacaaagaaaaaaatcaaatataagcattctaaaagaggaatacaattgaatttaaattcttattctcacattttagtatcctgttcagattatataatcagatgacctgtaattatta

SEQ ID NO: 34387 - DNA, 1023 bp, Homo sapiens
tttttatgatttgaatctttggtaacttatgtaagaaatctttctctattccataaaaatttcctcctatattgtcttctagaatttacataattttggttttcatatttagatttttgattcatttcaggttactttttgtaaatgatctgaggtaacagtcatttttttatatatggatatccaatatttcccacattacatgttaaaaagtatacactttcctcactggattatctgggatcaggaattgaccacataagatgggtcctatttgtagactctattccgtgccattgatctttatgtctgtcttcatgccaacatcacatcaccatagttttatagtaaattttgaattaggtaccacagatactcccactttgcttttcctttgaaaattactttgactattttagctcctttgcattgctatataagttttagaatcttctttttaacctcaaaaacctgttgaaatttttattggcatatcattaaaatataaatcaatctgggaaaattgacacatcaacgatattgagtctcctgatcatggtatctctcttcactgattttcacttcacttacctctcttcacttttcttcattcaacaatgttttgcagtttttggtgtaaagatcttgtatgtattttagtcagtttatccttacatatttcatgacattcgttgctactttaaatggtattgtagtataaattccattattatattgtcacaaatacatagaaatacaattgacatttgcaaattgacacggtattctgcaatgtaataaaatttacttattagttctgtgaactattttgtaaattccatgggaaaagtgaatagacaactttgcaatgtgtgaataaaggcagttttaattctaatttccaaacgtgctagggttaaaatatgagtagaaatggagaaaatagacgacctgccttattactgatcttagggagaaagcattccatctttcaccattaacatgactttatctgtaggttta

SEQ ID NO: 34388 - DNA, 1052 bp, Homo sapiens
ttcttgatcatgtgtatatcttcttttgagaaatgtccatttaaactcttgacccaatttttcattaggctaattgtgttttaattttttggttgcaagagttcttaaaatatgctaggtgcaagttcccttatcacatatatgatttgttagtatttcctttcattctgtgggttttcttttcattttcttaattattttcttagaagcatatttttttttcaattttaaaaatagtccaagtagccaggcgcagtggctcatgcctgtaatcccaggactttgggaggccaaggctgttggatcacctgaggtcaggagtttgagaccagcctggccaatatggtgaagccccgtctctacaaaaaatacaaaaattagctgggcatggtggctcatgcctgtaatctcagctacttgggaggctgaggcaggagaatgacttgaacccaggaggcagaggttgcagtgagccgagatggtgccattgcactctccagcctgggcaacaagagtgaaatcacatctcaaaaaaaagaaaaaaagtccaatttatctattttttgtcactgatgactttggtgtcatatctaaaaaactgtcatctaacccgaggtgaagcatattatctcttatgttttcttttaagagttttatagttttaacctttaaatttgtgactataattcactttgagtcaattttcttatgatgtgaaggagttcaacctcattcttcaaagatatgatttttgaaagaaaaaaaattgtacccatccttttttaaaacttagtttccataatcatgttcttgagttgggtaaacatgtagatgtgttcagagaaaaagacaactgaaaaaaaaaaaaacttggtagaaatacatatttattttttcattaagatatatatttttttctcttgcatggaatagactgactaacacattcttcatacagttatcaaccaaacatttgatgcctgggattgctcagaaacaaagagtgcttttacttagaaattacctttgtgttgattattcttgaacttctc

SEQ ID NO: 34389 - DNA, 1062 bp, Homo sapiens
ttggcattagtgattttgaattatgtttcttttaagagactgtttttcactgaaacttttgatgaaacaaaatccactttttttttgagacagagtttcactcttgttgcccaggctggagtgcagtggtgtgatctcggctcactgcaacctacgcctcttaggttcaagcgattctcccgtctcatcctcctgagtagctgggattacaggcatgtgtcaccatgcccggctaatttttgtatttttagtagagagggggtttcatcatattggtcaggttggtctcaaactcttgaccccaggagatctgcctgcccctgcctcccaaagtgctgggattacaggtgtgagccaccgcacccggccttatggaaaaaaaaaaaaaatgttgcagcttttctcaggcagatagccctgaccgggggatcgggggtgggggaggctggacacagggaacaaacaaaaaatatgctctttcaagtcactgtgtattttgtggctatggatgaaaagactgcaaatctggagaggttagtcaccctggatcatcagtcagatgttcatacaattgagatgcttacactataaatttcagtcacttccattttgtaaatcaaatgtttattgtttattactgaaaaatatcagtagaaaggaaatataaaattgtcatccctctggtttacttagtataatccactttgcgctcaaaggtatcatattcacatgtttatatcctctgtccccatttgtatttacttttatcgataatacgaggcaactactctgctcagaatgcagttttcttctttctgcagaggttagaactgaatcattttgggtgtcttcctagaaactgcttggtgtttcttttaagttcatacaattccagcagggcctgctccctattcagtcattggggatagatttatattttcagagaaaaacctaaatatgcaaggctagcctgacaacatggttacagggaacccctgccccacctgtcagtacccctaatctcttgttgtggcttttacctgggggcccagccgctaatga

SEQ ID NO: 34390 - DNA, 1112 bp, Homo sapiens
catttttgtgtatagatgttgtctgggtgatggaagggtagagattaaactgaatttcttgcagggtcagtttacatagtgagttctgaaagggctgggtggaagatttacattttcaagcaaaatcattgaaattacggtgagtaaaacatatgataaggatattaacacatacctaataggtcacccatactcacgtgggagttttagtacttcttagtaattccatttacttgacacaaatggttttggctgattgctctaacctatcaccataccttgagcaaaacaactgatgtcattcaataaggagttaggatccattaaagagaagcccattataacagcttatacaatctacaatgcaaatgagaacactgtttcaacataagatgaaaaaggcattctgaaagaggctaaagtattttctaaattttaaaaaagagctagtcttgacgcctaagatttcttaaatatttttcaaagtgtcaactcagaattgtggaatctgtcttttgtcttcccactgtaaggattcaaacttctcataatgcacagaaagatctccagtcagcatccccccccacccaatacaacgttgtgttaaacttcatccaattgtccagctaattcttgtgcttctccaattttactggatatgatgtttttattggggttcatggaagcatggctaatgacatcagcaagctttgtaatttctcactgccagttttctacacaacttacacttttgtcactcaaactgcaccaaattgctccaacaattaatcttaaagcgcaggagtagggggacttttaaatggaccccttcttgggattttgtgttaaaaacaggaaagttcccatgagtgaaggggataagttagcttttccagcctctgcctctccccaagtctcactcttctctgccacctccccccccccaaaaaggaatgaattacatttctcttcttgtcctttaaatgaatagcatagtttgggtgaaattatcaggcaattgcatgccttttatgcagataatgctatttgatgaaagcggtgttttgatctgctaaggataatacagatccagggttggattcattggtgag

SEQ ID NO: 34391 - DNA, 1045 bp, Homo sapiens
ttagtcatacagtgtgcatgaatgcatttgcaaaacaagtgtcaggttttaagatacatcaattcttggttttctggtttaaggtaatttcaataaaactaatacagtcttgcatttcattcaagtatgatgttaggaacttcggtcaaccatcagtatagccatgaccgaagtccattttctcattctgaaagttttctataaaatctgagccttcaaatctagttctagttcagctccactatgcagttgtttgatgtcttgtgacaaatgagagatctgaaggagaggactgagtgcttgttctatgagatgccatcagttaattcttctcacattatctgatgaaagtagcttttagacactgtattgtacttcagatgggaatcttaacatatcaagtttggtaaattttatattgagctatcagcaaaggacaatgtgagttactgaaacaaatcatgaatgtatcacgtatttcatgtaaatgtgatgtaagacgtgtggattggttgtgtaattaccacttcaactttaaaaagcctctataattcacttttaaaattttaaatgttgaggaaagtgaagtataaatagttcatactcttggaaaaatgttactaatgtaagcctcgtagggattattttttattatttttatcttttgaaaaacaatgataccttctaatgtaatttttatcacttaattttaagtctggaacataatcacttgatttaggagtagatataaattattaatgcacattatgctttttttctttttttttttccttaaaagaaagatctcaaaggctttcaggatgaggttctggttcttttactattaagaataattggtataaatggctaattttggtgggagagtgttacatagtctttaggccctcgttattacttttaaaagaatagcccatcggggataggaagctttgtggataagctgccactctttgatgaaggattatacattctcccctaaatctgtgatcccagaatctgttacacaatagttttatcaagtagc

SEQ ID NO: 34392 - DNA, 1059 bp, Homo sapiens
tacatcaatgtcaagtgtcctcactagagaatagctcctctccacaaaaggtttgtggcctctggacttcggtcatcacctaggactgctcaggttctaaaagtctatggttctattgtttgaagatctcctgtgattcatgttaaatagatagtaccaacacagacttgtcagcatttagatgaggacgaaagatgtggctggagactatagatctctggaaaaagacaagactttgaccaggagaggtaagggcgttccaggagagggaaacacaatggacaactgaggcatcaacggtagcaagcccaacttcacgaacaggtaacagcaacaccagcaggtagcacagatcaatgaatttggccagattatttgcatattaaattttcacatctaccaagatatgcgtcctctcatatttcttaaaatatgtagttctctttgtcctttttttccccatttttgaaagaaacattggtacagagaagtatttctttactgttagaaaaacaacagagcaagtttgatgataaacaatgttgacatagcctcagagtcagagacacatggggagtggtgaggactgtgaactaaagggcacacgctttctccaaaaggaggtgccacgtcgcgcctctagactagtcattgccatgtgagggtgaaacctagtgttgccagattgtgagatttctcaagaaatgccagaagatggattgtgtgaaatctctagattttcaaatgtgagctcattggggtaataaaaaacacacaacatacaaaactcacaaatcaaacaaaacaagtctgcagcctgggtttggcagttgggctaccagtttgcaacctgtgatgtagctgcggagatctgcatggatttgggagactgtgaatgagcagtaggtctccagcagaggctgcctcatggagaaatccaggaagggctggagagagagcttgggtccagattgtgggtaatcttgaatgccatcctcttctacccattttggaggagaaaatgttttcagtttacagtacacttcttcctgctttaaa

SEQ ID NO: 34393 - DNA, 1002 bp, Homo sapiens
tagtttaaaatgaattttcatggcttaataactgatttttataaaccgtgcttaggtttactacgaatatatagaaaatatttaaattttctgtatctttgattttttttttcttctttattgtaccttattaggaaagggtctgttttgacttcaaaagaggtcttatgttatgatcattttcatttggcaaggagaaagaagtgatttgatataaaatattcatgagctgacataattaaaaatattaaccgagacatctaaattggcttttgtagtacaccattataaatatttagctctctgtgaaatgtctgtcgtgttgtacatgggttttccataggatatcatttcagtttttataaatttgaatttgtatttactaacacatgttaatctggcattaacactggatgtgtatttaagaagggtatactgcagacctagtaagtgcacagtcaggactgtgtggggagggaaagactgcaaacagttgtcagtcttcaaagtgagataagacacgtccattaaagtttgcaatacaaaacagtatctaattcggtaccaaaggagatatttcatgaaagatgaagttggtttgctgctttaggctctttctgagtagctaccatgtatcctttgtttagtactcaaccttagaaatttgacttcattcgttccctggctgtgataagattttgtgaaccaaatgcacaagatactatttaagaaatcagtcttctaaattgtgttggagaataaccctatactcaaaatgtttttattgattattttggccactggcaatcaaggcatctgaaaaaccgagaaactataatcataaagttactggctgaatttaaaattatttattcatactttcagaaagttaccaatcgagtcctactatatgcaaagaccatgttaaaaataatgagaaacagaatatcttggtggatatgtttctgccacccagaaacatttaccagggtggtaaagatc

SEQ ID NO: 34394 - DNA, 1502 bp, Homo sapiens
aaacatgagcagttgacttgactttgtgaccacatgaatatggctacgtgaatggacaggaagaatcccatgaagattactagattttatcctggattctgagaataaatgttaaaaacaaaaagctatttattcccaatctcactgtcttaatgaacttttatgtttctgtcaaatgggagtggagaatgacaagtaatcttaaaatatttatggagtcaacaaatgtttatgatgtgccacacacataagggttcagcacctaagaggcagcacttggacacctacagctcggaagtgatcaagacagaccttggctcccaccttcatgcatctaagatgacaatgcaatgtcagagtgaacattcagtaggacttgaagatttgtgacaagagttcagggaaaacacatcagaatttttggtgatgtgcatttagtaggaagttgtggttaaaccttgagaataaatttgtccctggaaagagataaaagaacaaggacttaaggactaaaatttgagtaaagctttcaattaggaaccaataaaaagatgaggaatgggagtggaagccatggttatggagtttggaaaagtatcaaggtcaggtgcacggatataatcctatgtggccaggaagtttcaaaataggaagaccgacagcctataccgaaggctgtgaagaatgaagtttggaggagagcctttatacttgattaggaggaaatgggtatcatctgcccgtgaacttgacactggggttggaaatgagtcctgagatatgggaaatagagaaaaatcacatatacagcttgttacgtaaatccagcagcgaaaggaaggtgacaacttcacacatggagtatctccaggaggtttaaagataatgtggataaatgttgagaccaatttttcttgtatgtaagttctctatagctatgtctggagtatggatgatttttatgtaatatattataaatcttgacttttggattgcttctttggtggtacaaaatagaaaaaaatgctattttgtattaatatgctttagtcactttcttgtaagccataaaacatttaaaaagcagactttatgcaaattgataactaaaaaattgttttacacagaaattaagattaatttacttaaacactgtgctctacatttatctttatcttgatgtttatcttgatgaccaaattatgtcatcgcgggaaatttctctttatccattaactaaatacatttggatactaagggtagtgtctctaagagtaagaattatttcttaaattaatatattcatgaaaattcaaacaaacatagatcatctattagaaatgtaatttatatacagcattaactcggaactgattctttgtttttcctcattcttctgggattcttgaaacacaaatctaaatgtatgtggctgcaaaaaaaaaaaaaaagctctggatagctgcctacttttgtaggcactctttttgtgtttttttttt

SEQ ID NO: 34395 - DNA, 1038 bp, Homo sapiens
gcaagttctgggtggcaggaggtaagcctggccctggacaccaggcgcctcaccttccccatcttgttttcaccgtcattgccctctctggctggaaagtctcatttgagcttaagccctcgggtgtagtaatgtaactagggctgattgtggagaggacctgtgccctggttctgctgaagattctagaagctcctttaaccttatactgtgactttaagaaaagttgtgatcattaaagtttttctttttcttctttgtaacattttctacacatttgaaaggaacataccctgatgtttttaaaacagtcataccttgtcagtttcacatctccgtaccaaaacccaaaacctaaagagcatggcttcttttgactagaattcctgcactggtccttcttgtttcctttctctcgtcctcaaatgtgatgcatcatttccggtcatcttctcggatgccaaggagctcaggacctgactccttgaagttgtctttctccttctctgccattgttcacgtttcccatcctcggagttgctgttgcatttcatgtcagcatgttacagtttcacaatttaaactccttctaaaagttctctggttctactgatgacattatttgttaatctatttcctatacaaataataagctgtgtttctattatttttgttgtctacaagctttttaaccagttacactgcagcgggcgttcagtgtttaacattggttagcctgattttcctaagtgaattgtttgcatctacactcaaagcttggggttaatacccttgctatttagtatcttctatagcagtaggttgaaaactatgccacgataaccctgcctagccatggagggatgtgagatagggaatagccagttgtgtttgggggctccactcccaatttaacaaaagaagttcaggggttttttttcctctctaggagttcatttcaccatcagaggatattattcagaggataaaaaaagtttccaaaccactgctttaattacttaataaatactcaaaaaa

SEQ ID NO: 34396 - DNA, 1117 bp, Homo sapiens
gaggcggtcggatcacctgaggtcaggagtttgagaccaggctcgccaacatggtgaacctgcgtctctactaaaaatacataacttagctggatgtggtggcacgtgcttgtaatcccagctactcaggaggctgacacaggagaatcgcttgaacctgggaggcggagcttgcagtgagccaagatcacaccactgtactccagcctgggcgacagagtgagactccatctcaaaaaaaataaataaaaaataaataaaatttaaaaaaataaaagaattggtgggaaggcctagaataggcttctgaccctgggccgtttactctgggcaacaatatcttccctacacattctgcagattagaggttcatttgcacgaataaactctccttccaaagggaattcctgtagagatggcttcgtttatcagccatttacaccttaggttgtattactttaatcaagtaatcagattacttttactgagggcagggaccttttgattgattgggaataaggtgcagcactttgtgaactcaaggcggtgagaaagaggtgtgcctcagtcggttgtcagagcgacactcacatcaggattggctttgggattcagccaacccttccaggtattggggtgaactgtgcagcttgctgcggatagcccgctactttggtgagaagaggaaggacaaatatcataacacctaaattacaaatggccctgggatgtggagcagttggaatgaagctgacaggaaaagtcagcggcaatggaaataggtgcaggcgaccatttcctgacgagcaggtgtcaggtagtgcggagtggatgcggactgttttcagctcctggctcaggcctgggctgcagagagactgaagacccgatgatgaaggacagagcagagggaagcaaaggaatgacaaatatcatttgagacaggtgtaaaaccatggtctgagacattttgtaaagacacaagtggaaatgaggaaggagctagatggaaaagaggattgggaggccttcccatagaagaagacaaagtcaaattataactgaaaaaagttcttaacacatgaaagaagaagtaggcccttgcctacttctgcct

SEQ ID NO: 34397 - DNA, 1049 bp, Homo sapiens
tgccttcgccctacccgcttacctaacccctatgatttgttgagaatctgctagctttctttatggagatgtcaattcctcatgcgtgtcatagacatggagtcattcattcaataaatatttactgagaacctttcgtgttttgtgcttgcttcatgtcagttacttgtgctaaaaaataaggtggtttctattcttttcttcctcccctggaagtcattccagagtttttgtcccttcccaataactcaatttcagattatttgctcaaggagtaaaaaattagcagaagttactgagtattcatctgggggacttcattctagccagagaatttggcatatcagcctaaattctctagacttcaaaattcccgttctttctttctctctctttttaatttgtaaaattcctatctactattattatctctaagtccctgcatgtttgctaatgtcacgcactcaacataagcatgagatgctcggaaatttgtttgctaaatcatctggcaaatggtcttgttgatgtctgctgagctgctcagagcctacagttgttaagtacttattacaggaacccagcagggcaaattaagaaagctacatgtatgcttgttattttaggactattatgctatgcttctgagggggctgcatattggactttctgacctgaaaggacttgctgttctttagtcagaggttgctgcgtggaatctgaatctttgacccggcaacaataaaagtgattatcttcaagggggagaatgtcctctagttgcttttcatagttcagcctgctggaaaatgtaaaacacttatttaggcagctctaggttcacttggtatgtcatattttataactaagctgggagctttttctacttacacattaagttatttacttcatttttaaatgtaagtgctttatctaaacaggactccaaagcttaagctcttagcacagggtgagcatgcttcccagcccatgcaaaaagatatgtggcggggcagagctgttattaaaattatagctgatgctccccc

SEQ ID NO: 34398 - DNA, 1048 bp, Homo sapiens
taaagtatgtgtattcattgtggttggtagtaatacagcatttttatctgcagatctcaaagcatgtgtgaataaatatgcattatttccctattttaagtagccagagactcactgaacgttaattagatataagcagacagagaaatttcatgtccgctgcttgcttgatgctactaaaaaaaaaaaaaaaaaaaaatcttcccagagactgaggtgaagaacacagtgtacctgatctctaaataactactgttcaggggcatggctccagccccaagcgaagccccatgaagcgcaaaatgtccctgcacacgtcttccaccaggctcctcacacctaggctcgcagagcattctagcaagtcttaggtcagaagagacctcagggaccatgcttctgagtcctttcctattacctctagctactcagcacgtgcactaggatggggacgtgacgtttcctccatcctccacagcacttccttctgaaccctggcgaacctcttgattaggagaatatttgttggaatacgtactgtgttgtaaactcttttctaggtgcttgcaatagagcagtgaccaaaacagacagtcactgctgtcacagcgctggcgttccaggaaggaaagatggtctgtgccgagcatccctctatttattcacagctttaacctccccatctgcacccttcctacgcaaagcagggtgtcctaccttcttcagcaaaggctttcccatcccacctatccccatcagatggggaaatatttctgagctttattttctggagtttgtattcttttaatttttaaattttgtgttatgaaaacaatagctatattaaatacagtttctcaaactatatatatatatatatatatatatatatatatatatatatatatcccccttctacctcctgttctccgataattacagcacacgaagaggcaggtttccccagcaacggagtgggtgcagccctgcctcataattctcctgaccaacaagtgtctctcctgggccagacctgagggtctctaac

SEQ ID NO: 34399 - DNA, 1049 bp, Homo sapiens
agaagtgcacaggagaggggtctccaggcttccagatcacccagaagccgctccagggacctgaagccagagatgttcccaccttccgtgctcagccaaacaggagccggagagccccaaacagcggtgagggaatgacagaaattcccggatgcctcccactaatttctcacaggagaaagtaagacttccaggcatctatcctggatagacgtccacacatgatcccacactggcactgttctgcatggtggcggctcctggcctgccaggcaaaccaccctgtgtgcattaggggttaatttgacttgggaacctgaccgacgtatgctacaatttcagtgggaaatgtgcattccaaattcctacaagactgcctcaaaacaaatttctgaaatgcaacctgttcgtaagttgtggcttgcctgcatttaatacttttttggcagcaccatacacttacaaaactgtatgctgcttatggaagaggacattctggaaaccacttaaaattcacagaagtttggattctttctctagcatatatttcatttattttcttgctgtatatttgacacgtggtcactgttacagcttatcgtcaagcagatatgccagcactatcttcccaactttgggtaaattcttttaccaaaggacaatgtcctaggtgacaagatatttccagttttttcccattgaacaaaaaaaggaatcactttagaagggactgttctctttcacttcagaggaaactgcagatatgcaacatctggtagaaatccctcggattctcttggatgtaggcataggcttttgctccaactatctgggatggttttctcttggttaagtcactctttacgcctttcggcttttccagctttccaggcgtctgatttttgttattactgtgtttcaacttggggagttgtgacacgagtggttgattcctttatcggccttagtagccataggagcagagctggtttaggggtttagggtgtctgacaaatgcagaaacctccaagttcaccgtgaaagcctgg

SEQ ID NO: 34400 - DNA, 1025 bp, Homo sapiens
ttgtaaacatttttaaacacgtaatggatgagatcattaactgttttaggaagaaagctgatcagcaatggaagaaaagaggttcttattgtaaggtaactaacctaggacccgctgtctcgttcactcccctagcattgtattgccaaagaagttaaaatcaacacttacagaggattatggtatattatgcttttcagtagagattccaagactccagaatggcttgtgtttcatgcaagcatctttagcaactacctgatggccagcagtccagctagatctgagtcagagatcattgtggcaccgtgtggtgactcctggagatggcagtgtgtgtgtccctgggatgaccaacagcagccagagagattttttcctgggaggtcacacagcctgccagaattgggcttatgtgtatggggagaggatgggttcagagaattagagtgatcaagactagttctttcacagtcagtcctaaaaatttgcatccttcattgttaacatttttttttcctgaatgagaagactgaagtactgaaaagttatattctaaaaatgttggatatattcaacccttcactacaccacgtcttaactctcacatccccttaaatccttcatgcattctttctttgctgttctttgtacatcgttctgttattcaacttgctccattcaaagccctgcattcctgtttctgcaatcccattaagggcgtattgcacactctgggactctgccaagggccctgcccactcttcactgtctcttggatgtacgtataggttccaaccgttgcaaaatgatgatgttcttcacttctaggctttctcgaggttattctgataattctaaattatttcgaccctaaagttataagaataaaatgtgcaggataattgtctttttcccctttggacatagctataaagaagaatagatgaaatttgaatcgattatgggctccatctcagcctgtcttcattgtggggctagttccacataaggtgtgagtggca

SEQ ID NO: 34401 - DNA, 1071 bp, Homo sapiens
tggagacttcttttggccgctcgactttagtgaggcccctgctttaggctctcagtttcccccacggggtcttgctcccagaggttttccttttttgttttcaaggtgggccacataaattttttgattgcactctttgaaaaatgtgtattttattcaatatttctgtgtgttctacattttgggaggcagagacactgcttccaaccagtccatcatagtcactggaagttataatcactgagatttatatattcttgaataaggaggaaagaggaacattgacagtttatctcttactcacatagaatggaattcttttcaaccaaaattttagaatagataatttctatttttatggaaaatctattcttactaagtatgaacctgactcatggcataaaaatagaccttttcttctcctcttcctgttgcacatcagaagcctcatttcagtaaccagatcagcctctgagttggcgcggtacggaaaattgagtcccatccagacagacacctctgtgctgattacatctgtgccacaaacctggcgggtcaattggacttgccacttctctgggcatcatctacaaaaagggatctcttcaaaccttgttaagccaactttggaaatcttatgtaaaacagataagagtggagaggatctcttgaatgagagtgaaggttttgcctctttgccaagtagcctctaagttaccagcagcaaatcccctaaggagcctcgagaagcagagtttgtaaaccactagactagatacttctttcatgtctaaaatgacgtggttctgggagaacacagtagtaggcagcactactgattgtcagctgctcatctgtcgggtaatttctcctacaaactcctcctgttcccctttaataaagtaaaaaactcattgagtaagaggttgactccagtctccttcacatctttaagttgtaaagctatcatttttttctttaatagggattatccagccacactgggacatatggtcatcctatctttaatgattaagtgtgacagccttggtagaatttcctgcaatttag

SEQ ID NO: 34402 - DNA, 1441 bp, Homo sapiens
gggggagctacttcccagggctttgctgggcgtccccacagcacagtctcctgatacaggagatccatcgtggcttgaactgttcacgcagtaccccatcacaactattctggttggcagctggcctcacacctcttgcttctgggatcccctaaactgcagggcatgtttcttgctgggtattgccaagggtatgggcaagatagcttgagtccagctactttgcattacaacctggtgattcatgaagacagctgtgtctttgccacaaggaacagtggccatgcaggcagctccctgtttctgcctttctcttaaacctgccattctacaattttcttttcccttctcagataagcccagcatagatcagcaaattggcaggggcccacctaactgttcaaccagagattggaatgccgttctctacttcttgccagcatgcctgtctctatcagagcataccccttctttggttttcacttgagagggagaaagttctcaccacaaactgcatctccacaacgctgacggacccctcaacccccacatctcttccctctaccctccccagccctttctgtagatgcagaaggttgtgggtggtgactgttgggagcaggcctagctcttgacaagctttagagactgtttggtctcaattgttgacacttctcagaatgtggggctctcaatccttctttgtcctcagctttggtcccttgtggtaaattccaggtaatacgaaaaaaccccactctttttgccaactgaccaccaccccctctcaccaggactattaccgaagactctgaaatggtctctgtacttgcagtcttgccccctcctttctccctagcgtgtggtccactctacacttagcagccagagaagtcttttggaaacacatcagattacacaacagtccagacggaaactcttcagtgactgcccactgctgttaaaataaaatgcagaccaggcacggtggctgacatctgtaatcccagtgttttgggaggccaagggaggaggattgctgaggccaggagttcaagaccagcctgagtaacatagcgagaccccgtctctacaaaaaagtttaaaaattaactgggtgccgtggtgcatgactgtagttccagctactgaggaggctgaagtgggaggatcacttgggttcaggagttcaagactccagtgagccatgaccacaccactgcactccagcttgggtgacagagcgagactccgtctctaataaataaactaaaataaagtaaattcccaaatcgcccagtgtgatctggcccctgcctggttctctgtctccatcacactccactttcactcattccttaagcttcagcctcacaggctttttgttggtggctgtaatacaccgagcttttgctatttcagagaatgtgcatctgcagtt

SEQ ID NO: 34403 - DNA, 1060 bp, Homo sapiens
ttaaattacctgctgaggtcaggtgattgaaaagtgactgatggcggaggatgccaaggacggggggagggagggaagggttaggaaaatccaggccccagtgtgctattaggatgtgccttccattacagcacgagcagggtgattatttcccattttgatatgaacagaagaaaagacctgctgtattcaagtagatctttttttttttttttccttttgagatggagtcccactctgtcgcccaggctggagtgcagtggcgcaatcttggcttaatgcggcctctgcctcctgggttcaagcgattctcgtgcctcagcctctagagtagctgggattacaggtgttcacagccacgcctggctaatttctgtatttttagtagagacgaggtttcaccatgttggcaaggctggtcttgaattcctgacctcaagtgcacaaggcctctgcctcccaaagtgcttggattacaggcgtgagccaccacgcccagctcaagtagataattatttatgagaatcgttttcttcatgaaagaagcaagggaagaagaaggaaaggaaacagaaagaaaggaaggaagggaaggagggagggagggagggaacctctgctgaacatgacaattggtctctcaggccatacagttgaaaaggggacagaaattaccttgacttgttcttttctgtatgttgaattatgggatctgatgtcccacattttcacatgaagatgttgggtacatgttaccaggtcacaggtctgacagtcgagttaaacacctggaggattttgccactgactggagtggacacctggtgacggcttgtgcctacctttggccttagggatgggaggtagggatccactccagtgaagctgagatcagtgttctgcagccttgcacttgctatgtctccacaccaaatgagacttgatattttaccttttcagctgtagaattctctagctcgtttggcatatttgctgtccatagcttccagagcttccatactgcaagcatggtggttggaaggctgaggcttctccacaa

SEQ ID NO: 34404 - DNA, 1050 bp, Homo sapiens
tctttttggcagcacagacgatgcctacacaggttaaaaatagcgcactgaactgttctcctcctaggcagccttgatccagcgcagactgttgttgacaacccggcggtagcatttgtagaagccctgaaacggaggttcatagggggccaaagagtgttattcctcactccttccaagccaaggactgcagaatccaaaggggcggaggaaagagaaagggcgccaggcggccagggaggccttgttggagagcagaagtgaatggagaagcgctcgcgcagtgtgtgatggtgccgcaggtcacttgatgtgtatgaatccgaactttgtagaaacgtaaatgggatggactgctagttacagctaatgctgccaccctactgcgtgctggtcagtgcgctaggcaggtgtgtgaggcagctcccctggtgaggtgggtcccggtagcgtagtcttttcacagattgagacggatgaggtttggagaggctggagaccccatggctcctgagaactaagctggaacttgagcccaggcttgcctggttctggcctggcttctaatctctgtgcagttgccacagtggaaaacaggcaactcagtaaaatatcaccctttgatttattgcagtcaattttttaagtctattatcattattattaattaattaatttagtgacaagctcggtctgttgccaaagcctgactgcagcggggcagtcatagctcactgcagcctacagctcctgggctcaaaaaatcctcctgcctcagcctcctgagtagctgggatcacaagtgcacaccaccaccatgccagggtaattttaaagacattttttttaatagagacagggtctcgcttgttcctcagactggtctcaaactcctggcctcaagcaatcctcttacttgggcctccctaagtgctgaaataacaggcctgagccaccacgcccagcccattttagtcaattttgaattcgaatgttcatggtgtggatagtgaggtgtgagcaaactgtaggcatatttaggaaataaaa

SEQ ID NO: 34405 - DNA, 1025 bp, Homo sapiens
aggggtccttggagtatgaatgtgggtaactgcgagtccctgaaaactttttttttaaatatatttttaaaattattatttttttattattattatactttaagttttagggtacatgtgcacaatgtgcaggttagctacatatgtatacatgtgccatgctggtgtgctgcacccactaactcgtcatctagcattaggtatatctcccaatgctctccctcctccctccccccaccccacaacagtccccagagtgtgatgttccccttcctgtgtccatgtgttctcattgttcaattctcacctatgagtgagaatatgcggtgtttggttttttgttcttgcaatagtttactgagaataatgatttccaatttcatccatgtccctacaaagcacatgaactcatcattttttatgactgcatagtattccatggtgtatatgtgccatattttcttaatccagtctatcgttgttggacatttgggttggttccaagtctttgctattgtgaacagtgcctcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacaatgtaaaagtgttcctatttctccacatcctctccagcacctgttgtttcctgactttttaatgattgccattctaactggtgtgagatgacatctcactgtggttttgatttgcatttctctgatggccagtgatggtggcattttttcatgtgttttttggctgcataaatgtcttcttttgagaagtgtctgttcatgtccttcgcccactttttgatggggttgtttgtttttttcttgtgaatttgtttgagttcattgtagattctggatattagccctttgtcagatgagtaggttgcgaaacttttctcccattttgtg

SEQ ID NO: 34406 - DNA, 1031 bp, Homo sapiens
ccaagagcttctgcgcagttgaattcatttcctactttttagtttaagatgtaatcctgctatattaaaagtttctggccaggtgtagtggctcatgcctgtaatcccagcactttgggaggctgaggcaggccgatcacctgaggtcaggagctcgagaccagcttggtcaacatggtgaaattccatctctattaaaaaacaaaaaattagctgggcgtggtggcaggtgcctgtagtttcagctactcgggaggctgaggcaggggaattgctcgaacccgggaggcggttgcagggagccaagatcacgccactgcactccagcccacgtgacagagtgaaactctgtctcaaaaaaagaaagaaggaaagaaagaaaagtttcataggcacagtggtaagggcatttgatgagaagataagagatctggtttcttattctggttctatcattaatttgttgttttaccttaggcagttcacctggtgtcactgggtttgagtttcttcaaattctgccttcttattaaataattttaatgtgcattgttttatctttgattaagactacaaagctaattttgcaaagttttttcttgaggatttctctcaagggaggaaagtcatgttgggtcaggataggtctaacaaagtgaagatgcaaagcataaaaatccaggaaaccacctgaagtggtaagaaaagttagatttaagatttattttttgcatccatcaaacataacccaagtttccgttgggtcttgtgtgtctgttgtaagtatcatgtctatgacaaatagaacttaaactaatacagcataccctatcgcctacagagctattcttttattttgttttgactggtagtggtattcaggaagaaattttttgatgaataccttaccatacctagcaagcaggtcctatatttaatagattaatacaaaaataactgacattacctgaatattttaatcaacctttttaaaagataagtcggttttaacaaaaaagagacaataacat

SEQ ID NO: 34407 - DNA, 1062 bp, Homo sapiens
attatgtatgtttacaaacaaagagtataaacaaagaaatgcatttgttatacttagtgcccccaaaatcatttgtactaaagtagcccttgaacaagctggaaaataagtggaataaatgtggtactttggttcctttccattgactttcaaaaacaccaccgatattgaaatatttgtgtttcctttgctgtagtgccagcaacataatagatgagaagagagtagctattcactgttctccagaaatacaacttagcctcttcctgcaacttgagcctccacactgcagccttcccttgtctctgcgatttcctgcttgctccctcctctaattactcttctttttttcagactcctttcatgagtctcctctttttttgtccccctttattccctcttgcccacattccacatttcttttcaacctccctccgtatttggctacagtgtttaaaacgagtattaagtctggaagctgaataagccccatctcctaaaaaacagttttacagattttctactgacagagttagcagtctggcctcagtgctggggaactgaaaagacccatcagcagcctgaaaaagaagagcttcttcatcagtgcagtaaactgctctgcggcttcagcctcatttttacgtagatgacggtgtcccccagcattgttgtaagtacaaacacatcatcaggcatcctggaaagaaaaatccttctgcttgtccagattaaactccgaattcatccaaacattaaatgacaagaatgttgagttgagaatgtagaattgtaccagcagggaatcttaagaggtaaatctgggaaaaggaagttttattgtgcgtcttttttttttttttttttttgagacggcgtctcgctctgtcactcacactggagtgcagaggcacgatctccactcactgcaacctctgcctcccagattcaagcgattctcctgtctcagcctcctgtgtagctgggattataggcacccacaaccaagcccggataatttttgtatttttagtagagacaggatttcgccaagctggccag

SEQ ID NO: 34408 - DNA, 1025 bp, Homo sapiens
gattgcagtaccagtttcgagtttgctaacaaggtgccctgatctacaagatcgttagccatggaatgacagtaaaatgtggttgcagaaggttttgagacattcctgaattgtctgtgtgctgtgctgatgtggcactactgacactctcctaccgcagtgccttggtttctgcggttccttcagcccgaggcacactgccgtccccatctctccacccttcagcaccttgtcagtttatagatcatctcaaaagtgactttttttccacaaggctcttattgatcctcttcaaaatggatattgcttctgccttctcagactcatttatgatacttacatgtcccacttgatatgatgattactgttaacttttgcccaatctggagcaaaatggcatgatgtccacggcagggttatcctggatgtccctgtgtagcccaacacaatcgtgcacatgggagatgcttgttcatttaatagaatagctgttaattctgcgcaccaatccctcttctcatgtttcttgtccttatcctaattgcatataattatttaatgatgttctcagccatttgtaagctatttttagcatggaaaacaaattacctttacagacttttatattagagtaatattaaaaataatagctgccttcgtaagctgttcttcagtttacagaacattttcatacatattatttgatccgcctgtgtagattatgcccatccgtgcccatgactgagaagagggcaagagtctccctttacagattaggaagctgaggcccagataaattaactaatttatccagagttgcatctctggtaaatttcagaagttaaaatcaaacccagatgtcctcaggattctagtacgacttgttccacttatatataatttttcatcaaagttactgagcgctcattgtgaggcttgaatagacacagttaaataaaaccatgactggccctggctctaaggaggccagcgtcctgcaaacacaggcacacggctgttagaaa

SEQ ID NO: 34409 - DNA, 1248 bp, Homo sapiens
actgataataccaaattgaatggctattttatctataatgttcttttatctcaaatggggaaaagggcacattttcatataaggctgtgggatgtgaacagtgaagggtcgttcttcctctaagcggctctccattgctgcagccacctgctctaccgtacggagctgaggtaattaataagaggtattaacacgtctggtatcaccggggagagggaaaaccgaaatctgttgaatcgctttaactgtgaaacagcaaatgttgatttactcaccatctttcactttaccacccagcttgccatcatttctgcaagatgtaataaaaagtaagctcacaccccagtgtaactttaatgggtttaattacatgtaacttgaaatatgtgtttggctacatggtacgtccagccaccaatccataaccagcatttttggaaaagcacagccagcactcaggagagagatgggaattagaaatgcagactggggaggagagatgaggccttggagccctgagttattgcccatgtggggagcgctgagagcggaagggagacaggcaaagccgccaaacctaggggaatgcctccacgtggggcgggggtggaaacagagaaggaggcaggtgtgaacagtagagaaatagaggcaggctaaagagagggcatcgccacacaaatcaagagggaaattaatttcttgaggatgtggggcttcaggttgcaacggtgagtgaggaagcactgagaaactaggagaagctgtctgagctattttttaatgaagtttaatggtgaatgagaagagctattgggggtgcaaaattgaagagataagaactgaataacgatagaaatttattttgctaacaattgatgagatttgtgagtatctgtgtaggctgaagttaaagactcaatggagaaagaaagtaaagaaaatgtcggtttgtctttgagggataaaagatgctatcggagcgtttcctcttaatgagatccatttccatcaccgtctgtgtagcacaccattaaaaataactaacagacaacgtctttttaaatgacacattattttacttaaatctttacatctgaatcctgttcctgcttattttcctgcacttgttgacaagtcattaggaaaaacagtgtttagttcaatatggcctgtcatctaagagacctgtgtagcttaaataaaaaactgatggattaatagtagttaaaaaacaaaaggcagaat

SEQ ID NO: 34410 - DNA, 1729 bp, Homo sapiens
gaagaagagtttgtggggagcacgtggtgattcaaaataaaattgagtaacagaatgaaataaacatcaccgttgggctatttcaaaacctacagagtagttattaagaaggtcaccaatgcatctatgatatctacaagggctgtgcttggtctctaactgctcgtggaacaacccactggtttcttttgctgcctaatgtatgcttatatttatttccctagggaagaaatctgagaattttttttttattatggggactttacaagcaaaagaaaagagcatatttacctattccttcctgccccccacctatgaaagcaaaactgatcttacgcaattgaaatacatgcgcatacagaagcaaaagttacgaattagtatgaccatgtatacatcagattgaccccacttatcttgtgaaaaaataagattacatgctgaagtgatgtggtaataagcaattaaccaatgaatcagggtggaacttatcctcttaataactgaaatgtggttttactgcatttgagagcagtataatttcaaagagttctatgtaagctctgaggcacaaagttctaagtttttgttttaatcatttctgtattttattttccatagacactgattattttatgccatcctttccacagttgcttgaaaatgtagtctagagaatcaaattgatttttaattatgagttcttgattttagccttcagataaactaaattgaaccagaatattcttaaagcataaacaatggattgtctaaattcccagctctcatttcaagtattcgctaatgtggcattgatcaatctacaattcccagactgagcagaagtgataggaatattggataaaaaatgccgtacaggccagaaagataaattgtttgggttgtctttttgcaagtttgaggtcacgattcattcatcttgttactttgctatatccctttagtggcttcaattgcaggattaaatattgaatggtggcagatcattcaatatataggctctcatagtttggcattagagggcttttcatgcttagaatggagctgtgtgcacacagaatgccaaagataatcgtgctgatgatctagtctgtgagattaatccctcaacaatattatcagacaattcttaacacatggatttgtccctgatatgacacttctgaaacaaatggatatactaagcattttaggagtaacattgagcctcctatacagcctggctttttcaggaaattaacccattaggagatttggccagaaaagtccaacactttatcacaaccagtgtttatgaccacaaaattatataagagtcaattttaagaatcaaaatgcttttagggagtactgattaatagaggattaaaaaataaaaattagtttgggtaaaatgtggccctcagggctaaatatgccaaaggaaagtactaaattaatatactgtcttataagtctaattagcccaagaatattcaatgctgagatattatgtttaaaatgttttaattgttgctctccttatgcactttgataggggagatgctgagccctttaaaagagaaatggaaatgttaaaggttgaaaattcattatttagtcaagagacccggagtcttgaaggataaatgcatatgctttttaaaaataaaatgttttatttataaaacataaaaattaaagtttgacaaggacaaagaggtcattc

SEQ ID NO: 34411 - DNA, 1031 bp, Homo sapiens
tgttaaaatggcaataccaatgcattgaaaatacctttcaaaattgatttgcacataattatatatgcacttaccttgagattttatgtttattccaaactcctgcccaatgttataaacctgaactacagagttcaaatgcacctgtcatttctttctttagtcctgacttactcttactacaagccatccagaagtaaaatcacaaactcttcatgggaaaaaggcacataggaccataatctaacaccccagtgtgcagtaagagatatgatattgaccagggagttttcctttttaggttctgttattagtaaatcattgcaagaatagacataaatatcaacttagttgtatttaaactttttcttccaaattccataaaaaagacaccaatttatcaaccattcctcccagaggccctttcatccatattccttagtcgacagttcttctgtgacaataaaatgtgaataaaatgcaggcagaaatatgtatcatgttctgggcagttagggggtaaggctttgaaagctcattaactggaacggttggttgtgtttccctagagaaaaccttcggaccaactgcaaacatttatcttctgggaacaaaatgggccccatccctgaagaggagaaaaggccagcattcttgacatgagagcatggtaaaggtgggattgcaaggaattagagacaaggctgctagctatggttggttaacatcacctaacactttggctcttgttaaaaaaagaaaaaaatcaaatttaactagcctgattgcagagtttaaaataaagagtcatcctttatagtatacttttcttattaacattcagtggattccgtgtagatgaaatagtattcatccattcgttcaagaagcattcttcctcaaggaggcaggtctctgagccagtgttatttgcgatgcacactcaaaaaatgaatcacatgggatgccccttggggcctttggcagcctccttcccgttaaattatcagtgtgagcattaattcaagatg

SEQ ID NO: 34412 - DNA, 1071 bp, Homo sapiens
cagaagattttccccaaatgcttttgacatagagagtaaataagtgccaacctagatttctattcccagctaaactaccacttcaggtataaaattcaagctcctaatggaaaggagtaaaatatcttttatttaataaacagtgcaaggggtgcagatccaagacagttcctatcttagaagacctttcaacctagtgagaacacagtcttgtaaacactaattataacaaatatcttaaatcacatagataatactgtcaatgagaatgtaatttactctgttaccacaaaagtgtactattgttggaatatgttagtatagtgagacaatcatagtagttataacaccatagttgaagatcttgtttattaccttttacacacagagatcatacaatatatttcttccaaatttagtttctagaaaaaattattcttgcaaataaattaatttcttcctttagacagtggcaactatataaaagtaacattttcatttttgctgtagttgctaggaaactcctagtcaaattttatgcctaattgtggtgagtggacttttttgaaatcataccagaccaaaccaggatttattttgctaacagtcatgttctctgctctctgtggatctgtcaaaatttatccctcattgtgtatgttgttaaattttgcaaagtactttaaatctatttggaaggggatactgtgattcatttcttttaaaagaagaactctaagtgaaatctatcattttaataatgagtatagaaaaaatactatgcttcacagaaaaattagtttttaataatttaatttcatgatgtgtgtgcacgaggaaaccgagctttatttttaaatgcatgcaattacatttccaaaaattaccatagcagtttgggtttgaagcaatggattgaagtaaatctttaaaataggaattctgattctaaacttgcatagaaatgtagttcactttaaaatatgtataatattgaactaatctaaggagatgtgtgaaataaatccttataaagtatctcaaagatctattgtgggactatttaaaagc

SEQ ID NO: 34413 - DNA, 1026 bp, Homo sapiens
catttattttatttattattattttttgagatggagtctcgctctgttgcccaggctggagtgcagtggtgcaatctccgctcaccacaacctctgcctcccaggttcaagtgatcctcctgcctcagcctccctagtagctgggactacaggcacgtgccaccacgcccagctaatttttgtatttttagtagagatggggtttcactatgttggccaggctggtcttgaactcctgacctgatgatctgcctgcctcgaactcctgaccttgtgatctgcccacctctgactcccaaagtgctgggattataggcgtgagccactgtacctggcccaaaccagcatttatttggtgtctcttttgtgcaagacactatgccaaatgttaagaaatcagcaaagaaatcgtccctatgctcgtatgttcgtggtctggaaggagctacagacaagtagacagggagcagaatatagtacgatgaaggcaggaaaagagtatttacggagctgaatgggaatgcagaagaggggcccataaactattcttggtgaatcaggcaaggctaaatggaagaactgacttctaagccaagttatgagcaagcagaaattggtcagctaaaatgcagaggtatggagcatgtacttcctctatccacaatgatgcataaatatatgtgcatactcataaatcgtgttcacaaagtcagaaaatcctgaaaaacacattctatatgactatatcatgaaaacacctgaaattaataattattatctaaatttatttgtcaataaagatatgttaaactatttgcaaaaatatcttagtacatatggattcttttgaaatggttgatattataaattgtaaagggttaatataaaagtttgtgtgatttctatgttctgtccactgcataaaggatttgatctatgcacggctattgccactatagacaactacccatctgacaacaccactgcactagtcaccaatgaataattcttcctttctaaacaatc

SEQ ID NO: 34414 - DNA, 1050 bp, Homo sapiens
tttaattcagattttttaaatgaggtgtgatcatctatggtatagctaatgtccactctctgattaatatctagcaaggattagcatcattgatttgaaaattaatagattatgcttttattgacatttctattccccattgaatggcttgtttatttaattgatggctaatgtttttactattaaaggctattaacacatcagaatggtttttattgaacctggcaaaatgatagattatgtttgtgtttactcctttgtgcctaaggctaattattggtggtctttttatggttttggtcaactaaaaccttccggttaggaagttgagtaaattagcaaacttatctggtggtgtgaccttggaaaagtcgctggacttttctggattgctacctgtaaaaggagggaagtgaaccagatcaatgattttgaacagcgtagcttcttgtagaagttctgtagagtttcttcaattctctgattcagaattcttaaaaaaaaatcaaactaaagtggtaataaaacataatgtgaacaaataaaatagatactaaatgtttacatttgctactgggttagtttatttttccatacatgtcctgctttctttgtgtatgtatttgtactttttgtggtattttggtgaatgcagcttgcctaaggaataagaagtgacagcatcctctgcagagaaatcctaggaaaaaaggagtgtgcttactcaccagcttccagggaaatggttgtgctatggactgcatatgcctgccacttttggtatttggtcgtaatagagattctaaaaatgaagggggttgtccttattatgaatagattgttacttttccaatgttccgttatagtaccattcaccaaacttttttgaaactacttttttgaaattgcgtttatttccaagtcacagataaaaatagttcttgttattataggcattcctcattttgatgaaataccaatttaactagtttgattgcttgccttccttcacaggcttgactaaccagcatttcaaaaaaattagatcta

SEQ ID NO: 34415 - DNA, 1034 bp, Homo sapiens
aaatcatccttataagcaaaggtaattaagatggtgtcatttcattttagtgagttatagttctctggactctccctctgtcactgtttccaattagaatttctctaaaagttacaagagtagttaattttaattactaaaaatacctagggggaaatttgttgagtggactcttgaatttcaagggatttttgtcttgcaagtaaattatagagcagaggctataaattagttctccattctttttagaccttgaactttttattattctgcctaaatgtaactgtaacttccattttctcatcttaaaatttgcaaatttatgttctctatatttctttcatgattagcaagaggtctctgtcttacatattttttgaaccttactttctcaatttactaatttgtaatttctactctaatctttattaatccccttctttttcttagacataattatggctattaatatgctgctaaatgcaactttgtccccattccatgtgtaggtgttctttttaaaattgttctgtgtacattttgtgattgaatatttgattttctagacattttgatttttactatttaaaactttctaggtttaattcattgataacagaaaatgtggcttggatatgtaagctttttaaagatttgtaagggttttctttgcctcttacatagtgatcttcaaactttttgcttacatactcactaaaagaatttgatgaactcaataccctcctacacattttaaagttgaagtcaaatacttttcatcacaagtaaaaataattgcaaaggattaatttccagtgtatgacaaatattgatattttaaataaattgttatatcacaatttttttttaagagagtctcgttctgttgctaggctggagtgcaatggcatgatcatagctcattacagctttgacctcctgggatcaagctatcctctcacctcagcctcccaagtagctaggactaaaggtgcatgccatcatgcccggttaattgtatcattttgttgttg

SEQ ID NO: 34416 - DNA, 1037 bp, Homo sapiens
gcctaataatgttagactgaaatgccataatactagaggaaatttagaaagcattttgtagctcttaaaagattgatactttggtagcttgcattattagaaaccagaacatctatctgcatacatatacatacttctttattcagttcataaatttaacttgtgaaaatgacaagtagtagcaagctcacactcgggatttaatcttcactgactaattcatcagacattttacctttctgtagtcacagatggttttaatgtctgtctgtattgaacaatcactcagatgtgtccatcttcgtctttattggataaataataattcagtatccctcaagtgactatgataattggattccagaagagaattcaaggcttctaggtactatcatattcaaaatttgatctctgtgttccagtctctctcgtacatttgaatattttccagcttaagtggaatatatgggacagtagtattttgtgtaaattacttagaatagattttgtagagaagccctaagtgtaacctctttgctttttaaaaatggcatttgccattccaaagtaagtccctggtggtgttacttgactcattccaaaatgacctacacttgattaagtgaagtctcatctaatagctgaaactccccagagatttttagtggctgtttaaaatgaatgtctgtatttaaacccattttagtctatagccaacctttatttcctctatatccagaggcagaaaacagatgtatttcttttttcatctcttgttggtaaaaacagatagatgttgtggcagtggttatgtgtatgacttttaattgtttgggtttggagagaagaaaaacctgatagcatattaaagtatttaagacaggcttgatgatttctgtgatgctggagaaatgtatatttttattgtcaatgttttgaagagttagaaaatgtttatttttaaagaatggtactaagagcataaaatttcagcagtccattctatgttttcaagatttatgtatattatatataga

SEQ ID NO: 34417 - DNA, 1030 bp, Homo sapiens
aggtactatttttaccacccattttacaagaaatgaggtgaaaaagagatgaagtaactggcctgaggtcatgcagctagtcagttgtggagctaggatttgaacccaggcagtgtggcttaacacttaatgctccgaatcattaccatacttctcatgtgtatagagtgcactattaccaatcaattttataggctctgtttccttgttttccctttcacagctgacagaacagtggtaatactttaccttatttgttccatgtggttatttttaatacatggggaaaacgagaaagttttagaagttggttgatatgaattaccctttgaatacgattaattttgaatgattgtgtgcctacctatgagaattgtttgttaaaattttgtatgtcaggaaagattcaggaatattaatattaaataaattaatgataaagaaaagctgtcgtgttatttctgaactggagtacccatttcaaaatgtattaaaagttatgcaaattggtccttcttagagttactgataattgtgtgatttactgttaatgatcatgaaagctacttgagttgatactatgtctgaattaatttatttatggaattataagacaaaattaacttgttaaaaaattcagtacagtagataatgcaaatattatcatttaatatacactactaaattaatagttctctaatggccacagatactccgtgttttaagccatgttagacattttatgatgtttcattttaacttagaaagatacatagtacctttattataaatctgtttttcatagtttattaataattcaaaaactttcaagaagacattttatcttatacctcctataaataaaggtataccatgttccttgcaggcactgaaaaattgtggtatggtatataaatcagtattttctggtaatggatgtgcaaatggctttcacagccctgtcctcgtttgtatttttaggagtgacataagtgtatatataacattttccccttcattacaaatgcat

SEQ ID NO: 34418 - DNA, 1252 bp, Homo sapiens
gatcacaaaagccacagaaaaatgcagagctagaacccccatatgctgcacttttattgcaggagagcctgaagagtttccatctggactgtgtcttaccttctcagacaagggcatgagggtgatccagttgtggtccagattgtcttattgtaaagggctaagcttaatatagataaccctcaatatacactgccttggccttaaggaaactgaaatttctaaaatggttttaagatgagtctagtcccttgggggtcttccagatgatgttagttatctaagctagaaagacatccagttcctggcaaaagaaacggaacaaagcattgtattacatgacgagaccccctgttttctcttttctcttcctctatgtgagtcatctagtaccacatctcactcggtatcataactttgttctgaatgtcagcagtgttaaaggagctccacagcggacatttcctttaacccgctaattcttgcacgtggtttctagaatttggtgagtcaccagagtgtgggatacaatgtggaagagaaacagccatagctagccctttttatgactgctgcaaactagtgttgtaatatagttttatgttcctcttatctgataccaaagttacctgtatggaaagcccgggatgaagtgtgaaactggtgattattatggttactattattttgtgtacttgtctctttatcgttgaattactatagataacagattaactgtatttaactatcgcatatcaaggttgtgtagattacaaattaaaatttttgaaaaagaataatagagtaatttcattttcataatgcaaaataatgtgcatttggttagggcggtagaattaataaacccagttctggtttcattatttggaaccttggtgtattaagtataccactgaaaataattttgatgggccagtgcagtttaggtcttcagtctaacactctcccaactgagctacttaggctactctggccagtgcagtttaataagtgcccttttaacgctaagcatgctggctagatgttcatattttacaaaatgtaaaatatgatttttctctaccctcaaggagttgatgcaggtaacataatcacatgatagatgcttgcgatatctttaaaatgagacctaaataaaatttaagggattcattcaaacatttattctcaggtccagtgggtgaacatagtacgtatctcataaatatttattaaatgcagtgaagcagtt

SEQ ID NO: 34419 - DNA, 1026 bp, Homo sapiens
ttttaaatactgtgttttgcaaacaaaaatgtataatgaggtttttctctgaatacagtgtggtcagtactttttaattaataaagtaaacgttaaggcaaaaaactacctccacaaaaccattaacagacaaatattttatgtaaaccttaggagatgtttattaatcgtggttcggcttggggcacataggatgtttgtcaggttagtgaataaatttccctaatgtatgtcactgaatattgttaaacaatactctacctgcttaattccattactttaaaaattgcagtgaaatttatgtgtgtgtgtgtgtgtcttttgtagaaaagttattacaatttacgatcaaactcactagccataaatgtttttgattaatttatataaacatgatactgtggtagttttggtatgtagaatatttatatttatatttttgtcagtatatttcattaatgttcaaatggtagtggcggatagtgttttcaaatttgttgaaggattgcgttgaaattcttgaaacatggtagtgaaaattgcattttttccagtcttttcttttaaaggtgaattatattcagttgattataagaagtcccaaggaagtactttttactagctttaaactgttcaccatagatgttaatgtgggacacctacagaatccacttttgacatggggcaggttgcaatagtattgcattacactgtcagcaggtgctgccatggacattggtgtaaagtaagaaggaagggattgggatgcagaacagtaattggaaagagagaaataaatccttctctttcagttgcttcactgattcccaatgttccaggtaaagtgcacctgctgagtgcctgagaagaacaggtacatgctagccctccattaatttcagaggaatggcagtggactgcatctacccagcaggtgtgctgagctgaaggaagaagatggatggggacagagtatagaaaagaaagcaggtagcccagatagggtggttctcaaaataagagaca

SEQ ID NO: 34420 - DNA, 1023 bp, Homo sapiens
ctaaatgagaaaagttcatcctttgctataaataggagaattgttctcttatttagactgaccttggaagctaagcattttacatgatattgtcaggtgagcattataaagacagcctgtaatgagatctgtaatgaggaactaaggtatagtagccctttgaaaagttaatttattcagcattttcttattgcatgatagaattaaagtttgtgtatatgtccggacccctttttaaaggggccagtctcactgttcttggtttactcatattctgccagtagtttgaagtgggttagtattactattccaccttaatggaagtcaccattaaagtagtgaattcatcttgcccttttaaacagagctaatttatttagggagtaggaatgttattttccctaccttctcctcacttccttttacagaaatgatatatcagaatttattcaaaccactttaagcatacattttcctgagaggaaaaaaaaaatgcctttagacatcaataaactggaacggcatttccctgttctggaaaatcagcctttaattagttgatgtgtgtgtcttgggttagtatttgttgtctgttcagctcaagtgatttttgtgctttataagaaaacggattgttctggtgggagatttgattgatttctgcttgttatagtcattgtaaattttagtgccatgcatagctacttgcttttatttactttgttttctttgtcaattgtagcttcattaaaaatctcttatctgttcacagtggaaactcttaaaaatgtaagcgtaactacttatttccatagaacagctcctgctgagtgtgctttacgatttatcataaaaacctgtaaggacaaattgaggctggatgtgctaggaaatgaagccgtccctgggatcactagaagagatttctattatgcaaaagaagtagctaaaatgattgattttgagacttcagtcaaaacataccctgaatgttttctggattttctaatgagacatattgta

SEQ ID NO: 34421 - DNA, 1032 bp, Homo sapiens
ttcagtggcttcctatgtaccctcagattctattaaaatttttctcaggatcttggccgggcgtggtgtctcacgcctgtaatcccagcactttgtgaggccgaggcaggcagatcacctgaggtcaggagtttgagaccagcctggcaaacatggtgaaaccccgtctctactaaaaatacagaaaattagccgggcgtggtggcgtgtgcctgtaatcccagctactccagaggctgaggcaggagagttgctcgaaccctggaggcggaggttgcagtgagttgagattgtgccattgcactccatcttaggcagcaagagtgaaactccatctaaaaaaaaaaaaaattctcagcgtcttattaagagtcagttttaaaatacttctagacttcagtgcacaggatggtttataaagcagcatttgtgaaaagtttgccattaggcaagtttctaaagagatctcaggagtcttaagttatatcaagtatttgccaaaacttggaggtgctcagtagtataattctggtagaagcctgaaaataaaggcatagagtttttactttgcacagtttgtggtcattcaatgtacttcaacagtggtaggactgtgaaatgatttgatttggtagtagaaacattcctctggtaaggaagaagtgaatgaggttatctaatccagggtgatctgaacaatgtcactaaaattggaggttaaagaactcaatatttagggtaacaaaaaagaaaataaattacagcctcaattgcaaaagatacctgaacatgtaatttttacaattacgctctgaagtgttggtcccactttgcagatggcttagcttagtctcacaggagttctagcagaggccttccccaacaacacagaactgagaaggagactgtctggtatttgaacccaggtttatgtcactgcagaggctttcagtgaaaagctgcctacccaactctattagagcccatgggtttggctggcagtataaagacaaagaagaaatactgagaaag

SEQ ID NO: 34422 - DNA, 1082 bp, Homo sapiens
tcattacttgtcctaaactcatagcaaattaaaaagttctagtactttcattgctcacagcacctaagaactaaaagaaatagacaactgatgacagaatatgaagtttaatagcattttctaacgaactgaaaattgaataaacccaaccacaagccagattcccagctactaaaatctccactacccttctcccaaaatctattttttctttataacatttacagactataataatgctgtatacataaacattgagtagtaaatgtcatcataaagtatttatgtgattttaaggggaaatgtacaaaagctttttccatcatgtacctcctgaattagcaatagggccaaaatccaaacgagtgaaaagtaattgtttaagacacttatacgacttctggtttatataaccatcaaaatattgcttctaagtgttagaagttgttctgctgtgtgtctgaagcatgggatcccagaagcaaatactcaagtagctaaggcataatgggcccaagtaaatttttgggattgatcaatgaattaattgagaaatactgagaaaatacacgataacttgacaaagaagagctttaaaaagaagctttagaaagagacaagtaaatgagttcatggtaagtatgagagagggtcagtattcttaatatataaagagctcttacagatcagtaaatttaaaaagggacaatagaaaaatgaggaatttgtaagggacatggatagctaacaacgagaaaaatggtcagcattattaatgattaatgaaattgaagagcagtgagatatatttcatttttcacattgccaaagattttaaaagattgctaacatcactgtcatatgcttctgatgggatttgtttactggtgaatgctttaagcacaatttagcagtatatgtttaaaattttttaaagcaagaatatatcatctgacttaggaatttgtatttgaaattcaggaatttaagtaaataattagaaaacgtgtacacaaacatattgtaagagagacaaatgtatggggagagaaatgcatacatgcaaacacatgagaacattt

SEQ ID NO: 34423 - DNA, 1104 bp, Homo sapiens
ttttttttttttttgagacggagtctcgctctgtcgcccaggctggagtgcagtggtgcgatctcggctcgctgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaaacaaagttcattctaacataatagataatagtcaacatagtatggttctaggagaagagattgaagtttagccaatttttataccttatttgcatacctatacttaacattcatcttcaattatttcaaaataatgtgttgcaaatactcatagtacactgaaaaagctgtaattctactaatgcatataaaacaaatttagaagtatataaccatgagtgaaaccacacgttaatctacctggaaacaaatacaaatagtcccctacatgtccaaacagtgctgcctctgcttgcttcaccaacaccactacttgatgaagactccctagatcctctttttcttgatctttttccttctcttttctttttcttgttctttttgtttctgaagccttggaagccttcaattcatattcataggagtctactgtgttcatggtgcctgggacctcatagtaataaaagtctttgggaatcttattggaatcaggtacaccctggaaacactcaaatcatcaggaaacaccagacagtataatagaaggtgactgtgataggcagaattccaagatggcccccaagattcccacccctgggtgcgcccattctgtatgaatcgtgactgtgagtgggatctgtgaatatgatggaatatcactccagtgagtatcttatgttatatgggaaaggggtttgtaagcataattaaggtccctaatcagttgactctgcattcatctagtgggagatcatcttgggtgggccagacctaattgaaagagcccttaaaaaagataagaagcag

SEQ ID NO: 34424 - DNA, 1074 bp, Homo sapiens
ttagtagagacggggtttcacagtgttagccaggatgggctcgatctcctgacctcgtgatccacccacctcagcctcccaaagtgctgggattacaggcgtgagccaccgcgcccagctacatttgccgctttcttatgtatctcgtagaggcagtccctaactatcccatttcaagtgcaccgcccctctcactgtcctgttgtgattggtcgtcccctcagtagtgctgtacatagtctaatcgtatgacattccccttcttttttcactttccttttgccaaatcaaacacacgactctctcttcttcctttagtgggactctatacctgacatcgttgtcaggtatagacatgcactcaaagttaaaggaaattaaaatgggaaaagaaaatagtgggaaggaagaatattactttgtttagtgtctgcaaccctcactagaatgtaaactccatgaaggtcgagctgtaattgtgttttgttcacctctcaaacagagaacacatttgctgaatgaccgactgaataaatgaattgcactaatttactgtggagcctcaatagctgctcatttctcttaactattttacttgctaacggatttagcatggtagtacatctttattcattaacatagacaggtagctaccgttctcatgctggcttgttgaattgtgtgatgatagtcctgaatctatgtgatgatagtcttgaggctgtattcactactatatgtaatattattggttacttgtctctcttttaccttcttgaaactaattagccctttcgctcctttctgagttctttaatttttttttttctgagctcctaatatggaaatctgctggtatgtataatacatctgacaaatgaaatgtggataattatattgtttttctttagagatataatgagttgtctaaagtattagacttgaaagcaaatatttcaattaaagaagtcaaaagtagttaacaatcaaaggaggtaatacagtcaaataaaaagttaggcaacagcttcttaacatacatttgctatttgttgcctaccttatttcctccaa

SEQ ID NO: 34425 - DNA, 1034 bp, Homo sapiens
gcatgatcgttctctgcttacctgtgtcaacgtttagctgcggtaacaaatttttgtgatttctatgcttgcgacaaactcactttggcttatgaacttgtcaatttctattcctatcattctgaagagatttccaagtagattatagttttcaatattttcatatagaaaggaagaacgtcttatatactgggctagtgccataattgaacctgaaaggagttgggagggagggcggagaacattaggaacgctggtgttctaaagaggaaccctaagatgaaccaaaatgtatcacttggtctgaaaagattatcactgtggcttattttgtgtcttatcgataaattatggtggactttcaagtataaaaagtgttcaacatcgatttttcattaactttcttatcacttaggagttccagggtataatagagataatcatctggaaagacaggccttttctctctgctttgcccccactaacttttagtgtttgtctagggttgtgaatccaggatgagtttttagcttccatttcattcttcttcctttcttctacgtagtataaattttttccactccaccccatttggttcaggggcctagatagtactaaaggcctaccataaccttctccctgtaataaccagggagcactcctttttcctatccatctattccttcattcatttgttcatttattccttgacatatgattttaacaaatatttgttcaacaccaatttatgggctaaggtgttccgtatataaatcccagttagccactgacaccaaagtcatggtttacagtgtagttacagagaaaagtcaacaattaccatacagtgtgataaatacagtaagtagacttgtgtacacgtgccaaatgatttaaattgggctctagtgaggagagaccaatattgttttaagcctttgctctatccttgccagtgggtttttatgtggtagctggtttgagtatatatgtaagcgaggtatcttgataccaagtagtaaaggaaaattact

SEQ ID NO: 34426 - DNA, 1026 bp, Homo sapiens
ttgtatgactcagctaagatcatacagccagtaaaaatttgaaaaggagtttgaacccaagccgtctaactttggaagctatagcaaatgttggtgacataacaaaggagttcctaacgaatgtagcttgtgattgacctatatctttcctactagaaggaacaaacacaccagtaatgactcgatggatgcatggatgcaaggatggagggatgcatggatggatgcatggatgcaaggatggagggatgcatggatggatgcaaggatggagggatgcatggatgcatggatggagggaagggagggaggaagggaagtgtctcaacatagagaccaggagaagaaatggcactacagagtgtatttatttgaacaaattcaataggagaaagaagaaaggttctatgtcaggaggttcatgcaattattctgctgcatctggtagggtcattgcttctatttggaggttacatgtatcttcagaaagtttagctgtattaccagttgttggtgtatgctgatttttatgagtgaagtaatataataagaatgggcgagcacaaggagaccagcattctgcttttaataacctctaaccttaaacaggttactgaggcctcatctaggcatctgttcccttatctttaaaaacaaaagttctttaaagtctcatcttttttttcaccaaaaaacttaaaaaattgagatagaacatattttcatatatatatatgtgtgtgtatatatgtaagttgttgatacatgcttttttggtggtattccatctatagaaaggataattttccagaaaagtatattttttttttagtttgtgtcagctactctattttaagtgctttacatactgtcgctataggatagtcggatatgaatctttataaaagtaattttattagggcttattttattctttggaataccaattcagatgatatcatcaatataatccttttggattaaatagacgaaggaggttgccttttatttttatatttaagaacc

SEQ ID NO: 34427 - DNA, 1033 bp, Homo sapiens
agccacagaaattgttttctttttctaacccaatcatttgccatctctctgaaaaaaaattccaaggccaggcacgatggctcgtgcctcgagtcccagcactttgggaggtcaaggtgggaggatcagttaagcccggtagtttgagaccagcctggacaacaaagtgagaccccatctctacaaaaataaaatataaaaaaattagccacgcatggtagtgtacacctgtagtcccagctacttgggaggctcaggtggaaaagatcctgtgagcccaggaggtggagggtgcagtgatctatgatcataccactgtgctccagcctgggcaacacagtgagaccctgtctcagaaaataaaatattcccttctcatctctgatcagaatagaaaaagaccgcccgtgactcatgtttagaatttttgcaatccaaacccagcttttccacattttatgaaaatatgagctgccttgagttgcacaatgttcacagtaaacacacggttttaggaacttgaagaacgtccatacatagaacccagactcttaactccaacacagatcactaaagctttggactgaaaagcaaggagtgcacaggccgaggcaactctacctgggggaggaacacttccatgaccccaaggccgggtgagcctgttggttctggcattcattggttagtcacctgatgtagatgttctactccagaggtggcaagcgtgtgggacatttgttaacactcccacctccaatacttacaacagacatcaataatggatcaccacttctcagccttttggctaagatcaagtgtagtgtctgttcttaccggtttaataatggatcattgcagtgtttcctactgagtgcaaagacagtcttgggatctgtcttaacacagcagtcactttcaattgccaaccttgttttaaaaaagaagcatcagcactccctgaaatccctctccgtttttcttactctattcttatgctatgcatcccctcttcccacccttccccatcccc

SEQ ID NO: 34428 - DNA, 1068 bp, Homo sapiens
aggcagagaaaagcatacaaaaacatctcaatagcctgactcaggctgaactaggtaaaatgtgcatacacattgtggattccctagaagacaggcaagggaaggcaagagggatgtgcattaggttaccctagaggcagtattcatctaatcaagagttcattcattcctgcagccagtttttaaaatcatacatctaatgtgtactgaaaaccagttgctaaatatggttaccagacattttcttcttctacaagattgtcctaggttctgtatttgtttttttgtggagcttttttcggagaactttaaaacaaaattataaaatctcatgtaaaatcaaaattaaatgactttttctattcaacattgtatctaattattacctgtttataaaccaatcctgttcatagggtcagagcaaactgcggctttcaaaaggatattaatggttagtgcatttgttaactgggaccctatttattgttcctgtccaactcagatcactcgtgtgtgtgaactaagtactctgagcttcattagaatcgtaattgtctgtaagtaaactgtgatgtacttgaatttctacaattgtgcttatttttcacattttgttcaaataaaccagggctcagctcttaacattttcaaatacttgtttcattttaaaaaaggacaggggccttatttgagctaacagatgagccctcatttctacggaaccctaagcaagatcctatcaatccatgtgctaatggtcttttttattgatgaatttggcccttgctctgttgattgaatctacatatagtctctagccagtgatgcttaaatagaagccacagggtacaacattttggagttgaagttcagaccacacagtctccctttctgcatcccacagattctcatctgtgctctctcccccagcctccagctgctgcactgtcaccagcccagctgagattcagaatcacttctggtgtggttctgtccctcaggtaccctttatgtgcctcagaaacacttttacctagatgtctctctaccattcatacatgtttacag

SEQ ID NO: 34429 - DNA, 1539 bp, Homo sapiens
cttcacagcctgattgctgtcacatggcccttgtactctggaagagcactcaggttaatctccctctgacttcttttctcataataaatttcttcccaggaacctctgtgtggcctaccaaatcaggtacagattcttccacttggaggtgaaagtggttggttggccccactttatctatccagaactctctcttaagttgctttccaaaccagtgttgtttggaaatctccagtcttcctgctttgactttgctaactgtgcttctcttcaaggtttagctaaatgttagtctacactttaagccttcgaaaccaaccccggcacaaagcaaatgtttccttgttcaccttcttcatgtagtttattattttgcacctgcctgagatttgtgttctcgctgtctcaggaatggaagtcccatctcctcaattagggaataagcccctttaggccaatacacctgccttcttctgtatctccacggtacttaacattatggataaatacagttaggacttgtggcttcgcagcggtgaaccattgttggttctagacaaaaaacaaagttttgaaaatgccatgttggttttaaacagaatatattggagtagagaaagtcagtaggcagagagagcagcattctatttcctcagagcacatatctagtcagcagagagtgatttatttaataaatgagaggtagggaagggtctaggtaggataatgcaatgggaaaacagaggaaagaacataaccaaataacattttgaataagctaacaagaaaattgttgatttggatcaaagaatcaaagagcaagagtcaaaatgtcaccaaacttttgagtagaaaatggggatttcagtggaaaggtgaaatagttgagaaagaggaggagatcttggattgggcagagagtataaaacgaggatgatacatttagtttgggacagatggacagtgcacatagggaagagagaaatatgttttcctttaagattttttagtagaagagtaatgacattacattggctgtaatggatttttgaaattatttccacaaatttgaaaacttctctttttttccgccaatatggattaattttcagggatcatattttgcagtgaacctttaaaatctcatcagcttattttaaagcaaagttgttacaggactctggtataaggaaagttacattaattgaaacattcatactagtataattgtgctataattctcatttgaagtttaaatgaggtttagtgctggctacagagggagggacacactggaaactaatttatctgtgagaaggcagaggagcagagtatgacattttggtccttttgagaaaatttgcaggatgttgaggtccgttgctgctgctgctgctgtttctgttgttttaaatagtatataactaagggtgaggaccattagaggacagaaatcacatcttaatcagctttgatttttttatgtttaaaaaagagattgagattcactttgtagtctagggagtttaattaaagtaa

SEQ ID NO: 34430 - DNA, 1025 bp, Homo sapiens
aagggacattccaaaatggttttgttcaggaaacagtatgattagaaaatctttatagtctctcaagatgtctacttgaagggacagtgatcatttatgatcatttatatgtataaatcctgctatctacattagaaatcagtctctttcattagagtcattattgtgagttagattctttggttaaaacatttccttaatttttaatgttttaggttatataggataaattcttttaaaaaagagagagagagcaaaagagacaggagagctaaatgcatcgctgtctcttgtctcttgtatcgtaacatatttgtatcttataatgatattctccttttccacaggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtactgtagctggaaatgcactgcactgtgtgccgtaggggtctcggtgctcctggcaatactcctgtcttattttataggtaagaacaagttcttagaattactttgtctgtaaatcagggtgttacattgttttattacttgtatttattcatttggtctagaaatatattgtgagattatatttggtgggggtgagtttggtaataatgtatcataaatcacagagtattttcagtaattttcagcaaatttagatacatagaaaagcaggttttgtgggtagtgaggtaatattcttggacaaaagctatagggtacatttgtgtttgacttatcccttgtgaaacatggatagctctgtggcatttcatgtacacaaaataattcatgcgcttgcagtaatgaaccctgtgcaggatttccttcaatgcgtactcaatagggagctctccactgcttgtgatattgtaagtctctcagctcactcagccatctaaatgtaaaactcatcactca

SEQ ID NO: 34431 - DNA, 1040 bp, Homo sapiens
attcaatgcatatcagtgattgtttgctcttcattctgcaattcaagatgatgcacttgtaattcatagcaaaattttaagaagacacttctgcaaatcagcatcggtagtatcctctaaagcaataatggaaatccccatcattcgttatttatatttttagttatttgaattttatgaaagaaatattatcgtgtattttttaatgcatagaatttattcattttacatttgtctaatgagcacttatgatgtgccacgcactgagcaagattctgggaatatagctgtaaaagcaagatgatcacagctattgtttccagagcatgtgaattctaggctagatgggaatcgagcgagttattacagtgaattagaaaatctccgttagggaaaagcggagtgtaccctgacagaacatttcaacaccagcttgacttctaaaggggcagtaagacacatgcccaattttagcctaggataatttaggataataaagactgaaataaaaggctatatattacaggcaatgtaactatggcaagtgacttctccaatcaaaagaactctttttgtatggatacgagttgaaaaactacaaatatgtgtgtatgtgtatatatgcatatgatttatgctgcttaaacaaaacaattccaattgcttttaaattttaattttttttttttttttttttttttttgagacggagtctcgctctgtcacccaggatggagtgcagtggcgcgatcttggctcactgtaagctccaccacctgggttcatgccattctcctgcctcagcctcccgagtagctgggactaaattttacatttttgatcatcgtgtatcaactttctcaagtactagacaactctagagagttcagtctgacagcaggttgcagattccctgtgaattcgagaaatggagctgacagggctgcaagagcactgagttttgttcaatagtgttcatagtacttgtgttattacaatgtgtaatagctccttaattagatgctatattgattttgtcc

SEQ ID NO: 34432 - DNA, 1025 bp, Homo sapiens
tgggattacaggcgtgcaccactatgcccagctaattttgtatttttagtagacataggttttctccatgttggtcaggctggtcccgaactcccaacctcaggtgatctgccctcctcggcctcccaaagtgctgggattacaggcgtgagccaccgcacccagccagtctagaccattttaaagtttagatttgactccagttcatcttataggtgacactgactaggatataataaccagattttcttaaggctaggcacagtgacttaggcctgtaatcccagcaccaggaggccaaggtgggtggatcacttaaggtcaggagttcaagaccggcctgaccaacatggtgaaaccccatctctactaaaaatacaaaattagccgaacgtggtagcgcacacctgtaatcccagctactcaggaggctgaggcaggagaattgcttgaaccctggaggcaaagattgcagtaagtgagagatcgtgacattgcactccagcctggacgacaggagcaaaactctgtctaggagaaaaaaaaaaaaagcagattttcttaagtggaagtcctctataacttcaattatagtagacagattggatttatagcaattgtccagtgaaatatgaaaaaatattttcccactgaaaccgcatatgtgattatttgtgtataattcaagaaatatacctctaagctgagcacaatagtaaacatgtaacttacaaattctagaaaataatttcaggtaagaattgtctattgtgttgtgtacttgaaaggtttatttaaagatttagttgactgcaagttgtatataacatttaagattagagaaatgaaaggtgcagtttcgggttttctcataatccttctagtatttaaacacaatacatgtgatatcctcttttcttttctaccacaatatatgtgtttaagtaggttatgcattttcttaagcttcacggttattatagtttcttcctgtggtttattcaagatcagcagagcaaacaact

SEQ ID NO: 34433 - DNA, 1031 bp, Homo sapiens
atttctaacaattgtcatgtgtattttctgcatgattagagcagcatgtaaaattaaatgatgaataaagacgtagagttccaccattgatcatttcctagtagtcagtgctgaaatttacgtagcatacaaatacttttgatttcttttggatgattttgtgtttcccttgaacaaatttgtgtggaagataaaagctgcttattaattccccttctctctcccgccactcttctctcctgttttgtgtcctcttcctcccacatagaaatatgttctgtggactgtggctcacacggcgtttgcatgggggggacgtgtcgctgtgaagaaggctggacgggcccagcctgtaatcagagagcctgccacccccgctgtgccgagcacgggacctgcaaggatggcaagtgtgaatgcagccagggctggaatggagagcactgcactatcggtaggcttactgcaagtctgtgtctgtccccttcctcccagagaagagcaccgacggtcagctgttttcaacttggaaaaagcctatttctttacgttattttttacttgtctttcttaacacgaaattattttttaaatatggttgtcattttataatggcaattcagttctttttagaacagctgtcacaagtatgagctataaacttttttattcattggtttttgggacggccacaaaaatggactcacataaaacagacttaatgatttgtttatgtgaagttttatcgaatattacttcttgatgttccatattgtcattgcatttcttaatagcagattttccactttagaaaaaaatgctttaaatttttttcaaatatatgcccttgttggcctctgtagtttccagaatcacatagcttagacttgtccatatcttgagtctctgcaaaagaggtttgacttattatgacttcattttgtggtatcatgagaaataaagtagaatcaaatgtacaaatctcgctgctcttaaacaaacctgtatggttaacactttttcatatatga

SEQ ID NO: 34434 - DNA, 1083 bp, Homo sapiens
gaagtgtgttacagatttaaccttgtagtgtccctccttccttatctccttcaccttcccgtgtgagtcatacgatgacgtctccaaaagtcccattagaattacaactgcaactcagtttacagattacatcctcaaaaaagtaggtgagactcctcactgacttctgcacctgacttgctgtgtaaccgtcaggaaaagtcacagtcccgagggccatgtggatacacgttctccagtcatgttggtgatttattttccactaaagaatttcccaaggcctcggtttctgtcccttagaatgggagtaagtgtggggataaacagctctcactattgacatcaggccttgagttccctctttctccaccctatccttcatgccgtaatttatcctcatgaaaaagacaggcagcagcatagtcatcagctagagctgcgtggtttcatatcagacggcagtgccagtgctactgagaggtaaatttctaggacaggtgtgttgttttgggaaacgttagatgtgttttttccatactttagaaaaggaacattttttgaggccttctgagactcaattctgagtgtaaataattgcttggtgggtgaatacatctggatttaacatacgtttttccactgaagtgatttacacatagctgtgaggatgagaagttagaattcttgaaaagaaatacgcttcacatactcttcacgtccttgtttagggtcatatgataaatgaattctatactgtggtgtttacttgtgcaggaatttctttccggtctacctcctgtggtctaacttgagtcccaatagctattgctaaattaagctttctcctacaaggcccactggaaggcgggcccactggcattagaagcagctgtttcagaaagaatggagagttaaacctgttgtgatttttctcaactgggagcaatacataagcaacttgaggatttgtattgttttttgataagttagatgtcattgaaatatgcctgattcctttaggcttggcaaacccgattccttcctttcccaggacctcgtgtttgtttcccactgtgaaattaa

SEQ ID NO: 34435 - DNA, 1297 bp, Homo sapiens
ggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgagtaagtatatgaaaattctactctgattataaaatactgtgatataataatatcatctataataacaatataatcttaagagctggaggattccatgtttttgagagtctagagcttctgtaatttttggatcccggctgggcacggtggctcattcccgtagtctcagctcctggggaggctgagacgggaggattgcttgagcccaggacttcgaggccacagtgagctatgattgtgccactgcactccaggctgagtgacagagccagaacgtatctctaaagaaaaaaaaatggccgggcgcagtggctcacgcctgtaatcccagcactttgggaggccgaggcgggcggatcacgaggtcagaagatcgagaccatcctggataacacggtgaaacccccgtctctactaaaaatacaaaaaaaatag

SEQ ID NO: 34436 - DNA, 1079 bp, Homo sapiens
cctccttactcacctccgtttcccaagtcattgacactcatgagatgaaactaaaaacctgggttccggtcgcgattgtgtcgcttactcctaactgcatgactgtgagagtcagagcccctgtctggattttcctgtcctcacctgtaacatgaaaggctccttagtaattaaaaatcacttcctattcacaagaaaatatgtgatttttaccatttccttccaacttctcataggcccctgtcaaggtgtattccaaaagaaataacacttaacaaaagttaccaaatttcctctgctaaaacagttatgcatattgcatattgcatttcggtcaaactagtatcttatatgttatgttggtggtagaaatagcaatttatagtaataaatagaattttctctttccaaatgtgccacctactttttaaaaatctttcccacttactagaagcctggcacagccctccttgtcctcgctcagtgccagggtgtggggtctgtgtacggctgaacaggcaccaggatacaaggagaacaaaagagaaggaggggtttgtcctctgagcacttccagacccatggaataaatccaggaggatgagggcatgcacagttctgttttacagattctttggagcaaaaattttcctcgccatcagctgtctaggaggtctccatttcaagaccagatagctaaacaaataagctgtatcctacccatgtcagccttcctcactcgataaacaatttaaaaaagaaaaaaaaaagacagactgtcttaaacatgattcttctcttaatgatggctaacccagaatccttcgaatccctaagggaactaattctggaatgccctgacttggatggctttgtctcaaggcctgtgaatttcagagctgggcattatcactttgtcagttctccctgatgtggtaatgactatgaaaggaaagaggcattgggtcactatttttgaatttgattcttgaagaaaatgtcatttctgtgaccatctatcactatgctcagcgttcaaaagggctggaccagagaggagtgggggaggctctgccctt

SEQ ID NO: 34437 - DNA, 1077 bp, Homo sapiens
taattttctaactgctttgtatgtatcacatactctaaattgcacagtaggcgtgtttattaaacagatgattggctgggaaagtttcaaaatagctactgaatttacagtatcagtgctattactgtctttgtgtatttggtagagcataccgaagtaattaatcttctaatgaatgctgatgatattttattagaatgaaagcacagattagcattaatattttttattctggaaatcctttggcaagtattatgaagcccaaatttagaaaactatgagatttcaaaccacataaacatgattctgttttccattttattttttaactgttaggtatttgcagttctgttccgtggaacttctgcaggcctgtatttagcatgctgtaagtacttttgggtgaaataggctctgagtctaaattctcagacatgtttctgatgtattaccatgaaaagcttgtgccacatgacagaagtgagatcatagtcttaacctcttcttgacgtggactggtcttcactcgggcaccgataaataacagatttggagtatctcctggtgcttattttagatgatgaagtcaaatcaacccaattagtgtcctgttagtaggtataatgagcctatttctttctaaaaagacttgtgatctggacatgcttttacaagaaatagtgaccttggggaatatgtaaacaaaagacctttttctaagagttgggagggggtgggggactgtataatgaaaagaattagcttacaaaaaagaaattgatattcaaagtattttaggcaaagccagtcaaaatgctttcatgatattttgagatgtaaattttgtctgatttgtattgttcttttcatttgccttcttaactttatatgtgacctgaattttccataacttgatgactatagattgcacctaggcattccaataaaagccaacccaatgtgtgtgtgtttttatattttttcaagtcttgggctagccagcattgcttttgtgtttaacgtggaggacgcaaatagatgcagttgttggggaattgattcatctgcaacccagtt

SEQ ID NO: 34438 - DNA, 1020 bp, Homo sapiens
aacctctgcctcccgggttcaagcgattgtcatgcctcagcctcctaagtagctgggaatagaggcgtgcaccaccacacccagctaatccccataggtagttttttgatcttcaccctcctcccaccttccactctcaaataggctgtgatgtctgttgttcccttttagcttccatgtgtactcagtgtttagttcccacttataagtgagaacatgcggtatttggttttctattcctgtgttaatttgcttaggataatggcctacagttccatccatgttgttgcagagatcatgatttcattcttttttgtggtgcatagtgttccatggtgtatatgtaccacattttctttatccagtctacccttgatgggcctttaggttgattctatgtctttgctattgtgattagtgctgcagtgaacataaatgtgcatgtgtctttgtggcagaatgatttgtattcctgtgggtatatacccagtaaagggattgctcggttggatggcagttctgttttaagttctttgagaaatctccaaactgctttccacagtggctgaactagtttacattcctaccagcagtgtttaagcattccctttcctctgtaacctggacagcatcttttgacttttatctaatagccattttgactggtgtgagatggtatctcattgtggttttgatttgcatttctctaatgatcagtgatgttgagaattttttcatatgccttcttttgagaaatgtctgttcgtgtccgttgctcattttttatggggttgtttgttttttgcttgttggtttgtttatgttccttatagattctggatttcagacctttgtcagatgcatagtttgcatatattttctccaattctgtaggttactctgttgatagtttcttttgctgtgcagaagctctttagtttaattaggtcccatttgttggttttcttttttgttgcagttgcttttggcctctttgtcatgaaatctttgccagggcct

SEQ ID NO: 34439 - DNA, 1023 bp, Homo sapiens
ttttgtttttgttttaaattgagacagagtctcattctgtttccgaggctggagtgcagtggtgtgatctcagctcactgcaacctccatctcccgggtgcaagcaatcctcctgcttcagcctcccgagtaggtgggatcataggtgcacacctcgacgcccggccaatttcgtatttttagtagagacagggtttcaccatgttggccaagctggtctcgaactcctgacctcaggtaatctgcctgcctctgccttacaaagtcctgggattataggcgtgagccactgctcccagcctgggaatttgttttgtttactgctgcatcgctggtatgtataggtgctcaataaatacttgtaaatgaatgaatgaatgtgtactgtgttgtagggattgagaactgttcaggaatgtacagtggggaggaagatagatgtttaacaaatattactctaaaacagtgagtacattgtaaactgtgaccttggtggtccaacgtatatctgaatcatgtgggctcccgattaagagtggagattcctgtggtgccttgcccgagacctactaagtcaggatttctagatgtggggcctgggaatcttccttttcaagcagttattgcaatgattctttcatacacaagatttgagaccactgcttcaaggggagagtggtctggtgctgccaatagataaagacaaagcagatttgcccttgtgttgttaatgggaagatactgactcacgtgggagtcatgagtataaactattagaacttttcagtactttaaagaatatattgggtttagcaagtattttttttactgtatataaagaagcattatttttaataagcagaattacagttttactgctagatcaaattattaataagaccttggaagaacagcatggaaaaggaaaaattcatttaccttcttgacttgtgcccactctactaattttatagtttttataataaaagccacagcctttactgaatttttactctaggccag

SEQ ID NO: 34440 - DNA, 1050 bp, Homo sapiens
cacctaatgtaaattaaccatttaaaatgatcaattcagtggcattgagtacattcacaatgttgtgcaaccaacccctatatttagtttcagaacattgtcatcctcctccaaggtacccactgagcagtttctatttacccctttccttgtcccctggcaaccatcaacctactttccttttttatgcgtttgtgaactagctatttcatatagtggaatcgtaccatatgtgacattttgtgcctggcttctttcacttagcataatgttttggaggttcatccatattgtagcatgtataagtacttcattcttttttatggctgaataatattccatttcatgtatataccacaatttttttatccattcacctgtctatgggaatttgggctctttccaccttttggctattatgaataatgctgctatgatcatgcacacacatgtacttattcgagtacctattttcacttcctttagaagtagacctagaagtagtattgtgggatcatacggtaattccattttaactttctgaggaattgctaaaccattttctacagaggctgcaccattttacgttgccacccacaatgtacagagttcccattgctccacatccttgtcaatactcgtgtcttttgtgtatgtgttttttaatgatagccatcatagtgggtgtgaactggtgcttcactgtggttttgatttgcatttccataataactaatgatgttgagtactgttactatttttatataagttagaaaatgaaggataaagaaagccttgctcttgaagttattttcaaattagttaagtatcctttgaagaaaggaaatgtttacttaaaattaaatgaagtgtctactattccaaataggaggactgttaagccattatctgtttaaatatttcatcgttttcataacagagatacttgtaaagccttcaggtttatttttaacttgagcttgttttccacttctccatcacctggttggattagggatccaatctaatttacgtcttttaaacaatagc

SEQ ID NO: 34441 - DNA, 1066 bp, Homo sapiens
ttctcatatgagtgcattgcttaattttcaaacaattggagattttcttttattattgacatcaacttaaatacattgtatttttcagttcaaaaacttatatttgaacctgggtgcagtggcttacacctgtaatcccagcactttaggaggccaaggtgggaggatcgcttgatgccagatgttcaagaccagcctgggcatcataacgagacataatctctattaaaattaaaaaaagttttaatctcagaatttctatttgattatttttcaattgtttctagttacttgcccaaattctgcacattaatgtgtaatttttgaacactttgtcatcctagagaggatttagttttgtttgttttaggtagtcaggccagggtcaggtaattttaatataatcatgatttgagctgactgtagcctgggcttcagtccttctctaagggcgggtcaatttccagtttcccttttcttttagggcaaagctcttcaaaatcccagttgaactcttgaggtgttttaccagggccccttccgttcgatagatgctgaacttcacgtctcttccctatgccttagctctgtgcagctgccagcccttctctgtgtctcaggtgctcagtcactgcatgctcccagcctttcactttctctgttgtgtgggcaaatacctcaaaagcagaaacagtgcgatgtttggattatgacactgagcttcccttatcttttggattttttttttttttggcggagtcttgctctgtttcccaggctggagtacagtggcgctatctcagctcactgcaagctccgcttcctgggttcaggggattcttctgcctcagcttttggagtagctgggactacaggcacctgccaccacgcccggctaattttttgtatttttggtagagatggggtttcgccatgttggccaggctggtttcgaacacctgacctcataatctgcccacctcagcctcccaaagtgctgggattacaggtgtaagccacggcgcccggcctcttttggatctttaacacaagttcttgctgcctt

SEQ ID NO: 34442 - DNA, 1035 bp, Homo sapiens
gaagctgaggactgtaaattaagactggattgtgctttttattccattaggcttcttaacacaactatgaataaatcactgggcctctctgcaggttgggctcccatcatgtaaactggaggtgaatcacacccttctggagtcctcagcattccaagtggctcccaggcctcgtaagcccggcatcttatcgtgattcgttgggtgagggaaaagcatgccgagagaggactggggttcttccagaggagcctcgtggtccttacaaagcaggaatttctttttttttttttttccatagagtgtttccctgtcaaaatgccaaaattttatggtgctagactgcagaactgctagattttttgtaaagcttaaaataatgcaaatgttaacactcttaaaagttagatctatttttaaaattatgccaaagatattaatacactgcattcaaaaaatcttaatgattacagaaaagtattcagcattgaggtctacctacaaaattgtttggtattgattattagcagctgataataattctatatgttttgccacctaatttgtggagaaagatataggtatagatacagatataaatataaaaacatagagacaaatacagtcttcagtaaagtatattcttactcagcagggaaggaaatatcttccggtgttccctggtcagctttttttttttataaaacaaagccaagtttcaaagtaattttgtagtcaccatagaaatgctagaagttgaaaacatcagcagccattacactacttagagggactgccaaaagacttctctgcaagggataggatcctctgcgttctattcctgtggaaggtggcaaagacggaacaggatcctgcgagcctgtcttatttcctatctgataaaatcacttctaggtaagaaaagtgggttggattttcttacctatgcatgattcatttccttccctgacttttcgtgatatatcccttgttaaatcagtcaacagatgtctgttttaagagtgattttttttc

SEQ ID NO: 34443 - DNA, 1099 bp, Homo sapiens
atagcaacagtgtattcagttacatacacgtgtgtgtatgcttacgtataagtgaaatgagtggcagcaatgatgcaagggacaagagggaagaatgagggatattttgttattataaggtacttgtactactcatgatgtggtataatgttatttggaagtggatttggatagtataatacaaactccagagcaaccactagaaaaaataagagagaaatataaatgacatgctaagaaaggagagaaaattgacattatataaagtcctcaattaaagccacaaaaggcagtgaaagagtagaagacaaacataggaacaaacaacaagggcagcaaatagaaaacagtaacaaattggtagatattattccagctgtttcattaatcactgtaaacatcagtggtctgaatataccaattaaaaaacagtttgtcagagttgatcaaaaaagaaccagctgtattttgtatgtaggaagcccactttaaacataaaacacatatggactaaaagtagacaatgctaatactaatcaaacgaaagtgggagtagctatattaatttcagatggagcagacttcagagcaagaaaagttatccaggatttaaaaaaaaagtatgacataatgaataataaagagattaattatccaagaaggggtaacaattttttttttttggagatggagtctcgctctgtcacccaggctcccaggttcaagtgattctcttacctcaacctcctgagtagctgggattataggcgcacgccaccacacccagttaatttttgtatttttagtagagacggggttttgccatgttggccaggctggtctcgatctcctgacctctggtgatccgcctgccttggcctcccaaagtgctgggattacaggcatgagccactgtgcccgaccaggataacaattcttagacatctatgtgactaacagcaccaactatatatgaggcaaaaaaaaaaaaaaaactacaaggagaagtggatgaattcattattatcctctgacagaaataaacagacccagcaggcagaaaatcagcagacatagttgaactcaacggcactattac

SEQ ID NO: 34444 - DNA, 1053 bp, Homo sapiens
gcctgaagggggaaaaagaataaaaatttatggtttgcacttaggtttgagatgcctaatagatttccagtagaatccagcatggaacccggcatatgaccgttagggtaataggaggtgaacattttggagagtcatctctatggcatttgaagccatgtgactgaaattactcaggaaattagagcttctcaaatgttaataagcatgtttggttaagatccagattctgcttcaggagatctgacgtggggcccgagggtctgcatttctagcaagcttctcagtgatgctgatgccgctgggccggggcccgcattttgagtagcaaccaagtagatggggaggagagagggtcagccctgtgtcactccaacatctaaaatggggaggagccagcaaaggaacctgaggagagctctccgtgatgtgaaataaagtgtttcaagaagggagtcgtcggctcattcaggtgctgttgaaggaagatgaacacaactaactgttagattggggggattgtcgttaacaagctgcacgtttggagtctggattgtgagcagaaggggactgaaatagagatggcaactgcagacaagccttgcaaaggggaacagagatgggttataactgaggcggaggtgagctaagggaggacttaagctattcgggaaatagtatggcatgattgactatatgctggaggaatcccgttaggaggggcaagtgaatgctgttgatggggaaactgaataggcaagacggagtgggatgcaggactcaggagaggctggtctcagtaggcagaagaggcagtgccttgtccatgtccacagggagggcagcacttttattcacttactcaaatatttattgtgcacctatttgcaaggcatcgtttgtactggggataaagcagtgaccaaaatgagacaatctgtaaccttgtggagcttagattctggagtgaatggggcgtatatgcaggtaggttgctaactttgttattgggaaaatgatagcttccactttcccagctgaggaagtgatggg

SEQ ID NO: 34445 - DNA, 1026 bp, Homo sapiens
aaaatatatgtttgtatgctctgaaaaatgtgcttgcttgatatgctagtgcagtggtggcagaaaatggactccaggtgatctttatatgaatattgctaagagtaaatatacatgtgttctaataaaaagttagaataaggagcagctcgtaattaaaagtttaacctaaattatctggtaggataaattctatttcgagacaggtcaaacaataaaatacagataattgtgtgcgtatttgtatatgtgtatgtacgtgtgcatcttgtctagctcaaaacaagttgatcaggttcctaccttcataaagaagctgatttaactgtggagaccaaaagcatccatgttaaattccacagagcactgcaagtgtaaattctgtaatatagtttgtaagtcttacaggatttcagagaagaaataaatagatgtgacctgggaaggtttaaggaagaggaaggcctgcaactgtgcttgaaggtgtggattagtgggaggaagtagtggttattttggacagaggaatgtcataaaaaagcatggacatctgaagttcagctagtttaaatcactaaatgggaagactgaatcggttggatttttttttattgtagaacaaaaaaaactgaaggtctctttccttaaaagagcattcttaatgtttggtgttgccttaaaagtgtaatgtttgagtatctggtaagagaattggtcttttcactaacagccttatgtcttgactagatttgtcgtttatttatttatgtttgtgaaactggttataaggttttctccaaataagcctcaaataataaagaagtgtatgaattaaaaagtggaagccttacaacacttatgctctatcccgtgatgtctctgtagcctgttacggttaaagcgagggaaagatttgactctgtatccctcagtttagaggaaataatagcacttaccaagcctacttactctcagtcttctgtattgactgtttaacaggtgttttatctctaagtacacattcag

SEQ ID NO: 34446 - DNA, 1022 bp, Homo sapiens
ggtgcgatctcggctcattgcaagctccgcctcccgggttcacgccattctcctgcctcagcctcccgagtagctgggactacaagtagttgggactacaggcgcctgccaacacacctggctgattttttgtatttttagtagagacggggtctcaccgtattagccgtgatggtctcgatctcctgacctcttgatccgcctgccttggccttccaaagtgctggggttacaggcgtgagccaccgcacccggcccgtatcagtccatttttatgctgctgttaaagacacacctgagactgggcaatttacaaaggaaagaagtttaatggagaactcacagtttcacatggctggggaagcctcacaatcatggcagaaggcaaggaggagcaagtcacatcttacgtggatggcagcaggcaaagagagcttgtgcaagcaaactcccttttttaaaaccatcagatctcgtgaaacccattcactatcatgagaatagcacgggaaagatccgtccccataattcagtcatctcccacagggtccctcccataacatgtgggaattatgggagctataagacgagatttgggtggggacacagctccaaaccaaatcactggttttgaactcctggcctcaagcagtcctcctgtctcagcctcctaaagtgctgagattacagatgttagcacctaagcctggcctagaattattaaaaaaaaatgtacactccacagacatttgtatactcaaaagaagttacagttcaataacttacttaagtcaacttaaaattgaataatattcctagacgaatagcttgaattgcttaacaattgttttaaagccttttaaattgtagatattgattcattcagtgactagagcattcaccagttcctgggatgtgttctaggcactgaagtggagaacaagtcagatacagtccctgtacttttggaggctccattctagtggcacaacagacatttgaaaaattaaagaaatggtctg

SEQ ID NO: 34447 - DNA, 1039 bp, Homo sapiens
gaaaagaactgtccagtctggacgaatcactttggtttttcctttttaaatctctgttctctggtcaataaaccagactctcctggactcttcctgaggaagtgaaaggaggatacagctcagtgaactctgcggcgcttctggaaagaaatccagttctctatctcatcggttagggttacatctctcctgtagtcttgttacagcgccaccattcattccaatcctcgcctgactccctccagcagtgcctctgggctccaggttctcctgaccggtcacttcccctctgtcctgggttggtcgtgataggctgggaaagccttggaaggcctgctcactttggagttaatatagaaccgcagagacgggaagcatcctttgttttttgttttgggggactttgtgactagcataatttgtctaggttgatcactttcctttcatcagagcctggttattaatttgtaacaaaaagtttgtccaaggaaagtctttaatcgttagtagactgtgaggtaatgtagaaaatgcagaaagcagtacgttttaaatataggaaatgcagtaatgtagaaaaacaaaagcagtactttagacactgtctgttcccagataataatggttactctagcatctttgtttcatttttacctgtatctttagcatttcctcttatattgaaaaaggaacattctagaagacagtctttatgctatatacttcttcattctgttagatcaggggtgtccaatcttttggcttccctgggccacataggaagaagaattgtcttgggctacacataaaatacactgacactaatggtagctgatgagctaaaaaaaatggcaaaaaaaatctcatactgttttaagaaactttaagacactgggggtcttgattgctttgaattgtttttctaggggtagtgatgaatttgtactaaagttttcatctgtacgcattgtaaacaataggacatgcttgaattttgtggaatttggatacgaattagagctgttatttatttatttat

SEQ ID NO: 34448 - DNA, 1033 bp, Homo sapiens
aaaaaaaattcaaaaaaatttaaatggtgaagtgtattcatttattttggaaacatcacttttcttccacacatgagatggaatggaactggaacacattatcgaaatccacaaaagctgtgaaaattttatattaaataatcctgtaacttgaaaagattttaaaaagtcctcattaaagataggctcatgaaaattagcgtatttttgtgtctgccaaaacttctttgcagaggaaatggggatgaaattccagatgatgtctttgtctaactgtacgggcaagggctgcattggctgaattgatgacttcgctgaagctattgaatttctagtgttgcctcagatcacgtcatcatttttgctgtgagctctgatagttgcaattgtgttcaactcctggtgagtgcagcacatgcctcaagtcatgagagatggaaaaggactactgttttctgcaggtaggtggccaccactaaagctttgaaatggtgtccacattcttggaagctagtgaactgaagcaaagaggaaaagaaccctccaactattttgggggctgatctgtgtcattcataaaagaatggctttcaaaactgcttagtaatctaggggaaaacctcagtccttaccaacaagatggttcactgggttcaaaagaacgtgccacacacccggaggcgtgccttgctttgcaaccctttgcatgctggctgcagggtccgtcctttgctggcgatcagtgggaagtatggttgccagactatgagctgaaagacatagtagccctatttttggatcgccagggaaaaaatcaaattgtttgtacttaagaaaagtcctcaggtggagcattgtgtatttggtagaaagactggaaactccaaatacacagaaatagaaatttcaagggataaaaacaaacattatagttcatgcatttataaacaggttttaaaataattataagccaccaatttgatgacactctcaagacttcgtgagagtgacttttgagaagttacatctcatc

SEQ ID NO: 34449 - DNA, 1087 bp, Homo sapiens
tgagaagtaacccatttatgtatatcatggtctccaacctttttggcaccagggactggttttgtaaaggacagtttttccacagactggcatgggggatggttttgggatgactcaagcgcatgacctttattgtgcactttatttctgttgtgattacattgttatatataatgaaataattatacactcaccatcatgtagaatcagtgggagccctgagcttgttctcctgcaactagacggtcccatctgggagacagtgacagatcatcaggcattagattctcataaggagcacacaccccagatccctcacatgcgcagttcacaaaagggttcacgctcccatgaccatctaacgctgccgcggatctgacaggaggcgcagctcaggtggccatctgagcgatggggagcagctgcaaatgcagatgaagcttccctggctcgcctgccactctcctccttctgtgcagcccagttcctaataggccacagtaccggtctgtggcccaggggttggggacccctgtgatatacatgattgtatttaatcttcatggaaactcagtgaggctcttcttatctctattgtctaagaggctgaaattcagagaggttaagtatcttgctggaggtccagctgtgcagtgctgagacctcagcccaggtctgcctgactccacggctgagcctgcacatggctctcctagccttcctgtgtccgacccatctgctgtgcacctcctgagaaccttcgggtgctcttgaaagcttgtatgatctacgtttttctttcaatataaatgtaaccgcaatgatctagcgatgattctctctttttaaaactatcacttgggctgagcgtggtggctcacacctgtaatcccagcactttgggaggccaaggtgggtggatcacctgaggtctggagttcaagaccagcctggccaacatggtgaaaccccatctctcctaaaaatacaaaaatcagctgggtgtggtggtggatgcctgtagtcccagctactcgggaggctgaggcaggggaatcacttgaacccgggaggcagaggttgcagt

SEQ ID NO: 34450 - DNA, 1015 bp, Homo sapiens
gctgatgaggcttcccaagcagtaggttgggaggaaggtgggccgggagcggtcagccttcacacagctgggccatccctcgtgtggcgcgtgctgcagatggcagcggtcagctcgtgtcatctcctagcatccctggaccgcaaaacaggcttgcactgggtggcaggcaaccttcaatgggtgaatagacgttccttcaggcccaagtgcaggcagccaccctcgctgtaggtgtgtgtgtccgtgcctctgtcctgccaacgtgggtgcagcgcccgacccctccctgcccgtcctctgtgtcccaggactcgcggtgaagccctgagcatgggcttccattgttattttctgaggatagcttgacaggacaggggcaacctagacctagtggagcaggagtcagggtcagcgaggtggctggggctggactttgccggggaggggttcagatttaatgcttcgagcagtggaaagctgctctgggctcctgagcacaggcagggtgtgatcaaatcagtgtttggggaagtttagtctgggaacgagtatggcagtcagtttggcaaatgatggggagaaggcgcgagaagggtcgttggctgtgagctgaaaatcgacaccatttgcagtcgctgaaacctttgggtaatctatcacctcttcttctgctctttcctgtttgtctaatctagaagttctcagtttttagtgcacaacagactcatcgggaaacaggttaaaacacagactcctgggccccactcccagggactctagctcagcagaccaggagtggggctggggacctgcatttcgttttcatttcgctcctcagatgattccagtgcagttgattcgaggaccaagtttgagaaaacaaactcagctgccaggttccatctggttttggtcttttttccctttctgttggggcacttctttctgttctcatcaccactgctagtcctgacccctccatggtttccctgagccttgcccctcaccgtcc

SEQ ID NO: 34451 - DNA, 1048 bp, Homo sapiens
ggccagaacgcgaactgtgtcctcttgactttgcatttcatgttctttttcggacattctgataatttctattaattaataatggaaagaatttgaaatatatgtgagttgttttggttcccataagttacatatggtgatgtggcacctaatgttgtgcagattgcatgagtaaagaatccatttaacttttaaacatcaattatgaaatgataaactttcggatttacaaatattgttgatactgagtctgtagcgagttttggccaacgctctaagggttttgtttgttcttccttttgtaaaatgttgccttcgagtaacacaaaggcctgtggtctgtgaacactcagcgtgcaaggatttctttgtttttcatggactctgtgtgtgtgtgcgcgtgtgtgtgtgtgtgttggttgtgggggcaagaactaggggaaaagggatgccaaaaaatgtaagcatgtagtttttctccgctttgttgtgaaaacaaaattgataatgtaacttttggaatcaagtcttttgtatttagattggaacgttctaataccttattgttacaaatagacaatgtgtctgaaaagctgaatttttgagagtggatggattatttaaaataatgattcttaacccatttgtacaattctgtgttctgttacaaatgtcttttctttgtccatgtaacagtcaattcctgttctctgaaggaggaattctctcggtaatttctgagcccttctttaggtggttggccaccagggggcaagcgaagaatggcagaagccatctgacgtagccccttcatcactgcagataaactggtgatgctttcctgacacacttaatggcaaccagaggttttctgcacgtttgtgtttgtgtgtaagtgtgtggggtgagtgtgtggcagtggttatttgctgtattttgactgcataaaattgccatgctttcccctcggtctcctagaaatccttgtaggataattataacacaagaaacagatttgatggaaattctcataattctcatactctga

SEQ ID NO: 34452 - DNA, 1061 bp, Homo sapiens
cctgagaactcatttctctctttaggttgcctgacatttgtagctgagtgaaaccatggtgagcattgatttattttactataaaattatcagttttactcactcaaacaatccttttatattaaaaatattttaaaaataaaagcagggtattgttttgctttactaaatggagtcacctctttttctcttacttttgacaatttggttgtcaaattgtgtgaattgtgaaaaaatagccctgagtacagagaatttttacctcagggatatcaaaaaagtcatgttagtaataaaataagccattgattgtgttaaaactcaaggtgggtcatttaattgcagttattaaaaagttctttcattatttacctctgggagagactgtaggtaggactgtaagattattaatgaaaatgcgtgtagattggtttaaatgattcagcttcatctcaccaaggagttagcatgttcattcattttacaaaagtgtattgagcacctcgcctactatgtcttgagtaatttgttagacatacaaagttgactaaaacatggactctgaccccaaggctaaaatgttatttcacatgtgcacagtgctttacagattacaaatgacatcattacatcctcataagaatctcatgaagcagatgttggttccatttcattcatgatgaaactaaaacatagaaaacataatagtctccccaaggctgcctgtagcacagttccttagattcccaatcaggtgacctttccaaactgtagagatggctctataatagtttaaaaaggagagataagaaatgtccaccataggtaaatacaaaatagacagtaatacgtacaatcacagaagttcagctaaagtggtacaggagtccagaagacggagagatggcttctgggtaggggatggataaagggcataaggactagggatagggatggatggactgtgcactttcagggcaggggaagatcattccatccagagccggaaaagcttcagaaaagcttaagccaggtgggatatggcatgggaagaatggaaa

SEQ ID NO: 34453 - DNA, 1051 bp, Homo sapiens
gattaggaggggcagttcctgggatcccacggtgccttgctcatcgctgtgcccctgctctggcccattctctctctccctcttcccagtgttgtagggtgtcacatgctgccaggtcttgggactgaagaggtgaccaaagtgcctccgaactccagctcctaccgcagtagggcagatacagccatgaaaacagacaaatgcaacagggcaagatcacgacgctggggaggaagaaagggtgtccatcgggtgacattggagctggtcttgccctgtgacaggcacctacagagctcagctggcagtgaccaaagaggatgacagcaggcatttcaggggtggcagaggggactgggggcagtgggcagcctgggaagggcaggggccagatggtgggtgttggtgtggcttggcatgacagaggcggcggggccagggtatgaacaggcttacggagccatctccacccacccacaggacagttttgatgagacaaagcaaatggtgacgcacagaaggccagcatggcccttgcatgcagggaacttgttgttgaaaccaagataaatttctgtatttttatgattttgatatcacaagtcaaatcctgaaacccacatgtcactgggatgatccaaatgatcttaccgaactgaatggatttttttttcctattataccaaagactagaaagacttttgatatctaggactttattttccttgtcacaatattctgtatattaggatttgttcatgtcagttgcgtttactgacagattagattagattagattagatatttactgacagaatttcctggcagattagaatgtgtgtgtgtgtatgtatttgttagtatattaaaactagtcaaaaagcctctttgctgtttaaagataatatataattctgcaattaaatatctgtgtccctttaaaatcatattcttttttttttaccgatgtctacctatttaggatgtagttcactgtgaatttttaaatcaaagaaaataacttcttccagtttttgtaaagggagatgag

SEQ ID NO: 34454 - DNA, 1184 bp, Homo sapiens
gctgtgcagggtgccggctgcctcgcatttgctttgttaatggtgctgaggaagaaagaggaaatgcctcagcttctggaagctaaacaaagtggatgtctagcctgatggatgagtggagtttctgtatctcccttcaccgatagtccattcatccaaggtcctgctccttatatacactggtgtttaatgctcttactgtgggctttgcaggacctcctctttaaattttgtttttaaaagttcattgatgataattgaccaatagccaaattcccaaaacccgtgaaggaccttagtcccctttataacaatgtttgcgtggaaaaataagagttccagtgtcaacacgcatctcattgccccattacctgaaactgttggccgagggagggaaccctttcctggccccagcttatgagtctgcagagatggaggcccacataacagggtggacacgagggctctgagaagggtcctccagagggcgaaggttcagatggttgctggatggtgtaggcagatgcaagatcaggagggtgaaggttccgatggttgctggatggtgtaggcagatgcaaaatcaggagggtgaaggttcagatggttgttggatggtataggcagatgcaagatcaggagggtgaaggttccgatggttgctggatggtgtaggcagatgcaagatcaggaaggtgaaggttcagatggttgctggatggtgtaggcagatgcaagatcaggagggtgaaggttcagatggttgctggatggtgtaggcagatgcaagatcagggtcactaggattgcacaacagaaaggggggggaatgaggaaaggcctccttggagacaggccttgtacctaagagatgatttgacaatcgaatgtttctaagcaggggactacctggatttttcagtaatacagactgagaagaaattctgcctgcatgtctgtgagtccattgaggacacttagggacacaagagaaaggggaaaaaagctagtgtttgagcaataaccatgtgtctgcagctcctggcactctgttccagcaccgtccaggtgcagaatgaaaggcagccagactggaattaagcaagtagtcctggagtaagatgcaagtagtagtggggtaagtagtgtggtaagaaaaagaccaggtctttttcttctaagca

SEQ ID NO: 34455 - DNA, 1675 bp, Homo sapiens
aaaaactgtgtgtcccagcactgctaggtattattagcacaccaccctcaagattttaaaaatatgtccacataccacctaacctatttaatacttcgctttaacttgatctacttttgtatttaagtgaattaaagaaacaattttgcatttcctatgaaattatgggtttctctcgataattatatattttttctaatccctagtaaaatggacatttaattagttcagtaaaaaatattcaactaggtactacccagaatgaacccatgtacctgagcggtactcacaccatgtagtggaaaacctgagtaggccaagggaggagggatgggacaaggtggaaagggttatgaagaggaaagggagaatctgggagaacaaaggaactggccgttctttgtaagtggttgggtttaagaggtggaagaaaataaaggtgaacatggcgaaaccccgtctctacaaaagatacaaaaattagccacacttgatggcatgtgcctgtagtcccagctactcgggaggctgagcggaaggatcacctgagcctggggaggttgaggcctcagcgagccgagattgtgccactgcactccagcctggttgacagaaggagaccttgtctcaaaaataaaaataaaaataaaaattaaaaagctgcaactgattttgttgttgttggaagaatgcagtaaatgaccaggaacctgcagaaagtgagcagagaatgagttccattttgggctaatggtttggtattccaactacagagggctttcaggtgaacaataaaggcgtataagttgcaggtcatttgtgcggcagtgttcgttgtgaacacgagaatagcttggctttctgtgctttctgttccccttcttggaggggagcaggtgactgatttttatttccagcagaaggaggttcagttggattccatgaactcagagccctccttgggtttctgaaacctggaaactcgaggttaggattgcttggagattgtccgctttcctgttcctgaaagtaaagtgccctttaattcttggatttgttttattagtgttctcatctattcagaagccattgcattgttgatagaagggatatgtttttgatgtctatagtcaggtctgaaaacagagctctgcaagtagccgcacaaaagactaggccagctatgtaaataatgtatatttcaaacatctgtcatatacctatcccgttgaaaaattacggcttaggtaactcatacacacagtcaaagtctccatttatctttctactttaatccgtgatggcccctccaggccaagttttctttttctgaagataaaagagagagatttggcagatgcctgtgggcagtcggggtagcaggactattgcctggccttatccgtctgatggccgtagtttcagagggaggagccatcctctgcaattaacattgccttctcacccctacagattcctgtctggttggttcccctaagagagctaatatgccatttactgctttcggcatatccaacttttgctttgaaattgtctcgttattagagaaaacgaaggccgccagagtgactgaggtgcatggggtatttgtcttttttttttttcctttttggctgcccagtatctgaacctcttttcgatgtcggtgtcattc

SEQ ID NO: 34456 - DNA, 1048 bp, Homo sapiens
tcagcctcccaaagtgctgggattacaggcgtgagccactgtgccgggctgccttattcttaaaatcgcaataatgagacctcacttaccaggttgctattatgattaagtgagagaacatgtgaagtattgtctctgatacttagagggtgctcggcaaatcttagatctttctttctcttggctgtaatctatccattgctgaaacaaggatgctaattcctggagactataagaaaaataataagtgatatccactaagcagaggtccacacagtagtggcattaatagttttcatattttttttttagtcttctcatggagaaattgaagctattggtataataggtggggaaagcagtgttcacaaccactaatcaaacgaagattaggcactaaatgaagaggaagaaacaataagagaggagatctcagaaatgatctcaagttgtaaacactcaggagccaaattacaaaacaaatacacaggctaattttaaatcaatcactgtattaattctttaaacatggaaattcaaaggtagcattttttctctttttgtctttgattttaagaaactgcccttaaaatagtaatagtttggatgtgtaatttgctgtactttcttaatttaggccaggcgtggtggctcatgcctgtaatcccagcacttagggaggccgaggtgggcggattacaaggtcaggagttcgagaccagcctggccaacatgatgaaaccccatctctactaaaaatacaaaaattagctgggcgtggtggcaggtgcctgtaatcccagctactcaggaggctgaggcaggagaatcgcttgaacccgggagatgtaggttgcagtgagcccagatcgtgccattgtactccagcctgggcgacagggcgagactccgtatcaaaatcaaacaaacaaacaaaaactttcttaatttaaataccaatacactttagatttttgcaagatatttttatatttttagatcatatttttttgagtgcttgttgtttcaggctggtggtcttatccgt

SEQ ID NO: 34457 - DNA, 1031 bp, Homo sapiens
agtattgtgctatgaatacacttactttccttacacagccattcgttttgtctgcagttaatgattgcctttttaaaaaattgcatagattttaaaaaatagcctttaactttttccccagtgctcatcagaagtgccagattcccaccagaatttttttccccaagtactctagtatctcaggcaatctaggtattcctccctgttcttggagacttagctttgagagcgccctgtcctcctcctctgatcgggactagtagcttttaaggctggctaacagctgatatctgggagttttcttttcaccattcctgtgttggatcctctgtcttctaggccccatgtcttcctgttcctggatttatttcccgattttgctgggccacatctctagtagcttcctgggaatattaattttgggagtttgggagaggattgttctgttctgtgccttgcatccgcttctttaaagtttttttttttctagtttttgctttgttttgatctctggaggcactaaagtgttgcttggaagttctgtgggaggtgggcttatccctcgtgggcctgcctgcagagcgatctgtagaggataatggttgggcttttctcttgcgccagtttccctggaagagtctaccaggctccagagtgtgacagcagtccagagggagagtaaggcatatgatttttcacataaccctatttcattcagtaactgatttctcctttcagctatgcttggtatccctaagttaacaacctgtgggttaacctctccagtatataaaattgctgccgtctgcctaggttgagaggtaactgtattagatgaaggaataggactgagtgtctaaatgctccttagaaagttttgcaaacaatagttctgctttcagtcctgttttacacctcgccgttaacaatacctgaatttgagagactttgcagccttctttcctcccaccagcttttaatttatttcttgtgacagaaaagttacaaagtacatgaaaggaacactagtc

SEQ ID NO: 34458 - DNA, 1047 bp, Homo sapiens
cagggttttgtcggttggttagagaatgttttatcacattcataaatagtaacccaatgccctggaaaggttaaggcagtgtctccaactaaggtatgtgtcgctaggggggacacataccatagttgagttgggctatctggttcatcgtgtcacaaatgggaagcatgtgagcaagcttttggacagagctcaccgagctgtcatattgccaccccaatgtatttacccctcaaacagttcataaaaatttataagcctttaaaagcataaacaaagaataaaaacacatcgaacgacaagtgatggttgctgctgctgctgctgctgctgctgctgcatagaacggtggactctgccagccaccttgctttatgtgaggtcaggccaccggcatgtgaggaagctggatgatcgtcagcccagctacctccgttcaccaaatacaaggccagctagcaagaatctgtagccagctttgcagcgcttcacccttgctttattcttttatatattcattttttaatgttttagattcagcggtacaagtgcagtacccctaaatcttattgtgttacatgcgtatcttccacagtggtgacgtctgggcttttagtgtgcccatcacccagatagtgtacactgtacccagtaggtagtattcttggcttatttctacccctctatatggtttccgtttatatggctttgtaaagaaagactttaccaaagatacataaatgtgatagcatagctaggtttttaaataattggttcaaaatatttgtagcacaaaaaggatcttgggttgtgacttttaccaagatgttgattctatctcctggcacaaatgccaaagccagacagcttgtgctgagaccacagttggagaggcctttgaagtgggctggagtcctttgtctaaaacaaagcagggtgcggtgaccccatgaagagaaatccacctgttgatgagacaggcactttttctctataaacatttgattgttctgttaccttcatttctctggcagatgggttaattgt

SEQ ID NO: 34459 - DNA, 1069 bp, Homo sapiens
ataattcatatgaagtagctaaatcagggcttagagggaaatatggaggattaaaccctcatattagaaaagaaaaaaagaactgcaatgagcaatctaagcttctacctaaagaaactagaaaaagaagagcaaaacaagtctaaagcaagcagaaagaaggaattttataaagataagagtagatatcaatgaatttgaaaacaatagtggagaaaaccaataaaattaaaaatctggttttttaagtatatcaagagctgataaacctctagccagattgacaaggaaatatgacataaattaccattgtaaggcatgaaagagggcatatcactatagtccccacaaaaatataataagcaaacaccatcaagagctctgtgcacataaattcaacaatatagatgaaatggaccaaatcctagaaagaagaggctgccaaaactcaccccaaaatatccctttatatctcaataaattcaatgtataattagatctttaccaaaaactcaaaaatcaaaacctaaaaaactacaggtttggatggtttcactggtagaattctctgccaaacatttgtggaagaaatgacatcaattctgtaagatctttttcaaaaaacaaaagaggaggcaacatttcccaactcgttttgtgaagccagcattatcctggttaccaaaccagacaaagttagtacagtaaaagaaaactgcagaccaatgtctcttaggaacatagatgcagaaatccttcacaaaatattagtacattgaattaggcaataataaaaataataacaagtcatgaccgagtggatttaggcttggaatataaggcagcatttgaaaatcagtcaatgtagggctgggcacagtggctcacagctgtaatcccagcactttgggaggccaaggcaggcagatcatgaagtcaagaaatcgagaacatcctggccaacatggtgaaaccttgtctctactaaaaaatacaaaaattagctgagcgtggtggcacatgcctgtagtcccagctacgcaggaggctgaggcaggagaattgtttt

SEQ ID NO: 34460 - DNA, 1035 bp, Homo sapiens
gctaggtcagttcctggcttctgctgatttttctcccttcctccttttctggatgtgggtactcctgtctccctctggccactgggacaacgtcttatcctcctcatatccatcttgcagagagtggagctacagtagagctgatgggagccccatgtggtccagggaaaggggggcgttgaactgagctgggtttgggaagggggtgaggcctgagccttgggcactggagtcctgctgcttcctccgaggcacctgttggactctccccgtacgtgctgatctttgtcccaggccctgctgcctgatttcatcgagcaaaccatttctctcctagcccatcaaagcagcaagtttttccccatagggactctgcactcctcctgcaaactaggaactgtggctgggcatggctttaagtgcctgacagtgaggaggttggtccacctcagagcagccagacaccttgtcggggagggtgttgcttaatgctacaggccgacctgagtctcggttttggtcaaccatggtagcttattacaagcatgcttcagaaacaaaaaaggctagattatggaagtacatttaggaaatcagattagaaacttaacagaccctgtgagcccttctatgttctactgtgttgatagtttgcatcctcctcgtgtaggacatcttttcaaatgcaaccttggagaaccccaggtataaaacaggtggcacccaggtgtcaggagcgaactttcctgccctcccagcctctgcttctactgggggcacctccatcccagaaatattccaagaaattctagggatccttggagcatcacttgaaaatcactgactgcactgtggtataaagacttgagaaatgaagacagatatttgcattgtaggttgacatctcaagagtcaccgtccatcacccctccgatgcagggtcttcagcctctcctgcctccactggcccttttagtgtgcaggaggccacattctctgagggaattgtaatctgccttctcccactcctcccag

SEQ ID NO: 34461 - DNA, 1050 bp, Homo sapiens
acaacaacaaaaaaaaacaaaacaaacaaacaaaaagaactaacaatatccatgatgcagagtcatcaggagaattcgaaacaggaactgggatgcacttaattcaagagagctattattatgcagtagttgtcactgactaaaatttaaacagacatttttcttgatgtatttattatctgcaaggtgtaaaataactttctatgcatgtcattgaagctttgggggaggggtcattctagagctgctacggatccgggcgtgatacatgaagatgaatttcgcagcccttatcattagtaattaaaggtgtgtgagccaccatggatagtgtattagtgagcaaccctcatctttcagagctaatcttattttttcataccctatttatcttatttctgatgttcttttgtttctttttaaagtttctacttcacttatctttgaaattacctcaaatcttcctttggaagtgattgtatatgttaaaatgctgctctaataattgtcaatagctaagcattcttcctttctgttctgtggcttctccctaagacatacaatacagtactggttagcccttgctaactgatggtctcacttctgatttattcagacaaacgtgtgtgtgtgtgtgtgtgatttgtcaatgcatacaaaagtaatatataatagaacataacatggtcaacgctgatttgtcggtttcctacaggggagcaggtacttggatccacagcagagtgtggggcgggaggatgtgggggagatggaagggagaaggtacttggacccacagcagagtacgggacggaaggattagggggagatggaagcagagccaggggaaggaggacgtgtcctcagacgtgtcactgggcatcctgagtgggccagcaccagtcagaatggtgcagaggctgccgtttgttcttgctctcccctcaccccttctttctgttctttgtttcggggccccagtctacctgactcctggcctctgtttcacttttgtcctgtgattgggaccccctggtctgcacttcagca

SEQ ID NO: 34462 - DNA, 1023 bp, Homo sapiens
caaaacaaggagaggaaactgcgaagagccgcggctggaaatccccccaccccccgccctcctccggccgcgctccctccctcgcctcccctctccgccctcctccctccgcccttcctccccagtgtttgtttcaagcttgtgcaaccgggaggtggaggcggagggagggcgcgagcggcccggccgggaggtgcggaagttcgccgcagcagctcattggcgggcagcgccgctttcatcatttctcggaaaagtcaatttcattttcgcttccccaggtcgcggcggcgggagcaacaagcagcggctcgtgagtccgcggctcgcacccaggggcgcccgcacgtgcggctagaacgtccgagtcggggtccggggcggggggcgcaggcccgcggcggtaggggaggagagcgggcacccgagtctccatcctcagggtggcctgaaggttccaggagggcgtccggcgaaggcacggggctgcgaccatccagttagcagggctggtgtgactgttgagagtaaatgaaaattcgttttgtgacaccgaccacctccaaggaatgaaaggagcagtcagccgaaacgacagcattacttgcgtccttacctaattggaaccttatccgtggctgagggtgccaccattggaggggccgccgccccctctgacaccacctggcgctccgctccatttaggagctagaacgaaaaggaggcccatcccccagtaagtcacagcccacgccaagatgagttctggagcctgtgcgaccgaagtttcttcaccgcagggcgaggtggacaagggtgtgagttactttgacttcaagacgtctcagtggcggctggttctggagagaggctttatgctggagcacttccagcaaagttcggctggggcctccttaactcactggctggtcacccttggcctcggttttcaaccaaagcctaaggcctcagttttcaacgctgtaaatggaaataaatgagagaagaaagtacagcccgtgt

SEQ ID NO: 34463 - DNA, 1062 bp, Homo sapiens
atgtacattttatgacagtaaatgataacttagactagccatctacatatattttatgcattcatgacacacttaactttttctaattatttttaattattttctaacattttccaatattttaggctatacggttcatctgtgagttttctcaaattgttgtaagtccccccaaaattttccaatatccttattgaaaaaaatttggctcatgcctgtaatcccaacactttaggaggccaaggcaggtggatagcttgaggtcaggagttcaagaccagcctgaccaacgtgatgaaaccccatctctactaaaaagacaaaaattagccgggcatggtggtgcatgcctgtaatcccagctactcaggaggctgagacatgagaatcacttgaatccgggaggcagaggttgcagtgagccgagatcataccactgcactccagcctgggcaacagagtaagactcagtatcaaaaacaaacaaacaaacaaacaaaaaaactcacatataagtggtgccatgtagctcaaacccttgttgttcaagggtaaactgtagtgtgtgtttgtggttgcctttgtacccttagttgtgtgtttgaggaacataagtcattaaataatagtagtagtctgattttatcagtattttcctctgtggtcagtgtttcttgcatcttgttaaagaaacgtggcctatcccaaagtcattcttttgcttttcttccttatcttctaaaaacttattgttctgccttttatgtttatgtttaatttattattttttagagacaaggtctcattctgttgcccaggctgaagtgcagtggtgcaatcctgccgccttaaactcctgggctcaagcaatcctcctgcctcagcctccccagtagctagaactacaagtgcatacgaccacacttttaatacaaatcaatctttcttccctcccctcccctgccttcccctcccttccctttccttcccttcccttcctttctccttttccttcccttctcctttcccttcccttcccttcctttcccttcccttccccct

SEQ ID NO: 34464 - DNA, 1073 bp, Homo sapiens
gttttttaaccgtggaatatatcatacatacaaaagtatagataacacacttttttttattttctgagatggaatctcactccgttgcccaggctggagtgcagtggcatgatctcagctcactgcaacctccgcttccttgattcaagtgattctcctgccttagcctctcaagtagctgggattacaagtgtgtactaccatgcccggttaatttttgtaattttagtagagacggagtttcactatgttggctgggctggtctcaaactcctgacctcaagtgatctgcccgccttggcctcccaaagtgctgggattacaggtgtgagccaccgcacccagccgataacacacttgtatacgcacattttaaagactaaagtgaccacctgttgtatctgccgcccaccttaacaaccagaagctgatcaaacctcagaagcacctgtgggcccaaccccaatttccttctctccctggccctcagagatggtagccagtatcccgattttgtgttcatcttttcctcgcttttatgatttctcccatatacgttcatatctctaaacaatatactgttttctttttcttttcttttgttttttgagacagagttttgctcttgtcgcccaggctggggtgcaatcgcacgatctcggctcactgcaacctctgtctcccgggttcaagcaattctccggcctcagcctcccgagtagctgggattacaggcatgcgccaccatgcccagctaattttttgtatttttagtagagacggggtttctgcatgttggtctggctggtctcgaactcccgacctcaggtgatctgcctgccttggcttcccaaagtgctgggattacaggcatgagccaccgtgcccggccataaacaatatagtgttttcttttgcttgttttcgaatcgcatcctctcccttgccttgcggtagcatatctgtgattttcacccacgttgcagtatgtagctgttgcttatttgtgtcactattgtgcagcatgccatgtgtataaatataaataggccacagtttatctgttttcccac

SEQ ID NO: 34465 - DNA, 1057 bp, Homo sapiens
ccttcaccaccaccacccccaccccaatcacctttaggtattttctcccctaaagcctcacctgttggcattttacatctttttaagaccttattttgtattttaaatgtatgagaaaaattatggaggatgatgcaagatgagtgagtccataatggtaataattggacactaaaaacaatgaaaacttgtctcaagtatttgtgttgaaatctcaattaactgggcgactgctcccgttccattttattctgtaaaatatgtggcatcctttgtgttgaggcggcatttactaaacacccccaaggtgcaaggctgcaagagaatcgagcgccgcaaggcgagcttatcttccacacctggtacagtgcccaggacagagaaggtgtttagcaagtttctgctgaatggaagagtgagcgagaagggaaagtgcatctaaaaagcacagggaacctacaaaatatttgggaaagggtttcatcagttcgggtgaaatcttgaacgtgcaaagcaccatgggggtggctggacaggcttgttggagtcgtataatgcaatgaataaaaacttacggctgccttaaatgcaaatgtcaagcccttaaataaaatttaacaaagtctaccgtgtcacaaattctttgcttttctgctcctcctcaatatcagagattttatcaatccacaataaagtacagttgatctcattcacagattacatatctgtaaactggcttcactgccaaacttcatttgtaaccactttaaggtccttggacacacagaatgatgacaaactcaagttgcctgacacacatccctagctgcagtggaacaaggtgacacttaccccgccttttcatttcagcctcatcctgtaaacaagcatcctgttcacatgtttacttcgtgctacagaaattctgctgtttaaaaaggccctcaagctttgtgcagtggccaaaatgcagtttatccaaggcacaatcattgccaattaacatggcccccaagcagaatgctgttcctcagcacaggagggctaagacatgcct

SEQ ID NO: 34466 - DNA, 1072 bp, Homo sapiens
gataaaaagtgagagttaatgaagctgtgtgaatggagacaacagacagtacattcaaaagtgagtgagacttttctttgatacaattctcattatttatcattacaataggttcaagaatattctcaggagggtcctaacattccttttaaacaataaattcaaccccaaaccaaaggatcccacaatatatagcagcagatgtatcctaggaaagtcttccaagttgaatgttctacttggcaccttcttaattctggtcattcccaggggatttatttctcactcttgaatcttcagctgcttttgtttttgaagcatacgatgtcacattggtaatggtaattgactgttgccttcctaaaaatatcttaggcttcgtttcccaaccatatcattttggggataggaagtgccctagattccttaaaatgtaggattctttatagtcagaatggtacacgtggttgtgctaaaaaggtgacgcagcaagtttggtgccgagcgttcaggacacagaaaatgcacagtgtctgtggaaggctgttaggactgaaataattgcataccaccttgccagcatttttaacattgcaactgtacttttgaaggaaaaagattgcaaactcagaacctgtatttttatccttcactgctgtaggtcacctatgccacctaggttgcttggttgaatggggatgacaggtaggtaggcagcccttcgcaggggcactcctggataccctaagggccgggatttaggtctaagtcacaccctgctttagtctaggagtgtgtgcttctatagttttttgaggcggagtctggctctgtcacccaggctggagtgcagtggcacaatcctggctcactgcaacctctgcctcccgggttcaagtgattctcctgcctcagcctcccaagtagctgggattacaggcgcccgccatcaagcctggctaatttttgtatttttagtagagacggggttttgccatgttggccaggctggtctcgaactcctgacctcaggcgatccgtgccccttggccccagaaagttctgggattac

SEQ ID NO: 34467 - DNA, 1028 bp, Homo sapiens
gactccatctcaaaaaaacaaaaaaagaaaaaagaaaaaatgttttcttcttatggaagctaaggaacttatgcccctccttgcatctcctgtgaaggcagcatcttcttttttcttgtggcttctctccatctggctcagactggctgctgggatcaagccaggactttctctagtccccaaccttgagctgctacacataagccacctcccacaaggcctcttcctcttatgtaaatcaactcataaaaatatatacccgagggctgcttgcaggctgccaatttgttatacatgaaattaacatcttaactgttccagatatttccatgtgtttttcctgaagcagagttgttaatcttttttttttttttctgatttttttccatttcactgaacctttctttttttctgaaactgcaaccgctagatagctcagaaagttggatgtttcccagatttgcatttgggtcattcttgaggtctcattcttcattctgttactttagggcagtctcaactttggcctcctacaataatcatccctgtctatattgaggacttaagagatttattcctgaggttcagatctagttttgggcctcagacttatttattcaactgcttaacttgacatttccacctggcagtcccagtggtacccgaagcttgagtctgtgacatcttatgaccagtgtctgtctctgttcctcttgtttctttttttttctttaaattttattagtattatactttaagttttagggtacttgtgcacaatgtgcaggtttgttacatatgtatacatgtgccatgttggtgtgctgcacccattaactcgtcatttagcattaggtatatctcctaatgcttgttcctcttgtttctgtgtcagtgaatagcacctctgaaagtcaggtcccacaactgagtcccttttttttttttttttgagatggagtctcgctctgtcacccaggctggggtgcagtgtgcgatcgcggcttactacaacctctgcctgccag

SEQ ID NO: 34468 - DNA, 1032 bp, Homo sapiens
acagagctagctgggatggtgccaggctttctttgacaggagagccagccctcttgatctctgtgctctgctgtctcataagggagaagcagcatcgcaaaggtacgtgggctgagtgctgaggagttaagggccaagatgtgaagttggaggccatgaaagactagcaacgcccgcggtgtggttgtggaatttttgtaggtggaacactaacactcctggagtgaagcagtggagatctcatctgtgggcgtggtacgacagagggccagggcacaagaatgtttaatgagagctgcccacacctcatcaagccaagggaggagccgaggccgggaggaagctgagagcttggagagaagggaagggtcagaggcctgcgaggcctcctatctgctggcatgcaaaagccttccatgtggccgtgagaatgggcgagcgccgtggagtggagatgagggttgctggaggtgaggaggtccagttgcggtgtgggtggaatctgccccatgttctatgtctgttgtcttttttctcattgactgaaggaattgcccccagaagttctctggtaaaatgttaaaggaagattgcattatccattattaaatcagagggagttgaggaggctgagggtgggtagaatgggtgttgccatctgttgatttgcccacggctgtctctgggtgtgccagcgtcattcaggccattctcttgtggctgtgctcaggcacagttttgctgactaaacgctacagaagtcaggtattgggaaggagaattgtttcttctttagaggagtaggttttaaccatgttaaatttccaagaatgggtttatttatcgcctctacatagtgtagaccattccaggaaaataaatgatttttgattcaagtactatatttatttatttatttagagacagggtctcactcctgtcacccaggctggagtgcagtgatgcaatcatggctctctgcagcctcgactacctgggctcaggtgatcctcccacctcagcctcctgagt

SEQ ID NO: 34469 - DNA, 1085 bp, Homo sapiens
agcaagttacttcacttctttgagcctcaatttcctgaagggacgaaactcacttactatgtaggaactgtggtctatttgtttgttgccaataaatgagattataggatcaacccattcctgtttttgcagtttcatctgggtcagaaaccatttccgctgtttttccttaatggaatagtaccattagggatgagatgtagctactttttgcaaaatctagaaaacataacaaccataggttcaaattaatatctgaaaatgagcagaacgtgactgagagtttcatgtgccttgttttctggttttgcttttgttttaccttcctttttgtgtccagtgcttagtgatacggatattgattccaccttacagactagaagccctctatacattttatttgctgagtagtaaaagattgagatagatcttttttctgtctttggcaattaattgttctcagctggaaggcacagttatcttatccctacaactgaggctgctggaatcactctgaaaatttatctaaacctttgtgtcattgtttgtgaacaaaaatcctaatgctgttgcatgtttttgagttatgaaatttaaaatgctgttttataaattgctataaagctgaattgcaaaaatactggaaatgtgaaaaaacattgaatatacttccatggttgatatttcaaccatgaaaaaagccatcatagaatattaataccaaaattgtgcttcctttgacctgtgggcacttgcaaatatgtgattccattgccattcagttttctaagaaaaatgactctccctctccccaccctccaatccctccccccagagagctcacctaaatttctttttttttttttttttttgagtcagggttttgcttgctcacccaggctggaatgcagtggcgctgtcttgactcactgcaacctccacctcccaggctcaaatgatcctcccacctcagccccaagtagctgggaatataggcgtccaccaccacacccggctaatttttgtattttttgtagagatggggttttgccatgctgcccaggctggtctcaagctcctgggct

SEQ ID NO: 34470 - DNA, 1027 bp, Homo sapiens
agtcctggtgcagatattttgattctgttgggttgggaccgtgttctaaatgagaagcaatgaggcgctgcactcaggcagggcagtggggctgcaggggagagggcagttctgagaactatttaagacggcaccatccagtagaactttctacagtgaagaaaatgttctacttggcaccgcccggtgtggtccacaagcccacaggtaccgtggagcatttgaaatgtggctagtgtgattgaggaactaaacgtttattaatttaattggatagccacatgtagctcatgatcaccttattagacagtgccaatgtaagaagtagaatcagctagctctgctcacctaggattgtggaggagagggaggctgagcataacctcagagtttctacaggtagttatgcttctggtatagggaacagagtggaagtgaggaggctcctgatgtttacgtgagggcctcagaatgactagcgcgtggcatggggcccggcctattgtagatgctcggtctatgtcggattattttatggagccttgggcaggattcacagctcctgtgttacatttgtttagtataaatacagtctaaagttatttctgaaaatagtattttcttcctcttaaatctttttcttttctctttttaaaaatcaggtatcaaattgtagtggaaataatccaggcgactacaattagcagctttccccaactgaagaggcacaaaggtaagagccaggttgttttcttcagttccacatctgaaaggtcagcttgatccccggccttctcccacctgtcagatctttggcaaataggagcttttctggcttacatttaaatatttcaatttattaaaaacaatactattacagtattagagaagtaaatataatttcatcctaacaacaacctttgtctgtatttctgtattcccgtataaactttattcagctgcagtcataatttttagaaggctaaaatcattcagtatatgtttctgttctgtttttaaactaaac

SEQ ID NO: 34471 - DNA, 1029 bp, Homo sapiens
tgctcaccctctttctttcttcctcagccccaaattctagaaagaacacaatacctgatacatattagcaaaatgtaccatttgagagttcattgatccattcaactcctgtttaatgagcgtctcctttgctgccaggcactgttgtaggtgctggggatatagcagtgtatacatagataaacacctacttttatgaggatatatttacgatctcccttgtcagcttctcttcccccttactcttaagagtaaggtttatctcagttgtgtctaggattatttgtttcctcctgggttgtctcacacactcccatgatgtcatttactatcccagagctgaatgtttccgaactctagaccttctctctccacctaggtagctcagaagcccgcagactcattttgcctgtttggttgtcttttactgtgtaacaaactaccctaaaacatagtgtctttaacaacagccatttattttgctcatgaagctgcaatctgggcagggtttggaagtaatgactcttctctgtgtcacgtgacgtcagctggagtggcttgactggggtgggacggtttactttcaggatggtgtactcacacggtgcctcattggtgctgaatatgagcttgagatctcagccagagctgtggttcggggagcctcggttcctctccatatagatctctccaaggactgatggcttaggcttcctcaaagcatggaagcctcggggcaggtgagccacttacatagtgacccagagctccaagcccttggtcttttatgatctagccttggaagtcatagcatcactttcgtcatattcgtaaccccaaccagattcaagaaaaggaaacatattctactttgcagaggcagattgtcagagggacatcgtaaaaagagcatgtgagatggaagacattgcagccgtttttggaaaatatcacctgccatattgtccagagttgagttagcatcttccacaaacctgctttttctccagtgtttctagcttagtaatt

SEQ ID NO: 34472 - DNA, 1053 bp, Homo sapiens
caggaaaagagaaactcatttctgttgcaataattcatcctcagagtaaaaccatttcctctaatcttcaggatggaaggctaagataagacagaattccaatagttatggtcatttgctatttgaaaggtaagactttggttagtttggggccattctgatgtcttcatgagtgggaagaaaacttttgctatgacctaatcatatgtgatccagaagaattaccattaactttatttcagaatttagacttccaaatcaggttaatcctccaattaaaagaaagattcagagtgaattttttaaaaggcaaggcagttatatgttgcttacaagaaactaaacataaaggcacagataagttggaagtaagagggaaaaagacatgcgaatactaagtataagagatctagagcagctactgtgaatatcagacaaaatagacttcggaacaggaagtagaaccagagatgaagaacctttcattatgataaaggagtcagttcgtcaggaagatagaataatcaaatgttctcaatcaataaagagacctttagagtgtacatgaagcgaaacctgacagaaatgagaaaaaatgtcacaagtagagttggaaatgttaacagtccccctcagtaatatcagtaataggaaaatctggaaaattcccaaatatttggtagcatatctaaataaggcttccatcaaagaagaaattataaggaaaattaggaactattttcaatggagtgaatatgcaatatatcccacaattatttgtgggatacattatgatatgtatattgtgggatatattgtgcagttaaagcaccacttacaggaattatgtacagttggcccttgaacaatgtgggggttaggagtgctgactctcccctgagcaaaaattcacatataactatggagtctccaaaagcttaactgcccatatcctactattaactggaagccttaccaataatagtcagttaacacagatcttgtatgttatgtgtattatatactgtactgttagaataaagtaggctataa

SEQ ID NO: 34473 - DNA, 1032 bp, Homo sapiens
aggaatgagatcatgtcctttgcagagacatggatgaagctagaggccatcatcctcagcaaactaacacaggaacagaaaaccaaacaccacatgttctcactcgtaagtgggagctgaacaatgagaacacatggacacagggaggggaacaacacacaccagggcctattgggggtgggggcaaggggagagaacttagaggactggtcaataggtacagcaaaccaccacagcacatatatacctatgtaacaaacctgtacatttacttaaataaataaatagtaaattactacaataaaattttactttattcctttaaaaaatgcatttttaccctaaatgtagaaatcagtccattggaagttaaagcaaactgacatttaaaattcgattttaaaaaaagttttcttaaattctcttaatagattcttcagtttgaagatatcttggccaatacgttctaccgagagcactttggaatgtacatggaaaggatggacaaaagagctctgattagtttttgggaatctgtggaacatttaaagaatgctaacaaggtagtatatgtaggctgaaaggaatattaatcactagctgatgtaaacttggcatgtgaggcagcatgtctgtttttctcaagataagtatacattaaaaatattttaaaccaaatataatactgacattatgttctagcccataatggcaaataaaattacattatatttttacagaagattcttttgaatgtgtagtcaagggaaaaaaggttttataaatgtaccaagagattgaatttagttttgggtattttttttacacattgtaaaaagacatatacatatccacattactattataatgaatttggccccctcacctacacttcagtctcataatcttgccatttataatatcataatgtgcatgttttatactttgcctttcatttcaattttttttttttttttttgagacggagccttactcttttacccaggctggagtgcagtggggcgatctcgg

SEQ ID NO: 34474 - DNA, 1033 bp, Homo sapiens
cgagcttggtagtttgctttttgttctcacaagccatgctagatgctaaaaaaatatcttgggtgttttttttaattaaaggaaaatacacatataaaaatacacgtaagtgtataactgtctccgtttcacaaactgaacacacccatgtaaccagcacccagtccaatgcactggttatcaccagcagcccccagcttcctcccatcgctgcagcccctctaaaggcaactgctgtcccgacttccagcaccatagatcagttacagttgtctttcaactttatataaatggaaccgtatagtgtgaattccttcgtttctgacttctttcactcattatgttcataggactcatccatcctgtcatcttagttgtagatgattcattttcgttgctgtgagaggttttcatcgtgtgaatacactgcattccaaattcattccgttgttgatgagcctttggctcctttccactctgaggcttttacaaagggtgcttatataaacgtctagtacttgtcttttgacaaatatctgtcggctgatgcccagagattaggatttctccatttttcttcatggtcacagcagttttatactctccccagcagtgtgtaagggttctgattgctccacatcctcaccaacacttatcttttgcgtttttattcttagccattttgggtgtagtagtatctcattgtgtttggggggtttggtgtttttttttgttttcttttgttttgttttgttttgttttgttttgagacggagtttcgctcttgttgcccaggctggagtgcaatggcgcgatcttggctcaccgtaacctctgcctcccgggttcaagtgattctcctgcctaagcctcccaagtagctgggattacaggcgcctgccaccacgcctggctaatttttgtatttttagtagagacggggtttctccgtgttggtcaggttggtctcaaactcccaacctcagatgatctgcccacctcgacctcccaaagtgctgggactacaggcgtg

SEQ ID NO: 34475 - DNA, 1042 bp, Homo sapiens
ttttttgaggagcctccataccctttttcataatgactgtactaatttacaatcccaccaacagtgtacaagggttcccttttctttcatatccttgccaacacttcttttcttttgtctggtgtgagatggtatctcctggctttgacttatatttccctattcatgaggttgatcattttttcatatacctgttttccatttttatgttttcatttgtgtctattcaagtcctttgcccactttttaatgggattattgtgtgtgtgtgtgttttgctgttgaattgtttgagttgttttccttcatttgaatataatttaaggccaaagatttacatctgtaatgatttccctattaatatgctgattgtattaagtttgggacttaaccattagtatatcctgctattttgtaaaatgttagagagtagatgagtgaaggacatcaagatgggggagaacatctcactactcctgatccatcctcacatacaggttgaactgaccatttaattctgaaaaacgaatgaagactgtctgcagggttcagggacagggagggcagtaggggcactgcccatcccccttaatctccttctcaatggccatggcagggcctgcccacctccaggccagtctcctgcagggtacgtgaatgctgatggtgttccgtggaccccttgtccccagcggggcagtattgggccctctcagaggtgatttttctagggagggtcatagcgttcgtcaggtcattagccatctaaacaaataggatgttgccatcatggaccaacccctctggaactagacctgaacttccacctcccccacactctgtcatcagaggcatagctggcttctgagtgttccatctccctatgtggctgacagttcttataggtttacatattcctaagcccagtgtcttataatactagatgtgtaaatattctgtggtcacattgttaattctgctgtcttaccatagcacttgtacatagacaagctcgatttatgttcttctttactctctccta

SEQ ID NO: 34476 - DNA, 1054 bp, Homo sapiens
aagctgaggtgggagaattgcttgaacccaggaggtggaggttgcagtgagccaagatcgcaccactgcactccagcctgggtaacagcgagactccgtctcaaaaaaaaaaaaaaaaagagccaaccagatactatgctatatatacaaccccaagacagatatcatctctgtcctaacgtaacatagcgtcctgatttactctgccccatgttcctctgactacagaaggttagaatccttcacgttgctttttatgtgacttggcatagcttccattgccttgtcactaaaagttatacagaaaactgttttgcttagcacagaagaatcctgttgttaaaggtgagtgttggtgttaggataattccatggccaaggacgtgggaatgcctccaccctatttttcagctaccttttttcctcttgagcagtagttcttcatggagggaaggagggacatatggtgatgtctgaaaatgtttttgattgtcttaacttggagtgaggggtgctactggcatctagcaggtagagtctgggatactgctaaacattctactgtgctcaggacagccccgcggcagagttgtcctgcccccaatgacagtaatgctggagttgagaaatcctaccctagtgaatcctcaaggagagatgtacgtagaagaaaccattgtaaaatggggatcaaagttccatttccttaagagctatacaagtgcctctccctgaaagcatcaccttggtgaaaggtaaactggactccatggcttagtgttgagcgttgaataggacttaatgctactctccgtccacacattcacagctcccaacactctaaatcttgacaccagtagactttgtcatacctagagcctcagtaccagctagagatatggcaggtgcccacgggcacacctgaccacctcgaagaggaagcaaatgagaagagcaagggttagtaagactcagtagtggcaccagccagccaaatagtgcagcgtccatgtcctgggctctgtccgttcacatcagcaccttttcccttgag

SEQ ID NO: 34477 - DNA, 1133 bp, Homo sapiens
ctgggattacaggcgggagccacctcgcccatcctcccttgacttttgatatcacattgccgcataactggttggttttcttatttcagcaaagccaactgtttcccagtcatctctgattatagttaccaatattaaatactgtttgagagttacttgtttactgagataatttcagacctaaaattagacttttctcttagatgcagatatttattttgaataaacccttggagaaaaacatttttccacttttttccttctttgttggttcaggcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagagggcttaactgagaaccgtattgatttttattttagttacctccctctagttttatgtgaaattagtagaatcagggaggacgggacttatgctgtggtaggcaacagaaaaaaacttctattgattttaatttaatatgaatactttaaagatcaacataccgattgaaatacaaatgttaatatgtgagaacctaggaagtattttaaatatttatgaaaatattttgttttaaaatgaactatgaatattgtacagttaatttcctcactgaggactgtgaacattcttatattatttcatgtatattgaagaacattgttatgcaatgctttgtgtaaagttattgtgaagattttattgtctttatttttaccaaagatttcccatagtttgagcattcaaagcaataaaatataaaaatgaatcacagtgctctatgatatttaagatacttatatctcaaagaggttgaaactctacaggctgttcaaatatttatcaaatgcctttttagagaaaacactatgtacttaactacttctgcagggaagtaaaagtttgctgccttctccagaaacaaaataaatctgtaaaatatatgatttttagtgagcagaaagagccaaattagtgcttgaagtgaggcattagggaggagagatgggagctgacccttggagtatgggcagggccgagatg

SEQ ID NO: 34478 - DNA, 1047 bp, Homo sapiens
aatgttatccttaagatttttttagttatagcttttttatccttttttcaaaccatgatgatatttgacacttaaaaaaatacccaaagttggctattgataaaaattatccttcaaaagactatatagaaaagaccagataaaatacattcaaggaagagaggcaatgtgaagttgtcaagcctgaagaacttatcacaatacaattatgggaaatgtctattttaggcataattctatgctatcatttaaactgtagctgttaagtttacattgcgaatgagaaagatcactattattttgtctctatatttatttatgataaaatgtcatttttccatgagatatcagctacaaggaatcttagagaaggagtgtgtgtgtgtgtatgtgtgtgtgtgtgtgtgtgtgtaagagtaatgatctggaagtctcaatgcactcgagttacagactcaccgcagtctcaggtcaaggggtttactactgtcctcagcagtggtagtttgcagggactcgcttgtgccagagcattagctttatggtaactagagtaaactgaaattttaaattctgcattggatttatagaagacatataagcatagcatgttaccatgtatggcacacgtcaaagtttatgatttctgaaacccatctttaatggcagtttaaaaagtgctctttacttagggccgatcttttattatgttcctattttaagattctttttatttttttttgagatggagtctcgctcttgtcaccgaggctggagtgcaatttgcgcgatctcagctcactgcaacctctgcctcctggtttcaagcagttcttctgtctcagcctcccgagtagctgggactacaggcgtccgccatcacgcccggctaatttttgtatttttagtagagacggggtttcaccacgttggccagcctggtctcaaactcctgacctcatgatctgcccgcctcagcctcccaaagtgctgggattacagacgtgagccactgcgccgggctaagattaggtcaggagactccgt

SEQ ID NO: 34479 - DNA, 1065 bp, Homo sapiens
ggataggatagaacctgaaatcggcttggtttggaaattgatgtaatacagagagctttttttttttttttttttttgagacagagtcccaggctggagtgcagtggtgtgatctcggctcactgcaacctctgctcccaggttgaagcaattctcctgcctcagcctcgcgagtagctgggtttacaggcacacattgccatgcctggctaattttatttttcagtagagacaggattatttagtatttttagtagagacccagtttcaccatgttggccaggctggtctcgaactcctgacctcaagtgatctgcctgcctcagcctcccgaagtgctgggattacaggcatgaaccactgtgcctggccagtacagagaacatttaaatgaaaaaagttagacaactgttattcatgctaagaatggtgtagaggtaaatatcttaaagatcagttgcatttggctgtgtgctatgtgtctatgtttatgttttaatatggctttgatgctctggaagttttaattttaaagtaatttagggttcccaaacttacctgacattggaatcccacagggaacttcaacaaatacgcttctgtctcctagagaccatgattgaaattttctgaaataaggcctgaactttggaatttgtaaaagatcctcgggtgattttaacatgcagagaagcttgggaaccactgctgtaatatcagagtcagccaagggactcagaagactcccccactcaggctgaacaatctgtgttccacaaacactgctctaccaagtctgctatgatgtaattctgactcgtggatgtgatggacctaagatgtgcacagctttttggtttttctttttttaaaaaaaatctaaacttaagagttagtactcataatgatctcccttacaccccctccactaccacaccccttgctttttagtatttactttgagatgtgaaacgcatttgggatctaaataaattgatcacatggattaaaatatgaaagacttattttaactgattacctcaaactcaaaaatatcccgcctaa

SEQ ID NO: 34480 - DNA, 1033 bp, Homo sapiens
ttctttctcccaataaggctgtgaagtgtccgccctctgacacgatgtataatactatgaatctgtgcccaaggggtacaattgtcctggattctgcagggcaagcgataaggaggaaaagaatctctaaaagtacatctcctactcaggcactcccaggagctctgggatataagaaatttccttccttttacagctgcctgagttgatttaagtctcgatatgggcttccttttttctctcctccctcccatctaataacccttatcctgaatcagcacagttcttagaactggctaaagtggaagaatggccaggaacagctttcacatttataattcttacgatacacttgcgagcccctaacaaacaccgtcttccattcaagcatacttttactgtgtgctcatagtttgtatctaatatacaaatcttatgcactaatacgacatctgctacgtggtcacaaggaaagcatagaagatattctaaccactagcaagaacagatctgtaccctccacccccaaatccatcagacacaaaccttcaaacatcacccaaaagaagaaaataatattggacaatcaaatatattttggtttttgtttgtttgagacagagtcttgctctgtcacccaggctggagtgcagtggcatgatcttggctcactgcagcctcccaggtagctgggaatacaagcatgcaccaccatgcctggctaatttttgtatttttagtagagcctggccaacatggtgaaatcctgtctctactaaaactacaaaaattagccaggcgtggtggcagtgcctgtaatcccagctactgtgaaggctgaggcagaagaatcactcgaacccgggaagcagaggttgcagtgagccgaggtcgcgccattgcactccagcctgggcgacagagcgagactccgtctcaaaaaaaaaaaaaaaaaaaaaaaaaaaaaaaaatatatatatatatatatatatatatatgtatatatatatgtattaaaatataaataatttta

SEQ ID NO: 34481 - DNA, 1050 bp, Homo sapiens
tacttttttttgagagggagtctcgctctgtggcccaggctggagtgcagtggcacgatctcagctcactgcaacctctgcctcctgggttcaagcgattctctgcctcagcctcccaagtagctgggattacagatgtgtgccaccatgcccagctacttttttttttttttttttttttgtatttttagtacagatggggtgtagccatgttggccaggctggtctacaactcctgacctcaggtgatccacctgcctcggcctcccgaagtactgggattacaggcgtgagccaccgcacccggcctgataatataatttgtattattaaatattttgagcaaaaatataaaaatttgatttttaatctatagtgtgaaatggattttatactaaaacgactcccataaatggctttcatgacatggattttatgaagaaaagtcaggtagctcctcaagctggcagcactgtatcctactgttaaagccacagccatagtcgatgtaattggacagaatttccctagtataacacagtaagaaactctacatgaaatttttgtctgaggatctaacaacagaattacaggaaatgaaaacgaataaacaaaaaatgatacctcttcaaaatatagttgacctcgtaggaaatatgccagagtgtctcctttcagtattctttccttcaagagctgcaatgccttatccaccaaattagcatgggtgtaatctgattttaaaaaggtaaggaattccatcaaccacacaatatgaattttctctcttgaagtaatgaatcatataaaatccatctaacactgttgacattcttgctttctagtgctcattcctacaactggcctccttagctcaaggaagaaatattacctgaaaaaacgtcatggtcacaggccctaacactgtgccttgtgtaataaagcaatactggccgggcgcggtggctcacgcctgtaaatctcagcactctgggaggccgaggcgggtggatcacctgagtttgggagttcaagactagcctgaccaac

SEQ ID NO: 34482 - DNA, 1057 bp, Homo sapiens
atgttggccaggatggtcttgatctcttgacctcgtgatctgcctgcctcggcctcccaaagtgctggcattacaggcatgagccaccatgcctggcccaaagttctagaattttttaaaggtattcatggtgactcaggaatacacacatacacacacacacacacacacacacacacacacatacacacatataatttgaaagaggtgagtatgtactctgacttcagctctcaggttttaaaaattatattagtgggaccagttatgacaagaataatcattatagtacttttcagattttataacctggagcagattattttaagttgattagtaggttctgttacagtttttcttttgatcgtgcacttatagtcttcatttaattcctcatagaatcccagtcacctttatatatcatattattggaagagattcatcttcataatctccagttttttcacagtgcctcacagagttaatcatgccttttggagctagaaggactttagaacttatctagttatgctcctttatattataagtaagggaatagaatcaataagacagtttctgcccaaagtcatgttaccagttggtgacagagctggaaatacgtagagatctatacccttaaatctctccactcacatgctgatatactttctactacaatatgctatagctttatggaactcagggtgatgatcagacgtgtcattagaacatgagtcctctgcttctgattcaggcatacttttgggattcttccatctttaaaggaaaaaggaagccattcatctatatttagtaacccagtaatatctcacttagtttagggttagatctttagttaattcaaccttatagatcatacttatgaaggtgataactgacacgtgttcactgaattttaatttgataggcaatacatctacccactccattattttttaaaacttcatttaatagtttaaacaagattggttttgttttcaatttttattcactcttcatagaatcacaattacctttatatatcatatgttattgg

SEQ ID NO: 34483 - DNA, 1110 bp, Homo sapiens
ggaagctgaggcagagaattgtttgaacccgggaggcagaggtcgcagtgagccgagatcgcatcactgcactccagcctgggcgacagagcgagtctccgtctcaaaaaaaaaaaaaaaaagattgctatgctagaaagtcttcctgtagaggcatttttaagaaacattatgataggcattggctctggaaagcaggcatgaaatagatgactggggtctatcatgagagagaccattctctatatgtcactttgtaccttcacatgttgcctcttgttttgttttggtctttttttgagacaggaccttgctctgtcactcaggctagagtgcagtggcatgatcatagctcactataacgttgaactctgggctcaagtgatcctctttccccagctccccgagtagctgagattacaggcatgcacccccatgcctggctgtatgttgctattttatgttttaaaaacctaatcctgactgtgctggtagtcgcatgaatctctgcacatacatgcaaacaagtacatgtaaaactggtgaaatctgaataagcttcatggattatatcaatttcagtttcctgattctgacagtgtatgatacttatgcaagatttaatcgagacaaagtgagtaaagaatatgtgagatctttgtattatttcttacaactgcaaaataagaagtttttaaaattaagttataataacaaaaaaaagaactctgtgtcaaaactaaaatataaagttgaaatattgattttattttttaggaatctggtggacagtaacaaactttggtgaaatttcaggaaccatagccattgaaatggataagggaacctatatacatgcactcgacaatggtctttttaccctgggagctccacacaaagaaggtttgtgtctggaagggaagaggctgccacaagtgtagattttaggacattcattcacttaggccaaactctaactagtctcaaacattttccaaaggaatggaaccattgcatttgactcttccatttttttttaattccttaatatttaccagccattggcaagtccctctttctaatataagcatttgaaaacattccgtatag

SEQ ID NO: 34484 - DNA, 1061 bp, Homo sapiens
taaaaaatgaatcaaatagtacaaaacctggttcactgttgctgtgatatttaaactcactgtttggaagtccaaaggcaaacaggaagactaaaaaaaggaatattgttgaaaccagcagagaatgttacagaatcataacgaccaaaagaatatttttactcactatttttacagtcattttataaagtaaccttttttattctcaccttgtgcaaaagtatagaacgattctttgggcagaagatactgaaagtgaatttacatattttagtaattggttacatcaatatgataatgatttctgttatataatcattaatgtataaaggagtaaaagtcaattctggcatcccaggagattctcggtaaggtaaaagattagaaatcataattttaaaaaatcacattaagatgattatttctgtactttctttgaaagtctgataagtatggtgaaagacagaataaaagcagaggaagaaaaaattcaatagttttaaactgctttacaattataaacaaaaaaggattataaagaaaattaactgacaaatgaggaaaatatttgcaacaatcttaataggcagtgagttcttactcttcatatgtatcttgtatagaattcatagcactgatgaccccagtagaaaaactgcgaacaatcagatctcaatagaaaaatggacaagggacattaccagataatctaaaaactaaaaaggaaaggaaaagaaaaacaattgttattctagttaactactaaaatgcaaatttataggatactgttttttccatatcaggttttcaagtatttttttaaagtcataatgtttaaaaaaaaatgcgtgatacaaaacatactctgttaatttgaggtaagaatgtaaatggaagcagcattttctggaaaacagtttgatgacataagaactttatactcttcgatccagttatttctaggaattttttctaaggataaagcagttttatgtacagaatagatgtacatagaactatttataataagagaaaaagtaagttttagtaatttattcttg

SEQ ID NO: 34485 - DNA, 1069 bp, Homo sapiens
ggaagtgcaaagtccttagttcttgttttcttgagagaaacaattcagcccagacacaaagaacacaccaaaagaggagtaggttggcccagctggaaacagtcttgagagttacatgttgcagtttttattatcatagacttaaaaaaaatttcccacctctgtcttaagtgtctgcctttgtttagtatcctgcttcctggtaaatctcttcttttatcctcatcgagtttctgcccaggtctgtgagatgcttccttactgtcagctgatatacatgtgtgagttccagtgatcaatgaatcttaatggcagcactgcttattaccgccatcttaggaaaataatatagcagtcaaatgtgtacttactatgcctacgtatctcttaggaattttcctttagccctttttccctttttatcagcatgtagctagctacattctgacagtttaatcacagtatgagcaattactgggtgtcctaagtggtgtttcagggtgttcttcataggtatttctgctcctctctgctcaaatttagcatacatgttttgggttgtctttggagcatgaggctttttcctctggggctctttttttctgttcatgtctaactgcctactcgaacattccctcaatagattgtgactctaaaaatctttgagacagtgcactgtgggtcttctgtaactacttcctggtgacataagataactcatcagcatctcattatcttgctctttgtcagaaaaacattccctccatgttttcccaggtttgacttgcagtatccagaggaaatgtggagaaacacagttgtacagaagggaagaaaataggttgatactcctgttgcaggaccatttgaagtctgagagtttccaggtgagaggaaacaaacctggttacttgatttagtgagtaaagctcacaaaagagaaaaaggaagacaaaagctagggatcccccaaaaagggatgtgatgagaatttgaaccagttggcaccccaggagaactagcccttagtggcatgtttctgatggtgacaggcttggtttataaaatc

SEQ ID NO: 34486 - DNA, 1629 bp, Homo sapiens
actgggaagacataagtattggggatgttttgataaataattgtagtgaacaaacacaaagtgctgggtgtgtaatagatgctccataactagccataaatattcctggagttagttcgtagctccaagtaaaagattaaaaatatctatgttgaagaaatgtcattaattgtgcatgtggagaggacgtgttcccaggctgcaaaactgactcagtctgaatttaaagaggatttctgtttttattttctaattatctttagttttgtgatgtcttcttttcctttgtgttttggctacagtttcctcgctgatctcttcatgccgtgtaatttcacatggactttcaaggttcagatgagaagtttagaatttttaatgtggtatattattgtttttaactgggttgtttgagattatttataatttatcaatacaacattcagatgacttgagagtaattcactgttcacaggtaagaggattaagtcagcattgcttctctgtattggtaaaggaaaaattgtatgagattctaacaaaaagtgtgttaaacataagttagaataggtaaaacattaatataagtgggttgcatattgtaagcaccatatgaagaaactcatcagaattttgatatctcttaagataaaatatatcttagaaaaaaaatttttttttttttttagacagaatctttctctgttgccaaggctaacctgcagtggcacgatctcagctcactgcaacctctgcctcctgggttcacgtcattcccttgcctaagcctcccgagtagctgggactacaggcgcccactcccacgcctggctaattttttgtatttttagtagagatggggtttcaccatgttagccaggatggtctcgatctcctgacctcatgatccgcctgcctctgcctcccaaagtgctgggattacaggcgggagccaccacacccggccctcttgaaatttttaagagacttaatggtaggtgaaggattttacatatcattttctatgacatagcaaaactatttttttaagctgaatcttttgagtgtaaatgttaagtgttggaaaaatagaatgatctgtgtagattcaagattcaaaatctgcagtgatcttttctgttgagattcatgttacaatcttgaggaaatttgttatgatttttttgttttagtggatgcagttcatgaggtacggttttcatttttagtcactttatccaagtccttcgtcaccttctctggaaaatcagattatggcagctattgaattcaaacgttcattaattaatgtaattcagcatatacataataatatataccaaatactaaccataatcctgtatatctgttaattttcacagaaactcaatgcatagacattattattatccttattttacagaggaaggaacagagccacagagaaaaatgacttgctcacaacagaagagccagtagtaaaacacaggcaagtttgactctagagataagtcttaactactacggtaaacaacctcttcaaacagaaaatacatgattatcttcaacacccatttttttttttgagacggagtctcgctctgtcgtccaggccggagtgcagtggcg

SEQ ID NO: 34487 - DNA, 1099 bp, Homo sapiens
tgtgaagatcgtggcagagcctttggattgtccacaaacctgaatgaatataagaaaattcatactggagataaaccctacaaatgtaaagaatgtgggaaagcctttatacattccttgcacctgaataaacatgagaaaattcatactggaaagaaaccctacaaatgtaagcaatgtggcaaagtcattacctcatcctcaagctttgctaaacataagaggattcatactggcgagaaaccctttgaatgtttagaatgtggtaaagcgtttactagttccacaacccttactaaacataggagaattcatactggagagaaaccctacacatgtgaagtatgtggcaaagcctttagacagtccgcaatcctttatgtacataggagaattcatactggagagaaaccctacacatgtgaagaatgtggcaaaacctttagacagtccgcaaacctttatgtacataggagaattcatactggagagaaaccttacaaatgtgaagagtgtggcaaagcctttggacggtacacagacctgaatcaacacaagaaaattcatactggagagaaactttacaaatgtgaagagtgtggcaaagactttgtatggtacacggacctgaatcaacagaagaaaatttacactggggagaaaccttacaaatgtgaagagtgtggcaaagcctttgccccatcaacagacctgaatcaacacacgaaaattcttactggagagcaaagttacaaatgtgaagagtgtggcaaagcctttggatggtccatagccctgaatcaacacaagaaaattcatactggagaaaaaccttacaaatgtgaagagtgtggcaaagcctttagtaggtcaagaaaccttactacacataggagagttcacactagggagaaaccctacaaatgtgaagatcgtggcagatcctttggatggtccacaaacctgaacgaatataagaaaattcatactggagataaactctacaaatgtaaagaatgtgggaaagtgtttaaacagtcctcacacctgaatagacatgagaaaattcatactggaaagaaaccctacaaatgtaagg

SEQ ID NO: 34488 - DNA, 1046 bp, Homo sapiens
gtattttgttatgtgatcttactagcgtactttgtataatcttatgatttgtaaagtatatgcatatgaatctagtaactgggataatttgttatttttgtttctttcagctatgtgttctcatttcacccaagactttttgccagtgcaggggatagaagattcattccacaaacttatactgagaagatatgagaaatgtgggcatgataatttacaattaaggaaaggctgtaaaagtatgaacgtgtgtaaagtgcagaagggagtttataatggaattaataaatgcttgtcaaatactcagagcaaaatatttcaatgtaatgcacgtgtcaaagtttttagtaaatttgcaaattcaaacaaagataagacaagacatactggagagaaacactttaaatgtaacgaatgtggcaagtcatttcagaagttctcagacctaactcaacataaaggaattcatgctggagagaaaccctacacttgtgaagaacgtggcaaagactttggatggtacacagacctgaatcaacacaagaaaattcatactggagagaaaccttacaaatgtgaagaatgtggcaaagcctttaataggtcaacaaaccttactgcacataagagaattcacaacagagagaaagcttacacaggtgaagatcgtgacagagcctttggatggtccacaaacctgaatgaatataagaaaattcatactggagataaaccctacaaatgtaaagaatgtgggaaagcctttatgcattcctcacacctgaataaacatgagaaaattcatactggagagaaaccctacaaatgtaaggaatgtggcaaagtcatttcctcatcctcaagctttgctaaacataagaggattcatactggcgagaaaccctttaaatgtttagaatgtggtaaagcctttaatatttccacaacccttactaaacataggagaattcatactggagagaaaccctacacatgtgaagtatgtggcaaagcctttagacagtccgcaaacctttatgtacata

SEQ ID NO: 34489 - DNA, 1044 bp, Homo sapiens
taggatagtggtacagaactttgtgtacgtgcatatctttttcagaaagttacatattttcgtatgattatgtttggttttcttgcattatgttattttcactggaagacactttcttcagcatttttttggtaagacaggtgttgtgctaatatactttttcagcatgtgcttatcttgaaaggtctttactttttcttcatttttaggacagttttgctggttatattattcccatgtagaatttttttttctccagcatcttaattatattgcagttccttctggtgtgaaatagttttgttgacagattcactggtaatcttataagaccacacttataaatgacacatcactttttgtagttcctaaaatgcccttcttgtgtttgatttttcaaactttgctcatgtatatatatgtgccttgcgataaatctgtgtgtgtatcctagttgaagtttgttgagctgcttcatttattacatcctttttttaacttctgaaaatttctgagtcattattttatatttttcacctcctttttttatgtttttaatgttttcattgatgttctgatttttctgattacatttagttatatgtgttttcagttaactgattcagcattattcagattacatttaaaaaattagtacatctttttttatggttttctgaaaattttaaaatcattataatgtgttctaatattttgtatacattgtaatatttgcttgttatttgaacattaacaaaaagctatttgtcacaatctttattatgttgctttgtcatgatgtagtctgaagccagttgtctttggtagagattatgggaacctgtcatacatgttggaaggatgtctcttgtctggaattttgtgtttattttttagttaaaagggtttcttcatgtttcctgttaagaggctctaattggccaggcatggtggctcactcctgtaatcccagcaactttaggaggctgaggcaggtggatcacgaggtcaggagattgagaccatcctggctaacatagtgaa

SEQ ID NO: 34490 - DNA, 1049 bp, Homo sapiens
aaatttcttaaaataatatattttttgttttattttatttatttatttattttgagacggagtcttgctcagtcacccaggatggagtgcagtggcgcgatctcggctcactgcaagctctgcctcctgggttcatgccattctccttcctcagcctccccagtagctgggagtacggtgcctgccaccacacctggctagatctttttgtattttcagtagagatggggtttatccatgttagctaggatggtctcaatctcctgaccttgtgatccacccgcctcggcctcccaaagtgctgggattacaggtgtgagccactgtgccctgcaaaataatatattttaaactggtaaaaacgagttgcatttgaaaaattcttcctcagccaggcgcggtgactcacgtgtgtaatcccagcaatttgggaggctgaggcaggcggattacgtaaagagatcgagaccatcctggtcaacatgttgaaaccccatcttcaccagaaatgcaaaaatttgctgggcgtggtggtgcgcctgtagtcccagctacttgggaggctgaggcaggagaattgcttgaacccaggaggggaggttgcagtgagccaagattgtgctgctgcactccagcctggcaacagagtgagactctgtctaaaaagaaaaaaaagaaaaaaaaaagaaaattcggggttgggtgtggtggctcacgcctgcaatcccagcacttttggaggctgaggcaggcagataacgaggtcaggagttcgagaccagcctggccagtatgatgaaaccctgtctctattaaaaatacaaaaagtagaagagcatggtggtgtgtacctgtagttctagctactcaggaggctgaggcagaagaattgcttgaactgggcaggcagaggttgcagtgagccaagatagtgccactgcactccagtctgggtgacagagtgagactctgtctcaaaaaaaaaaaaaaaaagaaaacttcctcattacatctgtcctcgtttgttattgatgtcagtaatcatattt

SEQ ID NO: 34491 - DNA, 1050 bp, Homo sapiens
atgttccagcaatcccatttaattaaaaaattaaaaatagaacatgtgatccagcaatttcaattattttttctgtgtgtgtgtggtcgtccacagtttatttgtgtaggcaaggagtcaaagaaacagtgttaaaataccatttgttgatggtttaaacatatgttatcctgtgatacttatttttttctataatggctctactaacttacaattttaccgactgtatgtgtttccttttctattcattctcactaacatatttttgtctttctaattacagtcattctaattggagtgaagtggtatcttgtggttttgatttgcatttctctgacaattagtgatgttgagcatctttgcatgtactttttggctatttgtatttcttttgaaaaaggtctcttaaagtctcttgcctatattcaaattgtggtatttttgttaagtttgttatatattctgtaaatttatcttttgtcatatgtatattttgcaaatattttccttcattctgtagattatctcttcactctgctgtctttgctatgcaaagcatttttactttgttgtaatcccatttgcatatttttgcttcttctgcctgtgcttttgaggtcttaagattctttgctctgtactgtgtggtaaagcattcctgtatgtttacttcaaatagctttatttgggtttcccatttaaatctttatttgtgattgacttttttatatcataagaggtaggagcctagttttattttttttattatcttgtagataattttcctagcaccatttattgaaaatattgtctttttccaataacaaaaatgttattggaaaatctatacttttgtgtgtgtggaagaaacactttcgtgatttgaagataatttccaaaactgtcatacctctatctcttttagatattatttttgttttcaaaaatgctgaaactttacaatcatatatttttaaatattcagcttagtcatattaacgttgttatgcactctatctttagaatatgtttatcttgcaaagctaacac

SEQ ID NO: 34492 - DNA, 1058 bp, Homo sapiens
acatataggaatagattgaaatagagatttctccaaaacggcactggatgaacgtgtcaaggggctcacacagcccattccgggatttggtgaccgttgtttgtgtccatgttcaattgagttcaaatttaatatttaacttttcctccacattcggcctcagtttgatcctcaattgtaggaaaatacccttacagatacatggggaaggcatagttgatatagattacagatacaggtaagcacaggagaactaaaagcagagttaataaaaaccacacccaccatggctttgcaaggagagtgattgtgagaattgtcagggatatacacataacattcagtatgcagtaaggctcaaacccctccttgggctgcggtaagcatatctaatgccattcagttttgcaacacaacagtacacagctgagcaaattcctctgacaacaacataagtccagtgctactatcattaagagctttgtctacatgtaaacttaatattttaatttgctgctgaagcaggattgtaccagcagcaggggagaatactgtagtaggctatcaccaccagggagtccagcgcatttgtatggtggatggaattaatggccacccccaagtgtatctctctgtccattgtaggggcaggtatcaccacccgtagtatccacatatccagagggcccccccaggggactgcaatatagttactgtaatcatagtgtactaatgtgttattaaagtaggaaagagattgtgtttcattagggacaatgctgttgatttggagtatgtgttgacagttgtctggtgggagaaacccagaggaacattagaggagccatttaaggcctccagacaaagtggcgggtgggtggggagctatatggaatccggccaccagcacagcaggttcccaatatataccgttccaggcatattgggcaggataccaaggcttttgatgcatggtgaaggtggagttcacctttcacttgacttgggcataaatagattgcttggtttggtcataggaagttcaggttggattgcaa

SEQ ID NO: 34493 - DNA, 1054 bp, Homo sapiens
ccctgtctccactaaaaatagaaaattagccaggtgtggtggcgcatgcctgtaatcccagctactcaggagactaaggcaggagaatcacttgaacccgggaggcggaggttgcagtgagccgacattgtgccactgcactccagcctgggtgacagggcgagactccatctcaataaataaataaataaataaataaataaataaataaaaatttttttggtgatcatgactgttttcttttgtaggtgagtaggcaaagaaacagtggaatattaccacctatttattgtttgattatgttttgtgagagaaacacttgttattcaaaggtgatttttgaaaaatggaacctttttaggtagatgtaaatatttagttgtgatgaaaaacataaaattgcctaaaggttttcaagtgtacagtctagtggggttaagtacatttacattattttgaaatggatctctacattttgtcttacaaaagtaaagtttaatactctatgaactataaactgccatttttttctttttcttcagctcttgaagaacaccattttacttactgtttctgtaattttgactgatttttatattgtcattggtgtaatattttttctttctttttttttcttttttactgtcttcacataatgttcttaggcttggtttttggttggttggttggttgttttgagatggagtcttgctctgttgccaggctagagcgcagtggcacgatctcggcttactgcaacctctgcctcccagattcaaacgattctcctgcctcagcctcccaagtagctgggaccacaggtgtgcactaccatgtccagctaattttgtatttttagtagagacagggtttcaccgtgttggccaggatggtctcgatcgcttgacctcagctgatccgcccgcctcggcctcccaaagtgctaggattacaggtgtgagccaggacaactggcctcaggcttttgtttttgtaagattgttgtgtgctgcggggtgaaaggagaaggaaagacacacacacaatatcttta

SEQ ID NO: 34494 - DNA, 1032 bp, Homo sapiens
cataaaatgagttagggaggagtccctctttttctattatttggaatagtttcagaaggcatggtaccagctcgctcccctttgtaccgttagtagaatttggctgtgaatccatctggtcctggctttttttggttggtaggctattaattactgcctcaatttcagaacttgttactggtctattcaggggttcaacttcttcctggttaagtcttgggagggtgtatgtgtccaggaatttatccatttcttctggattttctagtttatttgcgtagagttgtttatcgtattctctgatggtagtttgttgctgtgggatcagtgttgatatcccctttatcatttttcattgtgtctatttgattcttctctcttttcttctttggtagtgttgctagtggtctatctattttgttgatcttttcaaaaaacctcctcctggatttgttgatttttttttttttttttgaaagggtctttcgtgtctctatttcctccagttctgctctgatcttagttatttcttgtcttctgctagcttttgaatttgtttgcacctgcttctctagttcttttaattgtgatgataaggtgtcaattttaggtcttttctgctttcttttgtgggcatttagtggtatagatttccctccaaagactgctttggctgtgtaccagagattctagtaggttgtgtctttgttctcattggtttcaaagaacttatttatttctaccttaatttcgttatttacccagtagtcattcaggagcaagttgttcagtttccatgtagttgtgcagttttgagtttcttaatcctgagtcctaatttgattgcactgttgtctgagagactgttataattttctttcttctgcatttgctgaagtgtgttttacttccagttatgtggtcaactttagattaagtgcgatgtggtgccgagaataatgtatgttctattgatttggggtggagagttctgtcgatgtctattacgtctgcttggtccagaggtgagtt

SEQ ID NO: 34495 - DNA, 1032 bp, Homo sapiens; identical to SEQ ID NO: 34494

SEQ ID NO: 34496 - DNA, 1712 bp, Homo sapiens
atggctgcaaatttgcagcatttagaaaactacactatcaacaagctttcctttatgaactgagatgtacaaaatgtagaaagcagatgaaagtgaattatttcttcaacattttagtaaaacttctgataatcagagttcaaagcacataacaactcaagcataaatgaagatggagagcctggggagtttgatttcttaaattttccaaaaaggtattattgcaaacatataggatttccccccattttaaccttaccagtttcaaaggaaagtaaaggtactggattacatgaagacagcatgtgtgcgagtgcacacgcatgcagggtggcaggtagagtgtcttaattcctttttcttactacccaagtctcacttcacagaaatcattaggtaaaggaaaaccaacgaggagttctgcagttttcttttaataactgaggctgaggcaggagaatcgcttcaaccctggaggtggaggttgcagtgagccaagattgtgccactgcattccagcctgagcgatagagtgagactccacctcaaaaaaaaaaaaaaagaaaagaaaaacgacaacaaaaaagataaaaggcagagaaataacttatgactaccattttgttcattgttttctgaccatgtagtagtttctgttttttaatcctttcatgctgtcttcccttgtgtagtgttgagttgttttgtttctattgttatatgctttggtttccttttttgtgtgtgtatctactacagttttgttttgttttttttttgtaatttccaagagacataaaatatctcataattataaaagcgtagcttggccaggcacagtggctcacgcctgtaatcccagcactttgggaggccgatcacgaggccgatcatgaggtcaggagatcgagaccatcctggctaacatggtggaaacccatctctactaaaaatacaaaaaaattagccgggcatggtggtggatgcctgtagtcccagctacttgggaggctgaggcaggagaatggcgtgaacccagggcgcggagcttgcagtaagccgagatggcaccactgcactccagcctgggcgacagagtgagactccgtctcaaaaaaaaaaaaaacaaaaaacaaaagcctagcttaagataacaatctaacttcttttttattcacatagggtcttgctttgtttcccaggctgtagtgcagtggtgcattcacagctcagttcggcctcaactctccaatatcaaacaattttcccatctcagcctcccaagtagctgggaatacaagtacacgccaccaggtccagctaagttttttggtatttttttgtagagacagggttttgctatgttgctcaggctggtcttgaattcctaggctccagaaatccacctgccatggcctcccaaagtgctaggtttacaggcatgtatcatcaggcccagctgctgttttttttttttttaatggaatcttgctctatcacccaggcgggagtccagtggcacgatcttggctcaccacaacctccgtctcctgggttcaagcaattcttctgcctcagcctcccgagtagctgagactgcaggcacctgccaccacacctggccaattttttttttttgtatttttagtagagacagggtttcactgtgttagccatgatggtttcgatctcctgacctcgtgatcctcccg

SEQ ID NO: 34497 - DNA, 1712 bp, Homo sapiens; identical to SEQ ID NO: 34496

SEQ ID NO: 34498 - DNA, 1050 bp, Homo sapiens
cttgcagtgagccgagatggcgccactgcactccagtctgggcaacagaacgagaccatctcaaaaaaaaagttctacttttattcttttgtttgtggctctccagtttttctagcaccatgtattgacaagactataatttctgaattgtatattcatgatccccttgccaaaattcgttgaccttgtatgcatggatttgtttctgggctctctattctgttcattggtttttgtatgtgtgtttatgcacatgccatactcttttgcttactacaacctttacataaagtttaaaattaagaagtatgatgcccctagctttgttctttctcacgatggctcagattatttaaagttgtttaaggttacacttaaattttacaattgtgttttctattactgtgaaaaatgacactaaaattttgatagggatcgcgtttgaatctacaaatcactttcgataatatactttgacaatattagtgatcctaatgaaatatgtgtttgtgtctgcttcaatttctgtcattattgtatttagtgtatacatttattgttatacactagattttgtgctttattgtatttaatgtataaattttttatttcatttgttaaatttattttgaatttcttatttttatagtattgtaaattgaatttttttcttttttttgggaaattttgttgttactttatggaaatgaaacaaatatttgtatgttggggcaggtgtagtggttcatttttgtaatcccagcactttcagaggccaaggcatgtggatcacttgagcacaggagtttgagatgagcctgggcctcagagtgagaccatgtttcaaaaacacacaaaaaaacaacctgcaagtatttacatgttggttatgtatcctgataccttaatgaatgcatttattagttcagtttttgttattctactctagggtttcatatatatgcatgatcatattatctacaaacagtaacattttttcttcttttgcaggcaggagagctttgttctcctttttcttgcctaattgtt

SEQ ID NO: 34499 - DNA, 1050 bp, Homo sapiens; identical to SEQ ID NO: 34498

SEQ ID NO: 34500 - DNA, 1066 bp, Homo sapiens
agttatatatgtgtatagtaaattcttaacattgttgatagattctcagaaactgtaagtgaagcaacatatcatttaggaaaatgaattttagggctgggtgcagtggctcacgcctgtaatcccagcactttgggaggctgaggtgggcagatcaggaggtcaggagtttgagaccagccttgccaacatggcaaaaccctgtctctactaaaaatacaaaaaactagctgggcatggtggcaggtgcctgtaatccagctacttgggaggcttaggcggagaatcacttgaacctgggaggcagaggttgcagtgagccgagattgcgccattgaactcctgtctgggagacaagagcaaaactccgtctcaaaaaaaccaaaaaacaaaaaataataattttagcaaagtttaattgatacaaacgagttatgtttggtatatagcaacattgcttcatataaagttgcagttttcaagaacctgttttgaacattaagtgaggacttactcttcatctgtgtttgtgtgacatggatttttctgttaaataaaaattgtttaactatatttaatgtgtacaatgtaatgatttgatatgcatatattttgtaatatatgcatatattttattgtaaagtaaaatataatcaagttgatcaacatatctattacctcatatagatcatgatttttttggtaataagaacacttaaggcctagtgtcctagcaaattgtaagcatacattacagtattattaattataaatggaatactgttttgctaatctaatgctaatgtacattagcattaggtttctccttaggtttctccttattcaacttattcaacttataactaaaaatttatactctttgaacatctcatattcccacccttaggcactaacaatcgccattctactttctgcttttatgagtttacatttttagatttacccgtctatgtaaaaagaagcagtttctttgtctgtctgtgtttggctaatttcatttagcatcatgtcctccaagtctatccatgttgtaaaagactagatt

SEQ ID NO: 34501 - DNA, 1066 bp, Homo sapiens; identical to SEQ ID NO: 34500

SEQ ID NO: 34502 - DNA, 1060 bp, Homo sapiens
agaaaagaaaaaaaaaagaaatcacactcaaccaatgcatttctcaccctgaatcaatgcttcttacccttggatgcatattagaatagcctgctgtgcatgtgggtggtggtatttaaagttcccaaatctaagttgcaacggaataattaagccagaatctatctatttatttatttatttatttattttttagatggagtctcgctctgtcgccaggctggagtgcagtggcacaatctcagctcactgcaacctctacctcctcggttcaagcaattctcctgcctcagcctcccaagtagctgggactataggcacgcaccagcacgcctggatagtttttgtatttttagtagagacggggtttcacccatgttggccaggatggtctcgatctcttgacctcatgatccgcccgcctcggcctcccaaagtgctgggattacaggcgtgcgccagttaagccagaatctttagagtgagacccaggcaatggcgattttaggctctccaggtgattacaatatgcaaccatgctcccaaatgtctgctgtaaaccaacatctttcggaggaccagttgaaaataatatttctcaaattaatgtgaaaagtgtttgctgttgagttgcggcctttcagtcccgcctttgttctctactcaccactgttgagttgtggcctttcagtcccgcctgtgttctctactcacctctactgcttgttttgctcctgattcaaaccagttccacacatactaagcccactgtgctaggtggcctgaccgtggtgaatattattgtggaggaaggactttgctgtaagaaattgcattccccaaaactgaaaccatgatatttactcaactgaggtaaaaaatgaaagactaagggggactcccaagggtcagggcaagaataaataccttggaatattaatacccatctcatgatgcctgagtgtaaatgctccctttcaagcaaaacaatactcgctgggcgtggtagctcacacctgtaatcccagccatttgggaggccgaggcaggcagatcactg

SEQ ID NO: 34503 - DNA, 1076 bp, Homo sapiens
ctgtatctgggaggtttctcttcttatttgtgtcgttcatatctggattccattttcaagtttacaataaatgtttgggcttggctagcccgactgcacttttcttggcaagtccaaaccctggggctgctctgcctggtggtccgaggcgagggggacagagcgagcgccccaggacggcgacttcccacggaggaagagcagacagagacgcagagcagctggtaattcagaaagaagaagtgagaacacccaacagcaacactttgtacacggatgtgcctgcttttgttgatactttcttactgtaaagctctccataaatagtgaaaatgtttggtaaatttattgcaatttaaaattggtgagttcctttattaaattaattgctatgttattggagaatattcatcaaattggaattagaggatgtctacgcacaagtcagtgtggggggaaatggtttcatttggtcggacaaatgttgagtttgaacagttgtattctgctagctagttgactgaatccagcctctttctaaagctaactttctgtgtgtgtagagaccctgatgccacatcccatacatttcttttttcttttctttttttttttttggaaactggttgtgtggtttcgactgcaaagcagatcttatttttgattaatacatatgaacaatttaatcctatttcggaaaatcagtcatagtttttctggcatagataattttcctgttgattatttcattaatctggtaattttgagtatgatagcatttcatttcaaatataccccgtaatcgccttaattgatgtgaaggtcatacttttaaatgatgaggctatgtgtgtgtgtgttttcacacatgatatgaaatgagttccatatgctcgtggagtgtgtttccatctgtctgctgggctggctgggagccagtccggctccaagtcttgggaaaaggtgatcggactcccacatgctggaattgtggcatcaggctggtagctgctgaccctgagcagctgggagcagagccacagcctggtgggaaagatgagtacctcctgccgtgg

SEQ ID NO: 34504 - DNA, 1068 bp, Homo sapiens
cacctgagggttcccagccttcctacaaggcagtgtgcatggtgatgactgaagtctcggggtaatctcccagcaagaggtcaggtcctggttgtgcgtcccagggtgtcagtgaaattggctgctcccctgacccagggcaccttcatgcgtcttcacagcaggactactgtgaccaaggccagacctttcatctttcaaaagactttgactaaaaatgctttaaaaaagcaaccttcggctggacgcgctggctcacgcctgtaatcccagcactttgggaggccgaggcgggcggatcaccagaggttgggagttagaaaccagcccagccaacgtggtgaaaccccgtctctactaaaaacaaaaattagcctggcgtggtggcaggtgcctgtaatccagttacttgggaggctgaggcaggagaatcgcttgaacccaggaggcagaggttgcagtgagccgagatcacaccactgccctccagtctgggtgacacagtgagactctgtctacacacacacacacacacacacacacacacacaaagaaaaaacataggaataaatgtagtggtcaaatggttgtttgtccaacgtcgacaggagtcttatcccttgagcaggccacaccttccccaggaattggcgtgggcagacactctggggtgggcggggtgggcccaggggagcatctccttcctcacaattggagcataagccaccaaaaaaaatgaaacaaatgtgctttgtgtactttccttgactgaggagtaatgtgggtaagagaaaggactctttgcttatttatggatttaggactctgtgctgatttatgtaagcacagttgcatttctgtgtaagcggaagacagataattctttctattaaaggggacgttcagtgtagctactgcagagcaccgtcaggacacaggcctcccaaccaatgcaggctcagccctccacagcccctcaggagggactcagtgcatctcaagggagttttatccttaaaaactagaagccatatggacatctactttgggaggatttggtgggcctca

SEQ ID NO: 34505 - DNA, 1050 bp, Homo sapiens
aagcagaggctgcagtgagccgagatcgcaccattgcactccagcctgagcaacaagagtggaactctgtctcaaaaaaaataaaagacccggtgtggtggctcatgcctgtaatcccaacgctctttgggaggctgaggcaggcgtatcaccaggtcaggagttggagatcagcctgaccaacatggtgaaaccctgtctctactaaaaatacaaaaattagccgggtgtggtggcacacacctgtaatcgcagctactcaggaggctgagacaggagaattgcttgaacctgggaggcagaggttgcagtgagctgagatcatgccacatttgaacccgtgaggcagacgttgcagtgagccgagatcatgtcactgcactccagcctgggcaacagagccagactgtctcaaaaaaaaaaaaaaaatcttacttctatagacaataaaacattggaaactgaagttaaaaacacagtagctcctgagagagagagagaggtataaatctaacaagacaaaacaggatctgtatgctaaaaagactatgtatgtggagagacggcacacagcacgctcatagactggaagactgaacataagatgccagtctcagaaggatctgtgaaattaacaaaattccaaaacattgcagtaggactctttttagatttagaaaagatgattttaaaatgtatacagaatggtgaaggagctagctaaaacagtaaaaaggatagataaaacaatgttttaaaaagaacaaaaaagttagatgaatcacattacacagttttaacagactttaaagccacaaaaatcaagactgtcgtattggcaaagaacagacagatgggtcagtgatcagagagtctagaaacagacccacataaatagggccatttgatctttgacagcagtgcaaacaaaagcaaccctgtggagaaaggattgtccattcaacagagcagtggggcagttggtcatccatatggtagaaatggaaccttggcctaaacctcacattgtacacaattaactccaatcat

SEQ ID NO: 34506 - DNA, 1050 bp, Homo sapiens
tgccctcggtggggttggggagcacacaggcagccccccctccatttgggaggaaggaggggcctccttggagatccagggggtgcccagcaccaggagcagaaccaactgcttctatggggaggggctgctgagacaggagcaggagatggcaggggaggggctcctcctgggcagaaaggcccctccctgtggctggtgatcccgcggtgtgctcctccgtcctgtagagtgctggtgcccactcccctcctaagttttctcctggacgcagctgctgacgccttcactactccagagcacctgtaatctcagatccaggaccttggacctggcccgggggtcctgttcaggggatggaagtccagctccgtacaacaccaggcccccaatccttccaggccagcccaaccccactggttcccaccttcctgggcagcaggaggctgttccgtagttccgtggcctgaccatgaccacaggcttcctgggctggtggctcacgggagggctggaggagtgtggcgtggggaggcgtattgatctagaaaccaaaaccccggggcctgacaaaaacttagaggcctggagggcagaagaacaaaatcccacactccctctggaggctctgggggagggcccttccctgccccttcctgcgtctggcggccccgaatccctggtgtttcttgaccactcgcgacctcctccgctttcgtatgcccgcccccatccgggtgtctgtcctttctgtctcttacaaggacactctcactggacttgaggcccctcaaatccaggatggcctcgtccccatccttaccattatgagatcaacaaagacctgtttccgaatgagatcacctttgaagctccaggcaatatgaatttgagggggacaatattcagctactacggagggcagacgcactcacgggagatgagaaacgcgggtgggcagggggtcggtgaggcccaggcatactggctgagggcacgactaggcgggattccaggacacccagtgcctggaagtgaccgcagcccagg

SEQ ID NO: 34507 - DNA, 1048 bp, Homo sapiens
gagggccccctgccgctggtacgtgtttctgttctgaaggcgagtggcttcacagtagatgagtgatgaggctgagtcattctcactgcatgggcgtgtttcgaaggtgcttgcaggaagggaacgtgcccttcccccacctcccccaggagcagcctcggggtcatgtcagggttctgtgctgcccacctgagctcacgggccgggagctactggcttctccatctcagcagtgttgctgtgtccctgggaaagtcatcctgaggcgtggggcacggggagcccctgggctgactgcctcagtgcccctgcgagggcagccgtggggtctgggctgcccagctggagtggcctcttgggcaggcctgactccagagctgggctcctttgtcttcaggcagccgggctgagtcctccccatgcccgcctgtccccacagctgacccctttggcccgcttctgccgtcttcaggcaacaactcccagccctgctccaatcctgatctcttcggcgaatttctcaattcggactctgtgaccgtcccaccatccttcccgtctgcccacagtgctccgcccccatcctgcagcgccgacttcctgcacctgggtaagtgcctctcgcctggcagccagctctccatggccgcctccctcaggaccgcagcctctggtgggaaacagagctgtgggtctcaggcagtggtggggctggactgtgtggcctccgggtgcgctccttgcggcccaagcatcctgcaggacgtcccagaggtcaggacagactgctccctgctctgtctccccaaaccatccccaaacctggaacaggttgtggggccctgcagtgcctcagtcgtctgtgactggcaacaggtgtttctccaggcctcctcaggcccaggccttgcagctgttagcagagaaggccacctgcacccagagcttgtgtagggaccagaggtcagagggaggcagctgggggacccagggtccgggaagctgacctggtctgggtgtagcaggggccgtggggcaccgtatccat

SEQ ID NO: 34508 - DNA, 1037 bp, Homo sapiens
ctgactctgagaaagccgatttctctttcatttctgaatctgcttccttggccactcgggctgttggcaggatttatttgttgtggctgaaggaccggctgtcctggctccctgctgactgagctgggccacagtgtcctgtggctgggaagatggggtctgcaccgtcaccatagaagtggtgtcacctgcctggcccgcacaagctccgggagagggcctcctgcagggcatgggtgccacgaggtgggaggcagactctggggggtttatgctccacagaggcaccacgggaacgccagccacgggaaagccagagctgtgctaccaaggtcagagaaaacagattccattccacatccatcaggcaaaaactgatcaaattgaaaggagaaccagacaactcatttgtagggtagacctcaatattttcgtctcagtaatccgtagaacaagtagacagaccaccagcagggatatagaagaaccgaatgtgccaacccatgaaggctgacacagctgtagagcgttctaggacgttccacccaacaatagaaaaacacacatttatttctttcaaatgcacatggaatatgcaaggagaaagatcagatttggggctataaacacacctcaatacatttttaaaatttgaaatcagacaaactatgctgtcaggccacagtggaataaaaattgaaatcaataccagaagaatatctggaaaactctctaaatctccacctcccaggtttaagcagttctcctgccttagccctcccgagtagctgggattacaggtgcacaccaccaagtccggctgatttttgcatttttagtagagagagggtttcaccgtgttgcccaggctggtctcaaactcctgaccttgtgatccacctgccttggcctcccaaagtgctaggattacaggcgtgagccaccgcgcctggcctcaaaattaagcaacttctaaataacccatgagtaaaagtgggagtatcacgagaaatttaaaaatatcttcaactagggcg

SEQ ID NO: 34509 - DNA, 1042 bp, Homo sapiens
ctccttcctctgagcccctcacgtccttggctctcctccgaagcttcttttcccagagatgggcagatagatgccgtctctgcccacacgtagcctgctctcaccctgtgtcttggagctggaggagttaacttgcgctctctgcacttgggccttcttgctcttgtgtcttgcattggtagctgactgtcccggcctcaggcaggtcattcctggaaagcaggtcttcgtgcttttcagcatgagtggagggcgctttatcctgctttccgtaagctctcattttcccattccctttaagaaattgtggcctgcccaaggccgtgcgctgtcctgctgtataactgcagagcccacttgccccctgctctcctgtgaatctgcagctgaggatggggtttgtgtgtctgccgtgcacggagattcactgtctcctcacagctctgcggccccagcctctgcctctcacaacatgtctgccatgcacggagattcactctctcctcacagctctgtggccccagcctctgcctctcgcaagtgcctccgtgtgtttgtgaggctctccattgttaaccttgaaccagtcgggtgagcttgggtggacggcttcctcctcccagataccctcacgtaccctggggttctgggtgtcacagaagctgctctgggtgcggccactctggagcggggcccttgtgccaggtgagacacccttctcctcagcaagcggacttggtgcgcagcaggccaatacgtcggtgccgacatgccatgaagcacgggaggccgtaggagattgagggaggtgaatgactcagtcctcatcgtaaggagcgcgctgaggccgaagatgagcagcggagctggtgcatggggccgactggcctgaggtcatcccggggcatagtgtgcgggacaggctgcccctcagtctgctgtgcatttggaaagctgcacggaagtggtgcaacataaaaaatactgtttgtgggatgcaacttttcctttgaaatgtttgtattttttcagatcacgagga

SEQ ID NO: 34510 - DNA, 1028 bp, Homo sapiens
ctcactgcagccttgaactcctgggcctacgtgatccccctggcctaggcctcccagagtgctgggacgacaggcatgagataatgtgcccagccttagactgatcttaaaagtagaccgggccgggcacgacggctcacgcctgtaatcccagcactttgggaggccgaggtgggcagatcacccgaagtcaggagttcgaaaccagcctgaccaacatggcaaaaccccatctctactgaaaatacaaaaactagctgggcatggtggcgcgtgcctgtaatcccagctgctcaggaggctgaggcaggagaatcacttgaacctgggaggtggaggctgcagtgagctaagattgcaccactgcactccagcctggacgacagagcgagactctatctcaaaaaaaagtagacccttaggttgctgtggcgagccagccttgtagccgaccctcttcccacataggacttgtgactgagggcaccagcctctgaagctccgtgctgttctcttggccatgtgactgagggcaccagcctctgcagctctgtgctgttctcttagccaccagggttctgtcatccttgcttctttgtacctctcctggacccagagcctgaagtgcggtggctgcgctcacccagggaggggtgcggggcctgcgctcacccagggaggggtgcggggcagtgcagagcgcaggtaagcagggaggggtgcggggcagtgcagagcgcaggtaagcagggaggggtgcggggcagtgcggagggcaggtgagcggggaggggtgcggggcagtgcggactacaggtgagcggggaggggtgcggggcagtgcggactgcaggtgagccgggaggggtgcggggcagtgcggactgcaggtgagccgggaggggtgcggggcagtgcggactgcaggtgagccgggaggggtgcggggcagtgcggaccgcaggtgagcggggaggggtgcggactgcaggtgagccgggaggggtgcggggcagtgcggactgcag

SEQ ID NO: 34511 - DNA, 1067 bp, Homo sapiens
acacctgagaaggagcctcccacaaaacagaccatgtggggaacggtaccgggagctggactggggcgctgaactacctgggcgggaatcgcctcggcgactgttccgcgcgcctccgcttgagtcagcccggccgggagcttgacagccggaagttcatcgcaagcccggcgacgccgcgcacgcgctgtctccgtcagacctccgcgcctgcgcgcgcagccaggaagtgaggccgcggcggaggggacggggctaggccgggtcgccgcctgacgcgacgcgtcctcacgggcgcctacgtcacggcgtcgaggcggaagatggtgcacctccgggccggcggttgctgagctgacccggacggcgagggagcgggagcccgagcccgaccactccggctgccgcggggtgcggcgcagccaccgccatgtcgctgctgcagtcggcgctcgacttcttggcgggtccaggctccctgggcggtgcttccggccgcgaccagagtgacttcgtggggcagacggtggaactgggcgagctgcggctgcgggtgcggcgggtcctggccgaaggtgaggccccgggtcggcagcgcgggtgcggccgcggagtgttgtctccgggacgctgggggcagcgtcagcccggagtggaagggcgtgggttagggctggggagggtcccagcgggatcgtgggtcagggtcggccaggggagggtctctgccgagggcgtgggtcagggccaggcgaaggtcatagcgcgggcgtaggtgagtgcctgctggcggtgattgcggagggcgaggctgggaccgggtcggggtactttcttgtcataagagtagggtcaagtcggagcaaggcctggggcttggggaaccccctcagggtgggtgggggaagatgttacggtgaggtgggggatggtggcaggcagggagcttgggtggggacccacagcggagactgagggacggtgcctagaaggccgacagctggagtcaggaggtgagcggtgcaggaggtgggtttaagccttggccttttgccggacatctgggg

SEQ ID NO: 34512 - DNA, 1023 bp, Homo sapiens
gggtattttcaatttgtgtgccagcctaagggtgaatgtctgataacactcagagctggtgcaggggctgtgcctgtcatcccagcgtatccagaggccaaggccagaggatcgcttcagcctaggaggtcaaggctgcagcgagtcatgattacaccactgcagtccagcgaggtcctgtctgtaaaataagtaaatgaaaaagtttatatattcaaagactcctcccaatcagtagaaacagaaaaatcccgacagaaaatggatgagggcggtggcgtttggtacagacagagcggtgtatgagaaccggggtgcgcctcctgggttctcacaggtgcagcaggcaccgccggtaacccctggcctggcctgcgctgagccctgcaccagccgtgctgagggagcctgggcctggcccttcatgtgggatagaaacggccgtgccggtctcgatggtgctttggcagtttctctggaaatctgaaacctgcggtcttcagcccagccccaccctgggcctgcatgtggctgcgtgtcgtagagaaacatctgccctgatggtgacctgatgtgagcagcagtttcacagagtaagccacccctgtgcacgaggtctggaaaggtaagtgcgacgtcgagtcctgagcacagaagcaggtggcagaactgcatggcaggaggtgggcttggcgggccccttcctgacccccaagagccagctgccaccaggagcgtcctggggtctgtttccagcccggtggcagccgagcttcctgggcacccagctttccccagcctgctctgagcactggagttgagggcactgagcagagtggggctgagcccctggcggtggaggggacacatcagtgggtgttggcttgaggtggtttctgggaggctgctgggccccgatctaaagggacacacctggctgcacccacctcctgcagactttctccgtgggagaccaatgcaacaggcggggtggagcagccacgtggcagccacgagggggaa

SEQ ID NO: 34513 - DNA, 1030 bp, Homo sapiens
ctgagaggctgaatttggctttggtggcatcactggcctgctgggtgtggggccctgccgggatatccatggcctgaaaggtgacatctggagtgagggtgacctggactctgacgcgccacacgatcggcacccagcctgctgatgtccaggaaaccttgaatctggatttttggggaccccgcactgccggccccaggtgcctggcaaaagaagtaagacggcccctttagaggaagacagcgtcagccgaggcctcgggtcatttctacaaatcaccatctggtgcggggtccatcacatgcaaacagaggtaaccaggcagtcaaggagatgcgcaaaacgcagaagccagggaagcagtgccacccgcaggagctccccgtgctgcccacgagccgatcaccccagcccagcccccaggaggctgggccagacaccgacgaagagctgatgactctggaacggggcgtagcagcgttaggggagaaaatgagatgcggatctgagaaaacggcgaagctgatcggtggaactgaggggcgggtttaccagctgaccaggcggcagcggacaggagggaaggagagaacgcgggagagggcgagatgaggaagggtcgctcttgcagaaacttcagaacaggagagggaaggggttggaagtgatgatgacagcaaaaccctttccaaaatggacggaagaaaatctgatgttaaaaatgcgcgtggtctgccgggagcgtctgctggggcgttcgctctggaagattcttcatggtttctcacacgggtagatgcgtgcttgtaatgcagcccagtggccacactcctttatcccggagactcggaatgcgcgtccacacacagacctgcacgtcatgctccctagcagcttaactcaccatagcccaaaccagaaggacgccccccaccggctgtccttcagtgggtgagtggccaggcaaatgctggccacctccctcggtgtcctcctcagcaacaggcatgaacgctgggtccctgccaca

SEQ ID NO: 34514 - DNA, 1058 bp, Homo sapiens
gttgtagccacggggccgcagtggtgcaaggctgagcacttgcctctgtcttgcaggcgtccgacctccgatcatgaacgggcccctgcacccgcggcccctggtggcattgctggatggccgggactgcacagtggagatgcccatcctgaaggacgtggccactgtggccttctgcgacgcgcagtccacgcaggagatccatgagaaggtaccaccacgtggtcgcctggggctggcagaaccgcacgttggggggagttggagggacgggagcacggcaggcccgggccacagcaggtctgggtgccactggggcaggagcagcctctgtcccagtcgtcccgcgccgtcaggaggtggacacggggttttccctggacaccatcaggaggtggacatcgggtttgccctgagccccatcaggaggtggacacggggttttccctgtgccccatcaggaggtggacaccacgtttgtcctgagccccatcaggaggtggacattcggtttgccctgtgccccatcaggaggtggacacggggttttccctgagccccatcaggaggtggacactcgttttgccctgtgccccatcaggaggtggacacggggtttgtcctgagccccatcaggaggtggacacggggttttccctgagccccatcaggaggtggacacggggtttgtcctgagccccatcaggaggtggacacggggtttgtcctgagccccatcaggaggtggacacggggtttgtcctgagccccatcaggaggtgaacaccgggttttccctgagccccatcaggaggtggacacagggtttgtcctgagccccatcaggaggtggacacggggtttgtcctaagccccatcaggaggtggacacggggttttccctgcacaccatcaggaggtgaacaccgggttttcactgagctccatcaggaggtggacacggggtttgtcctgagccccatcaggaggtggacacggggttttccctgagccccatcaggaggtggacatggggttttccctgagccccatcagga

SEQ ID NO: 34515 - DNA, 1035 bp, Homo sapiens
tctccagtggtgtcgtgtgtagactgtgttgggaaggggaggaaggtgtagccctgataccccacatgtggtaggagccaggaaggtggcgttctgggggttcctggagctcacaggttgtgtgcatgtgctcgctgaacaaacagggaaacgtgcggctccacggatgtcctggagaggaatcttgctggcaaatccatgcctttgatcacagcccctgcgctgtgtcctctgagctgtgatgcggccctgcaggccccgtggagtgcggtggctccctggctcacagggatgctgccgtccaaggtgccgtatcggctcgtggatgacttgggcagtgtctgtctggggtgctgtcgtcggaggagctgtttcaacctgtgggtgacgggccttgtctgtctgggggaggttctcttggccccgtgctctcagcccagtggctccatgctgctgtgcggctccctcttgggggcctgccttctctgccattgcagggcagggcctcagttttctctgggcggcaggtggctgtatctcaggactggaaggctccgggtcaggctgtgcacagccttcgttcatgtcagcccctggctgggcagcaccgccaggccctagtctttgggcctccaggcctggacagccagagggggcatctcaccaatgcccagatggctgccggggactcacggcagggcagctttgtcacgagagggccactcgagcccggagtaatcagggcttatggggacagggcagggtgagggccgctgagaccacccagccttagggtgcccttctggtggtcggggagcccttcctgggcagcggctttaggggctgctgtggggagggggaagaagatggggttggtgaggaggagcttttgggacactgtcctggtggaggtcgtgagggaggggagcggaccggttggcccagcagggctggccagtggagggacgtggagggttggtagctgccgagcctgggtctgagcaggcggggatgaggaccaggtgctgaggctgg

SEQ ID NO: 34516 - DNA, 1196 bp, Homo sapiens
tggggaaaagggaaggcggtcgcgcccttcccggtgccctgagtggggaggtgaaaccctgagagttggggcaagagggcctggagctagggccgaggcggcgggtgcgcagggtgttccgttgagcccgagccccccccccctccccggcctctccaccgtttctgtaggagcgcggcagggagcacacgtccctcgggaagaaaacggcgctggcggctgggcccgcaccgcggccgtcctcgctgagctcctagcgcgtggcctttgcgcgtctgtgtacccgtctgcagcttggggcagggttgggggagaaccgtggggtaactatttgccgttgcagctgaggatgacagctgcggtttgggggtccccctttctgtgtcctggaactttgtagggcgtggctctgccctgggcctcagcacccggcctcccaggtctcccctgcctgcccgggcctggccacctccctctggggtctgggtttggctcctggttggggctgtcggctccgcagacgccttttgctctctgtgattctgttgcccatctttgagcacctgcttccatacaggcgtcctctgcagagctctgggagggacacgcactgggggtggcatctggtcactcctgggggtgcctcgtccgcctgcccggccatttttggggtgtctgccatgtccccaacatgcacttcttcctgtcagccttgaccagggcagctgttagttctgagaggtgggcgtgtggttggggatgtcagcgagtaggatcttcccttttactcgcttgtcattaacctgagaacgtggcagtgggggaggagaggcttggcccggggtgcacaggactgtgggctggtcctgtccctctgatgagtgggacgagccttggtccagtcctgtgggcttggcgcagagccggccccctgccatgtcctggtgggattggaagtgctggctcgtcctgtctgcctcccccaagggctgggagccccccactctttggacatttgtagtgtaagcagacagcaactgttaaccatcattctgttaataaattttttctggaggaaccctggacagaagtagtcatgctctccaggaaacgggccccaggctcgagaggcccagtctcttccctcggggcttagaggtggccgtcaagccacacctggttccccaccagcctgg

SEQ ID NO: 34517 - DNA, 1086 bp, Homo sapiens
tttttatagtagaaccacaaagacagaaaatatgtcaattcgtcttttgtctatttatttatttttttgagacagagtctcactctgtctcccaggctggagtgcagtggcccaatctcggctcactgcaagctccgcctcccgggttcacgccattctcctgcctcagcctcccgagtagctgggactacaggcgcccgccaccacgcctggttaattttttgtatttttagtagagacggggcttcaccgtgttagccaggatggtcttgatctcctgacctcgtgatccgcccgccccggcctcccaaagtgctgggattacaggtgtgagccaccatgcctggcgtcaatttgtcttttagagcccaataatatccttagaaaaaaggagctctgtccccgagggccatgtgcttttataaaaatcagtcgctggaagtgtttccaggaagtgtttgaggttcccgtctgtggggtgtttccttgctctggacgaaggtgatttggggagtttcttgggtcctgtggaattggtgagcttgtgctctaggtcataactttaggtggccgagggtgctgtgtcagtgtggccttgtcatcggcatcatggcgcccctgtgccctgcaggcgtggccagtggcacccacgtgccctcacaagcctgagccacgaggtgaggcgtctgaagccagcgtggtgtggtcgaggaggggagccttgaccctgaggaggcctggaggtgacccggcaggtggggctgggtaggaaggctgctcccagtggcagtggacgagtggcatggacggcgctgggcaccacagacgggggacttgaggcaaggactgggaggtggcggggggtgggggcccgggagtgctgaggggctggtgccctggtcgtggccatggactcgtgccccagctggacacacctgctgggtctcagggccctggagacgcccaagagagcacgcctgggtggatggagactgtttgcagctcagagtgctctggttggggggtgcagcctggggggaccccctattcctaacaggccttgggaagggaggctactgagtgaga

SEQ ID NO: 34518 - DNA, 1089 bp, Homo sapiens
ctcacaggagcgactcgcgggtgcgggcactcccctgccctgggccagcagcagccccacgtccacgcctgcgctgggcgggcgccgtgggctgctccggtgccgctcacagccttgcgtgctcagtgggaagaggagccggcgcaaacggaggcgtgaggaggacgccaggtggacacgcccatccttggacttcctgaaaatgacccaggtgaggctttcttatttccaggggctcagaggggcgtagatctggacagggcggtgctggggtgaggctggctgattctctggatgtggctgttagcatccggctggtcttctctgggctgggaggaaaggagtgaggagagccatctggagtgcgtgggagcgatcgggggcctgtcctggtgtcagagcacccagctcaccccgcctgctcccgcagaggcagagccccacacacggcccagggtggccggccaggcttgcagtgaggcctgggggaggcagcagaacggagctgtgggtttctggcctggctgagccgccccccgcctcagctgctggggagtcccctgactttttctggtgatggctcaggaagtaacaagctgtcctgggagccccattcgaggcagagcccggggtcctctcttgtgggagctggtgggtgtgcatgttgcagctcagagcccagcagcgcctgtgcgctttgggactgtacaggcacctcctgcagaaactgtctggatgtaggagagagccttcacccacttgaagattctcagtgccacccacctctccacacccccgtcacaggccgtggttggcacagagttaaggaaggaaacaggactgaggaggctttcccaggtcttgctctgtgttactaagggagtgcattcaccagagacctctgggggcccggcagcgctcggggagggagatggcagagccgtgacagagtagggtgggctgtgtgcacactcactgggtcatctgtgtcggggaagctttgggcagtggcagaaattaacaggacttcccgatgccaactgagtaccagccagggccgagtggggctgtggctagggtggggcggga

SEQ ID NO: 34519 - DNA, 1061 bp, Homo sapiens
acagcttgttttaggggttgagtgaggtccggccccaacagtcacatgttgaagtcctgaccccccccagtacttcagaatgtgcacttacttggaaatagggttgttgcagatgtaatgagttaagatggggtcacactggagcatggtgggtcctgccccaaaatgactgatatccttataaaatggggagacttgcacacaggcacacgcagggagaatgcggtgggaagactggagtgatgccagagccgggagggaggcctgatcagtccctccccagagccttcagaggggcatggccctgctggcgtcttggtcctggactcccagcctccaaggacggctggccagtgcgtttctgtcctaagccaccactttgtgattcttggttataggaagctaattcatggctctacaaatgctgtatctgactgcatgtggatcgaattaaattaaaacacagaaaaatcgaacctgctttggtgcctttttggaggatggagtcctggagaatgagagtggccagagccgccagccgagggcattttgccgctgtcccgtgaggcggccatctgagctgaggcactgcctgtggtgggggctcgtccctgctgcccccgtggagctccagctctgggtttgaccctcctaggggtctgcagggcactggtgtggccagatcctggggagcgaggggagaagatgggggagttggaggaccagggtgaggattttggcctctgtcctaagggctgaggaggctgtttctgggggccagagcattgtgatctgctttccgctgaggtcgggccaagggttgcccagtgtatgggaatgagtgtaggctgctgcggtcctccagaccttgaggatcaggcttgagctgggtgcagaggtggaacgagaggcagggaaacctcctggggttgtcggctaagtcaccagtgcagttacaaggaagggatttacggtgcagttacaaggagcctttgggagcgaggacggcgacttaatgccagaaaagtggaagtgagttcgttgtagccgtcctctgaagt

SEQ ID NO: 34520 - DNA, 1023 bp, Homo sapiens
gggaacctgcccagaacagccctgcagcaccagaaaggcatgggcaccaggccagccccgcccttcccttcagggcttcatcaacgccagaccaccatggacctgacacaaggcggcttctcctgtatgggagcaggtagcattctcagagggccatcaggagagcaggtggtggcaaagccacagactgtcactatggtgggacaaacccctttgctctgaggctcagcttccttatctgtaaaatggggaggattccaacaccttcccgtgggctagtccacagcaagggctagctacacagcactgtgatgactgaccctcagccacggcaggccaactgccccacagcagcctgaaacacggccctgatctgactcctctcacataagggagaggtctaagccctgagacccagcaaccatctctggccagcaagtgtgtccctgtaatctgccctgtaggagggctttgaaatgcttttcggttttatggagatcatcaaggcaaatgggacattactttaaaggggcacagactcgtatttctgtctttttttttttttttttttttttttgagacggagtttcgctctttcccccaggctggagtgatgtgatttcggctcactgcaacctccgcgctccccaggttcaagcgattctcctgtctcagcctcccaagtggctgggattataggcgcccgccagcacgcccggctaatttttgtatttttagtagagaccgggtttcaccatgttggccaggctgatcttgaactcctgacctcaggtgatccacccgcctcggcctcccaaagtgctaggattacaggcatgagccaccgcatccggctgactctatttcttaatccactaaaagcccttaataattatccaagtaatggctgagaggggtgggtagatataagttaatcagtcacacagctctgacgtttgtgatttgaagtggttgtctccagtccacaggggccaggatggaaacccagctcaggaggggctg

SEQ ID NO: 34521 - DNA, 1917 bp, Homo sapiens
agaaagaaaaccatgtgctgcgcgtggtggctcacgcctgtgatcccagcactttgggaggctgaggcaggcagatcacctgaagtcaggagttcaagaccagcctgcccaacatagtgaaacccagtctctactaaaaatacaaaaactagctgggtgtggtcatgcaggcatgtaatcccagctactcaggaggctgaggcaggagaatcacttgaacccgggaggcagaggtggcaatgagccgaaattgtaccactgccctccaccctgtgtgacagagtgagactctgtctcaagagaaaagaaaaccgtttttaaatgtatcagtttaaatactgtctcctgtcctgagacagccactatttgtggttttgtctaggcttttacaattctttctgtgcttataaactatgtacatggccaggcacagtgactagtgactccttcctgtaatcccagcacaatgggatgtgtgcacatctaaacgtcagtgtcttgtaaatggtacatgtggtttctctttgcagtgttattattaaaatctgtctcagttgcacgtgaagtgtacaccttgctgtgcattacatcacatgatttaccacataaggagtggggtgtaggaaggggcccctgttttcagggtgagatgaatgtcaaccgagccatgcttctgttttccaggatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctctttcactgactggggctgttgccaggtgggccagctgccgtgagagctgacatgtttggagggtcagaattgtgtctgcctttcttgtgtctgaagcaagtggcactcagtgagtggcgctgggtaaagggccttctttatttttttaattttattttttgagagtttcgctcttgttgcccaggctggagtgcaatggtgcaatcatggcccactacaacctctgtctcccgggttcaagcgattcttctgcctcagcctcccaagtagctgaaattacaggtatgtgccaccacacgcagctaattttgtattttta

SEQ ID NO: 34522 - DNA, 1084 bp, Homo sapiens
cttttggcccacggagcttctggattgcataggatggtgtgcctgcgggcatcagggtggagcttcctcagacctggctgctttatttttatatcttttttaaaaacagcaatatttattttgccctcagatataaaaggaaactcctcatcaatgactttggaagagagagaaaatcatcatcaggaaggtaaaggctgtgtaaatgtttcttttctaatttgatagacctgtaatttgttaaaaaaaaaaaattgtgactgtcagaaatgctgactgtcgcagtagcatttattaatacctttttcactaatttgaaatactgtatctgttgtgtactaaattcccatacatgcagtctccggactatttaggattcatatggttgggaatctggagtgaatcttccattattgtgttttgacattttcttggcttaccttacatacatggtgatcttaattgcagggcttattctgttaatctgttgttttttcagttctgattcaaaggagtctatgtctactgtgccggctgactttgagacagatgaaagtgtcctaatgaggagacagaagcagatcaactatgggaagaacacaattgcctacgatcgttatattaaagaagtcccaaggtagtcttgtttcagtggcatgtcttgaacaagctgtgtggcattgcgtttctaaagagttgcttagattgggtagtacaaatgatgctggggatagttcacacctgctaagagctatttaatagggacttactggggcttatgacgtaaataaagaatggattggcaactggaaaactaaagacatgaagattttaaaaatcattttcatataattttgaatgttagataacattttatttcttaggagtcagcaatcatagatgtaagcttattaaaatacatgatggggaaaaatgaagttcaagttaaatattgtaaaattctaattggagaaaaaaaaattggcattgccctattgtctttaagcagcatgttcttgcctatcctggtccctcaaacacacagacacagaaggatataaagaaagctttagtgttttcctga

SEQ ID NO: 34523 - DNA, 1412 bp, Homo sapiens
tacaggcgtgagccactgtgcctggcctttttttttttttttttttttttctgtagagacagggtctcactatgttgcccaggctgggttcgaactcctggacttgagcagcgctcctgccttggcctcgtgcagtgctgggattacaggtgtgagccatggtgcccagctgatagagcatttttttttttaagacagtctcactctgtcacctaggctggagtgcagtggcacaatctcggctcactgtagcctctgcctccctgcagcctccacctcccggcttcaagcagttctcacgcctcagccctccaagtaactgagattacaggtgtgtgccaccacgcctgctaatttttgtagttttagtagagacagggtttcactatgttggccaagctggtcttgaactcccagcctcaagtgatccacccacgttggcctcccaaagctctgggattacagatgtgagccactgcgccctgctggagtattttcgatccaagagaacatcgtggacattatgtagcagcttccagccttctttctcatagaaacaaaggcagagaagcagcacccagactttgggtaagcaaactgtaagacagcagttgtgagacccagcaaacttgaatctcactcagtggggaaacctcagctgatgtgaggctatttttatttctaaatctgtacttagcgtgaatgctgatgggatttgccgggggatgttactgtggtgaggaccaggcccctgcaggtgtgcccaactctggatggctccctgccttcactgagtccatcgtgtgcttctctgcctggtctgtttttccgagtcttcgtctttgcctgtcgacaccccgtgactgctggcatcatgccttcttgtggaagccaccatcgtccttgctaactgagggttgtggagttgtgtaattcagcttgatgcagggaggaggtgtattcccatgtgtgggcactgtcatcacccacacagggaggtgagcccacctcacagaaggaacacagcctggccagggggcagtctgagcctgcgtgggctctgctgcattctgtgtggctcggctctcggcacgccttgactcaagactgcatggattcaggggccccttcctggctcagaggtgaccccagagctgaggagaacctagagacatggtggctggggctgggccagcgcctggagagagtctgaagctgccctcacagggattggggaggtgaccgaggtggggtgcctgtcccccttcccacccctcccaggcctcattggtgtccaccaggcaccttccacgtgtctatttcccgtattcttgagaacctctccgtgaggttagtgttgggtttgcatgtctgtaattgagggaagattttgagcctgggagagtttttgg

SEQ ID NO: 34524 - DNA, 1036 bp, Homo sapiens
gctctgtcatccaggctggagtgcagtggcatgatctcggctcactgcaacctctgccttccaggttcaagcgattctcctgcctcagcctcctgagtagctgggattacaggcgcacaccctcatgcctggctaatttttgtatttttagtagagatggggtttcaccatgttggtcaggccggtcttgaactcctgacctcgtgatccacccacctcagcctcccaaagtgctgggattacaggcgtgagccacctcgcctggccaattcttgtaatttttacaataatggctggttagccactgaaacttttggagtggtgagaggatgttgagtggtggaactgcacagtctgaaggtggagctcagcatgtggtctttccagttgctgtgttagatgttagagctctctctggacctcttgatggtgataaaagtacttttaacacttcgtgcttattatcagatttttgataaataataataataattagctttttatgtgcgattctgtcatttcaggaacacaaatgtcttctgtagttactactgtgctttgtgacagggacactggcaggtctgctgtagaaacagtagggatttcagagccagcgagacccagggctggactgtggaggaggtccctgaactgatgagtgatacaccgagtggagtgctgcaggcccctgctattaacatcttagatgagtagggttcgttgtcacagttaatgaactgaccttgatctgttactgttcactaaagtccataacatattcagattttctttactctcccgttctccattctgaggtcctttttctgtcccaggacccatctgtaccacccttcttgattgcctctcaggctttccttgtctgcagtgaccttgacagctttgaggagtactgcccaggtggagtgtagggtgctgctctactggtatttcttgatgtttcctcataattaagctgggaaagatggtttttcaggaggaagaccacagaggtgaagcatccttatcatatcccgcc

SEQ ID NO: 34525 - DNA, 1101 bp, Homo sapiens
ggttgaggaagttctggataatatccttaagtgtgttttccagcttgtttccattctccccgtctccttctggtactccagtcagtagtaggtttggtctttttatgaaatcccgtgttttttggaggctttgttcgttccttttcattcttttctctctattgttgtctgcatgtcttatttcagtaaggtggtgttcaaactctgatatcctttgttccgctttgtggattcggctgttaatacttgcggatgactcatgaggttctggtgctgtgtttttcagcttcatcaggtcatttatgttcctctctaaaccggttattctagttagcaattcctctgaccttttatcaaggttcttagcttctttgcattgggatagaacatgctcctttagttcatcattgtttttttttttattacccatcttctgaagcctacttctgtcagctcgtccatccaatcctccgtctagttctgcgccctttttggagagacattgtgatcatttggaggagaagaggcactctggcctttggggttttcagcattttttcgttgattctttctcatcttcgtgagtttgtctagtttcagtctttgaggctgctgacccttggatgggggcttttgttgtggttgttgttgttgttgttgatgctgttgtcgttttctgctcgtttgttttccttgccgtagtcatgtccctcttctgtagggctgctgcagtttgctgggggttcacttcaggccatattcatctgattcactcccatgcctggaggtgtcactaaaggaggctgcagaacagcaaagatgggtgcctgctccttcttctgggacctctgatctcgaggggcaccaacctgatgccagtagggtcactgctgtatagggtgtctgacaacccctgttggagggtctcacctagttgggtgacatagggagcaggacccatttaatgaagcactttgtcccatgatggagggagtgtgcttcagtggggggaaaccacttgtctgggctgcccaggttattctatatttaacattttgagaaattgccaaactattttccatagtggctacaccatcttac

SEQ ID NO: 34526 - DNA, 1039 bp, Homo sapiens
aagatattcaggacttgaactcagctctgaatccaatggacctggtagatacctacagaactctccaccccccaaaaaacagaatgtacatttttcctggtgccacatggcacttactctaaaattgatcataaattgatcatataattgatcatataactggaagtaaaatacccctcagcaaatgcaaaagaaaggaaatcataacagtctctcagaccataacgtaatcaaattagagctcaagattaagaaattccctcaaaaccatgccactacatggaaactgaacaacctgctcctgaatgacttctgggcaaataatgaaattaaagcaaaaatcaagaagttctttgaaactaatgagaacaaagagacaacttaccagaatctctgggatacagctaaagcaatgttaggagggaaagttatggcactaaattgccacatcaaaaaccgagaaagatttcatatcaacatactaacatcacaactagaagaactaaagaaccaagagcattaaatatataagttgctttgggcagtatggccattttcatgatattgattcttcctatccatgaacataaaatgtttttacatctgtttgtgtcctctctgatttccttgagcagtggtttgtagttctccttgaagaggtccttcacatcccttgttagctgtattcctaggtacaaaacaaacctcagagctagcagaagacaagaaataaccaagctcagaatggaactgaaggagacagagacacggaaaacccttcaaaatatcaatgaatccaggagctgggtttctttaatcaataaaatagactgctagctagactaataaagaagaaaagagagaagattcaagtaaacacaatcagaaatgataaggggtgataccactgaccccacagaaatacaaacaaccatcagagaatactatcaacacctctatgcaaataaactataaaatctagaagaagtggataaattcctaacacatataccctcccaagactgaaccaggaagaaat

SEQ ID NO: 34527 - DNA, 1063 bp, Homo sapiens
catccaggcacagggccttcctggtattatttcaaagagagaaagctgatgttttccaaacagggcagaaccccagttcagcaccacagtggaaacaccttaggccagggagtgttagaagctggtttcagcattgcagatgggttttctattatcccacctgtgcgttccacagtctggaagatggaggagggctgcaagcacaatgggaatgccaatccctccaatcccaaccagctttcactatgcaaggtaagatgtcaatcaatcttttttcttttttcttttttctttttttcagagagagacaaggtttctccatgttgtccaggctggtctggaactcctgggctcaagcgaccctcccacctcagcctccaaaagtgctgggattacaggcatgaggcaccatgcctggccaataaatccttttttttttttttttttgagatggattttcgctcttgttgcccaggctggagtgcaatggcaccacctctgctcaccacaacctccacctcctgggttcaagcagttcttctgcctcagcctcccgagtagctgggattacaggcatgtgccaccatgcccggctaattttgtatttttagtagagacagggtttctccatgttggtcaggctgatctcaaactcccaacctcaggcgatccgcccgcctcagcctcccaaagtgctgggattataggcatgagccaccgcgcccagcccaataaatcttttataacgtctcacagtttaccccattctctttctttccacagctttctatatccactcttatctatcattcgtttttatcccttcaactaaacctttaaaaacctctagacaaatttactcttcccataacaaaaaccacattttcatgccttctttataatctttaccaaagacataacctatttttcttacatgctctgtattcagaattgtttcttttacatctagtagttttaattatatatataaactacagtgttttttgagacagggtctccctgttcttgctcaggctggagtgcaacggtgtgatcttggctc

SEQ ID NO: 34528 - DNA, 1025 bp, Homo sapiens
tgtctttgagctctgaagttctttcttctgcttgtttgattctaatggtgagattttctagagcattttgcatttctataagtgcatctattgtttcctgaagttttgatttttttttatatatgccatctatatctatttcattgaaaatttctcccctcgttttttttttttttttttttttttttggagtggtagggggacagagtctcactctgtcactcaggctggagtgcagtggcatgatctgggctcactgtaacctccacctcccgggttcaggcgattctcctgcctcagcctcttgagtaactaggactacaggcatgtgccaccacgcccggctaattttttgtatttttagtagagatggagtttcaccatgttagccaggatggtctcgatctcccgacctcatgatctgcctgccttggcctcccaaagtgctgggattacaggcgtgagccacagtgcccggcctcccctcatttcttgtatcatttttttgacttccttaaactgggctttgcctttctctggtgactccctgattaacttaataactaaccttctgaattctttttcaggtaaatcagggatttcttcttggtttggatccattgctggtgagctagtatgattttttgggcatgctgaagaaccttgttttgtcatattaccagagttggttttctggttccttctcatttgggtaggctctgtcagagggaaggtctaggactcaaggctgttgttcagattcttttatccaatggggtgttcccttgatgtagtcctctccccattttcctagggatgtggcttcctgagagctgagctgtaatgattgttatctgtcttctggatctagccacccagcaagtctaccaggctccaagctgtcctggggcttgtctgcacagagtcctgtgatgtgaaccgtctgtgggtctttcggttgtggataccaacacagtatttggggtgtctcctgggagcaggagcaatctgcttccttcaaagga

SEQ ID NO: 34529 - DNA, 1050 bp, Homo sapiens
tatcagtaatctctaaaacagtacttggcacaatagcatttgttgaatatatgaatgcacagaacagcttacatatcgagtacacttcagcaagagtttcctttgaatcacttaaaattatctatcagaagttgttgcaattaatcttacttagaatttatattaaacctgttatggattttaaatcgaggtttatttattgctaaaattgcgggaagttattaagtcctttaaagtctttccatgtaaattatattttaattttataattggtattaggaataaagtgttttaatttttatttttattttccttttttaggagttaacagagcagtttcataaagttgaatctcaactgaataagctaaatcatctcctcactgatattcttgctgatgtgaagacaaaaagaaaaactttggcaaataataaattacatcaaatggaaagagaattctatgtatattttttaaaagatgaagattatctgaaagatattgtggagaatttagaaactcaatcaaagattaaggctgttagtcttgaagattgaaaattactgaaaactgaatctttattacgtgtcctcttttatttattagaagactgtgtataataaacactactaaatttttaaaatttgaggtcaatggaacatttaatttgatgaattgaactattatattaatttgtcttttttctcatgtagtacattcagaataccagtgctttttatgacttgagcatgtgtttagtggtacttagtcctggtaattttttacttacagggaaaaagcattattacataatgcaaatattttttaatatagttatctctctcctttttagaaatagaaattttctgccgttaaatttttttttgagatagagtctcactctgtctccaggctggaatgcagtggcacgatcttggctcactgcaacctctgcctcccgggttcaagtgattctcctgcctcagcctcccaagtagctgggactacaggcgcacaccgccacacccagctaatttttttgtattttagta

SEQ ID NO: 34530 - DNA, 1022 bp, Homo sapiens
tttcttattaagaatttttgtttttcatacttactagaaaagatctttttagatgtaggtagacatagatttttatcataccactcttgggcatatgttaaaaggaaaaaaataagtcaatttaaatggttagggtagttctaaagcatcacatttcaatgttcaattcttctgttattttttgactcagagttgtctgtaattttccacactgtgtatcaggaatgttgatgagaaagtatttcttaagagtacctggccagaaacaatcatatgatgttcttgattaagatgcatcttcatttcagatatgttaaaatgtgaaaaaaaaatgcatccaagaatcactaaaatatggtaatctcactctaatcttatcagtgggtatcattagtgtttttccctagctcaatgtgatataaaatgccgtatcaattttaacttgtgtttctattattaatgaagctgaacttcagtatctgtagcaatgttgttttagcaactgtatgatctttagtatttaattgaaggtaaagatgagattgttgtttctcagtatattcaagtttaccaagtttgtcttagaggatatcactaaatgtagatataatgtcgaaattacttgattttcaaaagtatgtattttaagaagtactcctctgtgaattggcatttatgacaggtcttaagtagtcattcttgaacttgtacattagaatcatcagggagcgtatcaaaacgcaggttcctagctctgtacagagattaagtaatttagtctagtgggggggtacaggaatctgtattcataacaagtacctcagataattatgatacttgtggactatgcctagaagctgtggaaaattgagggtagttagagcaacagatttttctgagaacctctttggtgatactggctaaaatttataagtagaatgcttgattagaaagctatggaaacttgttaataatctggtttaaatgctagacactgaggaatttgaatttactgtaataaa

SEQ ID NO: 34531 - DNA, 2032 bp, Homo sapiens
gtaactagccacaaatctctgaggttaaatgctaaagaagaagaagccactaaaaagctgaagcagagtcaaggaattctaaatgcaatgatcactaagatcagtaatgaacttcaggctcttactgatgaagttacacaattgatgatgttcttcagacattctaatttaggtcaagggacaaatccactggtatttttatcgcaattttccttggaaaaatacctaagtcaggaagagcaaagcacagcagcattaactttgtataccaaaaaacagttctttcagggtatacatgaagtagttgaaagttcaaatgaagacaattttcaacttttagatatacagacaccatctatttgtgataatcaagaaatccttgaggagagacgactagagatggctagactgcagctcgcatacatttgtgctcaacatcagttaattcacttaaaagcaagtaattcgagcatgaagtcaagtataaaatgggcagaggagagtcttcacagcctaaccagcaaggtaagcataagaaatgagattggattcacattgtaattattgttaggaatagaggagataatattgctgttaaagtactttagaatggtgcatctgagaagagattacattttattttctttgttcagtgcttatttgtgatctgtgtcaatgtttcatacaaatagttccatacgttaatggagggcagcaatagtaattataatctctaccacattatctaatttattttaaacaaaagtgctttaatttgcattccgaattttaaatttgtgtaatgcagatacagactggactgagattttctttttaagatgtggctagaaactaattgctttattatgggtattctgcctcgtttgctccaaccagagcatagtgctaatgaagtcagaggtccaggttcagtagactgaaactgatttctttttgagaatatatggatagatgtattgcagatgtctgtctgcactcttggagagcttgttttcttggtaatataactgctagatacttgagtaaaaatgtaacttttctgaatcagaatatcagcaccaagttagtttctatagctgacaaaacatttgaatgatataggaaatccaataattacgtagaagtgctaaaatcaactggccaactaggacctattgaagtaattttaacttaagaaaaactagtaacatatacttggattcagtgaatagtgtcctattaataatgattctgattaaaagaagtataataagatctctattttggtagccgttactatatatatggtagtaatagcagtaaaatttagtaattcatacccttgacttagtccacatttttcccttttaaactgtaatttttgtttatatgaatattaaattagttttcattcattgagcttattatctggtcacctaaagtggaaagtgaaaataatcttaagatgatttcaaatttaggcatacagtttgaaatgtaattgcttttctttgtataggctgtggacaaagaaaatttggatgctaaaatttctagcttgaccagtgagattatgaaacttgaaaaagaggtcactcaaataaaagacagaagtttacctgctgtggtaagagagaatgcccagttattgaatatgccagtggtaaagggagattttgatctgcagattgctaaacaagattattatacagcaagacaagagttagttttaaatcaattaataaaacaaaaggcatcatttgaacttctacagttatcatatgaaattgaattaagaaagcatcgggacatatatcgtcaacttgaaaatttggttcaagaacttagtcaaagtaacatgatgctctacaagcaattagaaatgttaacagatccatcagtttctcaacagataaatccaaggaataccattgatactaaggattattctactcataggtacgtatgcttcattgtttctttagtaaatatttccttttgtttttgcgaaatactagagagagtttgagct

SEQ ID NO: 34532 - DNA, 1327 bp, Homo sapiens
tgcgagaagcaagcggaacttcctgaggtgactgacgcgggcctcggttctgggcgcaggggtgtggggctggaggagtggccgcgatccccgtctgcacccaggtgcctcttttttttcctgcgctcctgggggctccttccaggtgctccagcagctgcccggggatcagggcccggtccgctgggcgaggagctggggcgggggctgtgcggggcctgtcacccccgtcttctgcagctcggtgtcgacggcgattcggtgggcttgtgcgtttgttttgtcagcgtgcttaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggtaaatatttagttgatcttcagaagatgtgccatgcttatttgcgtcttcttacgtacggagggcagggaagagaggctgcctagcctcctggtggcttgggtttgtttggatccatttattttgaattaaaaacaaatgctgctctataaagtgtaatgcattttaaaccattttatctttggaaaaaaagataaaatggatccaaatagatccactttcttgttaattacttttcgttactgttgcggttttctgagaactagcctaattgtttctgtttctctttatcatcatcaaacattgcagctacgactacctgtcatttatcccgctctcggatatcatgtgatatttgtctgtgtcttctttttaaaaacactgtcgtcatatttgtggtctaatacttgttttcttcccccctaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtggaaacattaaaaaaaattggttatcccaaagctgataatcttaatggagaagactttgactggttgtttgagggcgttgaagatgaatcgtttctgaagtggttttgtgggaatgtgaatgaacagaacgtgttgtctgaaagagaattggaagcttttagcattcttcaga

SEQ ID NO: 34533 - DNA, 1049 bp, Homo sapiens
tttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccac

SEQ ID NO: 34534 - DNA, 1044 bp, Homo sapiens
gtgtgaggagacccgctgtaagcaggactgtcctggagacggtgccagccaaagattgggtagcactgacccgctgccacacatggctcaacttggccaaggctgcctggtggctgcgggtattagagctgggccgtagacagaaaccacagggctgggaggtggcatctgactgtgaccgcctggctggggcagggagggacccacctcaggctgtggggctggcagagactgggcaccctgtggcctgtagccttggctaggtcttggcagggatggggaacctcccgggcccaggcctgggtgccccagtgcctggccagggggatggggggactcctcttcccgctgtgagctcacagcccccctcgaccccagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaaggtggggcgtggggcgcggggcagcctcacctgggcctccgggtgcgcagtggtgcagctccctgggtggagaggaggtgcctggtgctggggctggggagaaccctcccagctccctgctgcactggggtgtgtgtttgtcactaagcgcagaagggactggacagggagggtgggatgcagaggctgtgtggcccgctgaggactggtgcttctgaggccgggttctcagccagagccctcctggcgtctgctgccccagggcccagacagcgccctccgcacttctgcccctctgcctagagcttctgcttccagaaaagggagaaatgggctggcaccctcagagtggcctgaccccatccccactctattctccctagaagtggacatagagggcatggagtttggccctggtgagctggacagtgttggcagcagcagtgacgcggacgaccactacagcctgcagagtggcaccggcggcgacagtggcttcgggcc

SEQ ID NO: 34535 - DNA, 1065 bp, Homo sapiens
tccagaggaggtgggaggggacgccaccctggatggaggagcaggccccagctgtgcctggccttgacgtaactgcactcttctgaccctaagacgtggtctgtgtccctgactctacagaggaatgcactgagcttcagggaagacgagggctttgcaggtccccagccgactgagagtccgtctgagcccatggctcctgcggttgctgctctttattgccctggctggagtgcgatggcaccatctcggctcactgcaacctctgcctccctggttcaagtgattctcctgcctcagcctccctaatagctgggattacaggtgtgcgctaccacgcccggctaatttttgtatttttagtagagatggggtttcgccatgttggccaggctggtctcaaactcctaacctcaggtaaaccacccgcctcggcctcccaaagtgctggcattataggcatgagccaccgtgcctagcctcctctatcactttaataatcctaaaaaacagtcacatgcaccgtgcgtgttttccagcagtacatggcggccgccagctggacacagcgattggcgcactttctcctgtcttctgtttcaggacaatgtgttgaacatcattaaccagatcatggatgagtgcatcccccaggaccgcgcccccagagatttctgcgtcaagttccctgaggagatccggcacgacaacctggccggccagctgtggttcggtgccgaggtagcgggtggccacccgggttcggaggtcctgatgtggggtggcgtctagccaagtccctgcgaaccttgtgcatgggcgcctgcaggtgccgggacctggtgtctcctccaagagctccgtccactctgggttacgtggtgtggtctgagcctggtaggccgtgcacccctggaggatctgggaaagccatgaactggtgcccccaaaactatacatacaaatgaaatttcccatgtggtttttatgaggttcacaggcccccagacagccaggacctaaaagtggtttttaatggcagtaatgcccacatcaggaacaagt

SEQ ID NO: 34536 - DNA, 1064 bp, Homo sapiens
ccgtcgtgctggacagatttaacactaagtgatgagtaggttgagattataattgtttgctttatactctgcatacttagaaatggaaatttagtaccccaaattttcttctggattctgttaatcaggatagactgaattttgtaagctgtgttcattcatttcctgggacccctgcctgaaggtgtctgctcacagtgaggggtctgggtgggatgactgacacaatgaataaagacccctcctgctcccgccccaggcactgctgggaccatgtgggaaacttggcctcttcctctgaaatactggtcctgaatggccgggacgctagctcaggggctaactcagcttttcaaatagcacggggtttctgtgtgtgcgtgcgtgcctgtgtgtgtgtgtgtgtgtgtgtgtgtgtgtgtgtgtgattacagctctctttttgcagatggtcaacacctttgtaggtctggttttaaggtctttaatttactgaaatcaaggtacagcggcagggtatttgcttgtgggcactgatgccaagtcagcagtgtgactgtggtgcccgtcatggcatggtgtggggcggggtgtggtgagtgttgttcctcgtggtcgtgaagacactcggagcttccctgttctcgggggcaatggctttggacacgctgttcaggatgcccctttcccacgcgcaggcaattataccgtcagagcccatggcccctagacatcatggaggcctcctcaaatcacagagaaccacaaatggcctcgcaggttgttgtagacgccgtgcgcttgtccggggtgggtaaaggctccgaggctcaggtccagggcccgagggggctgtccttccaggtggatgggggtccccagggtctttcagggaagcttgagcccaccccaagagcagcttcctcagagttgtacaggcccacagatttgaggttttaccttggaggagggttacctggcagggtttgctaagtggatgtcagggctcccaggccctcctgcatggcactgcagcatggaggggtctggccaagggttggctc

SEQ ID NO: 34537 - DNA, 1023 bp, Homo sapiens
acaaccaaaaatacacttcagggctacatgtggctgccacctagcttttggaaggggccgtgagagccaggctcagggactgtgggaggtgtgcaagcggccgaggggcaggcaggggtggttatggcaggtcccacctgcatggtaggtggtgagcttccagggactcatggcatgagcaaaaataactagcacaccctttaacttttttgcatagttgggaattagctgtctccacacctgtgtggcctgccttccaaggaattcccagcccaggagttttaaattagtgctgcctgtggcattatgtttcaggtattggaattactctgtgtttgacaaggggaaggcaggtgttctgtgtctagaaaaggaaaaggtgaatggagtgatcttttatgcagcggatgcggtgagatttcaggtgccaccagcaacctgcattccacgggccgaggagctgtgggggtctcctctggggctctgcagatgagatgggattgactggccatgatcaatatgacagcgtcctcaaaggaggggcagacgcagcctgcggccctttcacggggagctttgtgaatccaattccttccaagacaggagcaaaagatcctatttatttgcctgaatctggaaagagataaaagcttttttcttttcttgtaattccagccagggtcgattctacatggacatatttttctgcatttttgtaaattccttacagctgaggtgtgtgaagtgcgattctcattaaactcacagggccaaagctgagcctctcgactgatgccactttaaatattgggtatgggaagagctgggaggtgggagtttgacagaagaatgaagagaacgtaatgtttcctttgataacttttccttggagttacatgaagaattgggtgacagtaagaaaggatataaacaattcattgtaagctgcaaaatttagttgtatttaaataatttaatatgatttaagagtcactaggatgcagtgggatggtcctattatcg

SEQ ID NO: 34538 - DNA, 1014 bp, Homo sapiens
agcaagactccatctgtctctctctgtgtgtgtgtatatatatgtgtgtgtgtatatatatgtgtgtgtatatatatacacacgtaacttttcagattccataatttccatttggttcctttaaaataatttctatattcatttgatgcagccttattatatcattgttttctttctactacccactagtattccagctatgatgttgctcctcagggtgtgtagctttgcgtatgcccacagtcaccctgggatgacagtcattttggtagagttctcttcctctttccctgaccacattcattaaaccactaattgccaattctattgttttcaacaatgccctggggcaccatgctctacaaacaaatccaatcaaattctgactcctttgaagagagagtttctgggaacactgtgtgatattccttctgacccctggatgccttctcccagctcttttcttcagttacctcctgcaaactatctggcctgtagctgagcctgcatcttgtctctcttcccagggtttcatggcctccactgtttctgagtgccttcaggcttgaacctcttcattctttgttgcaaacaaagtcagtttctttgggaagagattaggagctatctgttttactgcctgtttctctacccaggcaaaatctctgagcagggctcagagctgagggtgcagaaaacagtaagcttctcaatacaactgttcactgttaaagtttcctttctaactattgttattgtttcatttcatgactattacaggttgagtatgcctaacccgaaaggttccaaaattcaaatccttttgagtgttaagatgatgctccaaggaaatgctcattggagcattttggatttcagatttttggattagaaatgctcaattggtaagcatgatgtaaatactccaaatccaaaaaagtctgaaactggacacacttctggtactgaggatgccagataagggataagggatactcaccctgtgctactgtg

SEQ ID NO: 34539 - DNA, 1837 bp, Homo sapiens
aggaaaggaagaggctgatccacaaacacaagcgtgaatttaaaggggccgttcgagaaatccgcaaggacaatcagttcctggcgaggatgcaactctcagaaatcatggaacggtgagggggacgtgtgtgtgcgacacgattgtggtgtcactcagctttggtgctgtgtggccctgggcagagcaccgggcacctggcatcccacagccttggctctggctgggggttggagccaggcaggttcacttccccctgtttgaactgaacgtggccacggtggctaatgtggttctgatgtgggagagagagggcaagatgctctccaagaactaatccaaaaatgggcatttgccttttgtttcttttagggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacctgccaccttgctgagggaggtgctgaagtaggtggtttccctgttccaatg

SEQ ID NO: 34540 - DNA, 1035 bp, Homo sapiens
tttccaaggatggtctcactatcctgcacaaggtgacaggaagccccaagggacagtctcagctggacccaagaacaagtctttgatggcacatcctgtcctctacaggctgctccaaattcacctatggcctacccgcctccctgcctttcaccctgaccctgacaggctgtaccctgcatccacttcctgcttgacatggctgtggcttgtgcctttcatcctgccccaaccctgccccttattggcccgcaccagcccaggatgctgctggagccgaaggcatcagtgccatctccgcagctacccccacaggaccgtcccgcaccaccagcacagccctggcagccttgcctcgtgccttcccctcatgcgctccggcctcctcgcaggcctggcttcgtctctggagtagttctctgcacctagaactccccacagccatgctgctcgcgcccacacccttgggaagccaggccttccctggcccacactgtgccgtgctccctgcgttttgtctgtggtgctgacccccgggcacgttacaccgtccttgtctctgccccactaggatgagagttccatgaggacagcaactcggctcgttccggccaggtccctggagcatagagcagataagctagctatcacagactccgtcgcctggtcaaaggctgatgaggatgagatgtgagccctgccccttatcctgtatccacttcctgctggtgtggctgtggcttgtgccttttatttaaaagaatttgggttggcctggccgaggggcacagcaggtctcatggtctcggtagactgggccagtcaggcccttgagtttggtctccatggagacgaggcattccggcactcgaaggttacatccacatgggcccaggagtggctgtatctgtgggtgcagccagggttccaggacacacctgtgcaggagaaagcgggtaggaccaacctcagtgaactacctttcgggagattcctcagaagccaccagccaactcttctggaagccaaggtctt

SEQ ID NO: 34541 - DNA, 1030 bp, Homo sapiens
cctccacctcactgcaacctccacctcctgggttcaagtgattctcttgcctcagcctcccgggtagctgggattacaggcgcgtgccaccatgcttgactaatttttgtatttttagtaaagacagggtttcaccatgttgggccaggctgatctcaaactcctgacctcacgtgatctgcccaccttggcctcccaaagtgctgggattacaggcgtgagccactgcacctggcctgttttcgttaaagcagatgtattctgagaatttttctaggggtaaacaaattctttgtgaccgaatgtccactgatttcgcaatcctcagggcttatcagaacagttttctctctagaagaaaagacgtagatgtggcttagctacttcaataacattatctagccattactagaatgtgccaggaagctagatcttttctttttgtaaaataagaaataaatatatttttaaaatgaagaatttcttctttctaccttagcccgatgcatatgacatgatggttcgcgagcttggctttgaaatgaaggcgcagccctctaacaggatgaagacggaggcagaattggcaaaggaagagcaggagcacctcaggaagctggaggtagggtggcagcacctcaggagcagggctgtgctgctgtccgtccacagccccttctgctccattttgcaggatgggctgaagagaatactctgtttgatcagtggaatattttagtctatttaaagtttatatttattcatgaatacctttttttttttttttctttgagacagagtttcgctctgtcacccagctagagtacagtggcacaatcttggctcactgcaaactccacctcctgggttcaagtgattctcctgcctcagcctcctgagtagctaggattacaggcgcctgccaccacgcccggctaatttttgtatttttagtagagataggatttcgccatgttggccaggcggtcttgaactcctgacctcaggtgatccagtcacctcggcctcc

SEQ ID NO: 34542 - DNA, 1029 bp, Homo sapiens
ctgctcttcttagagactagagaaagttattgcatgaaagttttactgatcattaacctctctacaaatttcacaagtgacagtttttatgtatttttgttttttttttaagttttcagaactttaagatggtgtgtagatagatgcttttatgggccaagaaagcatgttgatatccattattttatttgaacctcaaaatagctcgttctacccatgagctcagagaaataaggtgttttgcccgatgccagagtcagagctgtggggagaacccacctcactgactccaggtgcctcactgaatgcactactttgctccccctactttatcaattccagcctaatatttgtaccagtggcattgatgtagttcctttagcttttacctactgtggaattatagcagtttgaggaaaatcatattgagcctcatatctgtagataacaacatgaaacagataaattttggccttaaataatgttaacagagtttaagattcagttcgggtctgactgtcttgaaccctatttataaggttgcagtcatgacatcaattacttgacatttcttgtaagttaaagtaggtcccatttccagcatcttcagaacaaaggtgtacaaatctaaaactgactctcaaagctttgtcttgtcagtgtgtgaaagttaaggcgttaaagcctggggctgccttctgatatttggctaatccagggggtaaaaggcttaggaattagggcagcaagcatgtggtgcagaacccgccatctgcggcacaccaggaggccccgccactgctcggcttcacgggcgtgaagagaatggccagttattttaacccctctgtgcctttgtctttgctcttttcattgttcaagacttctcgtggacccttagctataaaacgcattccctggggagatcctaattccccgagactggaggtaactgccttggtgtgagttgggcgagtggccttcccctcattgccaggaggcgctgtggcgcaggtgactagagggggc

SEQ ID NO: 34543 - DNA, 1048 bp, Homo sapiens
ggagccattcatgccttgagcttgactagtgtgttcttttttacccttccttttggcaccggtagactctaaagaagaaaagaaagtgattgccccattatccttgaaagttgttttgctcttctcaaaattctgtgattagtagagaaagcctatcgtgcatgaaagcagattgggtgtgaactttgacatcactgtgcatagccctgaactttaaagtatgcactgttctgatgtcccctgtagtggaaatcacaagaattttttgtgagattgtttctgacctgttttccagcgtacacagactttactaaaagagtacaaagaaagggataaatccaatgtattcagagataaacgcttcggagaatacaacagcaacatgagccccgaggagaagatgatgaagaggtttgctctggaacagcaggtatggaaagaaactggaggagggtttttgctgtacatttcacagggaagtcaaggccaaggagaaggctgactctgcatgttttgcatgttcctgggcactcggaaggtccaggggatagccctcgaatcctgtgccttatctggctaggccaaaggagaagcaacctcttctgcaaatgttagctgaatggataaatgccttaactctactacacggcagcagtgtgcacaggagttctcagctgagcagcattgctggagtggaaactggcccctgggcttatttaagaattcccctccatgaggccgggcgcggtggctcatgcctgtaatcccagcactttgggaggctgaggtgggtggatcatgaggtcaggagatcgagaccatcctggccaacgtgatgaaaccccgtctctactaaaaatacaaaaattagccaggcgtggtggcgcatgcctataatcccagctactcaggaggctgaggcaggagaatcacttgaaccagggagtcagaggttgcagtgagcccagatcactctaccgcactccagcctgggcaacagagcgagactctgtctgaaggaaaaaaaagaattaccctccatgagttt

SEQ ID NO: 34544 - DNA, 1074 bp, Homo sapiens
gggttcacgccattctcctgcctcagcctcctgagtagctgggactacaggcgcccgccaccacacccggctaatttttttgtatttttagtagagacggggtttcaccatgttacccaggatggtcttgatcttctaacctcgtgatccgcccgccttggcctcccagagtgctggaattacaggcgtgagccaccgcgcccggccccaaaggtgtttttaacaaacattgtttagcactgccacggtaggaagttactagaagttactagggattaataactcagcgtgtgtcagttgaaacaaattggttcttgaaatattcttgaagaaaatgacgaaaattgccttggcagtatttattgaactaatggatggtttcctactcttcaggtagcagaggggtttttcatgcattttaagtgtaataatagcactttcacatttcaaagtgagataagagaaatggttttttcacatccttttctcctgtccacatgattaatatttcggttgacctctccagatggaatgtgctctaaatggaaaggagggccaggtcgtgcttctgtccctgctggagcatcttctgctcttgcccagctgcttcttaaccccttccactctcttttcctcctcttccagctcctggttttgaccttaaatctgggtttcttagcctttaagttcatctccgaccctggggaagtgacctatgtctggagcaaaatctgacctgtcccctcctgaaacagaacttggaaccagagtggcagtgaccaagtcaccacacgctccctcctgccacacgcacgcattctttcaaagtgacttcacaaattagaggaatccctgaggaaggcaaggaacacttaagtcgggttagatgagaggtttcaaatgtctgccgaggcaccgatttgtggtgggtttgtaaaaccactgaattggatcattccaagggccttccatggcatcaagattttgccttgatgccatttcctttcggaattgctgtgtaaacaccagtgtaatggcagttccttagcaaatagaagaagttccgcagcaaga

SEQ ID NO: 34545 - DNA, 1065 bp, Homo sapiens
cacacccccgggccggggtgggagaataaggtagtgtggttccctagaagagacacatttgtcttcaccactgaagcctcagttttctcatttcaaaagtagagatgatagtatacatcctacccctcgtggtggtttgtgagaattaagtaagatagcacatagagcacacagcaagtgttctctaaatactgttattcttaaccttcttggcttgtcgttcgagtcccgcacagtctggctgttgtccttgcttcgcctcttgcaactcagtttgtccaaaaggtctgccttacctccgaaagtctctaaagggccagctcaggttcaccacccaagctatgtaacccaaataggacaggttgctcaaacttctggtattgagcagatccacctccctgccctgtgctgaaggcctgggacggggacgggaattgctgctcctttttggatctccaatgcttggcccttggaagaaacacaaatatttgaagaaatcaaagatggaacctgagtgccttaggagatcccggtcaggaaaaagtgtaatagttaggaaagtccaaaaattcttctagagggagttacagtcaagttttgcaaggggagtgagctgttcatgggcccagggtgggcagaggacacacatgcaaaggcacattgtcccggtatggtgaagtgtggcactcacagctgtctgagggacagcaggtcgtccagttgactccaagcttgataacgcgtgtaggggccgtgaggccggcgcaggaggcctgggtcttttcatgtgggttagtcccttagaagtaaacaggctgcctcagttggcttctcccctctggtcagttgtagcactctgaggcactcagtctggcaggaagagggcagcccccaggtgccagtctcaggacattgctttatagctgtgcctcagtttccttatttctgaaataatttataaaataagttatattaatgtagttcttaaatcagtaactatattaatatagttactatatattaatatactaactatattattaatatagttactatatattaata

SEQ ID NO: 34546 - DNA, 1043 bp, Homo sapiens
agagatggagtcggtagaagggggcagagagggagagagggccctgtgtggcctccctggacgtgtgtgagccacgtcatctcacaaccaggaggcaggtgggatgacaatgaggggctggcagaggtccccctaggaaggtggccttgctgtcctcaccacctgcagccgggagagccaggcaagcccggggtcaccgggctgctgccctgtccccctccttgggatcttctgctccccaccccagccagctcggtagctgtcccctgttgagcctggacacgtccaagagaagggtggttgcctgccggcagctcttctccggtttgttttttgttttcctgcccttcgtgaggccaagaacctggcctggcactcacgtaggcaagggcctgcctggccatgaggagtggttggctgaagagcggccctggccacacgagcccgcggcgggttcactccaggccttgtttccctcttaggcgaagacctctgggaaattctccggcgaagaactggacaagctctggcgggagttcctgcatcacaaagagaaagttcacgagtacaacgtcctgctggagaccctgagcaggaccgaaggtgccccccgcccccaccccctcctgccctctgccccaccccctcctgccccccacccctcctgcacctgaggctcgttgtgctcagtgggcagcctcagctcccctcaggaacacagcaggggcagggaggcggcaccagacgccctcccagggttccaccggacttgtgagtggggaggttgctgtgcaggcaggctctgggagtcgcctgcctgcattggatgaaccaagtctcaccggcgcctgcccccactatgggcacagctgctgcctttgtcagacctgagcttcgctgatgggtccttcattctggactcgtgaccctccccaaatgtgtgactttcccaccccacaaagctggagtaaaatggagggtgacccagcagagagggggcagggcaggggtccagagtcagcccccaggggacctggtgcccc

SEQ ID NO: 34547 - DNA, 1035 bp, Homo sapiens
cctactcggggccctctcggcccggaggggaaggcaggaccccattctgtgggaggcggggccctgggagaattcccccagcccccaggaaagggcgggcaggcaagcccaccgcccgctaaggaggcgggtgtggttgcatgggccccggattccaggggacctagtagagggcctgtcacacagagccacagcacaggacttggaagtgggaattggggcctggggagagctactgccgtggagggcgaggccagcccccaggctctgctctcacatcccaagtgcaggacttgtcctgttggcaccagggcccgcgtcgagcgcctgctttcatatcatgttggtggcagcgtgtggtgacagacacagcccacagatgccgagtcccccctagggaagcggggctaggggagcaccacgtgggcagatcctagagggctccccgagtggctgggccacagcacactgcagactatttattcctcctggctgctaccagtaactttttgttagaagctgctgacactgacgtttctcctttagaaactgtttttcctcccaataaatataagatgtgtgctgtcagaaagccctgccaccctgcacagtctgcaggtggcctctgtcctgtggtccttagagtttttgccctatggcagcaggtgaggctgcaaattttgttcttgaaaatctgtgcagctggtcgctaaagacgggccaatcggtaaccactcttacagcccagcccaccagctgctttcgacagctgcgtctcagggggacacagcttgatggaggactccagccggcgtgtccctggtaggaaagagggaggtcctgggggtgtcccgtgagtcgccagacccgttcctaagtgctgggagaccacagaccccacgcttgtttacattcttgttctccccagatctccagtggtcatccaggaaacaggtgaaaggaaactactggaaaatgagaggcaaacctgtctcacccaccgtggcaacccagatgtgttggcttttgactgtt

SEQ ID NO: 34548 - DNA, 1047 bp, Homo sapiens
ctggtgtccatgttgagttcttgtctaaacctgtggggtttgaatcctgctgacagtgaccctgactccacctcttcctggtctcccagaacctcccggtggccagcctcctccgaggtcagtttctcgctgtgtcctggtccgtcctgctcgtggctcacaggctcctccccttcgttcgcagctgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatggtacgtttgtttctttcctaatgcaggtcgagtatccctcttcctaaatgcttgagagcggcagtgttttggatgtcggattttgtttttggatttgggaatatttgcattatgcttaatctggatatccaaaatgagcctttccccgagcatcctgagtgcccagaaagcttaggatttgtgttgggggctcaccctcatgagggaggtggccactggcttcagtgtttgggggggctaaccctcatgagggatggtggctgctcgcctcagtgctgtgggctacgcctctgactccttggcttttggccaaggggcccattgggcacagcctgcggggggctatcctccgagcacagatgcgcccttggccgtggtctcagtttgctgtcacagatgccattggcacgccagagggagggccaaggcaggggctctgggtgcaggaaggggccggaggacagcaggaggctctgtcacccagaggaggaagcaggtctgccctagcatcttgaagttttggggacatactccagatgtcatcagaatggacacttggttgtcatgcgcttagtgagtcctcgtccctgtgggtattcaagaagaggcaggacagtcgcctgcttggtaccagcatacggaagacaggtgtgtcctcagagccgggagggttttaaatgacagagttgcgactgttccttttggacccctctcctcc

SEQ ID NO: 34549 - DNA, 1050 bp, Homo sapiens
aaccttatctccctatgtggggaaacaagaaaaacaaaatgttgggtagaaagacgtgtccagggacagaaggaatcccagtagcaagcccgtgcttgttcatttgagcgagaaatgaggaggtgaggagatgggatcggtttagagcacataaaacgcgaccttgggaatgctgaaagtcagtcttaacagggcgctcacctgacctctccttcatttgagagatgagggtacggaggccccgaggggaaagggcacccccaaggtggctcggccggtggggccccccgggacaacagcttcctaattggtgcgtgaccctgggccagctgctctcttcattaagatacggttgcttcatttgttaggtgttcctgaaaacacctgaaatgggtgttttcgaactatgccgaccatctgggcctcattatctcatctcaaatgcaggagtcagattagatctctgtctcaatagtccagttttaagcattcctgagtctttgagagggaaagtaagtgatttgcagaataagaaggaacttttggaacgaaaagggagaggagaaacaggtgggggacagacagacgacagacggttataagactgcgtggggatggggattgacgcctgggcatcagctccacaggcccttcctgaactgctcctgggaccagcagtcaagccccaggcgtaatgttcagcctgcggaggtgggaggtgggagaacgctctgggctggagcggcagggcggcttcttggaggaagggattctggaggggctggggacacggctgggtttggatgtgttgatggcctcccagcagcagggaacaggtgtgaccaggagcagccgggatgcagtgctgcctccccgtgcccactgcactgggcatctgttgagtgggtggagtcccccctccccatgaggaatggggagcccgaaatagactccctgaccgattggaggtggcgctgaggaagtgcactcggacccaggaaccccagcggctcccttttgggtgctggcccaagtcttccacctgctctg

SEQ ID NO: 34550 - DNA, 1930 bp, Homo sapiens
tgtcattgcagcaggtaatgcccagccccgggcatcctgtgcaggcggtgtccttgcagctctacccagctcttggctctgggaaaagggaacaatggatgctgtcaggcatggacatgatggggcttccagaagagttactctgggcctccaggctgacatcaaaggacaggggtgcctcttaaggtgaccttcaagccacagccctcttgctggagacaggcatactcccgttccagttgtcaccacatggctctgtcccagagccatgccctgtgtccttcagagaccaccggaggaaaacaaccacttctgggatgaggacagggcacttgagagaaggtggtgtttggctgggccaccgaaaacccctcgcccctgccagcacactcagtcccctctctgatggaacagagctctgcctgtggtcctgggtcccagccctgaaaaccacaggtccagcggtggccagggacacaggcccacccctgcaagccagcagacaaatcagcggatacctgaaacacgaagttcatggcagattcaggctttgtgtcattcaaagccctctagataggccgaaaaccagagctggttttttaaggaacaccagtgagtctggacatttttttcttttgcttcggtcttttgcagctttctctaagggttctcctttttcaccgtagtaattgcctttccatctaatggcccaaatgtttaaatggcatctaatagtctcatatgaccgctgcctctctggcctcgccctgctgctgtggtcagcatgacctggaactttccacttgtccctttcagtaacctgaagatttcaccgtagacgtgctgtattgcccagaagccatcgtgtcgctagtcggggtcctgcggaggctggctgcctgccgggagcaccagcgggctcctgaggtctacgtggcctttaccgtccacaacccacagacgtgccagctgttcaccactgagctagttgagtccccacgcccacccgggcctgcatggtccccgagctgtccctgcaggactccagtggaagtgaaagaactgggcgccggcgtaaagctagcatgccccacactcccacaccatgcggggaactcgggcagaggccggtgagcagggtgggcttggagcatggggggcttgaggcaggaggagggcagctcagcacaggaaggagggtctgagcctagcagccctactgtgtgcttcagagcagggttccctaagcccttgggcctctgttttctcatctataaaatggaggtggtgggaggggcagtcggggtcagggctggacacagctgtggccagcaggatgctggagcacaggctgtacaggcggatccaccacgccactgtcctgagcacccagtcggtggaagacaagcagagtgactgtagagaaggggaattggccctgtagtgggccagccactgtccttagacctaacatttgtcagcccccagcacctgtgagggtgtgctgtccttgtcccatctcagtgacaaatacactaggacacacggaggccaagtgacccccgagctcccgcacactgcagcccggccacctggctcgcaggtctccacactacatccaagccccccattgccaccagcctttgccccagctccccctgagcacagcccctcctggcagccatgtgcacagatgcacgcacagcagcctctgcctgcacacagagacacggacgacccagtgactgtccacgtggggcagcccgttaactacagagtaaacaaacaagccggcacacgaaggcgtactgggttccacgacagagtcctgcacaacctcgcacaggaggctggccgggtgcggggcccaggcctgtcatcccagcactttaggaggctaaggcaggaggactacttgaccccaggtgtt

SEQ ID NO: 34551 - DNA, 1037 bp, Homo sapiens
ccatcagcccttctgaaaagacaaagcaatagactccctcccagaaagaagtgcaccagaagaatacattttccatacaaactcaggggaggcagacatcctccaccctcacccacccagcccatcctaggagccccggggaagaattcctgtgctagaggtgaaccaagattatccacgtggaaaagatgcagccacagcagggaagactttcggggcaatacagtaggtcagggcttcaagcatggagatacctgaagttatctcgcaccctgctctgagtttcaccctgagcctcactctcgtaggtggtgaagcatgaaatgtggggagagctgctttaaaacccagcacaaggctgggtgcactggctcacacctgtaatcccaggactttgggaagctgaggtggacggatcacctaaggtcaggagttcgagaccactctagccaacatggcaaaaacccatctctactaaaaatacaaaaattagctgggtgtggttttgcacgcctatagtcccagctactcgggaggctgaggcaggagaatcgcttgaacccggggggtggaggctgccataagccaagatcgggccactgcactccagcctgggcaacacaacgagactgtgtcagaaaaaatgaaaaaccagcaccagcctgaagggcctgtgtattgcgtggggtacttttctgcccttgggcagaatctgcatccctcccagccagcaggtgctgcggaccatctcctccctctccctccagactcctgttttcccaccgtccccactcctgctgcaccagtccctctgccctcctttccatgtgctaggccgtggatacctcagagcttacaccggctgttcccactgcctggaacttgctcgtcctgcacttggcttctcttggctttagctggagtgtcaccctgagcgtcccttcccctccatcctgtccccagggacagatgctccaagagagcagttgctgagtgggccttcccgcctcttccatagagccagacagttggcgact

SEQ ID NO: 34552 - DNA, 1050 bp, Homo sapiens
aagtattctgactaaatagcatggtttcttttcatatcactaaagtaatttcttcccaaattgactctggactaaatcttatgatacctacttgttctgattatacttagtcacctgcaaataaggtgggggcagtggtaagaggagctgttgaatgaaattaaacatttgttgaatgcctactgaggataaagccctgtgctttgtgccaggaagattccagaataaatgaggcacagacctactctcaggaagcttttgcaaactaatggagaaaacacatctgcaggcaatgacttatggtataagaggaaatggggccaggtacggtgactcacacctgtaatcccagcactttgggaggccaaggtaggtggatcacttgaggtcagcagttcaagaccaacctggccaacatggcgaaaccctgtttctactaaaaatacaaaaaaaaaaaaaaatgagccaggcttgatggtgtgcacctgcaatcccagctacttcggaggctgaggcaaaagaatcacttaaacctgggaggtggagactatagtgagccgagatcccaccactgcacttcagcctaggagagagagtgagactctgtcaaaaaaaaaaaaaaaaaaaggaaataagattgatgttgaatgggaaatctaagcaggatggaatgacaggagagcgcccacttgcccagctccaataacacttttgacagccatgacgatattgcagggacgcccattcctcatggtgtctgaagccccatgaaggcttgtgtctggaggctgcttcagtcttgactttaagatcaggggatacaaggaatgattttcatctatcccaagccaatagtccagccaaaaatctagctctgagatgatgagaaaaagcaagtcatgaaccatgtcagccatttcatcatcatcatcatcatcatcatcatcatcatcaaaaataaaaagcagacctgtaaccgtcttgtgtgcctggctcttgtcttaattcaaaatatagaagtaaattctatggccagtgaacaatgaccaa

SEQ ID NO: 34553 - DNA, 1076 bp, Homo sapiens
aataacaaaattagcgggacatggtggcaggagcctgtaatcccagctactcaggaagctgaggcaagagaatcgtttgaacctggaggcagatgttgcagtgagccgagatcacaccattgcagtccagcctgagtgacagagcaagactatgtctcaaaaaaaaaaaaagaaaaaagagaagccagagttgatgccctgggaccagtcctcagccagtgacagatgggagccaggctataaatacttcaatatcttcgccccctggatggaacaactttgaaatgtattccacatcacctcccagaggtccccagtagggtcaaattctagttgcctggagtggtaagctgcttactgaagcccacagtgtggcctcctgccttttcatgaatcagttcctcactcccctattggtgttccctggaatcatctcctaaataatccacttgcaatcctgtccctctttcaggatctgcttgcggttggggttggggagtgcagaccaaaacatgatcccttttccactccacactagtaacatgagtttctgtcactggcaaccacaagtctgactattacctccttctgacataattttctaaaatgtatttgggaatttccccacctccaccccactgcatatgtcatcaatatgtagatttcttaacaaagtttaatggtattctttgatcaacctcaagtttcacaaagcacactgcactttaataagggttccccatgactgacagatcagccattcaaaagaagggaagtgtcagagatggctctgctagactcatgtatttttcagtagaacctgggtcaggatggtgtggttgggagatgcttctggagctctgggacccacaagcctgagtgtcccacggtggagtattagcacaacttgaaaacatagtggcaggaggaggcttcctctctcccccgcagttcatcctccaccgtacccaacgtgctcaatagatactggttaaatgaataatggggccgggagtggtggctcacacctgtactcccagcaatttgggaggctgaggcaggtggatcacctgagg

SEQ ID NO: 34554 - DNA, 1028 bp, Homo sapiens
gtccccaggcctaagtcaggccccttaaaactgcacctaagtcaggtgaagccattagattcattctttttgtctacctcacttatttgtttttgccagttacatcctctgtgccttcctactcctttctcctcacctctttcacaacaggacgtgtatttgcaaacaccacttagaaggtccgtacctccaaggaagtctcctttgcagttgatttatttgtactattcccaaagccagcccacacccacaaaaacaacaccatctgccagtcccaggagcaggaagtgtcgaccttgcagcaagattcagacactccaagagccaaactaattgcagaagctccaaaagtgcagaaaaaaagactccaaaatgttgacttttacctctgtcctagaaatcaccctgacgctagctgtcaagatgcttatcagtttttctgccctgattagacatgtgtaactttagccacctactctaaaagatcaaccagatcttcaactctttccataactcgtgcttctcatcctaaattatgtactagaaaaaactgtaatcctctaactgtccatgaccttaattcaactcaatagtatcatggcatgtcatgaacattaagattttatatcccaggatttaatgttaagtatatgttcaccatccaaaaaaaccctagtctcataaagcccacccaagtcaatcaggcctttaactgatctaagtaaccctatgttccaggaacaccctgacaaagttgatttaactgttcctccacctttcttagtcataaaagatacactccaaaaagtgcaagaaaatctagaaaagcgccaacaagaacaagaaagtaacatcccctagtatcaacgcatgttcaactagaacccatagctaaccactctaattactaagttagctggaccccctccccatcctactaataagtctaattttggggcattgtatattaagttagtttcttaattttgtaaaacaacgaatagcttctgtcaaacttatgtatctga

SEQ ID NO: 34555 - DNA, 1034 bp, Homo sapiens
ccgctgtgttacagaggctggattacacattgctcaggataaaattcaacagaccactcctgttcaatatttaggaatggtggtcgataaaaaatgtatacaacctcaaaaagttcaaattaggagagatcctttaaaaactttaaatgacttccaaaaacttttgggtaacattaattatttaagacctactttaggcattccgacctatgccctgtctaacttgttctctatgctgcggggagattctgatctctgcagccctaggactttgacccctgaggctttactagatctggaatttgtagaggaaaaaatccagactgcccagttatctagagtacagccatttcagcctcttcagcttctggtttttgcttcattacactcccctactgcactaatagttcaacataatgatttagtggagtggtgttttcttcctcattctgtgtcaaaaactttatctagaccaaatagccatattaattggacaggttcggtgcagaatacttcaaatttctggatttgatccaaatgtaattgtagttcctttaaatcagctcgaagttcaagctgcctttcaacattctgtactgtggcaaattcacttggctgattttattggtgttattgacaatcattatccaaaaaaacaaattgtttgattttataaaaataacgtcttgggtggttcctctattaaccaaaaatcaacccattcctgagaccgttacagtattcactgatggctctagtaaggcagtgctggctatataggtcctgcagacaaacttatttctacctcttatacttccgttcaaaaggcggagttaattgctgtgattactgccttacaagatttccccaaacctttaaatattgtctcttattctacttaacctgcggaagaggatatgcttgtgtttcaccaggagatcatcaatcccctgtctgggtacctaccagaagactcaagcttcttgtgaatactgacaaaaccacagtgaagagacgtctgtgtcagagactgc

SEQ ID NO: 34556 - DNA, 1037 bp, Homo sapiens
tgaagccatgacagaagaatgtggattatgaagattttatggacatttattagttccccaaattaatacttttgtaatttcctatgccttcctttactgcaatctctaaacataaattgtaaagatttcatggacacttatcacttccccaatcaatacccttgtgatttcctatgcctgtcattactttaatctcttaatcctgtcagcccagaaggatgtatatcgtctcaggacctgtaataattgcgttaggtacacaaattgtacagcatgtgtgtttgagcaatatgaaatgtgggcaccctgaaaaaagaacaggatcacagcaattgttcagggaataagagagataaccttaaactctgaccgccggtgagccgggcagaacagaaccatatttctcttctttcaaaagcaaatgggagaaatatcgctgaattccttttctcagcatggaacgcccctgagaaagagaatgcgcacctaggggtaggtctctgaactggccccgtggggcgtacctgtctcttatggtcgagattgcagagatgaaataaactccagtctcccatagcgctcccaggcttattaggaaaagaaaattcccacctaataaactttggtcagaccggttgatctcaaaaccctgtctcctgataagatgttatcaatgacaatggtgccaaaacttcattagcaattttaatttcacttcggtcctgtggtctcgccctgtctccacttgccttgagatattctattatcctgttaagtacttgatgtctgtcacccacacctatttgtatactccctccccttttgaaactccctaataaaaacttgctggtttttgtggcttgtgggacatcacggatcctaccaatgtgtgatgtctctcccggacgcccagctttaaaatttctctcttttgtactctgtccttttatttctcaagcaagtcgacgcttaggaaaatagaaaagaacctacgtgattatcggggcaggtctcccgatatctggcgcccacgtggt

SEQ ID NO: 34557 - DNA, 1050 bp, Homo sapiens
gcaggtcgaggctggaagatcacctaaggtcaggagttcgagaccagcctggccaacatggcgaaactgtctctactaaaaatacagaaattagccaggtgtgatggcacacacctctaatcccagctacttgggaggctgcggcaggagaatcgtttcaaactgggagagagaggttgcagtcagctgagatcgcaccactgcacttcagccagcctgggtgacagagcgagactctgtttcaaaaataaataaataaatacaatagaattctgaattttatttttaattatttttgtaaagagaatgtcatgttttttggagttgttgaatttattgaattgacaaaaattatgtacaagagggtatataacatgatgtgattgaagtatgtatacattacgaaatggctaaatcaagctaaataacatatcacctcccagacttatttttttgtggtgagaacacttaaaaaatctactctagtgatttccaagtgtatgatatgttgttattaactgtaggtaccatgttgtcccatggatctcctgaacttattcttctaaatgacattctgtgtcctttggcatctgcccacttccccaccctggcaaccatcattctactctgcttctgtgaattcaacttttttcttttctttttctttttcttttttttttttttttttttttttttttttgagacaatctcattctattgcccaggctgtagtgcaggggtgtgatcttggctcactgcagccttgacctcccaagctcaatcaatccttctacctcggcctcctgagtatctgggagtacaggcatgcaccaccacgctccactaatttttgtatttttatgtagagatggggtcttgctatgttatgcaggctggtctcgaactcctgggctcaagcaatctgccggcctcagcctcccaaagtgctgggattacaggcatgagccaccatgcctggccgagttcaacttttttagattccacatataagtgagatcatgtggtatttgtcgttctgtgcctggccta

SEQ ID NO: 34558 - DNA, 1084 bp, Homo sapiens
ttataagtggagcattgtcataggcatgaatgaatatttagggaaagacagtatatataggggttcagtaccattgtgatttcaggcatccactgggggtctgggaactgtcccctgcagatcaagggggacaactggaatggttatttttgttgttgttgttacattttttgttttgagatccttgtagactcacatgcagttgtaagaaataatggagactcaggcgtccttatgtatccgcgtaccctttaccttgttgccacccaggataacactttacacaactgtagtacagcatctcagccgggatgttgacatggatacgcttccatttccatcgccattgcgcaaggctgcctcctgctgccctcttgtagccacagccacttccctctcacccccaccccctccttagcctctggcaatcactaatctgttcttcatttctggaatctccgaatgttctatgaatggaatcatacagtatgtaaccttttgagactgactcttcgctcagcgtttttctctggagattcacccaggttgctgaactgaccaatattcatcttattggtgaggagtatcccgtgctgtgcgtgcatcacagtcctttcatcattcacctgtggagggacacctgggtggtttctagtctctggttattaatgaataaagctgcagtaaacattgatgtgcaggtttctgtgtgaactaagtcagtttttctgaagcgaatgttcaatgctgtgtcatacagtagttgcatattctttcttttctaagaaaccaccagctcaataactaatgctggcgaggatgtggagaaaaaggaacgctggtgcactgttggtgggaatgtaaattagtacaaccactatggagaaccgcttggaggttcctcagaaacctaagaatagagctcccgtccaatccagcagccccactgtttgggtatatattcagaagaaaggaaatccctgtgttgaagagatacctgcactcccgtgtttgttgcagcactatttacaataaccaagattggagcaacctatgtgtccagcagcagatgaatgggtaaaga

SEQ ID NO: 34559 - DNA, 1050 bp, Homo sapiens
tgtcctgggccctgccagcctccttaagtaatagtgaccttgtagttgtctgggaaataggccttttgttttttaaacacagaggcggctctccattaaaactcctggccgttggcaaacctctctcctcagcccttagcacctttgatccttgaggcacctgcttctcttcctctagggactaggtatttttcaggtggggtggaaggaaattagagccagcatctgatcccactcctgagtgcagtggagggcggacatggagctatcagaagttaacaattacgaagaggcctaagaggaggtgccgcacctaagtgccttataccacaggccctcaaattggggaggaaacaagaaaagctttgttcccaaggaacagtccaggaatgaatcaccccaaaccactagttaattttgtttaggaacagtttcaaagcataaaagggactgtggatttaaaaggtcagggccagggccatattttgtcattagaaaaattcaagaaaatgccgccacccagggaaagctgagtagtacctgaattagccaaagtgaattggcgcctgcatgttttagtaattacatgttttccttaaatactgtcctcttaagtaactgttgaagttaacagagcggatactttcaaactcaaaagtgaaagttttactctcttaaatagcctttgtcttgcctaattaaaggggccataagcaattctgtgtcagcagccagcacggccccctgctgtggatgagttggtcctgcagggagctttcctggcacttccgcccttcccagagctttgccccttccccgttttctggcccggtgggtctggagtgcagcagatgcctccttgtgttttgagtagccggggccgagaactggtgttctgtcatgtgtgaggccctgggctgggctcagtgtccaaaggaggacagctgccttccacagagagaagacaagccccctgaacaagtgtgagaaatgtccttgaagagccaagtacaggggaacttggtaacaagagtgagaaagtaagagaag

SEQ ID NO: 34560 - DNA, 1030 bp, Homo sapiens
tcattttcttcctgtgaagtatctgttcaagtcttttactcatttctgtattagaggattgtttggctgttgatttgtataggagttctttgtatattctgcatacatatccttatatacatgctgcaaatattttttcctattctgtggtttatttattttcttaatggtgtctcttggtgagcagaaatgcttaattttgaggaagttgaattttattaatttttactttgtctaccccaaggtcactaagatattattttatgttttcttctagaagctttatgattctgggtggtatgtttaggtctatcatctgtctcagaccaactttttgataggatgaaatggggttgaggtttattttattctatataataactggggttgaggtttattttattgtatataaatatctatttattatatcaatgtttgtttaaaacactttctttttctcattgaattgacctggcatcgtcatcaaaagtcagttgacccaaacatgtatatgtctgtttctggactctattcagtatcattggtctgattgtccttatgctactgccacactgtcttgattactgtggttttatcataagtcttggaatcagctagttgtaaatccttcaaatttctaaattttcagtattgtttttgctattttagattttttgtatatttccatatcaattttagaatcagcttttcggtttcttcagaaaatctgctagaatgtttatagggattatgttgaatttatagatcaatttggggagaatggacatcttaacatctatccacaaacatagtatatctttgcatttatttctgtcttccactttatttttaaatttctttttctcagcaatattttgttattttcagtgtagacatcttgctcatcttttgttagatttattcctggattttttttttattctattgtaaacgataccattttgttaatgttattttccagtttctcgttgctagtatatagaaatacaattaatttttgtatattgac

SEQ ID NO: 34561 - DNA, 1043 bp, Homo sapiens
ggcattagtgccactgcgcagccgcagcccctggagcacagacagcagggacaggcccctttgcaacataggagagagaggaacagagcggaacctctgctgtctctaagtaggtaaaagagaggagagaaaggtgtggtgactatatgcacaccccatgctttctgcgagggggccagagggaggaggctctgggaggaggcaaggtgtcatttggggaagttggttcccacagaaacatgaggattagggaataagcattccccccggtagcccaggttctgtccaggtggagaaagaccacccttattgtctctcatcaagttctccctcccaaaggtggtagactgcttaaagcctttcttttttactcttctgccctcccagtgcaatgtgctagccttggcctgctcctaggaacattttatgtggagtatgatcatggaattgaaagaatatgtgtagaaatactgccttcagacctatgaggctttgttagtttgacataattaggaagctgtaattttttccagaatgtagagctcagactttattgacccatttaatttttttttaataatgacattttactagagcagaacagcatgtaacctagatagcctgtggctagatctctgaatgattttaattaaaaataatgtctccacttctggtagatggactttttccacaatatcctggcaacaaaacaatctgggagaaaaaacttccttggtttctgttgttcttactaatagaataaccatactgtcaattttcaatttagaaggttaatgtatatatataatgtttcctaaaggaacattaccttttaattaaataatcagttttatcaaattaacctttagaccttttcaatttcactgagctgagtttccattaaatcaaaatatagagtaggaggatgttaatcgaatgttcttggaactagtcatttctaggtctgttctgtctgcagggtacatattcactgagttggtacctttctgactcatttgtccctgaccccgttagcctctatt

SEQ ID NO: 34562 - DNA, 1044 bp, Homo sapiens
catagttcctcacccatatttggcactcagtaaatacttgttgaatgaatgatttcctcctagtcctaaagtccatgactagcccagcagcactcaactgtggtgattttgcaccccaggggacatttggcaatgtctggagacatttttgtttttcccaactaggaagaggagtattgcgcatttagtgggtagaggccaagaatgtgcacaactcaggacaactctccacaacagggacttacccggcccaaaactgaggaggtgctgacattgagatcccctgctgcagcctgacccctcacttcagattaaacttcctggttcgtcacaggtttattgaattctagatgcttagggcacatctgggggtaaaatacaaatattcctgccctcatggcgtttgcattctcgtgggctggcaaagacaagcactacgtgtatagtacattaggtcataggtcctatggaaagaaaaggaagagtagaaccaaggtaacagggatcgggagtgctgggaaagcttgtgattcttacacagagtagtcaggaaggccccatcgaggtggcatcagagcctactcctcggtaaagtttggaacctctaatagggtctctcagtttcctcctcacctcatcaccttctttccacctgtcatagagaaacccctctctttgtttttaaggatactgtcctacttgtgtataaactaaagggaagaaaaaagccagacgaccaaaaatagctgggaatcatgaatgcagcagtacctgagaagtggtgcgagtgcatcctttatgtcatcactcacaccgcctctcaggtaccgctgtgctcatgattcctggccagttttcatcatctggctcttttcttccctttagtttatacattcagcggtacaagcatatcctttatctcatccctcacaccgcttctcaggtactgctgtattcatgattcccagctatttttggtcatccggttcttttcttccttttagtttatacatttgaccttgcttgctccttaagccaacaggc

SEQ ID NO: 34563 - DNA, 1100 bp, Homo sapiens
cctcacgcataggagtgagtcagaagacaggattgggaagcagggagggctttgcgtctggagacagcagcagagcgtagggcactggcgggccttgggcatgaggatgtgggcttatcctgggttaaaggggaaggtaatgtacagttttagtcaaggaagtatgtgggaagattcaccctttttgattgtttaataacatgttttatctgattataaggattttacgtagtaactgtagaaaaattttaaagtgcaaaaagtatgaagaagaaagcagtctccaaatcttaccacctacaatcattgataccttgccgagcagtcttttagattcccctctatgtatgtatacagctctaggtgtgcatttcctatgtttcacgcatatgggtcacaccatacatgctttgggcaacctctgttttgtctcagtttttccccactaggtaatatgcttatgggactttcatccatgttagtagttcctggtgttgagtccatgtcaactgtgtagatccactgataggaccagctctcacaggagacctgtttgcctattgggatgctgtgttgttttgtttggtgtttcctagtaaaacctttatgtgtataagagcagataatgtaagagagtctttttttccccctgtcaaatgcatctcatgtagggaccatactgctgttttataatgaatttggttttatggtagatgggttttatggagaatttcaatgtcttgatgatctaggaaattagcgtcattaaaatatagctagttaaaaagtaaacttgatttatctttggagaaagaatgggatgagtcagatgaatgcctgtagttttagaatggagtttaaataacttgtttggttaagtattagcctaatgaaggagccagagcctggctgatcctggattgtggctgttagttctgtgctggcccatagctatagacagtgcctttcacctgaacaagttagatctcactatgtcccttctacaggtctggtaaatgcgacctgcagtgacttaattgtactcagatgggacagcagagtcatctttgtgggtagacttgcagaagctaaaagcacac

SEQ ID NO: 34564 - DNA, 1031 bp, Homo sapiens
atattgagtaaactgtcaagatttttctctttgtcatctttttgtcagctttatcatgcttaattttcaagaaaataatgtgtttgttactgtggtcacaccgtgattttgcattggcttatgtatgatattttattgtctctgtcctagaaaattatagcagtttttatgaggagtggtttgtgggttcacacaacccacttggagtgccatttactacaattctcttctaaaagaaccataaaacatcatgtaaattgtttaaaaagggaaagacctttttcgagaaaggctaagaagaaatctttccaggctttcttttgtttcttatagtcagttttatgattttaagctcccaatttatttagagcgttaatgtcataaaataaagtgcacgtgtgtataagtaaaccgttgtgagctagagctaggctagaactgggtgttgttgatgcagataatatcaaattcattattttataatcttttaagatatgttttctgtgactttggaaatgaaattaaagaaattaaggaagaaaggaaaagagagaggaaggaattaatttatagcttgtatatcttttttttaaaaacccttatgttttcttaagtagtgatgtgtttataatctacattaaggcacaatttttggtaaccagtcctgtgaaactcacatttaaattcacaaatagatttacttagagaaactttcctcccttaggagttttaccatttagattggcttgttgcactcagtttgtatacaccctttcgaagaaagaattaaacagcacaataacaaggccaaagttctgtcatagttttctatacaaatgccttattctgatattatcttggctttgtgcatgagctctcaggagagtaaggacgaacattgttaataattttctacaacatttacatggttctctgtgcttttagtcacttaatacaggtatatcttacgtttaacaaaccgttataagaaaatccacatatatctgaaatataaattggggcagttgttc

SEQ ID NO: 34565 - DNA, 1047 bp, Homo sapiens
aaaaggcagtgccctgtctgggaatagggagtaaggaatgttgggcaagcaaaagcaacaaaaacatccctcacagtgcctgggacagtgcctgatgtgccttcaccttgcctgcctggctgtcttcaactctgtggggaatgagaaactagaaaatgcaggagtttataatgacaggttctggggtgaggataggcctagagatgcctcatagtggcagctcttctattctcttactgacttataaaggttacaggagccagggggggctaccacacaggtaagcaagaaacccgtaagcaccgaactgctgtgcagaggcagcaggggctactgaagagcaccgcacaggaaagcaggaacccatgttctagccgcaggtctgccagtaagtgggctgctcatgtgatttctctgggcctcagtttccacattagtaaaactgaaagcttcgattagataactgcagagatttcttgtagaataaggacactttgattctaaataaggtaataatgatcctgaattgctgggaactctattttcagattaggcatgcagatgagattttgttcttgataatacattcttttgtggaagctaaacttcgttttttatttacttatttttaggaattgattatcttgaatctttggctgaaattcagagttcttggagtggcccaaagccagatgatctggccctgctccctctctggcctcacctcctctccccctccttttgctcactctactccagctattctggcctctttcattttctcacatgcatcaggcacatttcccgcttagaacctttgcatccctctacctggaacacttttctcctagattccatatggcttgatctctcagttcctcaggtctctggttaaatgttgcctccgtgaggccttccttgaatgccctgcgtaaagtggcctcctttttctgtcccttcccctagcagatcatatatccatttatttgttgtttgtctactcgaatatatgttttctgaaaatgaagaactttgtgttgttagcac

SEQ ID NO: 34566 - DNA, 1068 bp, Homo sapiens
ggccagtgttctgcagctagtaaaaaaaattcaccaagacagttgtcggtaaagaaagtcagatgtattagaaaaagtatgaaagggtacagtgggtaggtcagcaagaaaggagccgactgcaaggaaacaaaggcttgctggagattttataggatggtgcttgtgctgtgtgccgaagagggctttgtgcagtactgataatgctgtggttgcagtgagctaacttacttacgtttttctgttagctgaggatctggtgataagttgagtacaggaaggctgtgttgtagaccatgaagaaaggcagacttacagcttatttgctttctctttttgattttcctcagttccgccggctcaacttcccctccctgataaggactctatccttcccacctttcagcattatccacccttcatgatttactcatttaataaatatttgttgagctccaggcactgggtttgctgctagaattttacatctttatgcaagagaataggtaaaagtagaatggatggttggttttgaaagattaaaattaagaacctctgcacaccacccccccccccttcagatccacctatcgccaatgagggaagtaaatccagcttgcggagttcacatgcacatgcacacacatatgcacatgcatatacaaatgtgtacacacacaatatgtaaaatacctttggagtgtgggacagtgtgcctaagatcatgggctttgaaaaccaaccagtttgggcttcaatcctggcttccccacccaacacctgtgtcccgcaagacacgtggcctgaacctcaaattgctcacccgtaagttgggagtacaaacacccccttcatagtatgattgtgtgccctaaatgcagtaacatgttaaagcaccaaatgtgcgcctgcacacagtaggcactcagtaagtgtttgatcacctgtctcaggaatgtcggattttactggggattttgacaagaacaccacaaggtggtcagggctgaaggtggggggagcccagggactgaggggcacagaagagggagcagtggactctgtgga

SEQ ID NO: 34567 - DNA, 1026 bp, Homo sapiens
aggccaaggtgggcagatcacttaaggtcaagagtttgagaccagcctggccaacatggtgaaaccctgtctctactaaaaatacaaaaattagccaggcatggtggcgggcacctgtaatcccagctattcgggaggctgaggcaggagaaattgcttgaacctgggaggcagaggttgcagtgagctgagatcatgccactgcacttcagcctgggcgacagaatgagactctctcaaacaaaaaagaagaaagaaagagaaagatagaaagacaggaagggagggagggagggaggaaggaaggaaggaaggaaggaaggaaagcaggcaggctgcggaacagggcacaggtgtcagaggaattcagagaagagatgactcagccctggcagaagcaacaagagatggcttcttggggtttggaggatgacatcagccaggtgttgagggacttgattggttgagggaagggaagggcatgcaaggtgggtggaatatttcacacaggtgaatcagaggacgcagaagtggaaatacatgtgaatgggtggggctatggggggattctataaagctttggaaatcagggagaatgcacccaaggggatggaaataacacgtgggttctaagtgtgtcttagatatgaatgggttatttgatgttgagcaagtcactttctctccctgggcctcggattccttttctggacagggagagttggattagataattcagttccaagttctaggccactctgatcttcttctttggttaataggaaggcactggaagttcttgaggtaagatgctgttattatgaaagcagcttgtaggaatgtggattctgaactcagactatctggctttgaatcctggctgttttacttactagctatgtaattggacaagtcacttattctttctatgcatcaattttatctgtacagatttatgtttggaaatcagaatgatatttcctaagattttttccccatagaattaaatgacttaatatgtgtaag

SEQ ID NO: 34568 - DNA, 1057 bp, Homo sapiens
ccctaatagctgggattacaggcatgcaccacctcacctggctaatttttgtatttttaggagagacagagtttcaccatgttggccaggttggtctcagactcctgaccccaggtgattcgcctgcctcggcctcccaaagtgctgggattacaggtgtcctcttcttttaaggatgccagtcagtgggtttagggtccaccctaacgtggtataacctcatcttaatttgcatcttcatttcatctgcaaaggccctatttcgaagtaaggtgacattctgattttcggggtagatgtgacattttgggggacattattcatcccactacaggtaccaagaatgagaattgatgttgaggtagtggcctctgcttcagtctttgattcccccaaactttgcaataaagtggagctcaccaaatcagtcatgggtcagtgggcttgttttcactaagatacatttcctggtggacttgactgcttagaaacaaccggactctgttcctttggggcagaggggacagggagggcttggagagtacaatctgcacttgagtcatggttctgctgctaactagagtgttagcacattcccctttctgggcctcaagtttgtgtgtaacttggggtaaatgatgtccactttgaggatcttttaaagactcagagagtgtctcttaagtacaaatgagtacctagctcacgctagcattaagagaggagtgatagccaacatcaagtttgtcgttcttccctgaactctgttgattgtgattcttttggtcgcaagtgacagaaattccatcaaaccagcttaggccatgggtgtctgttggctcccccaactgaagtcatgggatttgctgtaggtgcagctccaggtgcactaacgatgtcatccaggatcccaggttcttgggctctgctctgcctcctgctgtgtcattcccaggctgtgggctctcatgctgtgctggggggatgccaccactgtgccaggtcccacattctcacaccacacagcccagagtccctttcttagctcctaaagaaa

SEQ ID NO: 34569 - DNA, 1034 bp, Homo sapiens
aaataaaatcaataaagaaaatcaacaaattcaagagttaattaaaactgataaattgacaaacatttagcaatattgataaagcaaaacagagacaataaattactaatatcaaaaatgtaaagggggaaataccacagctcctacagtcaataaaaccacagcaaacagcatataccaataaacttgaaacctcgataaaatgaacatattccttgaataagcacaatgtaccaaaactgacatgaaacaaatagaaaatctaagtagtcctaaagctcctaaataaattaaatctgtaatgaataattttcctatgaagaaaggcccaggcctagatggcttcacaagtaaattctttcaagtgtttaagaaagaagtaaaactaattctagccaaagtcttccagaaaatagagaattaggaacacattttaactaacttatgaagccagtgtaactctgattccaaaagcaataacattacaggataagaaaacttttggattaccttttatgaacatagatacaagagtacgagcaagatattaacatatcaaatccagcaatacataggaaggctaataagtcataacccagctgggtttattctgaaaatataaagattggcttcatattctaaaatcactgaatataattcaacataataatatgataaaaaagaaaaacgtggtcagtcatcttaatagatgcagaaaaatctgttggtaaaattcaacttcatgatataaactctccgaaaaccaggaaaagaatggaatttctctaatatgataaatggttctatcaaaaatcttttacaagtaacatacataatgatgaaatattgaacatttcccacccaagttcaaggtcaaaacaagatgttgactattaccacttctagtcaacattgcattggccaggatgtcaaatataaaataaaataaaataaataaaagtttcattgggaggccgaggcaggcagatcacgagtttaggagattgagaccatcctggctaacacagtgaaac

SEQ ID NO: 34570 - DNA, 1059 bp, Homo sapiens
tatcctttccagggcttgcaagcatcctcaggacccactgcacatcctaaaactcccaactggcctgggaggacctgggtacaggctgcctgctctcctgtctcccaccgtggcttagactggctgaagggccactttaaggaatgaaaggggttctgtgtgcaccagccagggactgccagtgggtgctcattgtggcagaaatacccttatgcctgccaggtcagagggaggcgctggctcggtgtgctggcctctgagcttctcccttggctgcattttgagtcaggagcctggactgacccgggtccctccacagcactggagggggtgggacacatcactacagggtttccttccatgaggactctgaggagttgacagtggaggcaaggagtgagctggtaagtagctttccactatcttttacccttggagcttctgtctcctgtcttctctcaccctatcctgttgcatctggtggctggtcacccctctctgcttgttctgacatgggactgtattgaatgagatcacaacctgtgtcttccattgaagcaattctttttccccttctttttcttaaaaaaattgaggtgaaattcatttactgtaaaccgttttcaatggtacaattcggtggcatttactgcattcacgatgttgtgcaactgtcacctcaatctagctgcaaaacattttcctccctccggaacaaaccctgtgcccatgggcagtcattcctcacttcccctctcccagccccggcatccatccatctgccctctgtctccttggatttgcctgttctggatatttcacagatgtagaaccagatcgtatgtggctggcttcttccacttagcctgatattttcagggttcacccatgttatagcaagtgtcatcaagtgtcattgcttccttcttcttcatggcggagtagtattccatggtgcgtatacaacacaatggtctattcatctgtggatggacattggggtcgttctcacctttgcggctggtgttggaagcagtgctcagggtgttaacattttct

SEQ ID NO: 34571 - DNA, 1315 bp, Homo sapiens
agtgtacatttaaaagtggtgaatttcatgttatgtatattgtacctcaactttagaaatgctaaaatagaaacaacaaaatcatcatgatgcaacgcctttcctcatagacctggagcgaggcctgagagagaagccatataaggcagatgaggggtgggatggagagcttcctttcattcgctgcctgcccagtgagggtctgcttcctctggcacttacttaacaaacccgagagtcacccatgtgtgaggcatgggctgggcacagaagggtccacgcccacccctgaaagtgctcgtccatgctagaaagacagaaggatggggtggtcattgaacctaagtcagaccgtggcttcccagctcatgcagaataaaatgctcaggcctctcccggcctgctgggtgcaggaccccggcccagcccacctctctgagctctgagctcatgtcctgccccatccctctcacacgcacactggcctccttgctggcctgcaacagatcaaactcaccctacctcagggcctttgctcgtgctggtcacctgatatctgtgaggctccctctctcacatccttcaggtctctgctcaaatgcgtctcccccaggaagtcttccctggcctccccagctaaaacagcccctcccacccctcccatgccatttaccatactatagttttcatcttagcccttatatctccctccaagagctatttattgacatgaaaatttgcttattggctgtctctcccattcgagagtgggctttctctggggagtgtgcactgctgaatttccagtgtatgcaacagtgctgaggagagggtaggtgctcagttaatgctttttaattaaattttctattgtggtagaatatacatgacatagaatttaccatctgaaccatttttaaatgtacaatcaatgtcattaagtatattcacgttgctgtgcacctgtcaccaccatccatttctgggactttctcatcatcccagacagagactctgtacctgttaaacaagaactcgccattcattaatattcttttgaatgactaattgaatgactaagtgtatttcctgtgtgtcggtcacaagctaggtgatgagccagtaaacctggcgcctcggagggtgtgtgttcccgtatctgtctcggagatggacagatcgactcagagaggtgtgaagggctttgcccaaggtcacacagctggtcagggtgggattcaaacgcaggtctttccccctttccacacagtggcagttctgggggatcactgcatgcaaagggcatagccatggc

SEQ ID NO: 34572 - DNA, 1062 bp, Homo sapiens
cctctgagatgatcaatcctcccatttcagccagatgagaattgctgtgggccctgccttttcttaatattttgcatgagagcgacagcccggccagcggcagtaatctcccacccacgtggggaggcacccactgtcctgccatgtgcataattgaagtcttcagactgctcagtggttctaattagcccaaagtggccccttctggcctcagtggaaattactgccctcctgccgcctggtcttactagctgatctttgaaggtgtgagtgagccgggagacgtgcagagcctagcactccctctgctgcattggtctttcttggcaggccttcatggctttgcagagggcgggcagttgaggcctctgtctgccgttgaggtcctgcctccctcctctctgccaccactctccatgggacaggtgctccagctgggcgcatgcatgcccctctcacctgaatgcctcccactagcagtgtctctgctctttctgacccttcaggttatgcagtgcctcctcctccaggaagtcatccctgatccccaggctgggccctcagaatccccatgtctccctccatcgcagccctggccatgccatgtggtgcttgtttacatccatgactgccccatgagactgggagcccctagggggcagaagccgctccatgtcccacctactcctggcctagcgcggtcccataggacatgtctacggaaatggagggcgtgagggtgggaggaaggaaggaaggcaagaaggaaagaaggaaggagaaggaaaaaggagaagagagaaaagagggagggtgggcaggtagcaccatgcccattttgcaggtgagaacactgaggagacataaccgggaagtggcagggccaagcacacccttggcagctcattatactttcccttcagcctagcaaagctactgttcgatttggggaaatggggccgcttgtatgaagagccgcaggcaaagtggaaagtgccgagggctggaagtcagatgggtgtgggtgcgcagccttcctgtgtacctgtgggcaccacttac

SEQ ID NO: 34573 - DNA, 1032 bp, Homo sapiens
agccctcctcaggcacatcgaggagaaccagctgcccaagctcttggctgctgcccttctgaggcctgcctggtaggtggcgtaggaggaggcttggtaagcagatgatgggacatcatctaccacatcccatcagtaacatccaacaagtgtgtgtgccagcacagacctgggcactggcatgtcccagccgtcattccatgtcaaatacttatctgtgccgtcatcgtcgaggtctggtttccaactctatggctccattgtctcatgtttaaccagtcctcttactgggcatcagcttttccatttttgctctgtgagaggttgttgagttagttggaggaccaagcccataatttcctggatgacagttcgtgtcccgcagatagagcttaaccaacagtggttccctttccagacctaagcaggtgggagtcagagatgagcatagagaaagggtgaaggggtgcctctggattcccaaggcagggacatagctgggggagctgcctccggactcgcaaggcgggggtgtggcagacactttgcagaaaaagtacatctgtccttggggcgagaggccgcacatgcagccccaagtccctggacctgtgagatcctggctgcctgctgttgatagaacgggacaggtggggggatgcttttgattcatgtacggtgaatgatcttattctcacctttatcactggtggcacattctgatggaaggagacattggcagtgggactgggcaagaaacaggtcatttgtcatggctgtgtgccagcctcctgtcgttgcacagcctgtccttgggaagtcttgctcacctgtcatgtggagtagttgtatgtgtgtgagtgtgtgtgtgactgagagagacatacacatatgcacacacacgcagaagtgtctgtacctctgagaatatagttctccagaggatgcagaaaaattggggattgcagactgtcgtgcgtttaaatgtgtccttctctcaagaataatgtccacttggaacctcagaatgtg

SEQ ID NO: 34574 - DNA, 1034 bp, Homo sapiens
ctgtgaaccaagttagtcaaagacaactgggcatttggacctcagctttatagtctatataagggttggtaaactatggcccacatgctaatctgacccacctcctgtttttgtgaataaagtttaaatgaagatgcagtcacacctatgtgtttaggtattgcctgtggctactttcacactacaacagcagggttgagtagttgtgacggtagttgagacagtgtggccctgtatttattctctggacctttatggaaaaaggttgctgacccttggttcatgtcaatgactcatatggagcagcaggaaacattctgaatttggagctgaatgaccagggtttgacgcctggctcagggaactctagtaacagagtagagagtgtttctcttttctccttttggaaatgatcctgaagcaacaaatggaacaaatggaaatgcaaatgccatctttgatggaaccatagcttctggaacctcatatgtggggaagtgcagtaaaggtcaaaaatgggtgcaggatgtctccaaagggaaataaaatgcccatggctgtaaagctcagacagagcaaacaaagcagaattttctacaccttctgtggtgggctcagatggcaagacctatagttcctctcatggagcaataagaacaagtgcattggctggtgtcttagtctgttcatgctgctatagcagaataccatagattgggtggcttgtaagcagcatacttttatctctcacagttctggaggctgggaagtctgatacccaggtgtaacagatttggtgtctgctgaggacctgttttcttgttcatagatggtgccttcttgctgtgtgcttgcgtggcagaaggggctagggagctctctgagatctcttttataagggtactaatcccattcatgagcactccaccctctaagacctaatcagttctgaaagacgttacttcctaagaccatcacattgggggctaagatttctatatatgaatttcggggggacacacattcagaccata

SEQ ID NO: 34575 - DNA, 1050 bp, Homo sapiens
gctgcctccttgccttcctgctatgatctgaatgtttaagtaccccctccaaattcacaggttgaaatccagacccccaatgtgagggtatttaaaaggtggggactttgggagtgatgaggttgtgagggtggagccctcatgggtgggattagtgcccttataaaagaccttagagagctcccttgcccttctgtcatgtgaggacgcagcgagaaggcactgtttgagagtcaggaagttggacctcagtggacaccaaatctgctgtgccttgatcttggacttccagcctccagaattgtgaggaataaatgcttgttgtttataagccacccggtctatgatattttgttatagcagcctgaacagactaagccactcccagtgatgagcctgcatgatgttttacacaaacagatcactgaaagaaggaattggccagcaaagatgatgctcagcagagatgtgaaagatgttaatgctggaagtgaaatttaaattggaggtaaatggagtcatagaagaaatccatgatcttgggaagctgaagctacccttcaagaagctcttatatgcagccagaggagttgagtgaaggtgaacacactgatgtaaaccaggaaaggagttgtgccccaaagcatggagatgtcccagaggaagcgaggctgggaaaaacgttaaaggaactcttgaagatatttcacagtgttgaaagtgcaaaggataaaatcttggaagctggtctggagaaagataattctgcaaagcatagaaagggtgcttttttggtatcgtaaggtatacaataacagtagcgagcactgtgcaaactctctccatatgtcttttacaaagaaataaagcacttgacatctcaatgtttctgatgctttaaattacattgtaccaaataaatattagttgtactattttaaaaaaactttcccggttgggcattgtggctcacacctgtaatccaagcactttgggaggctgaggtgggaggatcgcttgagcccaggagttcgagaccagcctgggcaa

SEQ ID NO: 34576 - DNA, 1032 bp, Homo sapiens
ccatcctcaccccaggggaccctgcctatccagtgggttgcagtgccagctactgggccaggcagggtcatgcagaactgcagaggtgagggtgttaattattaacttttaatcatggtgaagtacatataacatacaatttaccaccttaataatttgtgagtgtatagttaagtagtgttactacattcacactgttatacaaccaccaccaccatccctttccagaatgttctcctcttcccaagttgaagctcttggcctcattaaacactaactccctatgcccctcccccagcccctagcacccccattctactccctgactgcatgaatttgatgcctgtagatatcagcggaatcacacagcatcagtccttctgtgactggcgtatttcactctgcgtaatgtccttaaggttcctgcatgttacagcacgtgcaggggtgaggatttttgtgtgaacttggatagagcactgattttgatgatgctatggaggtcttggacatcaccaacaataaaaggttaaaggtgaacttcaaacctaagtgtgcggtggttcaaaagacgtccaaggccagcaatgtggctcacgcctgtcatcctggcactttgggaggctgaggtgggaggatcgcttgagcccaggagtttgagaccagcctgggcaatatagtgagaccccatctctacacatgcacacaaaatttaaaaaattagccaggcgtggtggtggcacatgcctgtagtcccaggtacttgggaggtggaggtgggaggatcacttgagctcaggaggttgaggctgcagtgagccatgatcctgccactgcacttcagcctgggtgacagagtgagactctgtctcaaaaaaaaaaaaaccacaagaaaagatgtccataaattattgctgcgtcttcaacaggtgaggcttagggcctagagggtggccagactcagtgactcacttctaacaaacacagtgaagcagaagtacctgtgtacccttgaggagagaaggtgaaggg

SEQ ID NO: 34577 - DNA, 1063 bp, Homo sapiens
ctatgggccaccaccctggccaatttttaaaaatttttttgtagagacagggtctcacaggctagtcttaaactcctgggcttaagagatcctcccgtcttgccctcccgaagtgctgggattacaagtgtgagccaccatgtccggccagaaccctgttttctactcaagatctgggatgccagttccacccctgttttgtcatctactggtctctctgctcagaaggcacctcagcccctactcctttcaggtctagatgttcagctggagctaccatcttcttacaataccccaggccatgctgattggtccaggcatgggccacctgaccccagtaggaccaatcagaatctttccctaggacttttgcacttggaactggaaagtccaagtcttaggtccttttgagtggggaagacagagctgctctttgagagcagccccagagctgttcagagtcacatcccaggtgggaggtgaaggaaagtctgcagacagagagaagtgcaggtgagagacgaacaaggacagcctcacgagggctccaggccctgaggcccaattacaccctgcccttcccttggttatgtgggcctcaccatacactctccctgggggctcagctagttcaagttgggtttccgttacttgcaaccaacagagaccagagtgaggccaggtgggatggagctgacaacagccatggggctttctcagacatggcctcatctccctttgcaggaaaagccccagctacacagaaggaaccactgactggtctgggagcagaacctgaccctgctaggccaatcagatttcctcttctgggaatctgaagcaagggaaccagaggtggctcaatggccgtcctgggagacatggctgtgagcctctgctcctgatatgcctagagctgccctgccccatgcctgtctggaccttgtatccagctcctccttagattccatgagcttctccaggctctgcccaaatagctgccccttcaggctctgttacttccaaagaaccttaattgacaccccctggacctgatccctga

SEQ ID NO: 34578 - DNA, 1041 bp, Homo sapiens
gtgcaggtaccatagtggctttgccagagttctcaaggaagaaccacaatatgtttactgtatccattgtccttgcagaacctgaatcctgtggacacccacatttgaagccacgtctttaatattcaccgggctgaattcaccttccacatgcccttcatttcctcctgaagatttgggtgttcagtcactttcatttccttttaccccaaagaagttattaaaacaaaattttaagaaacctttttttatacagcgaatcttctggaagtcaactctcggagccttgactgtctggaagggtcttcatttctccctcgctcggatgagacgtcacccgccctttgtgcccattggtcctccgggtgtggagtgtcctttcccgccttcctcctcttaagatttgttctccacatctggttttcagcagctgactgcgatgtgtctcagtgcggtggtgtgggtttttctctttctcagggttggttgtgcttctttgttctatgggttggtgtctctcaaaagcttcacttggggaagcttttggccgtcctctcttgcctcatttttctctcctctccctttttttttttttttttttttggagacagagtttcactcttgttcatgctggagtgcaatggcactatctctgctcaccgcaacctccacctcccgggttcaagcgattctcctgcctcagcctcccaagtagctgggattacaggcgtgtgccaccacctgcagctaattttgtatttttagtagagacggggtttctctatgttggtcaggctggtctcgaactcctgacctcaggtgatccgcctgcctcagcctcccaaagtgctgggatgacaggcatgagccaccgtgcccggcctctcctctccttttgaagttgcatctgtaggtatgttgggtcctctgatacttcccgtagattgtggatactccgttgtggtttccttcactccttccgtgcctcagcttgggtggacgcttctatttacctgtactcgggcttacgggtcctcttct

SEQ ID NO: 34579 - DNA, 1006 bp, Homo sapiens
tatttagcttttgacaagttaatactgtaattatgtactatttagtccctctcctagcctataaaccttttctgtagaagatatttttcaggtttagggaatttttttcttgagagtctgggacagacctgtaaacagtttagattatgaaacaatatacatttctgttttttagtctcaaacatatcgaaattgtctttcgacttttcagacctttcaaaatagagattcgaaggaagaagcccaggctatttgtcttttagggattgcagtttctttggtaagagaaaggttggtagctttgttagtaaccctttgaccttgtgaatgtcttttgtgtttagttaattatattttccgtataactttgaagattggggaagcaagtgtagtttagcagttagctctcttccttgataattatctttccttctttcatttattatagttacagcattaaaaactgcccataaggccactagtttttgtcgtcaccagagaaagatgaccccaaatacggacctttgcattagaagttacaaattttatccaaaaagttagcgcacaataatttggatattgttaaactttccagatagagtatatgggttgaatatgaattgtgtgtgtatataaatatatttatgatctaggaattaacaccattcaattcaaaatggccaaattcaaatactgttggtgggaatgtaaattagttcaactgttgtggaagacagtgtggcgattcctcaaagatctagaaccagaaataccatttgactcagcaatcccattaccgggtatatatccaaaggaatacaagtcattatgttacaaagatacatgtacgcgtatgttcattgcagcactgttcacagtagcaaagacagggaatcaacccaaacgcccatcaatgatagactaaagaaaatgtggtacatacacaccatggaatactattcacccatcaaaaggaacaagatcatgtcctttgcagggacatgga

SEQ ID NO: 34580 - DNA, 1034 bp, Homo sapiens
tctcataaccagccctaatactcctgaacagctttttgtaggatggggtggggcagggcagaggttcattttgactcataggtaccttttccacttttactgctgataactgcgttacggattaaagttttgtttttgatgctgaagagggcttaagagagttagatattatggcacatgtaagtctgctaaaatagaactgtggggtagtgtaggagaatctcctcttaattatggatcatatattgtgagcattagaagccatgtgtacctaagttgaaaaatcaaaacatatcttgtatttgggtgaccccggtaagtcaggataccactgcgccttgtgtgaacacaggatgctaaggtgtagggatcaacagcctttttctcgacattttgcgcttctccctcggggtaaagtggggcggcagtaggaactcacagctgttgggcagctaatatttgtcagctattttacatgtgggattccatttaatgcaatcttggaggtaaaattattttattaaagatgaagatagaggcttagagaagttaagaaaattgttcaagttcacatcattgctttctttctttctttctttttttttttgagacagagtttcgctcttattgcctaggctggagtgcatgggcacgatctccactcaccataacctctgcttcccaggttcaagcgattctcctgcctcagcctgccaagtagctgggattacaggcatgcgccaccatgcctggctaattttgtatttttagtagggacggagttttccttgttggtcaggctggtcttgaactcccaacctcaggtaatccgcctgactcggccacccaaagtgctgggattacaggcgtgagccaccacgcctagctaattttgtatttttagtaagaatggggtttttccttgttggtcaggctggtcttgaactcccaacctcaggtaatccacctgactcggcctcccaaagtgctgggattacaggtgtgagccaccatgcccagccaaggccacgtaa

SEQ ID NO: 34581 - DNA, 1031 bp, Homo sapiens
acccacggaatgaggccaaggcagttacagttagaggtcagatttatgaggggagagcgagggtgaggtccgtgggtggggagactccgacctcagcttgatgggaagacctgatgctgcccctcagacgctgtatttctcagccaccaaagaaagtggaatcactccttagtgaatgctttcatcaaacttttgaaaaacctgttatgtcccaggaagcaaaatcgaactggacagttttccccttttaggagagttaaagatcccggagacaaacagcagaaggctcaaggagtccaaatacccaacctgaagttctttctgaacaagagatggtgtttaagtaacaggcatacaagacaaaactgagctaattaccgcagctgtggctcctagccctctagcgtgtcatgcgggcccttttgctttctctgccctccgctgccccagacccccactctacgccgcacctccagtcatcagctcatgccgacccattgctatggactctgttgaggtggctcccttctctctgaagctttgcttgttctcctgaagtcctggtctttaagagcttatgatctgccaggacagattggctttgggtaatacatggttaactgtagcacagcttgaaaaatgctctgatagaggtgggcaggcgcagtttgtgcatgcgggtaaatgcgagctcctttttcaataccatgaatccaagtattcatgctattttaaatctgcaattctttgactctccagagggtttttagattaatctttttctattacttcctaatgtttgttgcatagtgcagagtacttgattaaaacttagcaggtcggccgggcgcggtggctcacgcctgtaatcccagaactttgggaggtcgaggcaggcggatcatttgaggtcaggagttcgagaccagcctggccaacatggtgaaaccccgtctctactaaaaatacaaaaattagccgggcatggtggtgggtgcctgtaatcgcagctactcatgaggctgaggcag

SEQ ID NO: 34582 - DNA, 1029 bp, Homo sapiens
ggttgaggctgcagtgagctgagactgcgccactgcactccagcctggttgacagagcgagaccctgcctcaggagaagaaaaaagattcccagagatcacggaatgatgaggactctgctgtctgggtcgtgagagctggttcgctggacagaaagaggagtttgcccccctgcctatgcccttttggcctggcatgtccctcttcctgtgcctgtcacgctggtgtggtgctgaatggcacacctctctccccagtacctgacagtgcgtctgctcccgtgtctgttgaacaagtgaacacatggtttgcagcccagcaggtgatggaaggggtgggaggaggagcctcggacacacctgagctgggcctcagtctcttagccgtgtgaccatctcctagccttggcatcctcatccgtgagatgaggatgactgaccattcctgtggggcatggtatggaacaaacaagagaatgtcgagggctgggaccgtggctgttgtgttcactgtggtgtccctggggcctacactgtatttactgtcttgccttttcctgaaaatgcttgtggactcccgctctggactgggaaacctcgagtagacctcagagtcatcgtttttcctctttctgatagccacccctgatctgacccctccatcctgcggcctgcaagtctggtctctgagccttggagaggattcagctaacagctactgttcacggccacctgtcagaccttgcacgtggagctttctctacttcaatggacatttaaaacatcctcctaagatcaagccctgatttacagatgtgaaaactgaggctttgcagagttaaatccattcaccaaggtcacaccgctgcccctggatggtgggtccaaaccggaccctgctggctcccattctggctggctggtggcagaccaggagttcagcctggagggggaggcagggggatttcctgagagagccacgtccctttgttgtgaaggttgtgtgttaacgacaccagcaatcattttt

SEQ ID NO: 34583 - DNA, 1050 bp, Homo sapiens
ggggacacgtttgatgacctatttctgatgtttgcaagtcactttctttttttttttttttttgagacggagtctcgctctgtcgcccaggctggagtgcagtggtatgatctcggctcactgcaagctccacctcccaggttctcgccattctcctgcctcagcctccggagtagctgggactacaggagcccacaaccacacccggctaattttttgtatttttagtagagacggagtttcaccgtgttaggcaggatggtctcgatatcctgacctcgtgatccgcccaccttggcctcccgaagtgctgggatcacaggcatgagccaccacgcccggccgcaagtcactttctaagcttcccaaatgttgccacagaaagaactagaaaatgacctaatcattgtggtaacttcaacccaaccaatacctttttcctaaaaccatcactccttatattaataaaatcaaaacataaatgggacagccagcttctccatgtgcccatcacgctctgctcttccctccccttcccctgagactgaaagcaaaagcaattttacagtctctccatcatcaggaaagacaccaaagtcatctgcttttctgcaactgctctaatatttacaagatgcaacaaagtgaaaacgttttccggagtaacaaaggcaaatggctttcacttgttcaaagtggtatgggagagagaccgccattatccctcacgccgcagggaagcttgtgggttctgccagccccatcgtctcaagggcatttggtcacagatcccaggtctcagggctgactgcagcctgcgtcatgtggatctttggtaaaagctgtttaagtgatgtggggccctcaggctctgcaggactggagagacacaggccccttccggggttgcgcttgcctgtgaggaagggtggaggatttgccaagccaatggcgggtccttcaggggttcgattctgacttgggtaggggaggctgggttttctgttgagttcctctgatttttgcacaggcatttttgcactgagctga

SEQ ID NO: 34584 - DNA, 1114 bp, Homo sapiens
aagggtgaccaggctgattctttctgaaactcagtggtttaacccaggcagaggagggcctcagctcagccccttatgtgaagttgaaaacactcataaaatgggtcactggacttagcatgcgtgtgtgtgtgtgtgtgtgtgtgcgtgtgtgtgtgtgtgtgtgtgcgtgtgtgtgtcttcctcttaattgtttttcctttttaattgtctttcttttttaaaattaaaaattcttcttttactctgaatcagtctcttaagtttttgtttgtttgtttgtttgtttgtttttgagacggagtctcgctctgttgcccaggctggagtgcagtggtgcgatcttggctcactgcaatttctgcctcctgggttcaagcaattctcttgcctcagcctcccagactagctgggactacaggtgcccgccaccacacctggctaattttttttatttttcagtagagacagggtgtcaccatgttgcccaggctgttctcagactcctgagctcaactgatctgcccgcctcggcctctcaaagtgctggcattataggcgtgagccactgtgcctggcccagcctcttaagttttcatcattagatatcaagcagaagcaaaggagtcttctttcttttttttttccccttaaaaaaaagcctgcagcacctgctattcccaggcggtctcccatccaaatactaaccacgcccgaccctgcttagcttcacgagatcaggctcattcagggtagtttggccatggacagcaaaggagtctcaataaaacatgttaggcctgagggaggcacggtgagcccccacacagagcagaccatcagttaccgaggcgcttgcagccttctgggaatggactggtcccggcccttccctgtcctgggagcgagcactgtctgcggtgctgagtctggttccctggcctttcttcatggtttcgctgcaaacaattgcaaccttccatggtgtgtcattcactttgacgtttgtgaactttatataaagtgggccatgacgcacattcttctgcagtttgcttctgggacccgtgttagggccctgagagctatttgctgtgtagagctgtgttttcat

SEQ ID NO: 34585 - DNA, 1001 bp, Homo sapiens
gaccaaatgttggtagaattaagtaaaaggcaaatgagacgtatcctcccagacacactggctcaccctagcccattcagtgtttgatcacatacagtaattgatttttatgctatcttagttttccagggcttccataacaaattaccgtaagtttggtggcttaaaacaacacgcatttattctctcatagttctaaaggctctgagaatccattcatctctcctagtttgtagtggttgccagcaatcattggcattccttgacctgtgcctccagcacttcaatctctgcctccgtggttacgtggtgttcttgtttctccagatctcttttcttcttctaataagggcaacattcatattggattagggccaaccctaatccagtataatctcatagtgaataactgctgaatgaaacagtcactgagattagggagcgtgtcaggagaatggtgcagatggcagaactatctcagactgtttccctttggggaagcaggccccagccagaggctgctgggtccagggagcagggagaaagctggagatatccaggcttaggtcaaggatctgacccactgcctggggctggaaatagtgtctacatagcactgtcctgtaggactttctgtgataatggcaatgttctatgtctgcactgtccaataccgtagttacttttggctactgacccacacttgagtgcagctagtgcaactagggaactgatttaaattagatttatgggaaattgaatgtatttaactgctgcacatttaagtagccacatgaggctaggggctactgttgaacaatgcagcactagagacactcacctgggacccttaaagcccctccattctgagttgtcagcgtctaagtgctggaagctgggtggaactcgagaagcagcagtggaggctccaaccggaagtccctggctgctctgagcgccctgagtggcagccctgttgtgctgatcagaatgatggctcc

SEQ ID NO: 34586 - DNA, 1050 bp, Homo sapiens
gcctccagcaagtccttctctcagctgagcccagcgctctcatctgtgatgtgccggcatggagaggtgcaggcagggcccagagcatgtgtgcctggtctggcgggtacccctcaggacacacagtggcatatgcccattatattgctcctgtgcagcctccccaagggcaaatttagcagataaagatgtacacgcttcaagtcgggctccagagaaaccacagatacaattgtagtatcagtccaccccatgcgggttcttgtaagcatatcccacgcattggaacatccttacattgtcctaaaaacaattcctcacggtctctctggaattccaatttaactggaagtccagcatttcatctggcaactccacttccctaatgtcacaaaggtattggtcatgggtgaaaccgtgacatttgagtgttcatgaaataaactacaggagccacgggcctgggtcctccacaacagtcacacgacagcttttcatcaagacagaaacaaaactcacgccagcctcctctccaccaggtgaggcatcgccctgtcttccgggctctccagctggatcccagcagcagaccgtggagttacgccttgcccctgccccacccagcccctgcaccccccaccccccgcccagtcccgccctgcggaagccgcacctcccgtgaagctgtaccagtccgccccgttgatgatgctccccctcttcaggaaattgcctccacacctattctccgacctgtccatcatcatggggtggacgtcagcgtaggctctggacagcagcttgaacatctggaaaagaaacctggctcagataaggaaagggtcccctgcaggacgtcctgtgagctggggtcaatgaggggaggagctgcgcgtgcaaacacctgcattgcagataggagaggggaatggtgtctgcaggtaggagaggggaacggtgtcctgcagaggacacagtgtatgtgaaggcccagaggtgggtcacaggcggtctggcactgctggagttcggggccaggtcccatgggta

SEQ ID NO: 34587 - DNA, 1066 bp, Homo sapiens
ggagtttgagaccagcctagccaatatgttgaaattccatctctactaaaaaaaaaaaaaaaaaaatacaaaaagtagccgggtgtggtggcaggtacctgtaatcccagctacttgggaggctgaggcaggagaatcacttgaactcaggaggtggaggttgcagtgagccgagatcgcgccactgcactccagcctgggcgagagagtgagactcggtctcaaaacaaaccaacaaaaaaggacatggaagtgcagaagggccccccgctggctggatccggggtggtgtgtgaagagaatgctatctcctcgtctccacctccccggcccccactcttgccacggcccccctgcacagccttccccaaggctccctgacccactcctcggcccagtttctatgccgggggcctggcccttggcccctgacacgaactgggctctggaatgagtccttccaccccacacacccactgcagcaggctcttccctagacagcgtgaacgggtggggacagaatgaagtgcagggaaggcctcgtgcaggtgccccacggggggactgagactgagcggccacctgcacaccccgagtcctgggcaccttgcgcctgctgtttccacacccacttcagcaaagcacgaagcagaggtctgctccacgggcctcccgggatttcagaggacccctgcacggtgccctgtatgcagtggagccaaataaatgtaaacttacaagtcactaggcgcatgggtgaatgtaggatgcaggggctcaggaggctgtgagatgttccccaaacactccagatcattcttgctccgcaaaccaagcgctgttgtgccagtgtaagacttgagggctgtaggctgcctgagccctccccatgccttcccccgagagcacgccacccagcgccgggggtgtgcctgctcctctgggcttcagctgggaaccccgaggccttcgcctcagggcatagctgccaggaggcaatggaacgaggctgagggtgctggtggggaccatgctgtcattcagttgaggtcaaggcactgctcag

SEQ ID NO: 34588 - DNA, 1079 bp, Homo sapiens
caaatgggctgtaccttgtagcattccaaggacaggcctgaattctgagaagggaaagtggtaaaagtattgtccagtcctttttacgttggtggctgagcttggtaagatgtgtttttaaaagaccattagtctgttctactttcctgaggactgaggactgtaagggatataaaggtttcactgaatactagaagcctgaaaaaatgcttggctgacttgattaataaaggccggtctgctatcacactgtatagaggtgggaaggctaaactgaggaattatgtctgacagaagggaagaaatgaccttggtggccttcttacaccctgtgggaaaggcccttacctatccagtgaaagtgtctacctagaccaagaggtattttagtttcctgactcggggcacgttgagtaaagctaatttgccagtcctgggtgggggcaaatccttgagcttgatgtgcagggaagggagggggcctgaagaatccctgaggagtagtagaatagctgatggaacactgagaagttatttctttgaggatagatttccacgatggaaaggaaatgagaggttctaagaggcgggctagtggcttgtactatagcatagcctgcttttgttggtgtgtggcgattaggcctggtggagctgccatcaataaactaagtgtgatcagggtgagaaacagagaagaaggaaatgtggggaaatggggtgaatgtcagatggaccagagagatgcagtcatgagggtcaggtgtggtatcaggaataatgtgggtggccggattgaagtccgggccaggaacaatggtaattgtgggagactcaacaaagagtgagtacagctgaaggagccagggagcagaaagtatatgtggcaggtgtgaggaagaaaatagattttggaagttatgagagctgtagagagtgagttgaccatagcttgtgattttaagggcctttaaaagtattagggtggcagcagctgctgcacggagacataatggccaacctaaaacagtaaggtcaagttgtttggacaaaaaggctacaggatgcgatcctggtcc

SEQ ID NO: 34589 - DNA, 1050 bp, Homo sapiens
ttcagactatcacatggggagaaaccttggacaaaaccctgctttcaagggcagggctccctgcggctctccactgtgcattgtgcccctggtttattgtgactagagaatggcaatgacttttaccaactttactgcttgtaaacatttggttaacaaggcacgtcctgcacagccctagatcccttaaaccttgattttagacaacacatgtttttgtgaactccaagttgggtcaaagtgactggggcaaagtggctggggcaaagctacaaatgaacaacatctcagcaaagcaattgttagagtacaggtctttttcaaagtggagtctcttatgtcttccctttctacatagacacagtgacagtctgatctctctcttttccctacatttcccccttttctttttaacaaaaccgccatcgtcatcatggccccttctcactggtcgctgtctctccggagctgctggatacacctgtagactaacaatagagaggacagacatacaaaaattaatacaaaatttgcaatagtggaatttccaatggttttaacccaagtgacagggttaagatttgtgaggctatcaacagcttttaccattgcctccgtttctgacaccagatttaactgggcttttgaggtttcaaaaatttgttctttcaatttagaaatatctaaggtaagattatcttctcttccttgtagatggcgtctaaccatgtcccagtgatgttcaggttcattataggctcaaggtttaatacaaaaatctgacgtattccagtcacactgtaactgaaaaagatattctaagctcatgagcctatctcccatccaaataacagtttgtctaagatcattaatttgatttgccaatttttgatctatttgagtctgagaattccacaattttgaggaattcttttgccaattattcacatattctgcagtttgaacagaggagtgtaaagaaattccagcagccgcagcagtagctgtgactgcaataagacccacaatcactgcaatcaaagtaaaaat

SEQ ID NO: 34590 - DNA, 1025 bp, Homo sapiens
caattgcacacttttttttttttttttttgagacaaggtctagctggagtacagtgatgcagtcatagcccactgcagcctcagattcctgggctcaagcaatccacccacatcagtttcccaagtagttgggactacaggcccacactactatgcccagctaattattttaatttttgtagagatggcaggtggcggtggggggggggggttgtctcgctatgttgcccagggtggtctcgaacacttgacctcaagtgaacctcctgcctcagccccacaaatctctgcaattataggtgtgagccactgtggctggctacaatactatttatttatattttagaccaacagatattctagtatataagaaatgtgatgctctctgtacattgaagagttgggctaatatttgtcctggtggatacagaaattgcctgtctgctccgctctggttgaagaaaccagtccgactgtctctgaggctatggagcagtccatgaagaatgaaagccctctgccaggcatgttggctcacacctgtaataccagcactttgggaggccgaggcaggtggatcacttgaagtcaggagttcgacaccagcatggtcaacatggtgaaaccctgtctctacaaaaaatagaaaaattagctgggcctggtgatgcgtgcctgtaatcccagctactcaggaggctgaggcaagagagtcacttgaacttgggaagcagaggttacagtggggagctgagatcacaccactgcattccagcctgagcgacagagcgagactctctccaaaaaaaaaaaaaaaaaaaaaaagaaagaatgaatgtcctcatgatggcctcaagcacattggtccctgaagagggtcaaagaaggcccactttactctgcactgcaaagcaggcaggtggacaggatgagaagtggattcagtgagaggcattgacccagaggattttctgcctaatggttcagcagaagattaaactgagcacagcatcctgttccctgaa

SEQ ID NO: 34591 - DNA, 1028 bp, Homo sapiens
gcgtaatcctaagaaccttcgagtatgttaacttacagggcaaatggggcttggctgatgtgattaaagtaaggatcttgagtttgggtcattaacgtggatgactgggtaaacccaatgtcctcataaggacacaaaggtccttataaaagggaggtggcagagtcagagtcagaaaggaagtgatactagaagaagagatgagagagagagaaaaagatttgaagatgctgcactgctggccttgaagacggaggaaggggtcatgagccaaggatagcaggcagcttgtagaagctggaaaaggaaaagaaatgtattatcccctaaagattccaaggtgttgcgtctctatgaacactttgattttaggatttttgatccccagaactgtaagataataaatttttgttgttttaagccactaagagggtgtatgtgcgtgtcatcgttttttttttaatttttaactttttgtgttgaaatactttcacacttacagaaaacttatgaaaagagaaaatcacccagatttccattttttcagctacattgaagtataatcaactgagtcacaagggctagacatttaagatgtagaactcgtatatctgaaattgcatacatctaagatgtagaactcaatgttttgatattagtatatgttatgaaaccatcaccacaatcaagctaattaacatatcatcacctcatgtatttaccattttcctttctttttatgtgtggtgagaacacttaaaatctaccctcttggcaaatttcaggtatacagtacctgaaactgtagtcaccatgctgttcatgagatctccagaacttattcatgctgcataactgaaactttgtaccctttgactatcatctttccatttctccccttccctcatctcctgaaaaccaccgttctcctctctgtcgagccataagtttttagaaattagttacagcagcagcagaaaactattacagacagcctagagcagttgtctccagagcaggtaatgagt

SEQ ID NO: 34592 - DNA, 1033 bp, Homo sapiens
agtataaaaaggaaggcacgcacagcatggggccgaggaggttgttgcctgggggagctgagggctcttgtcgagaccatgctccagtgggcctccaagtgggatggtgagaaattgtacacgggtgagtaaggcttcgctactgcccagaaaaacagtttcccatgagccatccccgacagtgttctccaggtgtcagccctcaggtctgccgtcccgtttctgttggcagggctgccctgagagtgctcttcctaataccactgctgccaactgtctggggccagtgcacccggcctgccaccgtggctaaacttatgtcccaaaaaagcaaccagcatcccacccttccaccaaaaccccaagggccagttgtcaaaacccccatgtcccaactctcaaatgccacacctgtgtgagtcacgcagatgctgatgttcggtgctgatctgggctgcagtgggatggagcagcaggtatcagcccaggctgcgtgttagaaccacctgggagctctaaaaagcgctggctgctgacgcccccagaggcactaagtttacagggaagtctcagggcagcaggagcttgcaggcctccagaaggaacacccgtgggcatctgggcatggctaggagtgtttctggtaagttcaaggcattgagcctgcacacaagtctcttggcctcttgccgagtgcacgttctgatttggcaggaaggtgggcctgagccctgctggtgggggctgtgctggtctgaggtccgcgctgtaagggactggtgggatgccacattggaaggaggccgcccagctcagtgtctcttactggggcatgtgatgatttttccccacgtctctgtggaaaagatgaaagtagctgcattcgttgcccattctccagtcccactggtaactgtgtacctgtctccaaggagacctgcatccaaagatctatgccatattgtggcaacatgtggcataccacagagatcaagaattcctgcggaaaagccctgagctcagaggagagggg

SEQ ID NO: 34593 - DNA, 1033 bp, Homo sapiens
gggaggttccccaatccctctccctctttgttcactggccgggcctccgtgtggaaagggctatttttagccctcgctttttttggttaatgggcttttcgcggcttctctctttgaaggggctatttcaggagcagacatcagtgtctgcatttggactccttggctcgaggtgcaggaaaaggtgatggggatgagctactcgaggggcatctgtgtccctggactgtgccgggcccctcccttgcccctgctgggttctggggccagggagggacacatgacaccaccctgccagagcctgtgggaggcgtcggcagaggtgaaccacagacttggatttggggtcctggggtttgcgcgagcaggaatgtcctcgcttctgggacctggaactggagtaggaatgtccatgttttgacctcagggagccactgaaatgggcacttgtgacaggttggaattgaacagtggctgattagtttcctccattttgtagcaagagccatcagcgtccactgtcccacccactcatctgggcttgggtgattcgggcatttggggtgagctcttttctcttagttcttaactcattcgtcagaaggacccaggggtcagccaggcccagccatctccctggcccactgcacttcaaggaagctcaggctggcttggaggagccagtgcgaagtcagcggcaaggcgaggctgtgctggccaaggaagcggagttcggcagcgagagaactcgatgtgctggtcagaggtctaggattcgagctgtggttatgtcatggtcaaggttgtgtggcctcatctggaaggagtagtggtgcatacacccctgtccaccccccgcccaacagggggtctagaagtgctttgcctcaggccctcccaccactgccttcactgcagccggctccttcctgcagctctctcgggaactgccctgtgaggccctttgacacagggaatgtggaccctatggactgacatggacaagggaccgtgggccatgttgacacagata

SEQ ID NO: 34594 - DNA, 1114 bp, Homo sapiens
tttgacgcagagcttttcctgtacacagatgggaacaagaggtacaggagtgagagtggtaccccttctagaatggtggcccactcattcattcactcactcattcattcataagctcaacagatacttactgcctgccttgcctagccatctgcagcccagggaggccaagtgagtaagctgatgtgggcctcatcagcctctctggagagtgacagctatgaccaaattgctgagagagctaagcaccagtaggggagggcgggactcatgcacgccgtggccctatgcttgtaccatcctgcgtgtgcacagcagcctgtcctgaagggtgtatgggagatggtaggccttggggttggggaagacctgggttcggctctgtcttactctgctttgtgctcacaggctgggtaatttacgactaacacaaatgtattggctcatagttcttggggctgggcagttggacagcaggggccgttgcacagcaggggccggtatctgtcaagggccttttgctgtgtcagtccatggcagaagaacaaagagaaggtgagagaagaagaggggctgggcttgtccttttattgggaagctgctcatgtcataatacccattcctgagggcagagccctcctggcctaatcacctctccataggccgcctctgatgcattggggattaagtttccagcacatggttttcgaggtcacactcagaccatggcagcctcttactggtggcgtagccttagttgagtaactcaccttcctgggcccaaattttctcttccaaactggggctgctagtgcctgcctcttagggtgtgaaggagccagtaaggcatggatatgcccagcatggctgttgcactaatgggtacttacccctgggtgacccgttacctgtcacaaaactggggctctgttctgatcgagccaggcggctgggtgagctggctgactgctgttggcggtcagctgaggtcacggtgaagggttgggcccggagtctggctcatagtaggcatttaatggtttttgtgtttagatcttctccagctccatctgtaaaacatgctctcatttacatcccatgatttatttagctc

SEQ ID NO: 34595 - DNA, 1067 bp, Homo sapiens
gacctctgtgcaaagactgggaagggtcacccccaatggctgtgaacgaacctgtttgtgattctaaacagggcacgggaccatcctacaataaaaattacccagcctaaaatgccagtagtgccagtagtccctgtttagaaaaagaaaaaaaaaaagcaacttttgcctcacaacagaggccctcttgtgtgctgccaggcagccagcagatttgctatgcaggcaagtttggggcctggtttttaaagtatccagttcctagattccagaactaaaatacacatttggaaaaatgatgtctataaaattgagtttccgggagtgcaaggtttatagcaatttgacactgctgggaacccaggcgcagtatcagtggacttttctccttgaacagggggcagaccaagtggggggttggggagggtattgggctcactcttggtttcccttggtgtgagctgccaccattcacatgcagaggactcacctgtgtttcctgcgggttgggggtaatggtggcatgacagagggcttgaggactgacctagctgcttctccggaattggacgcctgctgactacctgcgtgtatccagatggccattggcctgtgggggtgcaggatggaggccctgcccacatggagctcactgtcctgggtgggagtgaaataaactctaggtggcagaaggaagtggtgcgttggattatcacctgggtgcaaacgagctggcagcagcgcctgccaggtgcagagccaggaacctctaggccttcagtctgaccacctgatggcaggggaagcagagggtggtggggggccttcatctcaggagaatctgagtggctgcaggtgccagtcaggacgctgggcttctgcagatgggaccacatctgggaggaccgaagggccgggtgcttatgggctgttactgtggcactgagcgtgaggggagtggacaggacccaggctgagaagtgctggtgtgcagtggtggcaggtggctcacacagccctaccatagcgcagccctgctctgaaggccactggagccattcagaggt

SEQ ID NO: 34596 - DNA, 1034 bp, Homo sapiens
atggccattcttttactccctccctggttttgtaatactcccgagtgttccgtatagcacaaagagttttgcttttactggccattttaaagaatgttttcaactgcttgcctgaatttactcctttcacagcaagtgttagaagaaagataacattttcaaatacttagcttttgctttctttaaaatacattggtttatgacatatgggaagggaacgtacctttttgcaaagacaaaaagagattacaaaaggaaaatatctaaaactattttctctttgcccttaccactcccagaaacataagtgaccaatttaaaatgctagggaacaggcttacaacataggtaaaactcgcaaacacagttcaaggtaggctcataaagttgtgaaaagggtttcatatgccctttagttttcatttgggattcatccaaagaccatgggtggatgctgtcttctctcttcttgatccctttgattcatggacactagactccctttgccatttcttctgaaccggccctcctgtggactagcacaacttccttgcccactgtttcttcctttctgtgcctttgagaccccttaaggttttccctcatgcgattactagaaaatggcaggaatcaacaaaatggagacctcccactgtttttgctaaagttacaggaacacgatccctagttttcattgatagtaacgctgtttctaatttgtcttaaccacattcatgcttaccctgctgctcagctttctcagggaagcaactccaggaacactccttccactcccctctctaccaacagatgtcaggactgtcatttatctacacatttgtgttctttagaaaaaggcccaccccctgcacaagcacagcctcttgggcagataggtggctgggtcagtgcttaagacaggattctagtcttcacttgcctgtgcagctgggcgctgaccttccaggtagagcacagatggcacaaccccgaggcagccccaacttgcatttccctccctccaggggctattc

SEQ ID NO: 34597 - DNA, 1028 bp, Homo sapiens
cagccccccactgcaaccctgcaggcctccatctgcttgatgtctaagtgttgtatgcatacttaagatagagcaagtctgactgagggcttgatttcatgctggaaattgcttttgaagaaggtgactatctttcgcaaaagtagagtaggaaaagacgacactgccaaagaaaatacagcttgtcatcagatatgatgtgttattttggtgctttccaaagggcaggttttacaccagatctgagtgcgttactgttgcatctcttgagcccctgtggaggggcttttttaaactccccgacgtcggtctttcagactacctttatatggctcttggcctgttagcattgtgccagaaggaagctacctgtgttgccacccatcattgtcattgaacaaacactgactgagtccctctgggtgcctcttgacacttggagaaggactcaaaaatttcaaaagtcttctcttatactctagtgttcttatactctagcattctaatcatcatggcggctctgggaggaattggataattgttcctaattctagttgctagatgaaaaactgaggttcagaagatctaagtgactttcttaagtcatgaaagaaaggcttttagcagattccaaactagaatggattttgttatgctcctagtttgccatattctgggaaaataagtgtctttaaagattgtataaaagagtcactgtggccaggtgcggtggctcacgcctgtaatcccagcactttgggaggctgaggcaggcagatcacctgaggtcaggggttaaagaccagcctggccaacatggagaaaccctgtctctactaaaaatacaaaattagctgggcatggtggtgcaaacctgtaatcccagctactcgggaggctgaggcaggagaattgcttgaaccctggaggcagaggttgcagtgagccaagattgcaccattgcactccagcctgggcaacaagagtgaaacactgtctcaaaaaaaaaaaaaaaaaaaggtcactct

SEQ ID NO: 34598 - DNA, 1053 bp, Homo sapiens
gtcccagaaggagatgaaaaatagtgtgcagagaaaatatttgaagaaataatagtaagaaagcctctcaaatttgacaaaacccataaacttacagatttaagaggttgaacaaactccaaacagaaaacaaacgaacaaacaaacaaacaaattcacacttggagacattataatcaagctgctggaaagtaaagaaaaaatattgaagacgacagagaaaatgatgcattacttaggagagcaacaatttcaatgactgtagatttctcatcagaaaccatggtagccagaaagaagtaaaaaaagcatttttaaagggcctaaagaaaaacacagtcaaactccatcgagtgaaaaattcctgcagaaatgacagtgaaataaagctgtctcagataaagaagaactaagagaatttgttgccagcagacttcctctaaaataactgttaaagaattttgttttcagaacaaagcttttcttttaaaaagaaaactatcgttaacatttagctatattagtatcagacaaagtagacttcagagcaaagaacaatagggataaagtgagacataacataatgataaggtcaatttctcaagaagccataaaagtcctcaatgtgtaaaataagtactgacaatagaatttcaaaacatatgaaacaaaatttgacagaactgaaagaagtatacaaatccaccattatatttagatgtattacctctgctctcagtaattcaacctccgttctcagtaattgatagattcagtggatactgagtctgcaaggatatagaaaaactgaacaacatcatcaaagctggatgttttcacactgacgttttacatatcaaccaacaaccgaagaatgtacatccttgtcttcaagtggacagagatcattcaccaagatagaatgtattccaggtcacaaaacaaatttaaaaattaaaatcacttgaaatcatacaaatgttactctttcattctaatagattaaactaaaatcaataacaaagattacaggagactctcaaacacttgaaa

SEQ ID NO: 34599 - DNA, 1040 bp, Homo sapiens
tgtgcttgtttctgtttttatttgctgtgtggaaccatcaactaaaacagttggcaatgtactttgattgcagggcacacaacggtagctggataagcttccttcttggatagcttagaagcttccgagggcagccattatgtataagaatagtgaatgtttaatgtattattgtgattttcctcgatttggtcctgaaatatctctctggaaatagccttaagctatgataatcgctttctaggagagtcttgatgggggaaagttacgttgaggtatattgattaggtgcaaaacagagcaggcaacacaacaaaacagaaaataaaagaaacatttgatcactcacaggtccacgagagaagaggtgtgctcaggagggctgactggaagtctgaagacagcatggcatacaaccaatgggtggagagcaggagccagagatgacatatgggatgaggccttcattaaagtccatgggtattatccatcaggctttcctgtagggattgtggattggtcaatttaaagaaaacacttgtgaacaggagtacttatctacatgattctgacattgatcattgagttttatcatggacagtagctgtgggattttaggctagtgagataggaataagcaggccatattgcaaacaacaacaggggcaagaaaagttttaactagtccaaaggtgaaggaatataaacaggtttccaacagtggataccaggcctaaaaatggatgccaaggcaacaactatattaaacaactttatgacacatacatttgtcatataaatagtcagtcctcttgtatgtagagaaaaagaataatgattaatatgtaacatgttcagatttttgcctaatggatctgcttttaagtgaagaggttacatattctaatctgctctataagccacagtctctgtacttgctaactattatttcacctttataatggccctctgaggtcagttgtatcgtttttttttaacagttaagaaaatggaaactgaggctgcaagatgtaaagtga

SEQ ID NO: 34600 - DNA, 1047 bp, Homo sapiens
gtttaataaggtttgctgaatttgataatatattacaaaatattttcaacatggagatttttattttccatttcaaaaaagttttggaagaaatgtctatcaaattttgttgctcaaactccagcttcgttttcaaattgtgcacaaaatttaatccaagggactggcccttttattacaaaatattaagaggataataatgataattaaaatggaaatacgtatggtctatcatcagtaatattcttcagcagtaacttatttttcttcaatactccaatctagttaagtgttaataaaacttacctaataacatctgtaagtggctggtttggatgagagaccagcattccattgctgtatttgacacttctaaaaaatctactaaataaatgagatatttctttccagaatccatggaaacatgtcaatttagtcaattctatagtttttatatatctgatttttcatgatgtactgtcaagaataaatgatttaaaattagaagatgggctgtgagtctgtaatatttgacattcaatacttataaaacatagaggatgaagatgataatcatagtcatttatgctttgcctacttgaaaaaggtgctcatttcttattaaataagacattttttgccactgataaatatgtgtggcactcttatcatatgtcagaacttgtgatgataattcaaagataaaatgcaatagctgaactcaacaaatttacagacaggcaagaaagatttctaaagagaataatcaaagagtttaataagaactgcaagagaggtcctaaagtagcccagtgaggagaaaacttaaaaatcagattcaaggattgagggatcatggacattttaataaagaaagtaacagtgatttaccataagctttagattttcccctgatcaccaggttgtttacttgatttattagtttgtttttaagctgctgataaagacatacttgagactaagtaatttataaagaaaaagttgtttaatggactcacagttccatgtggctggggaggcctcaca

SEQ ID NO: 34601 - DNA, 1051 bp, Homo sapiens
gaaaatcacttctgacatatccaagacatcctagccagcaggaatgatattcgaggagatgagtgatttcaacaccaaatgacatcatttttggcatgttgtggtaatgtccataagacatcattcttgccttttaaaatatctttgtaagaaataaaaatgcaagatgactgaggtgatttttctacatgtacatatctgagcaagtgggaagaacaaaaacactctttgggcaaccttgcctgcctgttagaaattagttcaaattaagttttgatatactctctgctccaaagtgcttttagacatggtactttggagctaaaatgaaaatacaaccaactttgctttggattcttcaatgtgcgaggtgtttttacatttattatctcaccacgttctcataggcacactgtgatttcagtattataagccacatttttataaaagaggaaacaaaagctcagaggagcaaagggacctccctaatatcacatagctaaacagtgagtgacaaagtaaggacttcaatgcagattttttttgtctttgccccaaatccagtgctcttggaaccataagtcattgccttagagatcattcttgccaattctcctttttatagataaaaaattaaggttcaaagaggacgaataccttcctgatgctctcaatggtaagcacattgattccatagagattcagtttgcaaacctcaaagaagggttcagttcctgtttaccaaatacttgtatatgggctgctctaagtataaagtttcagcactcctataaaaatgcagaattttcaaagaaacaaaaaaaacaccagaaattgtgattcatttgtcttggaatgccaacagaatacttcctgaatacaacagtaatatgaaatgtttttgttacctggtacataaaaagtgacttatttgattctgcatactgttatcataaacattatacacttatcttagtttgcagggctttcataacaaagtgtcacagactggttgtcgtaaacaataggaatttattttctcacacttttg

SEQ ID NO: 34602 - DNA, 1624 bp, Homo sapiens
ctaatgaaaaatacaaaactgtcttcaagtatttaagcagaggatattattgcagagcattagttacgtaggcaatggagttgccaagagttgaacaagagattcacaacatcacaaagcactgtaacccctaggctgcctggcagacaaaggcaggaaatcttgtaaccagcaccaatgacctggggcctcttcagctcccttgtgaatctctggcttaatgttgagtcttgggttcagctctctcatctgtcctaaggacagaagaaacctgagggacagtgagaaagtagtgagttcaatagtttggaggtctagtgagggtaaagaactgacaggagggtcactagagcaaggacacccaagaatggaaatggggatcagaaaattcaatctttaaatgaaagattttgaatgaagtgcagctcctggtgacaacactgtgcttatgacccaagggagtgaatatgtaaagtcaagtggaaagaaaagtcactggagattaggaaagtgaggaatggagaggtgaacagggccactgtgttgtacaactccagggggagcccttcacatagtcagcctgaccctgtttaggctaagacacaaaggtcctctcccacatacacacaagtatgtgaaagtagaaatgtttcctttttttgttttgttcaacactgtatccctagcaactagaacatggtctgtcaacaggtactcaatgaatttttgtgggatgaatgaattaaggctgatgtcagtggcaatgagaacaagataattaaattcacagctaaaggctttaataaatgagggaggttgacttggaggtcagtagatgacagcaacaagttggcaatgatggagataaaacagaatggcctgacctttataagcaatgggagttcctttgcttttggtgtgtgtgaggtggatagtgacctagaagctgtaacgacaagccaaccctctcctaagccacatgagatgtgagataaaagatggttcacttgaaaacactgtaggagaaatgaactcgtaagttggagtcaggtagatttttagataagacagtagagtaaatgttctgggaggagaccaaggatcaagtagaatttactgattatagatgggtagttccaaggcaccacagacagcaataggagggaggatatgttggtcagagtccggacagaaaaacaaatttgactcaggtggttcaacttagagatttttaatgacggaagaccatttagccgtgtgtaggcagggttaaggaaaccagctagaaaagtgaaggtatcctgagactagcaatgattgacagccattactattcctgagtctgaagtggcaaggacaggaaactgtgaaagagcccggtgagagccagaatcatagaggcagaaatgcctaagggaacagaggtatagagccactgcctggagcacagcagagaaccagggaggaagcaggggagaataaggcccccctccattctgtctacctaacccatgattacctgcttcgatctttcaatggctgtactcacctgcaaattagagggcagggagcctggaagctgccattcataggagtttgcttctagggcaaaagtggggcaggt

SEQ ID NO: 34603 - DNA, 1027 bp, Homo sapiens
ataattcaggactggtagtgccccagtgtgaaaagatagggtaaaatacagtcatgacacagagataggtcaaggaagacagagacataaaaatgagatgaagaaatcatggtgataataatatgtaacattcactgagtatatttatgcaccaggcactgtgctagcactttacgtatgctgtggtaattaatcctcctaatgatgccacatgtcagaataacatttaaaatatttaagagcaagtagaacatagatagcatcaatgggtgaaaataaatgttgccttagtgctgggtctgggtcctggaagctctgtgccatggcagatactagccctattgtgtctggattgtggaggagagaatcagggtaagaaggagagtatgcttactgtgccaatcttctccgtttgctcccctctctgctcctcttatcccatcagttctttttctctacttcccattgccttctaatcaagcattctggagagtgagagaatggttctcccacacatggactatactagcagggacttccagctatgatcttgaaataaagaatctgaacctaacttaaagcaagctggattcaaagagcaggggaaaggagcataaaaggattatcaatgattttcagatcaacagctctcaaactgatctcaagattccttttagttttaaaaaatattgagtacctcaaaaagatgtttttaaatctttatttgttatatattagcagtgagagtttttgaaagtttattaacacatttaaaagcaacaagtatgatcacagttctattaaaaatcatcattttatatttttgcaagccttttactttgtttttttcattgcaaacatttgtaatacttgatttaaaagaagacagctcctctcctatctgcttctgcattcagtcagtgtgataaattgttttggttgaaatatatgtagaaaattcaatctctctcacacaaacacacacacatagttgaacttataatcagcttttcaaataattattgat

SEQ ID NO: 34604 - DNA, 1021 bp, Homo sapiens
aatcactacctcataccatattatgtttgcatagtggcttctagcaaaatacatgacacgtagaaattactctgttaatatttatttaacatgtggatccaggatctatgttgaaggttatcttttgagataagcacacattgcttcattttatagctgggtacactgaggctcagtttgcctaaataacttagaaaggccacagatatagtaagttgtggcgctgtgtcaggaaattgggtttcctgtattccagtccagagctgactctcttggttggtatgggagagcacctgaaaaaatatttctcatcatcagaaacagtcatttgggacactcgagattttgtgaggtactgccttcacttataattgcaaaaaaggtaagatagcattagttattaataatactacttttattacatgtgagtgccactttacagttcacaagatgtttttgcagacattttcatttaatcttcgtcattgcctgcactgaccctggactttaacactaggttgattctttgagaaacatacctctgtaaacaaacatccattacaaacaaatattcaatgctactaaacgtctgcagttcgaggcaataactttggtcctttcttctctttccgaactcctcacattacctgtagtttgattttaccttcttagtgcttacttttattccatctccatcccatccaaaaatacctcttttcctgactcagtgcttagcatttggacctccactctcctgcccgggttctagttgaatctgtactttgtgtctcagaagctcacatattaaaagaataaagtccctgattcaggcaccatctgtcccaaagctgatgatcagtcaggccagcctcagccccagtcgaggctgtggggttaaaattcatgtattcacagatgaagaaacaggctcagcaaggtcatgcaacttgcttgagattgtagcagagcttgttggttgtctctcaaaacccgtttttttttttttttcattattctttat

SEQ ID NO: 34605 - DNA, 1035 bp, Homo sapiens
tgtggcatttgcgaagaatactgagtcacatggatgtgaaaggtgatagaacattgccttcaataaaacaagctctgagttctgcgggtaaaattcctcattcaggagctttaacatttcccttttgacatactccaccacagaatactcataaatgaaatcttaattctacagttgagaattggtgtttttcctgggagttccacagcattgcagcaagggcctccaaaggaataggtggatttgagcaggaggcctggagcattccccacatattcaatcctgtctcatgttttacccagaatatctctgctttatctgtctcatatatatatatatgtctaattatatgtatataattagactaccacatagtacttcttttgaacaaaaaacgactcttaaagacaaccatttaggagttcctcattctttttggcctaaacctgtttgtactatatcttattttctcactcgcaaactcttgtctccataggctatctttgatcttaccttcagacagactcttaaaaatttaatacatgttctgattctgcctcttggctcttcacataggatttctcttagtaggcaatcgtcctcctctccctaccatctcccaaaggccaaatgtcttccgttatctataataagaacctacagaggccgggcatcgtggcttatacttgtaatcccagcagttcgggaggccagggtgggtggatcacttgaggtcaggagttcgagaccagcctggccaacatggcaaaaccctgtctctactaaaaatacaaaaaaattagccaggtgtggtggtgcacacctgtgatcccacctacttgggaggctgaggcatgagaattgcttaaacctgggaggcagaggttgtagtgagctgagatcgtgccactgcactccagcctgggcgacagagtgagactctgcctcaaaaaaaaaaaaaaaaaaaaaaagaacctaaagctttgattttcagctcagctctttttttccacaccttagctagttcctggtgac

SEQ ID NO: 34606 - DNA, 1063 bp, Homo sapiens
gatctcatcttaccttaattaattacatctgaagtgactctatttctaaataaagtcacattctgaggtcctggaggttaagatgtcaacatattgtttttaggaggacacagttgaagccataacacattgtaaaattaaaataatcttgataataaaatacatgtgatttaatttctatagcttcaatttatttatctacacaatggatataataatgcttgctctgctaacaacacgtattaaagatcaaactgaacaggaggtcatcaagaactccagtacactttgcaaataatgcaaatatatttatcgtgattatgaacatgatccctttcatttcttcacaagtgctgggctgtgcactctcagagacactgagctttccattcaagatgtgaaaggtactggccagggatcgcagtgtacaccaaggcgttgttttctccaaaatgccttggcagctccaggtttctcaactccacgttttccaagccagcaggtactactgagctgtgaaacaagatgagatttcatgcagaatggaagagcatattggaggaacagcagaaaggggagcagagggaccagggctttccttagtgggcctgagagccagggcccatgacaaagtgcagcatttgctgggctcccttcccactctaactgcttgtctcatagttggacaactttggtcagccagtctttgttctggtccctgggagagtcaggcctttggatagtcaaattagaagtgctttagggtatctgctcaggaacccacatcaagatagccttcctgactgtacctgcgataagccctgcctcattgctgttggaaggcagtgtgctttgcaggctctcagtaaacaggtctcctgcactcagaaccctcttgctatacttctttccaaaatttcctcccctgttagcctggctgtggtgcctgagttccaccattactcacactcaagttaaagcttcaagctcacatgtcaaacagcaagacagaatatgacatatcagtgactgagtccatcccttgctcacttcagctgctgaa

SEQ ID NO: 34607 - DNA, 1077 bp, Homo sapiens
gattcttccaatccatgagtatgggatgttttttccatttgtttgtgttatctatgatcttttttcatcagtgttttgtagttctcctggtagagatctttcacctccttgtttaaatgaattccttgctattttacttatttttttgtaggtattgtaaatgagaatgagttctaaatttgattcttagcttgattattattggtatatagacatgctactgatttttgtatgtcgattttgtatcctgaaactttactgaagtcatttattaaatccaggagttttttggagtcttgagggtttctaggtataagattatgttctcagcaaacaataatttgattttctcttttcttatttgaatgccttttattatttctcttgtctgattgctctagctggaacttccagtactatgttgaataggagtaatgaaagtgggaatccctatcttgttccagttcttaggaggaacactttcaactttttcccatttattatgatgttggctgtaggtttattgtattaggtcggtgcaaaagcaattgcggtttttgccattaaaagtaatggtaaaagtaatatttgtttcatgcatctgagtgctctagtgttggtgcatatatatttagtcttgttatatcttgttgttgaattggtcccattatcattacataataacctttttcaccttgtttttactgttgttgatttaagtcttgttttatctgatatcaatatagctactcctgttaactttggttttcattttcattaaaagtaatggcaaaaaccgcaattacttttgcaccgacctgatatatattgtttattgtacattattttgaagtatgttccttctatgcctagtttatcgaggacttttatcatgaggagatgctcaactttatgaaatgctttttctgcatttatcaagatgatcatacagtttttccttttaattctgtttggtgaattacattttttgatttgtgaatattgaaccatccttgtatccctgcaataaaatccacttgattacagggtattatctttttgatatgctttttgcta

SEQ ID NO: 34608 - DNA, 1010 bp, Homo sapiens
atggaagacaagatcttggaggagaagaggctagggaatggagagacattattagaaggactatttttggggataactgacaagaattatgacagtaatgctaggaaaacagcaagccagaagccaatctcatcaagaaatggttaggagtgggagagagtagtcccaagggtctccaaacgatgggatggggttggtgtgtgctgatggcgtacatttccaggcaatggtggggtgtaggggaagagaaggagacaatgatttgaagtagcaataaggaacaaataggacacctactcctcctttagccctagagggtttagtagagaaacagccaccattgagcagactgcagggaaagcaatgcggtgtccttagggaagagccaggccttagttagagcaaaagacgtatggaatgttcagagaagaagcacagttataggggatcctgctgatgacagactgtggcttgtgttgggctttgtagaactaaattctagtacggtgtctgacctgggctggcactcaaattatggtggaaggaagagtggggaggatttcagacccttgagcttccctgaacttcatatcttcaacctctggctcatcacttactggatggatgagtgaataaatgagtaaatggaggcctatgagctggctcaggtggagctaaagacaagtgatagtctgtctgcttctacttaaggtggggttgtcaaacacaatttttcctacctgacttgttcaaggttctttatattctagcccgttccaacctatcctttcttgtttcctatcatttccaaattcagatgacctaccagacagtttgggttcctggctgtcccattaaaacaccatactcattcctgactctcagccttagcttaggaatttccttctgctagagtagcctattgtagtctcgtttccccagccagctctttgctgtccttcaaggccgtggcaagtcaaactcacccatgaaaccttccttgatgtgaa

SEQ ID NO: 34609 - DNA, 1043 bp, Homo sapiens
ctaccctttactttagagtcacttcagttattttagagatgtgcaggcctgctcacaaagtgctgagaactgggatttggctttggatcaggaatcctggtgctatcagtgtgggctggggttggagccacagggccttccagagagtgactttctggaaagatgtggaggaaatttagcaagtcattaaggaaacgactggtgagcagttcgtgatctgtggccagcattggcttatttgcatgacggatggttgaaataggatcctacctgtagcttctcctccgatggctccaagccagcccctccgcagtctgttgtgactcaaaagcttcaaggtctccatgcatcccagattgctgggacaactacacattgggtgggccagagtctgagggcatcaaagaagaaaggatagacccaaagaaagatgtcctttgtggtttttctctctgacagatggaagtctggaaaatgctatgctaaactccatgtaaagcagtatcactgaatatagctcagtgactgggctgtgtgactctagacaaactactaaactcttctgagtttccaattcttcattataaaacaagaacaattgtatgcacttcacaagacggtttcaaattttacatgatagaaaactgacgtggcacttagcgtagagcctgctataaagaaaagcagtttttcttttcctccattatttggttctctgggacttcactctttattcaattaaaatggtgataaagacaataagtgaaggtgtcactggcttttgtgcttgaggacagtggctatatgtgaagtgtgtgtgcatgctggtgtatgtcctatgtgctcagatattacataggaatcatagaaatagatatgtttgaatttaggctgtatagtgttgtgtcttttccaactgtgacaaagagataagaaaatccttgcagtcaggacatgccaagctctgctcatttatttatttaaggaatccttgcatgtcttctccatgtcagccatcatgccaactgctgaggatgcacaca

SEQ ID NO: 34610 - DNA, 1033 bp, Homo sapiens
agccatctgtacaaaatgatgagcctgataagcctctaagacagctgtgggtgttagtatccctgacacctcccatgttgaattcctcaggtagggggcaggcagaggctattctcctaccacctggggacttgtgttgagatgtagcactgtttgtttaataaatgaatgaacctaccaattgatcattcaactctgtgaaaataaaattttgttttccttgatttatagcttcatagtgccttgtattctatggatgtgttccaagcatgtgtagtttttctgttgtggaaagttatcaactcctccctcccacttccttcccttccctcctattttttccttctatcttttgtttttccatacactttaatcaagcacctattaagcatagtttcaatgctatcgaaggacacatgatacaatgaggtcaatgtaccaggtttatcatctgggttcatattcctgctcctttaccttgtaagctgtcacttaatcctttatagtctttactgctctgaattctatcctgtggatgataatacttgattttaggatttgttggggaaaccgagcatgggagatacttaatgagcactgattaaattggttaaataataatgaaatgtttttaggccagtatttttaaatggtgtaaattggaaagatttttttaaggattaattctatgtagggtattctatatgtggtaaaatgtcaagttgaggtatttgaataattctattaaattctataataaatgaaaagaacctggaataatgcttggcacatagtcagtgatgatcaaattttaacttttattacatgattatccacagcagtaagttcacttgttcttgctctaatgaaaattgtgagttaggtgaattacctctcaaataatttttccctccaaaaatgtgcattccataaattggtcttatttgatccttaagtcaacaaaatgtgtgtgtatatacgtatgtgtgtatatctttaagtcaactaaatgtgtgtgtgtttgtgtgtgtgt

SEQ ID NO: 34611 - DNA, 1035 bp, Homo sapiens
aaataatgtaattttggaagacaaatgaaatatcaaatgtttagtaggaaacagcctggaattgtgtaactgactatcaactttatgtttataatggttgaaatctctgtgtgtgtgtgtgtgtatgtgtgtctctgtgagagtgtatatatgtgtgtatgtgagtgtgtatatggttgatgtatgtatgtgcatttgtgtgtgagtgtgcatgtgtgtatttgttgggtatgtatgtgtttacatatgtgtgtatgtgtgtgagcgtgtttgtgcatgtgtgaatgtgtatgtgcatatatgtgtgtgtgtgtatgtgtgtgtgtctactttcactagagacatcagggaagccctctctgagaagctgacactttgtatgaggaagacagccatgcaaagacagaggggttattaagatcaaagccctcaagctggaaataagtgtgccatgcacaggaatatactgaagggcagtggggctagaacagagtgttccaggtcgggggaggggaagagatcagaggagttgcaggcttagatcacacaggatcctataagaactttgactttgactaaggcttatgagacacctttggagaattttgagcaggaagataatatattctgacttaaaaaataccacttcagcttctgtaggaaggctagagagaaagcaggaaggccaattaggagactgctgctggagtcaagaagggatttgtgtaggaggaagtgctgaagatagtgggaagggcctagacttgcgttctactttggaggtcaataactatgctgatgaatcgaatgtgaggggtgagagaaagagaagaacaagagatcatgcctaggttttggtcagtagagcaaggtagtcagtgctacccttggcagatatggagaacactagaagcagaactagtttatggctggagggtggtggaaatcaagaaatctttagccaagttaactttgagaagcaccttcccttctattccctgccctccctccctaaactgatttcctcttttttct

SEQ ID NO: 34612 - DNA, 1030 bp, Homo sapiens
gttacagtcgtcagagtgagagatgaagggatgagaaattgagaggtggacggaagtggcaaaatgtagaggacttgctactggattggctattgggatgtaaaagaaaagaagaaaatctttattggctttcacgtgatgatgctctaggtattctaactattttaagaattgcatctgattaaagacacattcaaagatattagaaaagatttgcaaacttagcagacaaggctagaacctgagctgcaagagtttgatatattgccatgattaactactttcataagaaaagatgatgacgatttgatcacttcattttaagaagggggaggtgcgtaggtgtcagtaagggtccttctgtccaaataagcatgattaacttcaattatggcagcctttggggaactgtgccggtcttttagtgtgtttcaaagtatttcatttagacatttagaaaaacatacatctctattcatagtaatggttactgttctgatttataagttctgttccactgtaaatcattcaaaactcaaaaattaaattttatggcataacacttcgatggctgtatgcctgagcaaagggcaggaggaatgcaatttttcttactgccaattacgattggacttcttttcgttatgtctttaagaaaaaatagagcagatggtttaagtgccatgtataagagaggcacactaatgctctgttaagaaaaacattcaaaacttgacttttaaaaaatggtatgcttttcatcattggctcaatcttatttagttttagaattatgtatcctaagcatactaaaaatttaatataaattcccatgtctaaggcatagatggatgtctgtgggacttggccatttaattgctttgggtgcaaacatgaattattcagttatacctacatgagcaggaatgggtctttatacaaatgcgccctctctttcctgacattgcacaattctttcttcatacatatttttccctcctttataggaggatgggattagttgggcttc
